United States Patent 9,567,581 (SELECTIVE REACTIVATION OF GENES ON THE INACTIVE X CHROMOSOME) - sequence listing, part 7

SEQ ID NO: 732 - DNA, 578707 bp, mus musculus
cctgggcttggggagacccggtggcctgggagcggcgcttggcgggcaaccctctctgtccgtggacgcgggacattcttagcgctccgaggggtgtttgcccttgaggagacttggggtttctgggcggcaggtgacagggccagagaaagatggaggagctcggggcggcggcgtcgggagccggaggcggcggcggtggcggcgaggaacacggcgggggccggagcaacaagcgaggcgcggggaaccgggccgccaacgaagaggagacgagaaacaaacccaaactggtaagtcttcccgcaagccccgctggtctcggagacccgagatccccggatcgtcctgcccaggaacacgcctgggagccggccctcccctcccggcagcagccgtgatctcgccgcacaactcagggaacggagacggcgtgggggcggaagagcaccccttctccactttatccggccttctctctcgggtcagcttgcggaggagaaaggccccaccccaacttggggacaccctgcgtcgcgtcctagagtactggggtagggctgtttgtctaacttgtgggcgcgaaccttctttgcgggattccatttccctcccacctcttgtcagttgctgtttggtcccttaacacttggggtcccgggcaggggagcctccctcctctccgtttcgagcgcatcggagcccactcatagctaaggaaatcaagacaagcaccacataggttcctagctccttcgactttgccagaaatcggagaaagaggcgcctgcgtgcgtttgttccccccaccccccatgtgctcacccaagaaacatttctttggaagtctgggacttggggggagcgtgggaggagttggaggctgggtaaccccgccaaccccccccccccccctgcatcccagcacagcatttccacttggttgagaatgctcagaagcagttatgttccccatacttgtctcacagtcctgacagtgtggtccagtagtagctcatttcctgctgaggccagaaatcgatggggcctggtattgggttgggaaatactggggtttcttcaactcatcagttaaaagggttcctcttttggtaaactttctaatttcagtggcatgaggagaaaggagtttcctgcagagattcagcaggcaaacttttgagcctctcctgagccttttgaacagtagaatcctactccacatcccaagtacaagtccatgtcgctcgtctacatttcagttgtaaacaacaacttgattatagtagaagagagggtgagactgtgacatgcaactcaaaccatttcctgtggcatctggccacttggtctggacttgcacttctcttctggctccggtttactttcctattatggaccgtccatacgggaaaacagggctcaaatattaggacatatgaaatcttccattatgtgcgaacggacttgggctaaagtaatctttcaactttaaaatctcatcaaaacctgagacaaatctagaaatcacttccctaatgtgtcctattaccccaagcacttacaaataaagaaactgagtcacagttcttttgacttgtctgcaatatttatcacagtgatgagggctcacaccatcctggattcaagaaaaacagttctgagtttattgttcgagttgaatgtatttcaatttgtttcttttctttttgagatagggtatctctatgaagtcctggctgttcaggaccatgctatgtagaccaggctgaccttgaactcacaaagagcctcctccgtgggtctcctgagtgcacgagtcactgcctcagccaagcagtcaaaagttttgataatgtgactttgaaatgtactagtttgtggtaagagagtgagcctacttctgttttccctctccccttacttagcccagtataaactgtagtaaaaagtttaaaaataaaagttaaggaatagtttccataaatagttttatacatttagcaagaatctcccaattttcaatatagtaaaggaaaagcatttatctctagtagtaataacatttactctttggctattcgtcctatttcatcttttatgttttagttgatttgacaaggtaactaggtgattatgagatagtatcactttcagttcctagctaactaacttcactgttctgtagttatcccagcttgatacaacaaatcaagtactggaacccagagcgcaataccaacatgagtttctttttttctactcatctataacttttgagctttatgtgatttcctgaagccaatgtgtcacagctaataaaaacaggaattgaatatgactcattttaatgcaaagagtttgatcaaataacaagttttggtaaacttgggattcttaaagttttgaaagtatgataagaccttttagaagatttatttatttatttatttatttatttatttatttatttatttgatgtatgtgagtacactgtcactgtcttcagacacaccagaaggtggcattgtatcccattacagatgattgtgacccaccatatggttgctgggaattgaactcaggacctctggaagagcagtctcttaaccactgagccatctctccagcccccttagactaaattttaaaaatattaatgctatgtattatgcttcactgtgataattccaaattttgaatgtgtgtaaaggagttgtatgtgattataaaacagccttatggcaatataagttatttgtctgggttattgtattattaggggctcaaaactccttaaataaaaaaaaggggtatatgtttatttttctggcttttcttccttttgttagtttcttagaagtatccatgacttgcagaaagaaaaaagaatcattgcagttcaaaagacagcaaaggaaaagacagctggagaattgagggaaactccttaaaacaattagttcaatcactgtagtctaagggtttcttaaactataagactggtgcaactgtgttcatttatttgcttatggatttggaaaaatggggattgaggttgtatttttgtaggtaaaatttttgtaggctagttatagtcccgcatttttgatgcctaacagtgaaaacttttttcagattgacctatcagaactttaatgatttctgtttaaggttgtgtgagtctaagtgtaataaaactcacttcagtttttcagatatgtatcctcataatgaaacccccacatctccacccacccacccatccacccatccatccatccatccatccatccatccatccatccatccatccatccattaagggaagcagttcattcattgactcagtacattttgaataatatatggtagtagagtttctgattttatataactttctggttaggcccagactgtagcatgctattaaacagcatgactcttatattaattagtaatttgatgccaaccgtgtattataatttgttaaactgaataggagataaagtgccctagagaagtgttaggaagatgctctgtcttaaagctcatatgcttaaaggaatgatttaaccattaagagagtccagtgttagaactagagagatagttcagctgataaagtgctttcatgcaaacttgaggatctgagtttgatgccagcaatctggtatagagtctatgctggttgcacacatttataatcacagggatgtaggtaggaaaagacaggcagatccctggggagatacaggccaaccagcctaatttaaccaaaggggtccccgattcctttgaaagtgataaaaaaaaaaagaagaaactcctttttgatgaatgaccccaagattgacttctggcttctataaatataatgcatattacatgagtacatacacacactataatgtatatattacatgcaaacaccccctcccgccacacacacacacacacacacacacacacgcacgcacgagtgcaatagacaagtgaggctacacaagagaacaagagcaacaggggacattgttaaagtgaagctaatatctctatcttctattgcaagatggtggatatagagtagtttgacaatatttgatgttttaatttttttctatataatttctgaagctgtttctttttttgtttgtttgttttttgtttttgtttttgtttttgttttttgtttttttttgagacagggtttctctgtatagccctggctatcctggaactcactctgtagaccaggctggcctcgaactcagaaatccgcctgcctctgtctcccgagtgctgggattaaaggcgtgcaccaccacgtcccgcccaagctgtttcttttttatgccagtaaaattaagttaataattataataacacatggatcttatggttattatatagctgaataattggccatttatttacaatgagatgatttttgttttgattttagctattaaattctgaccctaatggttttatgtatacactgtgtttgccaagtacttactctaatgttcaatttcagtgaaatgaagatgctcatagtcaggccagacataatggtgcatacctgtattctcagcactcttgaagtaggaacatctcatatttgaggctagcctggcctatagttagattttgactcaaaacaaaacaagacaaaacaaaacaaaaacaaaaacaaaaaacccaaatgtctcctagtttagtgaagcagaaaagtgagttaattttatcagtgttacaaaaatgccacagaggggaatttaagtcgaattggattttgatttttatggtttttttttttgaggcagattttctttagcctttgctgtactagaagtcactctgtagaccaagctggcctcacactctaagatcttcctgtttctgcctcctgagtgctggaatttaaggtgcatgcttccactgaccagctaaattggatttttttaagtgtctttctttctttctttctttctttctttctttctttctttctttctttctttctttctttctttctctctctctctctctctctctctctctctctctctctctctctctttctttctttctttttctttcgtttcatgtgtatggtatttaccagtaggtatgtctgtgcactgtttgtatgcctggtgcctatggaggccaaaggagagcttctaatcccttgtaactcaagttaatagacatttgtgatctactgttttggtgctgagagtcaaatctgcattctctgaaagagcagtcaatgctcttacctgctgaaccctctgtccagcgctaaagttgattcttgggtgaggtaaagaaaggcttatagtagaagatctgtgcaccaaggcttgaatagtgttttatttgaagtagaggagggaatgacattctagatcaaaatggcaacatatacaaagctaggtaggggtagaatatgctgataatgaatgtttaactagatactaattaatggctgaaacagaaagcagcaaaaacaaattttaatggatctggccataaagggatgggctgtaggtcatagtagatctttgtgtgtcatgttggaacattgactttttcccagaaagtcagcagaagttgttggagagattaaaaagagggagttacctgattaaacaagtctttcagtgacaatttaagaacaatggagaatttcctgtaaagggatgttggaatgaagggaggaaggccagccaggagtagcagagtgaagtggaatttgccatttagagtcctggatttcagttgctgctcatgtagttcagatatccgaatttctttatccctgtaattcccattttccaactctgctcttggtattctcaccaaattggaagcatcttttttattttcctttaatgaatctcatagctttcatagcccagctcctacctccgtgctgtcttccttccagtggttctcaactttcctaatcctcagaccctttaatacagttccccacattgtggtgaaccccaaacaaagaattattttcgttactacttcatatctataattttcctactgttaggaagcataatataaatatctgatatgtatgataatctgatttttgacccctgtgaaagagttagttgacaccaaaggggtcgtgggacccacaggttagaactgttgctttaaaccttcatttgttgtttcagcttactgaggatttctctgtcatctgaacatttagctgtcctgaatttcaatgttctgtactgatcttgctttacaaagattttaaagtacttccgggcatggctcttttatgtttattcttataaaccagccaatgataaatagctagggatttttgtctctaaaggtcaggtatattgggagttgaattgttgaagagacttagaagaaacaagcaaacaaacacatagttctttctttttttttgagatgtggtttcatttattccaggctggccttgaactccatattaagttcagggtgatactaaacttcttatccttctacttctacttcaaatgctgagattacatgcttgtatgctgtgtctggtttatgtggtcctgaggactgaacctaggacttcatatgttccaagcaggcactctactaactaggcaacatccccaaacccaaattattattgtttacatgttatatattttgttagtatgcacatgtgcttattatcagatgaactttcctgtccattcttatatgttttttggttttcttgagacccatgtctgattttaaattcactatgagtctggtcaataccagatgctgtctccttccatattccacatacagagattgtggcttgagcctatatgcctggttcccctgtctgttctctgagctagaagttcaaacaatgtcttcaagggtcatgagaaactcccctcctccccttgtttgtttagatccttctgatgtcagagccagaactcccatgcagagagagagtactgtcacaagtgagccaagtaacagattgctgtcattactaggaggcttcagattaatctcaaaacaatatgcactgttgagtcaaaagctctgcattccagtgtcctttctgtcttttatttgcttgtgatctctgatgaatattaatatgagaaaattgagcactttgattaatttctgccactcagagatatggcttccttcccaaaatgcttgtttgattttgagacatggtcttacaacactgttgtccaggtgatcttttaactcctgacctcaggtgatcctcctgttacaggtacttcagtagctagaactacaaaaacatactatcagacaagatggctcagataaaatacagtaaagattaataacacatttaggaaattgtataatgttacagaaatatacattactgttagctcattctatcatctgaatcaaatgtgatcatggaattagggcatagtttcatgatagagtgcttgcctagaattaatgatgacctgaggtcagtccccatttttaggaaaaaaaatgtgtttatgattgttgaatttcatgtctgttttgcaatttgaaatccttattgtacaaaatactgtaatcaggtgtgtgttgatggattccttgttctcattcccaattccctttgtttttgaagcattacacattttgtcagtccttttactaatgagcttttcatctgagtgattgtagatgtgagcttaacttttgtttacgcttttgtactactatttaattttagattcatttattttatgtgtaagaatgctttttgcttgcatgcatgtgtagccacatgtatgtgtgtgcctgaaatttgtacaggtcagaagagagtatcaaatcctctggaactggagtttcttaatggttttgaagtcaccatgtgggttctgggaaacaaaccaaggaccttgcaagagcagtaagcgcttttaaccactgtgccatctttccagcccacactctaaatttttaaagaacatgtctaccattttctttgaattgatccatttcaggcattacattttttattaaaaaaatgttagtaggtatgtatgaccttctgtcttgtcaggaagctcagtgatgttgtacaaataaggaaactgagtcattcaggagttatgggggctgacttagaaataagtttaaaagctatcacctctattgtagaagttatctatagcactgagtcattatgcttcagggactcttaaaagtaaaaagttattcaatctctcatttcttttgttccttttgaacaatttataattataatcctcttagatttcactgtaagtactaagaactttgccagtagcaacatgtcaaagtgagatcttactcatttcaaacctgatctcaaacaatactgtaaaaaccaagatgctctgaaaatagtatgataatatatgttaaatttatatgaatcagcatatctgattaatatattactgggtagctttagcacccaaatggttagtattgaagacccaggtttcccttactccaagttccttctgcaagacttgtggtatgtattacattatttttttctgaagacagagaaaagaccaaggtgatgcttaagtaacataaaagcattgctgtaatcttgcagcctaacttggcttcatatgggaaatactcattgtggaagaaagctcacgattggcccatgtaaaggttgatgtatgttttcacgtggttgtttattgtgaaactcatgaatacagggaaatgcattctctctgatttgaaacttattacctgaacatgctgaatctgatttactatcaaatgatatacttagaccctagttttattaaatagaaccttaattgaatctggatatgtttgtgtgtggtggcctggggaggaagatactggtaccttccttgtggaagaatgtagaaaacacaatttttaactcattttccctccttgtgttggtgttttccatctattatcctttgtaagactggatttatagaaagatattgtgtaaatttggtttatcatggtttctccgtctatggtaattaagagttttgctagctatagtagcctgggctggcatttgtgttctcttagtgtctgtatgacatctgtccaggatcttctggctttcatagtctctggtgaaagtctggtgtaattctgataggcctgcctttatatgttacatgaccttttttccttactgcttttaatattttttctttgtttagtgcatttggtgttttgattattatgtgttgggaggaatttcttttctggtcaagtctatttggagttcggtaggcttcttgtatgtttatggacatctctttaggttagggaagttttcttcctataattttgttgaagatatttgctggccctttaagttgggtatctttactctcttctatacctattatccttaggtttggtcttctcattgtgtcctggatttcctggatgttttgggttaggctctttttgcattttgcattttctttgcctgttttgtcaatgttttctatggtatcttctgcacctgagagtctctcttctgtctattgtattctgttggtgatgcttgcatctatgactcctgatctctttcctaggatttcaatctctagggttgtctccctttgtgatttctttattatttctatttccattgttagatcctggatggttttgtttagttccttcacctgtatgcttgtatttttttaaagatttatttatttattatatttacatatataagtaagtacactgtagctgtcctcagatactccagaagagggcatcagatttcattacggatggttgtgagccaccatgtggttgctgggatttgaactcaggaccttcagaatagcagtcggcgctcttaaccactgagccatcttaccagccctctttttttttttaatattttttttattacgtattttcctcaattacatttagaatgctatcccaaaagtcccccataccctccccccccccacttccctacccacccattcccattttttggccctggcattcccctgtactggggcatataaagtttgcctgaccaatgggcctctctttccagtgatggctgactaggccatcttttgatacatatgcagctagagtcaagagctccggggtactggttagttcacaatgttgttgcacctacagggttgcagatctctttagctccttggatactttctctagctcctccattgggggccctgtgctccatccaatagctgactgtgagcatccacttctgtgtttgctaggccccggcctagtctcacaagagacagctatatcagggtccttgcagcaaacgcttgctagtatatgcaatggtgtcatcgtttcgaggctaattatgggatggatccctggatatggcagtctctacatggtccatccttttgtctcagctccaaactttgtctctgtaactccttccatgggtgattgtttccaattctaagaaggggcaaagtgtccacactttggtctttgttcttcttcagtttcatgtgttttgcaaattgtatcttatatcttgggtatactaagtttctgggctaatatccacttatcagtgagtacatatcatttgagttcttttgtgattatgttacctcactcaggattatgccctccaggtccaatcatgtgcctaggaatttcataaattcattctttttaatagctgagtagtactccattgtgtaaatgtaccacattttttgtatccattcctctgttgaggggcatctggattctttccagcttctggctattataaataaggctgctgtgaacatagtggagcatgtgtccttattaccagttgggacatcttctgggtatatgaccaggagaggtattgcgggatcctccagtagtactatgtccaattttcaaaggaaccgccagactgatttccagagtggttgtacaagcttgcaatcccaccaacaatggaggagtgttcctctttctccacatccttgccagcatctgctgtcacatgaatttttgatcttagccattctgactggtgtgagattttcctgtaattctttaagagatttttgtgtttcctcttcaagggcttctagctgtttacctgtgtttttctatatttctttaagggagttatttatatccttaaagccctctatcaccatcctgagaagtgattttagatctgaatcttgcttttctggtgtgatggtgtatccaggacttgctatagtgggaaaattgggttctgatgatgccaagtaaccttggtttctgttgcttatattcttatgcttgcctcctgccatctgattatctctagagctacttgcccttgctaaatctgactgaggcctgtcctttctgtgatcctggttgtgtcagaattcctcagagttcagctgactctgtgatcctgtgatcctgtgatcctgtgatcctgggatcatgggatcctgtggtcctgggcatgttagagtgcctgggagtggagactcttctgggtgttgtgggaatggctgcagagtttgcacccaaggtctgctcatggcacaggctgagaccggaaggtaacagtgccactggttgattgaagttcctgggtgcctgggtccccctgatcccagttactccagatgttggggcagatgttatgtcctcctcatctctgatcctattgtcctggacatgttagagtgcttgcaagtggatcttcctctgggtgatgtgggactaactgctgagtttgtgctgaggtcggctcagggctctggcctagacaggaaagagttcttaacttcttgaatgagcagttgctgacccagtcaagtgggtgatttttctctaaacacataaatgagtgataattgttggggctccatagacagctagcattttctccatttattctgcttaagggaagaaaagatatggatgcgttgttttatgtgctttgaaattaatcactggtaaaatctgaactgtttaatagcacatcaagctacctggggctattgaggaagattctatacgtagatagtaagatattttgcagttatatctcgacctttaataacatgtattgtataatagaacagtgtcattatgtgggttgggtcctatacaagggtatcagactatagagatcacaccatttgccaaagtatgcagataacaaggctctatctttctggagtatttttgtacttcacacaaatgtcttatataggttaggtgatgcatttcattttttatatctggcactagttttggaaagcagagaggttgaatgtctcatttagaatacttgtttttttaattataaattaattttagttatacaaacctttatgttcctatgtgctcctgagtatgttggatctctggagatggagaataggcatttgtaaggttccagatgtggtgctagaaaccaaacttgggtattctggcagaccagtaagttctcttaactgctgaaccatctctctggttcaggtatatttctctctggaataggtatatttcatttgtcattcattttgaacaagaatgtgacatatatgtatgtaatgccctatacctgactacatttggttttgaattctaaaatcccatatgtgaatggccatgtcattgagggtctagattgaaggattaactaaggcactgctctttctttagttctccaagtgattttcttgaaattatttttttttaacaagctttgcatagtcacggatcatatggataagactgtactttttcgaagtttgtactataacttgaatgtattttcatttacatcacccatgatacaaggcgagaacaaacagaatgttaagatgggtttggcagagacatggcttcttataatatgctctgcagtctggtatcttccattatgaaatcaatgttttccagaagagtcaatgtgtatataacacacttgtgagtgaatataacctttcttgggttaacctcacagattgtttgtcattgtcactgcagtaacttacacccaccccccccccctttggtgaatagctaatggtctttaaatgggagaacaaatttactgtgccaaaaaagggcctggattttctccatgttgtgctttgtctggttctgatttttcatgtatttgttttgctaaagcagtgtgtacctatgttctgtgatctctaaattcttacatctttgcagtatagcctatccttgctctatcagactgttttcagatgctcttgtgaattgccctgagatccaagccctccatttttatataaagtgagttgtcccgaaactacatcctaaattttttaagtagccgtgtctctatatcaaatgaaatgaggtttcagttataactgaaagtagggattgtacagggctataagtccaattttccacactcgtccttccagtttggttccagctaattatggatcaaggtatgctattgaattacactgtagatcctggcttttaacttcttcctttccttgaaagaatcagttgtcacttgaatgtttctaatgctgaaggtcacattcctggtcatgtttattagttgtttgttgaagactttcaatgtagaaaaattgtcattaaatgttaaatcagttgttgaatttgtcagatatttatgtaatggtatttcccattcaaacttaccaccaaccatgttttcaggaaatagtagaaactgaattttttatcttaatacactggtatgagttttcaaggatcgatgagttaactaggatatgtatgccattctattacttagaagagcttgttttgggatatttgagatttcctagaagtgaactaacatgaaaatgtatttatgggcacatcatttctttatctttctagctgtcagtttattctgtataacaaaggggtagaaatagatgatatacatatgcttcattctccttccacccattaagggtcaatgattagttagagctataatgagtctgccttaacacgaatgcgtgccatctatatttcagttagattaaaagtggaaattatgaaaaataaaaataatttttaggctgaatattaaaaacaggataccctagctgactttatagttttgttttatttctggattattttggtccagtgaatactacagcaaaactgttttatccatatttttccctctagagagtgttcatcattcataggtcattctaggcattgagtcatttctgtgtttcaataaacaaatactcaggctacctagtgataattcagtgatactcaatgttgtgagtctggttgcttttctgggttttttgcatgcgtttgtgaagaatcatacaaaaaaggctggggaaatgatgtgtcagttaggaatactgaaccttgtcaaggactgtcctgacatccagggtcctcttactgcctctttgaccacttgcactcatatatgtgcacatagtaccccatgcatataattaaaaatacatatttaagaatcatacaaagtgtggggttttatactgactactcactgttcccatttcacagataattgcaggttacctgagacttctaagtaagagaccaagaatactgtcattggaagaatagcagtatgtcagtacaatactcaggttcaccctaatcttaagttctacagggtagacttgggtaatgggtggaggtagttagttgtgctacagcagaggaacactgagcttgagggatctgccactttaatagtgactagcacagagtctggtctttgctaagattgggagctgttgccttagtctggaaatcacttgttacaaacaaaatcctaggaaatagcctgaaaaaatccagcatcaactttcagtcttgacatatccagcagtaatgtacaaggatgctctcggatcgatggtggattgtctccctctgaatattaacacattttatcctgacagactttagtttgttgataacaagaaagactcagagcagctaagtaacttccttggcattacggaacaatgtgattatgaaaatctttgttttaacccaccattttgtatattgcctaagagcctaaacattgggcttgctctaaattaaccagaagaactagtagtcctgtggataggtgatgttttggacctagcctacatttgcaccatgcttatgtatcatttagaagacagagttcaggggctgtttgtttcaatgtaactgaaatatcccaagttaaaattctttgaattgctgccatgaagtagtgggaaaggtatgtgaccatttgcaaaagtgccatgggcacaaaagggatgtggctgtggattttagggctacatgaacacagttcttaaaaatagcagtcttggtagtttgacctttattccacagtttctggctcacctcaaggcttgctgtgctttaccactctcattaatgctgatgcatcctgtttctttctccccatttgcacatttgtgccttctaacacaatacatggcaagtgctgttgtattcttcgctctcccctcctttcccctcccttccccattctctgtttgtttgtgaacttttgtgtgaggcaaaactgctttggaaaactaatgctgcctcctgttacacaagcacacgatatgcattgtttcttattagggaagtgccaagaaccacctaccttgtcctgctgtttcccctgtctgctttgcctaaagattggctgctataaaagtgtagcatagtcagccaagtgcaatcttttttaaattagtctgctgaaagtgttgtgacaaactattttagcactggtgtgtgcctactactagagaccttaactgtgggctgaaatggcaaataacatgagagtgcatcatgtagtttgggttctacttgcctcagttttaagcatcatccctcccaagagagaaagagtgcctttaattttaaaaactataataggtaaattataccttgagtagttcactctatgcctggagcctgcagtcaagctatttcacacttatgatcactattaaaaaattaatgagacataatatttatgcatttttatgggaaccctatggtaatttgacacttactcactaatgttaatgaggtaaaatttccatgctggttcttttcctagaactttttagcatacttaaaagagaaggatcgacaggataagtgggcttgtaattaaacggatacaatattttattaaagtcctatttttccgtccttcaaaatcctataagttacttttcttttgcaatgacaaaggtaccttatagactaaagagtttatttgggctttcggttccaagagagtaaggtccatcatggcagggaagcatggctacaagcagtatacattatagtctgaagcatgaatctgggagctcacatcttccaatgcaagcagaaagcagagagagcaaacgggaagtggcttagagttttcactttctaagatcatctccagtgacttcttccttccagaaaacctctggaaactccctaaacagtgccaccaaatgttcaaatgcaagagatggagatgggggcacaattcaacccaccatgttagttactgatattctttttattttggcttcattaaatccaaataactctgttaagcgtaagtatttgtgaaatggcaaaaggttcctctatctctaaaagtcttttcttcccccaacccccttttagaccagcggttctcagtgtgcggcagttttaattcccaggaaacatttaataatttctggagacatttttagagtttagagttaggagaaagtgcaactagtttatagtatagatgatgatttaatatcctacaatttgtaggacatgccccctacacaaagaagtactcaacccaaactgtcaaggttgagatagactggataggctggaagaccttggtttagatcttctgactttttctctatttagagtggaaaactcccattgatactcagacattctcctccttccattgtattctctgccctgtattgacacaggagattatccctgttttcaagaaacatcatttatgtcattggctgtcacaactcgtatttttatctttttcttttctgctgataaaaacctgcaggactgggctggcttatgaactgtatttcttatcacttaacatatttctgacaactaaggaaaatgtgtgctctcttcctaatgagtttaaaaggtaattttcattttgcttattccttgagatattgctacctcttgatcctgctcatatttagctccttatccatgtggctcttatttatttacttgagatgtgagcttgccatgtagctcaggcttgccttgaatttacagtcttcctgcttcagctccttgagtgctggtaatattcgtgtgtgccaccacacacctagtgatctgtgtgtatgttgtactttgtgacatagacttctggtaccttctgcatctccatttgttaacttctgaagtcctagtctttcctctcatttcacagatttcttccagtttatcgtctctacataccaattcaggcaacagttatttctcctcaaataccacagcatgtagccgatgccaaacttctctactgactttgacatgtcagtaggagacaaccttggtaagctgaggggtgtctccagactgtggtttggtttgactaaacatagtttaaaaagcaaatactttatgggagtattcattttaatattcttttttgcaagaaaaatgaaaatcaactgtcccctcatgtggtaactatcaagtttgcctctgcaggttgaggtttatccttgcctcacggatcaccagacttgtttctttattattagctactgactgaccttatgatttctgttccaattgaatcaaggttaactttcctatttggccaatgaaagtcatcgactacattgtattcaactcaccagcaccaaggaagggtactttgtatttgaggataatgttaagcacctaattccttttctgtttttacctttgtttaattgaagccatgcgctgcagtatcccacttatttactttaacctttcctgctacacttttattctttccttgtgaattctaaatagtttccatccatttctttatgtaactgttaaactatttttacctgcttaaagatgacatgatgagacttccttcaccttcaacctacaatttcatttttgcagcatgcacagccacgctaacttgtgctttttataaatgtatgttacaatgtgtaaacatttgtgtatgtcctctccttgctacatatctggtatcatgctgagggcataagtacagttacaagcaggtgtcactctcaagaagctcgtagcctattgagaaggaagggataggtgactataaagtcataagtacaataataggtatgagcagagtgctgtttagagtgccacatactgtgcttgatagagacagagaagcctcttcagatgataagtttaatctggttcctagaggatgaagaatagcggggtcaggtttgttgggcattgtccctatgtaggtatgcatggtgagctagtcagttgggagaattctacctttgaaattcttcatgttcaaaaattaaccacatgtaataaatgttttagagaagcccaccacagtaataagcaagccttattaggcccaagataagcaattcctgcctgctatgtacacagagttggagaatatggtgttacaaacatatggtgcaggatagagtggtaagtacagatgcaggggtaaaggtgtttgggaacacagatcaacttcactacaaatggaagatagggataaaaagcttcttgaaaaggacagagattgtttttaacgaatggtgatagagtgagaatagtatgtgtatcatagtcagtgttggattatatataggaaggcattaaagactggatggcttacacgtaacaggattgatatatagttctggaggcttgaaatcaaggatcaagatgtcatcctggctaggttctgttgagggtcctttcgtggttactcactgctgctttcttgtggtagcttcacatggtcaagagcttagtaatctctcatctaatctgtaatatctttgagaggctccaggtacttcttaataccattatatcagaggaagatattttaatctgtgaatcttctggaaacactttcaacatacaaggcaacattacaagggagctaagaattagggcctgtttgaggaaatatgaggggttctaggagtcccaggtatgtgtatgagagtagctgatatcaagatgggtagattgtggctcaaccacagtgaccatcagatgcttactctgtttctgctccttcctgtgaactgggaagagtgaacaagggagttggggttgtagagcttacaatgtgattggagctgattggcgcttgtaatcagaccttactctagagttttggtaattggaaataccacgaagtctgaactcttgttaaaactacgtggtaattgccttgtttgcagtgtaaatatacagcatccattaattttgataccctttggaatgctttaatttgacagatttgaacctgtgaaattaaatacgtactgtaaatagcatgcatgagctttgatgacttagttttgtagcaagttaattggccctttctcccaccctactcttctgtagctctgttcctctcaagtttgtgttctaagtcaagctcttgttatttctcccctacaaacagatcctggcttaaaggtcatataacttacattacaggattcttgctgtcaaaccaaacatgtaatgtcttggctggattgcagccttagaatctctgaaatattccaagggaagctgtaagatttgtgacatgtgtaatgggtaaagatagcctcactaaagtacttccattttcatgtgtctaccacctaccacaaagtaagttaacttagaaacaatcatggaaaagtaatctttgcactgtcttgaaacaaaatcctgaactaaaggtagtttactttaacaggttggcttttttattaacagacattgacagtgtagttttattactacagcttttaagacagggtagctagcaattctatactcacatgagtttgaaataagtgccacatgaataaaattggttcaggattgtatatagctgggttatcaaacagtgttaatatgtgttatgactagttcttatataaacctgcttgtaacatatgagttgcactgattatagttacagtggttattagttacgttgttttgaacataaaacctaatcctgtgtgtgtatgtgtgtgtgtatatatatgtatacatatatatgtggttttgtgatttatctattgtttccttgaaagaaaacttttttaaaaatgggataaatgattgttttgtgttttagtttgaccgaacattcatagtcttttgtatttgagtttggatatattatccatgatgtgtcttactgaaaatgagtgatgatgtttatttgaaatgctttgtagctttcagaacaggctatcatatataatgaaaaaatatttcaagttctttgccttataaaattattttaaaaaggcacaggtctttgatacaggagtcatcttgtgcttaacaactttctcatgtgagatttgtgattcttgctacatctcttctgagtttctaggcatgaagagaattactataaatgaagaggacagaaacttcctgagttataaatacataaaacacatagccatatgaaggcccttgcagagggtctcccctgctgtgttgatccaaaaatactgcctgtcctgttcttcccctcttcttactgatgttgccttgggaattggaagcccaatcatgagtcactgtagtttctcttttgtttctttttcagtgacacccatatgcggtgccatgaataatatgcttctcaagaatgtgtctaacaggctggactgtgtgacttcattaccacagaattagggctgacaggcaggagcttttcctatgctaatagcttctcctcctgtttgactttccaggatgggacacgtcttcccatagctattattcatttatatatatattatatatatattacactgttcagtttcaaaatactatttttagtgcaagtatttgttttgaagaaattgacaatattgtctatagaataaaagtgtgagtcagtatttggtaagggccttatgaatgtctgggatatagacacaggaaagattaataatttgggacaaaatatgctaggaactgagttactagtattttcttcctgttactgttcctgtgtgtgtgtgtatgtgtgtgtgtgtgtgtgtgtgtgtgtgagagagagagagagagagagagagagagagagagagagagagagagagagagaagacatacatgcaacacttgccaaggggaaaatactcatttggaacttaaaacaaaacacttaggccttcaggaatccatggattttagtgtgtgtagtttcagaagtttcacatatattgaattaaataaaagtttaaggcataggtctgtttcattttaagaaaatatgtactagcaggataaaatgagttagtaaacaaagttgatttttagaatactgccataaatttcaatgctaattattgctactctgttgttcttaaatatctagtacattgaaaaaaaacatttttaaaaataatcgtaactgggttcatatattgttgatgtgtttatgaataaaaagtgctgttctgagttgaaacaagtttaatactaaattgtacttccttaggctcacaatgaatgagaacaatgaaaggactttaaatgcattacaaatatagtgtttatttctcctactgtcctcacttcttttaatcaaattcccctttatccagaattgttaacattggtatttgaaccatattgcttcaatatcaccaggaaagctagctaaaaagattgtaaatgtagacaaataaggaacccaatgaatctgaattgtgtattgtatgtttcataacccttaaggattgggagttcacatacgaaccaactttttaggttctctttagtcatcaaagtatgtttacagtaatgcttttttgctttttattcatgcttttctcatgggttgccataatccactgtatttcaaagagatatgagaatgggccatgtactcgagggtataacccagccccaccataccaccacatcctgcatgtcagctcaggtgacttaactgatatttatttttctacccctgacccacattacacatgctcagaatctttatgctttcaaatcttcagcttcaggatccagatattttgaaaagtgaggagcaatgactgtcaagaggtgagctacgtggttggaaggtaagagatgttagagtaggaaagaaatgagcctctgatgctaggtgctgaaacttgtgatggtgaaaagaaaggaggatttagaaacttagtgattgactagtggtgggacctggatgagacactgaagaacaggtgccatattcagcacaactccagggacagctgactaaggcagtaatgccgacaaatacaaagacatacaggaaagtctgggccaggtggtttgggctctttgatggagacactacaacgcagtagaagctcagcatgtttattacatgtagtagaagacagatgaggagttattgcatacagctgaacaaaacggtggggttattacatgacggttgggtttatggtatgcaactaaatcaaggaggcacgtttagctaatatctgtaggagcagtttgactgtagctgtgagtagcttttagactgtaagtacctgaagggagaaagctatggtggatactttctgtccataccgtcaacatctacatatggactagaggaagactttgctattcttctgggccttaccccagaggtgagacaggctttgccattcctatgggtctgaagctatgagctgttgacctgggcatgcctatgctaacatataccctctcagcatttccctccctccctccctccctccctccctccctccctccttcacacagggctacttctgttccctacaaaccagcatggtgggatgcaggaaggtgagtctgctcgaagacaccagactggtgggtgactctgaggcatcactgctaggtactgagatgtagcttgctctggaggaaagacactctcctctgtttgcgaagttgattcctggatggagtatgtgagagtctcctggggaatatgtataaattgaaaaagtatgctcaaaagactataactgtcctttcttaatgcaagcaggttaaaaaaaaattatctactcaattgtagctggcaagaatagacataaaacagtgtgtcctcaaccttaatctaagtagggcagagatgcgtacagaacccctagaggatgcaagatttgtctccaaaggggttacagattagcaaagattgacacattgcagtaggacatcataatgacatagtgatttaataacaacagcatctttctcgcaaatctgaactttatcttctctttccctttatcttttctgcatttcaaattcagctctgtgtgcattctttaatctgcagactctgggagcatgctgtattgtaagaagtatttgccagacccccttttttttgtttccgtttttatctataagaaattgtttctttgggaacatgttctgaatggaggttactttcccagggtagcgcccccttttcgggtcccacttaatctacattgcagatgagctgctttattaatagtatcagcctgagctgtgggagcagacatgtgccatatggtataggaacaaagaagaaagtcccatcctttctgttaggttctgggccgaccgtaagctatattttgaaattatttcatttatcttccggcctcccttcagagcccctttccacttcatggtgctacctattcagaacctcccctcttgttgtgactcccacctcaatagcttgctactttttcactttccccaattacctaccattgattcttttcaaattctcaatccttgctcagtagtggaactcttaattacaagaaaggacttgattattttaaaatcaccttggtgggcgccgattggctgcctgggaaactaggcagcagagaacacaaagaagggaaccgaggcaggtggcgaaacagaatgttttgggtaagcaatgattcttaccctaaactattctgatttaaggatttcctccggactttttttttttttcctaaattgttcttacttttccttcctatttccttactcttcccccttcctttctttttctccctttgcctctcttccttcatttcaagacagtttctcaagtaactcaggctatacttgcactacttgtgtacagaaatgacctcgagctcatgaaccttccatctctacatcccctgtaagtgctagacttacaggtgtacagcgctctacctagttttaggtggtgctgtgtattaagcttagggcatcaggtaagctaactgagaactctatgaacgagagactacatcctaaggccagttatatttcattttgaacccctgccatctttcgggagtgggactttgcctcaaatactaaacaggtgttcttttactgagctgcttcccccaccctcccccagcacgtgtttctgtttttcagtccttgtccttgattcttgaggcagcccatctcattcagagtttctttgttttcctgattgctctcttaaaaggcagcacaaaagcttttggagttgagaggagacaaatggcaaggggcacatttacagtacttacataagtctggtattaactatatggcctttggaataaaagaaatattcattaatggtttaatgcaagcattggttaataaaagttatttcatagttcttacctacaatattttcatgtgacatataagctaagacagtggtaattgaggcaaatggtgactatctttaaaagcactgattgactgttctttaccaattactctgttttgcgtgttgagttgtatgcttatcaaagagcagcatgtacattgtacttacttccatatgtgtgtgtgtatgtgtgtgtgccaagtgtagttgctattgtggttacatgacttaataaaacatggaaattgatgagatgtgcgagtgagaagaaatctattaaaattcagaagtcttttgtaggaattgatatggcagctatgaagattgctactgaaataagcatgagggaggtaactaaaagcctaggaaaaaacccagtgtactttaaaaggagtcatagggctttactggtgtctgtaggctctctaatatggaatattaaacagcagatgggaggatgtgtttttgtgaaaaggctgctttgaactccagctgatgagccaaaaaggctttagctctgcattaaaaaattgataaatgaatatatatttcagtgttgtcaattataataacatgttaaagatagttttttacttgtagtaatttttcattttaaccaccttctaaaaattaattgcctatggtaccttattttgtctatataatctgtatatagtaaaacaccatttttcatgcagagaattgaaattttagtgagcacttctttttaatcatttctaggcataataagggctgacctacctttgaataaaactttgtcaaatgaccatagtagtcagattttaattctttataaattactaatcataaattattactttattacatcattctttctatggcagatgaggaccttattcaatatggaaattttatcttgtagaaattataaagtagggaattactttaatatgtaatggtgaatttctgtgattaaatatttttaaagaacttgtctaaggcttctgtttgaaacatatgtgactcctctttgtaagtgagaaggattctctgactacactttgatattcttctttggtcttccttctttgtctttgtagtagggtttttgttggggaaattgctgagtacattcataagtgttctggtagggaattctggaactatttctgtataataactatttgttaagagaaacagcatctggttatgtagcttaggttggcctagaactacgtttgcctatttcagcctctggactgcttggattttagatctgtggcagccagagttccccacacatgttctgtgtagtaatcataaattttacccactgtccttttgtgtcctttgaatgatgaatgatcatgtgtcatcacatggttagaatttgggcgtgtaagggtcagccatttcagaaatttcctgtgattgctgctttattgttctatttataagtttttctggtgttcagattctagattacctttgaaggtcaataaataaattgctatttttttgttccttaatttgcatggaatagcttagctgttgaggactaatgctagtgaatctttggatctcatatgtagcatcatcccaccctaaatctactatcaccatagactgagatgagaaccatttaataggtggggtattagttttagaatttgtgtgtttggttgttatattgatgatgcaaagaacttgaatgcatgggtattattatgttaactgcacattaaatcacatggatgacatatcagagagagcacacgaggtgagaatgaatctcattttcttctttcttgcttaaataaataactcttgtttaaggtagccatgatgacacatacttatcatttcagtgtttgggaagctgaatcagcagttcaagaccagtttggtctacaggatagatcctgtcttaaaataacaaaacaaaacaaagtccccaaacaactctccacctaccttttaaaagcataactatggtctgaagagatggctcagcagttaagagcactggctgttcttctagaggactcaggttcaattctaagtacctacaccatagctcataaccttatctctatttccagggtatgcaacaccctcttgtggtatataaacatacatgcaggaaagatatccatatgcataaaacagaaaataaaacaattacaacatctatatttatctagatagtttttaggtggaataatccactcgaatgccatgacatttgctagcattttctgttcatgaatctattccaggttgattttttttaatagaaaataaacctgtgataaaataaggcaaaatggaacacctagcacttaaaaaaaatggattgcaacatctttaacaatctaaagcgatagtctggttagatattgaattattaggatactgaactctgttaaatatcttggtgatttacaaagagactcgtttgggttctaattgctatgcctttgccatcttacttcactcctttgtgttcaatggctgtcatcttctgtataatcagtaacccttctaatatgtaaatgttagctagcggtgacctttccaaagtcttctgacactttttccctagtagtttcctttgtatctacaaatattacgctatatgccactatgtcttcctttatttatttgacatattagcttttgacttccttctctgatagaagaggattaatctcccacagcatgcttccttcctcttcttatcattacaatacacttatcactatgtttaatttcttcgttagtgatctttgtttgtgtaatgtgaaatttatttgagacaatgaagataaatgtgagtctacctacttaaaaaaaaaaaaacttcaccctttccactctatagtcttccgtatttacaaaaaaggaaaaaaaagggaggagtcctgagtttgcagtggttccccatctcctcatgtggcagatttagccttcaaatggtccagctaccccatatgagaatggtgtgggatttgtgtgtgtggtgtctatttctgtgtgtacatatatacagggtcacacaggcaattttgcatgcagtgcaaagattagtatgcatttctgactttctgcatgtgagaagaaaatataatggagacctagagtaatttaaaggctgacctagtccatactctgtgtacattttctccagttttaaaagtgttcccttaccttgacaggggctcattctcagcatttacaatcactggtttttgtagcagtgtctaactgaactcttacctcaaggattgtgtttattttttaaaaagacactttcgtttttagacagcaattttaggtccataacaaaatcaagcaggaagtcaaagagtgaacatatatagaacactggttttatatgcctgcacctatatgcttggatttgcatagttgctagggattcaaacttagttcttcctctttgcacaacacgcatgttactcactgagctatttactccgaccctccttcttcaagggtcatgaatggttagatagttagttgtcaagttctctgtattaagtcactacactaaaaatgtgctttcgtacagtacatgggaaaatatgtataattaaatatataattaaaaaatttgaaaatcaggatgtgctttctgataatcatttgatctgtctgtctgtctttctgtctgtcatgtattttgaacagggcctcactatgtaaaagtagttgatctggaactccttagattagtatatcttcaactcacagagatccacttgcctcagcttcccaattactgtgattaaagatatatctccacatacctggatgattattttttttttttttcgagacagggtttctctgtgtagccctggctgtcctggaactcactttgtagaccaggctggcctcgaactcagaaatccgcctgcctctgcctccagagtgctgggattaaaggcgtgcgccaccaccgcctggcctggatgattaattttaacacgtagaaaaatataggccacatagtatttgttcagaccattcatttttgtgtaacacagtagcctcacagtccatagtgaaccttagaagaaagactttcaatttaaggtaaatattaacttacgatgcaagccatgtagttaacagttaaatctcactgcttttgtttgtttgttgggaggtggggtttggtttcaccatatgataaaacaccatggccaatgcaaacttatgaaaagaacatttaattttaaagtttatagtttcaggtgttaaaagtccatgatggcaaaaaaaaaggtgtggtggcaggaacagctaagagctcacatctttgatgtggaagttagaggcagagagagtgaactgggtatggcaggaatcttttgagacttcagagccctcccctagtggcacacctcctccaacaagcctataccttcacaaacaagccagtccttcacaaacagttccactaactgggaaccacatatttaaatatgtaagcctatgggggcattctcattcaaaccctggcaccagataactttcgctggtttagaatttgctattttggccaaagtagcttcaaattcatagtaatttgcccatccctgcttccagtgttgaaatgaaaggtgtgcactacttccccttgttaaaatttattctttaaatacagtttttgaagatttctttatttaatgcatatgaaattttgcctacttatatgtatgtatgtgtgaaacatgggtgcctagtgcctttggaggttaaaagagtatattgggtctcttgagactggaaatatagatcattgtgagctcccatgtggatgctgagaaccagtactcttaaccactgaaccatttctccagtccttaaactttactctgtatggatagactagacatattcatccacgtcagtattctctaaacagtgaaggtttgtcttgtgtcagcattggcatagtaatcatagttgagaggaagtaagaaacacaaaaaatggaatgcaatgctttaccttgcccttgctgctgcttcaagcttcagagtcctagaggtaagtatttgcaataaattgtacaagtaattaaggacaagtatcttcatatctgaatactgatttataaagattgggatttgggggactatgctatgcagctatccagtgagtacttctatatagctcaaggtaggaatgttataatagaacatagtttacaaataacatgaaaataaggtgtctcttcttctttgactttgtctctcttttgtttgttttgttcttctgatattgctccaaaacaaaagattcaactgaaagggtttatctacttggagctctcttcatttacagtaggtcacctatacaattctatcattttgttagggcataaactatatatttatgttttgttaaacaataacaacaaaataaataaataaatttagagtataaaataataaacacatattattgcaaatacgttcaataagtacccctttaatgagtaagtctgaatatatatgtatatgtgtatatatgtatatatgtataagcatatatacatatatatgctttcatatgcaatatgagaaaccacttccatcccattggagaattttataatttttaaagggaacaggtgatttgatttgtatattctagtgcattaaaagctaaaccttgtaaatggaaattgttggttttttttttgtttgttttcgttcattagataacatgcacaatggacatacaataaaccaaaaatatttaactggaacatactgctgatctacatatgcccccatccccaaagatgctatgtcctggtttttcaacaacctgtttgatggaactaattgaactggttgatgtaacattttttaccattctcttctaagttctcttatgcttacttgaggcagccatgctaaaatcttaccaagaccttctaaccttcttgcatagactccaggtataacctttggggttcagctgccaattgtcagttcagcgatgtgcagacaggtcatctggcagtgcttctttattttgctcagtagatacttggaggttatgttctttatcaaacttgaggtttttcatctaatctgtttgtgcatgtatctttttccacctttcaaaatatttttttcttccaaattgttctcccttgggtcatatgattgtatctattcctttgtatttgttgattgcaacagaattccttctgtgttagcatagttagtttctttaagcacatggaacatatttcaaggctaccagtaaactactgaagccacagacagtggtaacacacacacacacacacacacacacacacacacacagagagagagagagagagagagagagagagagaggggtacacagacagacacagacagatacagacatactcatacacacataatgtttttcaccaacatatatgactgtgacaaagcttgacttgcatattaatttcagtaggggctggagagatggcctaggggttaagaccactttgatttccagtatgtacgtggctgttccatcatctggaactctatttccagacatccaacacccttttgtggtctacagaggcattaggcatatacatggtacacagacatacatgcaggcaaaacactcatacacattagaaaaaccactgcaaattaaatacaatatgatgaaatattaataaaggatttataacagagtcctgaaatataagctttgtgactatattctttcttgaaagggtcaagacaaatactgacattttgaagctgcagttgagtagaaactctggaagcaaatttgcagataggggtgggattactgcatagcacaaaaacaagatgttagtgcccacaagaactttcttgtttatcctttttaataagcatgtttggctgtgtcccctaatgcttgagatgttttcataattgatcattttaaaaactcatcagaaactgggtaagtcttgcagacatatgtcagtttgcttagattatcgcttgacattctcattggtcatgctgcttctacaagactactagccagaagaaaatccaaagcactgttcagtaagaggaaatggtgtgttggatggatcacatcaacatgaattttggcataaagcttcctgttagtttgacaggttttactcctgactgttgtacttcctgaaaacttgcagtgaacaggaactcccttctttgcaagcctgagaatttgcagttacaaatagctatttctgaagtaatcctttcagatttgtttcgttttaatattttccctgttgaaactcaatgatgatgaaattgtggacactggaagacttttgaatattttaagttatacaaatggcttcacttaggtatgggtcccagaaagaagagctaggattgttttattagcatctgaaagaaagatatcaggacagtatgtgaaagtctgcatggggtgactgcatctggtactctctggtgctaatgttcaagctgtcttgaggggcgaggggaggatcttttagaggaagaatatggaccaccaaaatgtgatgagaagctggttgtaggatttggaccagtagccaaagaaaagctagaaaggtgtggaaggaaaattagacatttgatttataactcaggaaaaaagtgggcaggctgagcagtgaagatgtataagcaaatgtgtaggtggtgggaatcttcagagtgagacagggagatggaggtacagagagagagagagagagagagagagagagagagagagagagagagagacatacagaggggggagagagatagggagagagagagagagagagagagagagactgagagaagagaaaggtagggaggagtagggaacagagcatcaaagtagccttaggatttgagctagtatccaaagagatacatggaaaagaaaaattatacccttcctattagctcagaaaagtaaacaggtttagcagggagggtctgcaagtgttgctatgcatgtagtgatgtcaaaggtgtgtgtatgagtacataccccactaatctcatagttatttgttcaggggagagctttccttaccagatgataggccgagttggattaactcttatgtgaagtaattatagtgcctttgaaatattattttttagccagtaaaaatgtctcaaaaaaccaaaaaaccaaaaaacgccccaaacccaaagcaactcctcctccaaagaatgtcagtgctagacctctctgtctctctctgtgtctgtctctctgtctgtctcactgtttctctgtctctgtctctctcttcctctctttcttcccaccttccgccaccggaactcatttagtagagcaggctgtcctcttgatctgctgcctgcttcaaacaaaccaacaaaccaacaaacaaggaaaatgtagcattcaagataaagagacaaaaaccgtgtacaatgtagccgtgccttactggtttcccgttaactccctcatcaaagcctagatacccattctgtcttccagtttttgcattttaaatcttcaggaaggggcagctgtgataagtctttttcttaatattgctgtgcaaatagggatgtggctatgcaggacccacaggagattttgaggcagtggtctgttcttactggcctccatgcctgctacttcctgtctagttatccaagaacagtttgtggtttcacccctaattccactaagcaagaccattaaatttatggttatatgtcctcgatgaagttctgatgggagtttctatttaataaagttaggcttccttgttaactatctccagagtttatgttgaaattgtcaaatccttgagagatgaagttaatatagtttactttgtatgtcactggtactaaatttaggcagataacaaccaaaactgggaagatttttaatttttattttgagatttattgcatctaatgtaattttcttgtcatggaatttaaataaatacaataaatatttttaatgcaaatccaaactaaaaatccatcttccttacagatatcattagcatttatttcatgacattttctttctctattttaaagggaaagaattttctgaaacgctagtaggcatgctgtcacttcttagtactttgtagtttactgtagccttctctggtgctgacaaatgaacacctggaaaggtcggtgttggaaaataaaactgcagcccttttacacaagcttggttcataggaagcaatctgaaagtcatgttacctttgtgctctatagcgcttgcttgagttctgaaagtagctatgtagatggtagggtgggaacttgcattattttccaggcaagttaactagtaactatagtccggtgccaaggtgtttcactctgtgcagtcacgagttgcaacataccctcacagtgtggtgtttgctattcattttgtgatagtatgtttttgactggcatgatgatgctgcgtacaggccaggaaatgttacacaaagtagcttggttgaacctctgggggcctatgtttacattagaggctgtgcctacattacaggtttattgtgggaattaaattaaaactctaagaacagtgcctggtatgcagtacttagtggctcttaattagtaatacaatcctgaatatctctttaggttctgcttttctccccgcccccccccccatttctgtgaacaaattaaaaaaaaaatcaatagcattccctgctagttggattctcattcattcattcagtccgtctctacactttctctaaaatccatctccctttatctccttgtctctcttcctttgcttctccctttttctttcacctcccatatatttatgtggcttgttgcattgaaagtggagcaataaggtaaactaggcaatgtttacatactggcttgcagtacaacatttacaacaattgataaagaacctgaaatcggcattatatacttttgaggaatatatcatgtaagcagcatagtgcttgctaatcaatatacaggatcgttttttgaccaatttatagtgtgtattccaaagcataaaactaagttcctatactgtagtctctactttgtagttagaaataatggtggtggtggtggtggtagtggtaataatagtagtatactttgataagtattgtaaccaaagtgtgaaccaaggtattgggagtaacaaagggtatgttttctgtgttactgcttctttaaagcattctgtagttcacaaaaacactggttcttgacagctactggtgattgacaccatgcttcttaaatgtttagtttataaaatggctacttcaaaatttcagttacatgtcccaaatgggtcttgcctacagatttgtgtctacacatagtcttatttctacatttcatatgaaaagaagtgtctaacttagtatattctattatggaattaaagagagaagagcacattctaatattttgctaagataaataaatgctcactatttaaagctcaagtaggcatgtgcttctatatagtgtatgaaatttgagatcttacaagttcagtggttatctgaaaaaatatccattcagaggcctttcaacttggtaggtcaaatttatacttaagctcttgaagtagttcactctatgtactgttgagacagttcttatgaaggcatttagatgccaggatattttctttaaaagaaggggttcattgacccctgtttcttattttagacactcaaggacctagagcaagaatgtgttttctcccattcattctctcatcatttgcactgaaatgagtggccagttggtttttttttcttcttcttctgtcttcttgtggactactgctagtgcagcctgcactagcagtacatacttgcctgtaggaaagaaaaacctttttacaacctgagtctgattgtttttcactggaagtgttctaaaggagatcatagttgccctcctacattcatacttacaaagaaaataaatttgcggtgcattacagggtgtatatctgtgtgtgtctgtgtgtgcacacatgtgcatactaaatctagttgggaatttaaccatcatttcagaacgttggttttgtaggaaaatatagcgatagaactagctgtacgtgctacgacatacatctcaggactataaagagcccatgcatattgaaggttatgcttattaaattagatagtttatatagaataagtacaatattattagaaaatggaattgtattgttgagaaatcaatttagttattttgtaaatttctttgctacccttgtcctcctggcatagtaatgtggggctaaactcaagataacatagcaagagtaattctgtaaatgttgaagaacatttgtattttcatttcagtacactgactgtaatttattctgtctcttatatgacacttaagttcaatcttctaatgtctaattggacaaattgttatcaatccaaattactcaatgttgaagaaaataggaatgcctacagaagctattaaaataagtttagaacttctcaaatttatcccggagaagttagactttctcttgcatcaagaaggctacacacacacacacacacacagagtactattagcatgtttaatgtggctgaagcactaggtgcaaatatatgatatgcgtccctgtgaaagaatttgtttttcctgattggaatcttttcttgacgtcagtaaagtcaaataattataaacagattaatagttccttcatattttttgactttatataaactataatcaatatattgatgaacgaacaccagtgttgttctaaagaaaagcagtatgtttacagcctgagaagctttgcattaaagcatttatgtgattcacaatattaaaaatatttgagtcatttgctttgtcctgtaaatgtgaagtgttaccactttagttctccttttttttttccttcagagaaaggggcatgtaggcctttgccttttattttgtaatgatacaatggctagactacatatcctttgaaatatacatctattttgaaagtatagtttctggtttattagctgttgttatctttccataagcaaagctattgagatgtatgaagagttcattttgaccagcacgagtttagaagacatttagggcctgtgtgagtaaacattaagtcagttgttgctttgtgtaatataagaaaatatccacaattaatactctctgctaatttgttatgatggcaattgaaaacatgggagtataagtgacagttttgttcttctctgtttactattttgacagtttctcttgagagctcagaagttaatgccttaagcaaattaaaactgagttaaaacatgaaaataaatagagagctaaagtccaaatgtttgaagaatgcttttaccagggatatcactactgagcaaagaatatggcacccgtcctgagaaaaaatcaaatttaaacatttttatacatgctgttaatactaagttcttccacagcagttttgggaagacctctcaatatcgaattattttcacctaccatatcatcatatttgtctcaaggtttttagtttaaaatacttgtgaatgttcagttgtaaggctggttttataagattaaaaaaaaatcttctgtgggtctgagaaagccgcctgcctttccctgaactgatcagaactgaggggatgtacttttcgttgggaagccatggctttgagctgcacctttcaacctgcccgcgtttcccaagagctaaaaactgaactagacaaacaaacttttagatttgactcattcctgaattttggattgctaggaaattcaggaatagaagcagaaagtattggtaatgacattaacttaaattgttggttgaattttatgtattttgttataaaattaagtttaataataacgtattcaaaattcaggtataattttcagttttaggcaatttatactcttaaagctttaaaggagtgaatcatcttgttttgtcacattaattttgtagctgcatcagaaaactaaatgctgtggttatttataaaagctgcttgaagtagatgcatgataagtcattgtaaggtgaagtatctactagtagtaatcacagcaatttagaggttatttgtgtgttgtaaagatagtaatcacaacagcatatatttaaattactctacttaatacaaacaacaatcatatgtctgggtacattgcttcaataacaagggtaattttaaacaaaattacatatactaacagctttctctattccaattgctatcacctaatctgagctcttatcataacaatcagatctctctttctgtcactcctctttttcccagtcccagttccatcaatcattacaaatctgaatgcttattctacgttagactctgggtaaaatctccaaggaagttgtgggaacaaagagtcttgagacctaggcctgaatctgcgtgtggactgtatatccctgaaaatccagaattggggagagtgagctggggtggggggagaatgttgagagttttgaggccagcctgagctgcacaggaagactatctgaaaacaatgacaataaacaacactaaaaggtgctgagagagaaccagatggggtagagttctatatatagacagaaaggtggaggagagatcgttagtcctgatcacattgaatttccaagatagcaaggaaggcaaatatcaaataattgtgatctgataattacaaaggggggaggtcagaaaccacgggtcacttactacaagagaacagtaatgttagaaaagatgaatggtgatgaggaaggaagaaatgtgagtggaataagcactcaagtccagtgaagagtgcaaggataggccaaaactgacaaccactaaccagaaatgtcatagtgctgtttactgtctaccaacgactttggaaggagatagaagtttcagagcatgagatcttaattttatggcctaaatgttaattaaaaatgctaaggccaaatggaataataatcccctccatagcattcttatggagatttaaatgaggcaacatagtctttgagcacagtgctaacaaacgcacagtagagggttgctgatacatacatagaaaagaccacagcctattgttgcaagcttttcccgagcttttggttcctccttcagtcagtaatacgtatgcagccacaacccttttctgaaattctaaaacctatgaaatctgaaaatggcctttcttagttagggtttcgattgctgcatcaaaacaccacgaccgaaaagcaagttgtgtgtttggggggagggcttatttgaattatgcttccatatttccaatcatgaccacaggaagtcagtcagaaactcaaacagggtagaagcttggaggcaggagttgatgcagagacaatgcagtggtgctgcttactggcttgttcctcatggcttgctcagcctgctttcttatagaacccagaaccaccagcccagggatggcaccacccaaaatgggctggacctaccccattgatcagtataagaaaatgccttacagaagatgaacctagttttactgaaacttgatttaccaaggatgattgagactcatgagaggcctccacttttttgaattgagacagagtattgggcagggcggggggtgggggggaggactgagaggacaggagggaggggaaactgtggttaggatgtaattaaattaattagttaagtaattattaaaaataaataaagtggctggatgatttttaaaaaaagaaggaaataccttacagctggatctcatgggggcatttcctcaactgaggctctttcctctctgatgactcttgcttgtgtcaaattgacacacaaaaccagctggtgcatatagccttttataaatcggcaataaaacctacaggataaataaagtctgtgtgcaaactttatttatcctgcttagtggaacatcagtgtctcattgctcattgttttcagatagtcttcctgtgcagctcaggctggcctcaaaactctcaacattgctaaacttgaatgcaacgcagtgtgctactttgggttttcctgtatgttttgttatttgtagtacacatagccatatttctcaaacttgaactatttggagtttcaaaacatatctgccttcaaaagttccagaaatgattgtggattcaatgctatccaaattaattagaacagacaaacaaacaagcaagcaagcaaacaacattataacctccatgtccttctgtgaattaggaagcccttaggacccccagaggttggcaaatgttgtataggttaccccttatggttttcatgattaactctcacctgaccacagagtacatcttgaaaatgtaatgtccttccttttgaacgttttgtttcaaaggccactgctcccaacttgcctgaagcatagagtaatgtctcctttgtcttacttccttccccctttttttttttctccctgggtattcctgtccagaaattagtgtgtattcttatcctgatttttcaacccagttcaacacaatagttcaactgtttcttcccagaattctttttttgtacttaaatgaatttattaaatgaaatatttgaagaggtattgtgtgccagtagttgttaaagtgttagtgattagaagccagtgaaatctctaatatgaggggacctgttttctagtaagaagaatacaacatttaactagtgctcacaaacttacagatagcggggtaatgccgtgataatagtggacagtgtggtagaggaggagaagctgcagatcttagagcttagtatttaattattgacttgcttttatatggttagattgcacatgccttaagggaaaagcatgtcttatgcttctagataccacaaactgccggctgtttaataatgggtacgttcttagtgtttgcttgactcatgcattcattcatcctttgattaaccgagaaagtagaattttatttattaaacatcaatcttcatttggctaactcgtcaacccaagtgtatttaatgcactaattacttcattgaaacattgaaatacatgtatttatgtaaggctagcttctctattcctatcttttcttttaattcatagtccaagaagaaaaaaaaaattgaagtccaggtcttcatatctcagttggtttagtacatagtaaacaaatgtgatttctgtacctgtaggagaagcgcttactacaacaactttattatccctgcgattttgcttaattcagatacaatgtggcttttacaatttattcttaggaacttttgttgaataccaaagtggtgagcatacatttcctgaacatattctgaggtgggtcatgcctatcaaacagaagagactgttggattcccatactatagttgccttttctgacattcaagtttatggtggtacagttcatttttttattgttaggataggcttaaaaaactaatttaatgtagtaacagtcttttgcttcatgaagaaaacagaagtcccggactttgatgttatatttgatctcttatatataaatattttattctttttatatcgaaagaacagcttgagaagaagatcccagaaggaacgtggttttctttctttctttcttttttttcttttttgtcagaacaatagcagaaagaattttgatttgtaatagcaaaaagtctggtggcttaaagtttgatgcttcaacttggcagtatttctgaggaggtgtggttactgttaataaaaatataaatgtattttcctacttaagtgaagaaatggatagttaaaggtgttaaacagcaaagtaaggcagaaattggagcttaaggtcagtatggtcatctcatcttttagggttttgggctttgaaagcaggactatatttctttaagtttgtagtgtctagcatgttgccagttcatctagcatctattcataaatattaattgtgatggaggacagtattgcctaaaatgatgtgttcctgttagaaaatgactcttatgttagaaaggagatgaaagagtgactgaggataattttaaatccaggtagtaaacatttccatgatgttgaaagctaatatttgttctgtcatcctagaagcaattctctacattgagcttgcttctaaaaatcagattatagataattttcttggtgaaataaatagaacagggaactactaaactcaaaatctctatgaaggattccaaggactgcttagaatgttgatttttattactaggtattcaaataatctggaattatttcgattggtcttactagctttgaaagttcagagtatatgatcttacaagttggaaggcagaaccagttccttgtatgacggcctccaatctgaataggtattaggcagatgtgccatatagaggagtttaggcctgccttgtgtctcttgactcccttgctccctttcctcaagatatttctaacttgaaatgtgtgtggaagctatactagggtactttctcttgagaacccaggcagtaccctcacttccccaattttttgtgattgtttgttcaatcctctgatctctaaactagaacttacatggtagatgcaaatgtttgttatattgatatgaatgcatctttctgtatctcattgttctggcttttattttattttattttattttttttttttgtgagcaagatacttaaagctgggtgaataattgaccatgcattttttgttgtaatggccaacttattgatcttcattaaaagagaattgtctaatacagtgattgtggtttttgagttgacgatgagacttttgaattatatctaatttagtttttcaatttctgtggtactagactagttgcacaatgtttataaagcactgtattaccatgtaacgttagccatgagagagttgactctttacatcttgctccttttgttaatttctgcctgattgagaaaattaaaacttaattttcttgccataatgacctttagctttgcgatcagaacttcaacattagagtttatagtaactcagccatttctcttattcttaaggggttgagactctagagcaatacttttataattatataacgctatataattctacactattatatttaatatagctgatcatagatgaagtttaataaacactgattgcttgagtaatgcatagtttgattgcttcttcagagttgcgcttaatgaaaatatatggtcactatacttattgatgtaatatgccaccattgtaatgaccattatcattatatttgcataataaaaacttaacaaaatgactttaatcagtgcttttaattcaaggctgtgattccaattttgggggttatttttgtcttagccttttaaatgttctttcaagtccatgtatagctctctagtttgtgtgaaggaataagatccatgtttgctttttttgtggtttgaggaaacatatgtacatctatatatattaaattcataaatgatttgagaacttttctgggaagaacatatggatatgaaatgatagtttatctattcattttaaaatactgtttttctgtgctgagggcctaactcatggtctctcatacatgtctagtgaatgctctaccactgtgctataattcagtcctgaaagtaaactttgatacagttattttcaaatgtgttttaaagatcagttcataggaacatgtttgacttagtcttgccccaaagcagctctttacatttttttgaacttctttactgtttggtgtctttgttactatgatggggtgctcctgtatattgagttttcactgccactcattggttttctattgatgattacttaattgtgacttaaactacaatattagtgcatttttagtatacaatggctaaaagaaaatcacagtttctgaagctcagtttctttgtccctgctaaagatttaacttttcagcccaccatagtcctttctttcaatttgaaagaaaggttttcagtgtcactatgtttatgaaatatagtatttgtgaaattgaaatatttttaaaaattctttttgctttgcatgtgtacgtatgtgtgtgtctgcatgagtgtctgacgcatgtgtacaggcgtctgtagtgtgagaaaaggtgttgactgttctgaagttacagggagctatgagccacccgaccgatttgggtgctggctactacattggggtcttctccaagaacagtatgtgctcttacccactgagcaacctctcttgctcctgagagcaaatatggtaatgagagaaatgtattagaaaacagctgcattatagtaaatgttcacatttatatagaatgtatgtttctgtgctggaatgaaatttataaatcaaaaattcaagagtgaagtgtttttctttatggctctctatcataagtaattggaataattttttatgtgactataatttgctttgtgccctgggggtactctatcattcttgaaaataactgttagaggaaaaaaaatctttgagagtaaaatagagtacagtcattatccagttttcagagtttcacatttgatttgccaatagtcaaattttaaattttagagacgttctagaaatagaaatacatctactaaaatgaatatctcaggtcaagggatctgcaaaactaccaacaggacatcataggacatacactaagtaatattttgctttaagtagtacaaggaccaagagggaaaagtgaaaggtggcctggggccaagtcatacagagcctgaatacctttgggttattagtctttgcaggaccaggatgaagtaaatatttatgaaagggagtatgagagtcattcataatcattattgcgctttagtgtaccaagcgttgttttagacatcagaagcactgcccacaatcagtcagaaaagactatctatccctctacagctcatattatagtgtgttgaaaaagataggaaacagttgagggtgtagctgaatggcagagtgattgcttaacatgtactgagccctgggttatatctccagcactagagagtaaaaagcaaaaggtaacataatgaataacattagtttaaagattgttatattaaatattatttggagaaagacaaacaagggaatgtgtggattaggcctatgttattactagaattaccagagtaggcctcactgacaaaaaaaaaaatcattggtaggaggatgaaggggcaagttgtacagataacagaaatgaacaatgcaggtagggggaagagcgaattcgtgtgtgattgctttcttttcttgggagcactgaggtggttagtgcgaatggagctagttgaatgaaggagaagcagtgaaagatgaggtcagggattatctagtgattgtaatgaccttgagttgcattggatgggaaaatagtcattgcaggtttgagctggggagtgacatgactttggttttcacagtataccattgtctgcccttttcaaaactcactgtaagagaacaaaaatagaatgagggagacaaggtaggaggttactaagaaaatctaggtaagagctggtggtggttttaattaggtttggtgtgtgtgtgcttgcctgtgtatgtgtatgagtgtgtgtttgtgtgtgtatgtgtgtgtgttactgaacagtctgttgctaggctattggaaatgaagagtgacttaatgtagaagtcttcagcatagaaaatggaatacaggggtaccattagcataaatgatactctcttatttgtaacataagatgtttgcttatattatcttaaatttcacccaactctaaatgtccatattatgtggcctagtgtgaaccaaagaatgttaattcaaagtagagaaatgtgagaagattttagactcttcctgtaaaacaaagtgaaaagatagctagcatttctatttttttttcattttgttttttttcctttttttatttaaaatttttttattaggtattttcctcatttacatttccaatgctatcccaaaagtcctgcatacccttccccccactcctctacccacccactcccacttcttggccctggcgttcccctgtactgaggcatataaagtttgcaggaccaatgggcctctctttccactgatggccagctaggccatgttctgatacatatgcaggtagagacacgagctccaggggatactgcttagttcatattgttgttccacctatagggtcgcagatccctttagctcctaggatactttctctagctcctccattgggggccctgtgatccatccaatagctgactgtgagcatccacttctgtgtttgctaggccccggcatagtctcacaagagacagctatatcagggtcctttcagcaaaatcttgctagtgtattcaatggtgtctgcatttggtggctgattatgggatggatacccggatatggtagtctctagatggtccatccttttgtctcagctccaaactttgtctctgtaactccttccatgggtgttttcttcccaattcaaagaagggacaaagtgtccacactttggtcttcattcttcttgagtttcatgtgttttgtattttgtatcttgggtattctaagtttctgggctaatatccacttatcagtgagtacatatcatgtgagttcttttgtgattgggttacctcactcaggatgatgccctccaggtccatccatttgcctaggaatttcataaattcattctttttaatagctgagtagtactgcattgtgtaaatgtaccacattttctatattcattcctctgttgaggggcatctgggttctttccagcttctggctattataaataaggctgctatgaacatagcggagcatgtgtcattcttaccagttggaacatcttctggatatatgcccagaagaggtattgcgggatcctccggtagtattatgtccaattttctaaggaaccaccagactgatttccagagtggttgtacaagcttgcaatcccaccaaaaatggaggagtgttcctctttctccacttcctcgccagcatctgctgtcacctgaatttttgatcttagccattctgactggtgtgagatggaatctcagggctgttttgatttgcatttccctgatgattaaggatgctgaacattttttcaggtgcttctcagccattcagtattcctcaggtgagaattctttgtttagctctgagccccattttttaatggggttatctgattttctggagtccaccttcttcagttctttatatatattagatattattcccctatctgatttaggataggtaaagatcctttcccagtctgttggtggcctttttgtcttattgacagtatcctttgccttacagaagctttgcaattttatgaggtcccatttgtcaattcttgatcttacagcacaagccattgctgttctattcaggaatttttcccctgtgcccatatcttcgaggcttttccccactttctcctttataagtttcactgtctctggttttatgtgaagttccttaatccacttagatttgaccttagtacaaggaaataggaatggatcaattcgcattcttctacatgataactgccagttgtgccagcatcatttgttgaaaatgctgtcttttttccactggatggttttagctcccttgtcgaagatcaaatgaccataggtgtgtgggttcatttctgggtcttcaattctattccactggtctacttgtctgtcactataccagtaccatgaagtttttataacaattgctctgtagtacagctgtaggtcaggcatggtgattccaacagacattcttttatccttgagaagagtttttgctatcctaggttttttgttattccagatgaatttgcagattgctctttctaattcgttgaagaattgagttggaattttgatggggattgcattgaatctgtagattgcttttggcaagatagccattttttactatattgatcctgccaatccatgagcatgggagatctttccatcttctgagattttctttaattctttcttcagagacttgaagtttttatcatacagatctttcacttccttagttagagtcatgccaaggtattttatgttatttgtgactattgagaagggtgttggttccctaatttctttctcagcctgtttattctttgtgtagtgaaaggccgttgtcttgtttgagttaattttatatacagctacttcattgaagctgtttatcaggcttaggagttctctggtggaatttttagggtctcttatatagactatcatatcatctgcaaaaagtgatattttgacttcttcctttccaatttgtatcctcttgatctccttttgttgtcaaatttctctggctaggactcatttctattttttttgggggggggcttgttttcactgattaaattgtcaacatgtgttcaattgagatacagtgttgaagtatttctgacatacgtgtgtcttaatataggaacttgactgaagcaaatatttttcttctaatttctattctggatttggaaatgtagatgtttccaatcataactgtataaccccaaaggaatggaaggaaaggaaagcagaagttgcttgaagagttatgtagtctatcgaaaaaacccagctgggcaggctcatgtcagatgttagcaggctcatttcaggtctgtaattgtgctttgcaggaaatcccatctatcatcactgttcctgaagcttttctataactcaccagaaaactcaagagaaaagaaatggagaaaagtgtctatggtgaattgatttttttttttccgagacaaggtttctctgtgtagccctggctgtcctggaactcattttgtagagcaggctggcctcgaactcagaaatctgcctgcctctgcctttcaagtgccaggattaaaggcgtataccaccacttttttttttttttaaagattgctttagtttttatttaaatgaccccccttttaatcttttgtgcttttgtgtgatgttcatattttgtgtgtgtgtgtatgtgtgtgtatgtatgtatgtgtgtgtggtgtgcacttgcatgccacagcacgtttgtggatgagtggaggtcagagcacaactttgggtatttcttggtcctcacttccttatttagtttgaaccagggtctctttgttgttcctttctgcattgacaggtaacccattagctttcatgggttctcttgtcacagcctctcatcttgttggagtagtgggattatagatgcacaacactgcacctggcttaaggtgggttatatagtttcaaacttagcttttcatgtttattcagtgagcactttccttactaagccaccttctaaactcctctcccctcttccccaaggaaataaagatttattgagttttatgatgatttagtacaggagaagaagtttcgattcctaagggagttgaagctttcaaaatacaaaaatgatccatacatgcactagtgcatttgccatgtttgttctaggttaggatggttttcaatagcacagagtggatagtagtaattgaaggcaagtttctgagattgcgagaccaagcagtttttttttattagatattttctttatttacatttcaaatgttatcctttttcctagtttcccctcccaaaatcccctatcccctccctgtccacctgctccccaagccacacactccctctacctggtcctggcagtcccctatactggggcttagagccttcacaggaataagggcctctactcccattgatgaccgactaggccatcctctgctacatatacagctagagccacaagtaccactgtgtgttttttttttttttttttttgattggtggtatagttccaagaagctctggggggggggggtaactggttagttcatattgatgttccttctatggagcttcagtccccttcagctccctgggtatttctctggctccttcactggggaacttgtgtcccgtccaatggatgactgtgagcatccactactgtatttactaggtactggcagagcctcataggaggcagctatatcaggctcctgtcagcaggctcttgttggcatctgcctaatgtctgggtttggtggttgtttatggggtagatccccaagtagggcagtctctggatggtcattccttcaggctctgctccgaactttgagaccaagcagttttgacttatggaaaactcccaatgcaattgtctgtagtgaaagatgtgtattttacttagtaaaaattcatgccaatatttatggctatgttagatacacttcatttggcttcttctgtaagaaacagaatgtgaaacaagtctgaagggactgcacatgagatggtgaccgtgcaagagtatattatctgtgccatcctagtttgcttgagtgtactctgatgccatttattgtgcatttctagaaacataacatcatcatgaagagatgtgtggctgtacttaaaacagtgaaatcttgactttatactgattgcatgctactgtaagattctgaattatcttctgaatcctgaattttattgaattgttagatttgttacgttttaacattttactcattaagtaatatttgctatatgtgaaatagttactctgttttattttaatttcataatcgtttaggcactattcatttcagaaccttttgaaagactgcgagggaacagaagtttgcttactgctttgtagtattttaatactattgtggtgctatctaatatacaaatgaaagtttgatcttaatgtccatatttaaagtcaaatagctaaccctcccccttactaaaccttcatttgaagtttcttttctttttttatttattttttacttttaaggcaatttttattagatattttcttcatttacatttcaaatgctatccccaaagcgtcctatatcctacccctgccctgctccccaacccacccactcctgcttcctggccctggcattccagtttgcttactgctttgtagtattttaatactgttgtggtgctatctaatatacatatgaaagtttgatcttagtgtccatatttaaaatcaaatagctaatcctctccccaaccaaaccttcattttaaatttctaccatattttttaaaaattttgtaatgggtgtgttatttgtatgttgagttttattttttgacaattttcatttgataaaagatgagaatcattgaatttctttaattattgttgtcttggttgacttatgagtttcttttttctgactgttattttcttttgtttgtttccttttggttttaatagaacattcaaataaaaactttggcagatgatgtggtaaggtggtgtgagcagcatgttatttcattgcttgtgcatgttatgtttttatttaaaaagtggacattaaagcatatatatgcaacacataaagtgactgcatgtttagaaaatagagcagaataggatctttgccaatagagcaattcacccctttagaaaatagagcagaataggatctttgccaatagagcaattcaccccttttcacatatgtatgtaagcaatcgtagctaggcacagtggtacatacctgtaattctcacatttcagagactgaggaaggaggattgcttctggtaatggaggaggtcagcctggtatatacaaagagttctaggttacccagggctatttagtgccctgccccacctcaataaaaagaaactgcctcaaaattacccaaataattgggtcagattccagctatgtttttttttaaatcattgtaatatataacaaccaatattttgatgaatacatgtagactataaaaacatggctgttttctctattgatagataaatatattgtgagtatattaaattctgatattagaagaatttgtctacaaatcaaatatgtactattgaatttaaaagcttatatttttgagctcagactaccatagtaattcttgttggaagttataagctaagattttttttaatatgaacttacctatctacaaaaaatgttaaatcatattactgttttaaggaaatgaaggtatgtaacttaacttcattttcttaccaaaatatagctgaagtacaaagccattttttgcattagaatgaaaggtgtagaaagctcaagtctgtatgttaccaatgctgatactcagtataaatgctttcactgtataagtactttaagtggtgtataatgaatggagaaaagatatattaatttaatggccaactacatatttaaatgctttcatgtccaccaaatctttttcttttttcaccatatctttgagtaaaatttgactcagtttatttgggattactgattgtttttttctttcttttttttttttgagatgtgagaagcaattatctaaaccaacttaagtttcctcaaagagttacacaacatttaataatacagttgaaataattttaaagaaatacttgtaatatgaacgctgagatcagaaccagggactcatgtatttaagggagtcacctgttgtgtgaattgagggaattggtttggatggcatttcatttttcttcccagctctaaaatattgtggtttctataatctctctgtaagcaaccatgtactcaaataatttctgtaatcccaagtaagctgcttaaaactgctttcttcaaagtacacgtgttaaaaaaaaaaagcacccattatttcaatcaataaaataaagactatgttctcttagggggtaaacaaacataaactgtaataatgtctggaatgctttcatattcttaaggttatttaaaaggatggtggtaacatggcagtgtacattcattgtcatcatagctaacatgtgtgtttgcttattgtgacctgatgatattgcatgtgcttcctaacagacacctgaataaaactgagttgtctccagttttatgaatattactaatgtttgatgtcaaatatttggtggtttttaaatcagatggtccattgacaagcagctaaagtccttgactcacttggtatgaaagagcaagctcattgttagagattgtacatggtatcaatagtttaaagaaaatacctgtaaagtagtgagtttgtcagataatatttaaagggggaagaaaatatttctgtttatatgttcaacaaatggaatgagtgctttagctttgttttacttcctactggtgccactgatttggaaagaaagagttgaggaatatggtaataacagtaattagaatcaacgcccaccaagtgtatttggcttttacaattacctacaatataagaagaggaaatagtgagagagaagggtatcttcctttcctgactgattctgagttagtgattttccagtttggatttaaactcactgtgtctgtcttcagactccatggtattaggcaactgctaaaatgacagttattcatatatacttgtcacagtttttacagtgtgcagaagaaaaaacattaccctaaaattccctttgagtttgctagcagttgttccgtttccactctccctttccatagcactgaagttggcaccaaagcctcattcttcctaaaacaaccaccacaagattttgatccaaagtgtctctttacttacttcctgtgtaaagaaagaaatgacaagtgactaaattttacttttgaggaatgttttctcacccctagacttctgaagctgaagaactactcaaaggttgcaaaatagtccagtctctaactggtgcttgctgcttacaataacattttgtcaagagacaataataatatatattatactaaatgccattttgatgctttcattcttcttgttcatgaatcctgattcttttcttagggctttatttttgttttgttttgttttctttctctgtttctagcgtgaccgaattacaagtttcagaaaatctgccaccaagagagaaaagcctgttattcaacattctattgattatcaaactgcagtggttgagattcccccagctctgatagtacatgatgaccgatctttgattttgtctgaaaaggaagttctggacctctttgagaaaatgatggtgagtttgacctctaatttcattgtcattttaaactacatgtgtccagaataacgctgcatcttaaataggaatgtctgtggggaagttttatgccatataaacaacagacataaccttgttgagataacaatagcatttccacgaatatttgagattgtttgtttatttatttgctagaatgtctgtcctaatcatagtgcctaaaattagggacagatttatttctctttgttctctagtattttgtagtttgtgacataacaaatcaattttcaattaactaatttgcatgcttgctggtccaaagcaaagtgagcctaagtcttcaaggcctgttgagtacatgaaagatagttgggaagatacagtttaaaacaaacaacaatatgctaattggaaccaaggaattaaacctaacccttaccctaacactatcccttagcaacagtcatacaacttgcattctgtagtgtacttcttatgtttctttttgtgtactctaaagtacttctaaaataataagtgtaatacttggatttctcaacattttttttaatctagaaaagggacaaatgagacattgggtaatctcacattggttagcttcaccagatctcttttagagacctcaaaacatgatttgttaatttaacgtattaatcttatgtatgaacatacattttatataaagaattcaataacatttgttgcatcccttctttaccaaacatgtcctaatctatcttgcattataaatgttattcattataagtgttattccattgtcctgtcttaattaataatgatgataatagtaacaaacccagaaacattccttgagagtattttgttaataacattttctgtctttctcatttttctctctttcactgagcagttatgttcagttaactggacttttttgcttcttgttaacatgggtgatttttttttattcatgttcagattcttctatttgtgtacacaagtagtttccattcctttttatctccttagactccaccccccctcccccattttttccactataaagcagttgtgctgtctggtgtcaaaacaatttctcccagagatagctagcagctagtcctattgagtcaattcttcaacataggttccttctttccaggagactctacattgtaacaaattgacaataacaactacctatttttgtagttgggggcgggataatagggaaataattgccaaaggatttcaatactttgtgtagctatggggcataagttaacagagatctattttataaagtagtaactataattaataatatattgtattgacaatgtgaagatttaataaaaagtattctctgcataacattatttgaaatagtacataatgatgaactagacttagtcatctacaatgacttcttttttagaacattatgttgtatacaggaaatacagttgaaaaatttacttataaatggaaagtgaacataagtgaatatattcagtgagtacatatctttatagtgagtatgttataaactttctcccatttttttatcagataaatcctgaccattgttcaattgccaacatttcttatcagtttactaccttgttttactatcttaagcactgataacagcaaaacagttatactgatatacgtatgaataccatttacaaatgagcatatattactttaaaataatagtataatcttaacagcaacagcctttattagaaacatggtgtattagagtaaagagtttgaggtggagcatttcttaccttatctttagctgccattatagaacctcaccaaagccaacagtcttataatagaaagctggtaagtatcatcattagagttgatggtggaaaaagaactgaacttttagatatgaaatttcttgggcacaagtcccttccgctcgactcaagacccgggctaccttgccagcagagtcttgcccaacacccgcaagggcccacacgggactccccacgggatcctaagacctctggtgagtggaacacagcgcctgccccaatccaatcacgtggaacctgagactgcggtacatagggaagcaggctaccagggcttgatctggggcacaaaccccttccactccactcgagccccgggctaccttgccagcagagtcgcctgacacccgcaagggcccacacaggattccacacgagaccctaagacctctagtgagtggaacacaacttctgccaggagtctggttcgaacaccagatatctgggtacctgccctgcaagaagagagcttgcctgcagagaatactctgcccactgaaactaaggagagtgctaccctccaggtctgcttatagaggctaacagagtcacctgaagaacaaactcttaacagtgacaactaaaacagctagcttcagagattaccagatggcgaaaggcaaacgtaagaatcctactaacagaaatcaagaccactcaccatcatcagaacgcagcactcccaccccacctagtcctgggcaccccaacacaaccgaaaatctagacccagatttaaaaacatttctcatgatgatgatagaggacatcaagaaggacttacataagtcacttaaagaattacaggagagcactgctaaagagttacaggcccttacagaaaagcaggaaaacacagccaaacaggtagaaatcattaaagaaaaacaggaaaacacatccaaacaggtgatggaaatgaacaaaaccatattagaactaaaaggggaagtagacacaataaagaaaacccaaagcgaggcaacgctggagatagaaaccctaggaaagagatctggaaccatagatgcgagcatcagcaacagaatacaagaaatggaagagagaatctcaggtgcaaaagattccatagagaacatcgacacaacagtcaaagaaaatacaaaatgcaaaaggatcctaactcaaaacatccaggtaatgcaggacacaatgagaagaccaaacctacggataataggaattgatgagaatgaagattttcaacttaaagggccagctaatatcttcaacaaaataatagaagaaaacttcccaaacataaaaaaagagatgcccatgatcatacaagaagcctacagaactccaaatagactggaccagaaaagaaattcctcccgacacataataatcagaacaacaaatgcactaaataaagatagaatattaaaagcagtaagggagaaaggtcaagtaacatataaaggaaggcctatcagaattacaccagacttttcaccagagactatgaaagccagaagagcctggacagatgttatacagacactaagagaacacaaatgccagcccaggctactatacctggccaaactctcaattaccatagatggagaaaccaaagtattccacgacaaaaacaaattcacacaatatctttccacgaatccagcccttcaaaggataataacagaaaagaagcaatacaaggacggaaatcacgccctagaacaaccaagaaagtaatcattcaacaaaccaaaaagaagacagccacaagaacagaatgccaactctaacaacaaaaataaaaggaagcaacaattacttttctttaatatctcttaatatcaatggactcaattccccaataaaaagacatagactaacaaactggctacacaaacaggacccaacattctgctgcttacaggaaacccatctcagggaaaaagacagacactacttcagagtgaaaggctggaaaacaattttccaagcaaatggactgaagaaacaagctggagtagccattttaatatcggataaaatcgacttccaacccaaagttatcaaaaaagacaaggagggacacttcatactcatcaaaggtaaaatcctccaagaggaactctcaattctgaatatctacgcaccaaatgcaagggcagccacattcattagagacactttagtaaagctcaaagcatacattgcacctcacacaataatagtgggagacttcaacacaccactttcttcaaaggacagatcgtggaaacagaaactaaacagggacacagtgaaactaacagaagttatgaaacaaatgaacctgacagatatctacagaacattttatcctaaaacaaaaggatatacattcttctcagcacctcacgggaccttctccaaaattgaccatataattggtcacaaaacaggcctcaacagatacaaaaatattgaaattgtcccatgtatcctatcagaccaccatggcctaagactgatcttcaataacaacataaataatggaaagccaacattcacgtggaaactgaataacactcttctcaatgataccttggtcaaggaaggaataaagaaagaaattaaagactttttagagtttaatgaaaatgaagccacaacgtacccaaacctatgggacacaatgaaagcatttctaagagggaaactcatagctctgagtgcctccaagaagaaacgggagacagcacatactagcagcttgacaacacatctaaaagccctagaaaaaaaggaagcaaattcacccaagaggagtagacggcaggaaataatcaaactcaggggtgaaatcaaccaagtggaaacaagaagaactattcaaagaattaaccaaacgaggagttggttctttgagaaaatcaacaagatagataaacccttagctagactcactaaagggcacagggacaaaatcctaattaacaaaatcagaaatgaaaagggagacataacaacagatcctgaagaaatccaaaacaccatcagatccttctacaaaaggttatactcaacaaaactggaaaacctgaacgaaatggacaaattactggacagatagcaggtaccaaagttaaaacaggatcaggttaatgaaccaaacagtcctaatcccctaaagaaatagaagcagttattaatagtctcccagccaaaaaaagcccaggaccagatgggtttagtgcagagttctatcagaccttcaaagaagatctaattccagttctgcacaaactatttcacaaaatagaagtagaaggtactctacccaactcattttatgaagccactattactctgatacctaaaccacagaaagacccaacaaagatagagaacttcagaccaatttctcttatgaatatcgatgcaaaaatcctcaataaaattctcgctaaccgaatccaagaacacataaaagcaatcatccatcctgaccaagtaggttttattccagggatgcagggatggtttaatatacgaaaatccatcaatgtaatccattatataaacaaactcaaagacaaaaaccacacgatcatctcgttagatgcagaaaaagcatttgacaagatccaacacccattcatgataaaagttctggaaagatcaggaattcaaggcccatacctaaacatgataaaagcaatctacagcaaaccagtagccaacatcaaagtaaatggagagaagctggaagcaatcccactaaaatcagggactagacaaggctgcccactttctccctaccttttcaacatagtacttgaagtattagccagagcaattcgacaacaaaaggagatcaaggggatacaaattggaaaagaggaagtcaaaatatcactttttgcagatgatatgatagtatatataagtgaccctaaaaattctaccagagaactcctaaacctgataaacagcttcggtgaagtagctggatataaaataaactcaaacaagtcaatggcctttctctatacaaagaataaacaggctgagaaagaaattagggaaacaacacccttctcaatagtcacaaataatataaaatatcttggcgtgactctaactaaggaagtgaaagatctgtatgataaaaacttcaaatctctgaagaaagaaattaaggaagatctcagaagatggaaagatctcccatgctcatggattggcaggatcaacattgtaaaaatggctatcttgccaaaagcaatctacagattcaatgcaatccccatcaaaattccaactcaattcttcaacgaattggaaggagcaatttgcaaatttgtctggaataacaaaaaacctaggatagcaaaaagtcttctcaaggataaaagaacttctggcggaatcaccatgccagacctaaagctttactacagagcaattgtgataaaaactgcatggtactggtatagagacagacaagtagaccaatggaatagaattgaagacccagaaatgaacccacacacctatggtcacttgatctttgacaagggagctaaaaccatccagtggaagaaagacagcattttcaacaattggtgctggcacaactggttgttatcgtgtagaagaatgcgaatcgatccatacttatctccttgtacaaaggtcaaatctaagtggatcaaggaacttcacataaaaccagagacactgaaacttatagaggagaaagtggggaaaagtgtgccttgaagatatgggcacaggggaaaaattcctgaacagaacagcaatggcttgtgctgtaagatcgagaactgacaaatgggacctaatgaaactccaaagtttctgcaaggcaaaagacaccgtcaataagacaaaaagaccaccaacagattgggaaaggatctttacctatcctaaatcagataggggactaatatccaacatatataaagaactcaagaaggtggacttcagaaaatcaaataaccccattaaaaaatggggctcagaactgaacaaagaattctcacctgaggaataccgaatggcagagaagcacctgaaaaaatgttcaacatccttaatcatcagggaaatgcaaatcaaaacaaccctgagattctacctcacatcagtcagaatggctaagatcaaaaattcaggtgacagcagatgctggcgtggatgtggagaaagaggaacactcctccattgttggtgggagtgcaggcttgtacaaccactctggaaatcagtctggcggttcctcagaaaactggacatagtactaccaaaggatccagcagtacctctcctgggcatatatccagaagatgccccaactggtaagaaggacacatgctccactatgttcatagcagccttatttataatagccagaagctggaaagaacctagatgcccctcaacagaggaatggatacagaaaatgtggtacatctacacaatggagtactactcagctattaaaaagaatgaatttatgaaattcctagccaaatggatggacctggagggcatcatcctgagtgaggtaacacattcacaaagaaactcacacaatatgtgctcactgataagtggatattagccccaaacctaggatacccaagatataagatataatttgctaaacacatgaaactcaagaagaatgaagactgaagtgtggacactatgcccctccttagatttgggaacaaaacacccatggaaggagttacagagacaaagtttggagctgagatgaaaggatggaccatgtagagactgccatatccagggatccaccccataatcagcatccaaacgctgacaccattgcatacactagcaagattttattgaaaggacccagatgtagctgtctcttgtgagactatgccggggcctagcaaacacagaagtggatgctcacagtcagctaatggatggatcacagggctcccaatggaggagctagagaaagtagacaaggagctaaagggatctgcaaccctataggtggaacaacattatgaactaaccagtaccccggagctcttgactctagctgcatatgtatcaaaagatggcctagtcggccatcactggaaagagaggcccattggacttgcaaactttatatgccccagtacaggggaacaccagggccaaaaacgggcagtgggtgggcaggggagtgggggtgggtggatatgggggacttttggtatagcattggaaatgtaaatgagctaaatacctaataaaaaatgaaaaaaaaaatttctttgttttcttcactccttgtaggtaccctccttataaataatgtaaaacattttcttgtgctatttgatgactcataagatgctcttagagtctcttgatgttacctatattctgctgtttctgttaaccagtatttgcagttcttagaattaccatacaactctgtatcctgtttagactaatggtgtgtttggattttaggatgaaatactccaagtgtaaaatgattttctaccattgtatcaaatagcacctttcacacacttcctttgcaataggtgcttaacagcaaatggattacattataatttccaatacaatggattattaaacagttttgagaaatagcatgttttcataaaacttacagtgaaaagcaacaacagaaatttctgatcaaatttattctgtctcattatgataatcgatattcttcctgcttgtggatcaaccataccaacagcatttcttactatagaagccattagaagtctaagtttaaaattacaagagaaaaagatgttttataagcattagctattttattattaatcatttactaatgaacccccaatataacagttgatttattttgaaatgaatgaaaactcctaagtgggagggaagttaattaaaagaactaggtggtgcggtagtgcataccctttgtagtaggaggccatgctaggtagatctctgtgaatatgaggccagcctgggctatataggaagttaaaggccagccagcaggactacatcctgtataaaaacagtggctcacctttactttagattatgagtgttttcttgactttcacatttactttgttcatcaataaatcccttcttatattataaacatttggatatttgacatagcaagcatagactttctaaatattagttccactgacattgctgaccgatttaaaggtctcacatatgaaattcttaggtgattattttatagaacacatactctttacaaaacactattttaaaactatatagatatgctttgcatctttggcataatttaataatgccttagttatatataataagtgcttagttattgattttgtattccacctgttagaattcccacaggtcattctaaagcttttactcttgttcttccccccccttttcttcattaatttacacagaagagtggcctctgggcaccaggtgctctactgtaacctaagtatattgtattcccttgactgctattaaaggacttttttctcactcagcaccaggtttttagacgttggttagcttggctgagaacctttgagtgctctaagcataagtaagtttaattaagttaccatgaaatacattattcgtaaactaggccttcacatctataaaaagccaaggagtagttgtcagaaatgattagattctaagaaattgtttaggaagtccaattcctactgcttacatttaaattttctacatcctcaacccatattttagaccatgctcaataccaggatttttttttttttgcagataatacattttattttcctgtgaagactcatacagaaaacatgtaaaggagtatcaacatgtactcacgaaacagatgaaaaattagcctgggtctggatgcattagaaaaattgccattattttatcataaaagtcttacaggggagcagcaaggaagataggcatggaagtaggagaaattaaagagctaggtttgcaaattcacttccctgggagacaggttcatagcctgcttgcttctgttttaggtctgcatgtagaaatgtcttgaaaatagtgcttttattttaaaaggctttgttgcatttattgtgagtacagcttagctattattaattgatctgtgctgtgtgctagatagtgtgctatgggctacaggtttagaggtaaatgtagcaccttgcctcaaagagaagagagttcagccagggagaccactagaggtaagcaaagctatcctatttctaggattgctgtggatcagctgctttagtggggatgtaattccctgaacctctcatgggtgctcatgaaagaagcagatgaagatgtaatatgtgaaaagccagtgtctacttttgaattattggcctcgtttttttttttttttctggcagtccatactcataatttgagtaattcagcaaagtctagggcggggggggggggcagtcagagagagagagagacagagagacagagacagacagatacagcaacaatgggacagaaacagagagacaaacacaggcagacacagagacacaggcagtcagagagagagagagagagagacagagagagagagacagagagagggggaagaagggtgggacgaatacttaaaagaaaatcccaaccatcaagaagttatattctgagagggtgacatatagaaacataaggtggcattatgaaaagaacaaatagcaaaaagaagtttcgagtcatgctttgatagctatctccagtatgctagctagtttgttcttccagaaaacataaacatatcaaaggtactattccccacggaaggacttcactttgtatggcttgcaagctaaaaatgttgctttatgttgtattttctattttttattattgatatatgtgtgtgtgtgtttatgtgtgtgtgtgtgtgtgagatgtgtatgaatgcagataggaatgcatacatgtagcagtgtgtatgtagcgatcaggtgacaatacacaagagttggttttctctgtccatctactatgggttctttggggtccatggcagtttgccaggttttgtgggacaagtgcatttccctgggaagccacctcactggtcacatgttttattatttaaatggttaaagagaagattaattatgtgaattccattgtctacaaatgatattttattgaatgtagctatgtctatttattattattatttattttttctttaggctgcttatctgtaagttcatattatatttgatatttgacttgatatatcatagccaaaacgaagagctgacaaagaagctgaaacccacggctggagagatggctcagtggttaaggtcacagggtactactcttctgggggatctggcttcagtttctagtacctacatgatggtttataaccatctgtaacacttgactcaggggaactggcatcctgttctgatgtctgaaggcaacaggcataggggtggtacacatatatatactctggcaaaacactcacatgcataaaatacagtaaaaacaaagaaacaaagaaacaaacaaaaaacccaaaacataaagcaaggttcaccaggagaagtaaattctcttcccttttgatgatagccagttgtccaagtactatggcgtattacattttgatgtttttacattagtggtttaaaaaagcactttaaggagggagtctttaatcaatgctattagagacatggactcttttcatcttctcttctatatcattgatatatagctcctcatcctcatggatgtctacttcagacaatatctagcactcagaagaaaaaaaattaacaggagttcaagcagaacactgatatgaaagttgagtcagccaatatgtgtcattccacatggggttttttgaaacaaaattacattctaataagatacctttttttccttaattaaaagggaaatgtctaaaccatgctgaattttagctgttttaaagttctttatttttcaataaccagacgtgtttgtagggagaaatacattctttcttcttaaaatgtatttgcaactattcatacaagtattgattatatgtttacaattctttcccacccctaactttccctatctacattagtccttttgttcccaaagattagggagaaaatattttcatatttggttcctaccccatttgaaaattgtgtaactacattaatgtttttgcttttcatatatttttgagatagtctcactctatagcccagattaattgggaactcatcatgtacctgagggtggccttgaacttgtgattctccttctgcagcttctagagtgcaaggtttataggtgtgagatatcgcctaaggtgtgaaccttggtttaaaatacttcctgcaatgctgtttgagtttctcacatgtaaatttgttcaggaatctttcctatttgtggtattttcagaaagcatcttattaactacagcttttattgtggcgatatgtttctcctgttaaattgttctattagtgactcaaagaaaaatggcttatatatattatatctgtattgaaacaatcttaataatactataagccatttcattaaacagctattccatccatctatatagtgatcctcccacagttcagtcattttcctaacacttgcttatgcacatttttcacaatggtttctgtgtgtcttctgatagggtttgctgacaaggaaggcattttctttatttacatttttgcatgtattccttcagctgcttttataaagtgtttcctagctgctgtggggctttttattaaaagtggtattaaaggaaaaccaaaagaggctcataaacatgtgtcattaagtttataaactatcaccaaggtacaggattgagaccatgtgattgtgattattgttgagaatgttgaagacattacaatggcttcctgctctggctcctaggatttatatggcctgctaatttgaggtggatatttactaccattgtctaattttctaaagtataatatgcacataaagtgagggtcatcatcatgattcatttgtaactatatttcacgtgatttctttaattattttcatcttatggagacagcgtattagatttagatttttgttattattactatgtgataatggaagaaagagccagaaattatgaacagatataacaggcatctattttctcgttctcttgtgctcacattattgaaattatctttttatcctcaatctgttgtctttataggaatcgtttggagttgtgtttccattttttagggtatatttggttaaaactagataaataatcagaaaatatactaacattaactgtagcgtgttgcaggacacttaaggtgagtaaatattcattgtgaacattgcactactcccttaagcaacttcatgcatcattcaatctatgggtccaaggaggaatctagtgcatattcttggttacgtattagtaaatcttatttttttaatcctttgaatgattccaatttgtcaacctcagtgggacttttatatagtctttgcactctagaaacatcagttgaagattgtgctcacaattaacaattatgagacagcgaaagtactagttacattttcttatattaaaatacacggggctggtgagatggctcagtgggtaagagcacccgactgctcttccgaaggtccagagttcaaatcccagcaaccacatggtggctcacaaccatctgtaacgagatctgattccctcttctggagtgtctgaagacagctacaatgtacttacatataataaataaataaatctttaaaaaaaaaaaaatacacgatcttgggtgaaggcctctgattggatcttgatacaaagatataatgaggaaattgtgtgcccaatttactaatactcacttaatattttgcctttgcttttagtttcattctatattcagaaatattatctttccactttatcgttctgactttgtttttctatctgagctcctatatgttatattgaatgttttgtttaatttgttgaaagaagctaaaattatggaatagacaataaagttctgggtataattaaataagcataaaaattcactaattttaaaaacataaagcaccaaaaataattatatccattgttggttttggtgtattttaaacactacagtcctattaattcatttttcttaaaggtgaatatctccttagcctaggattttggaggtagaggaaggcaagggcaccagaatgaatgacagagtcaatgaaataaccttctcatctgagtctagttttacatagttcctcattaacaactttactggcatactgtttgaggttatatatataaatcagtgttatagcatgtatcgaatgtgtatgaggctctgggttcaagcagacacacacacacacacacacacacacacacacacacacacacaaatcaaacatttcatgaaggaaaggaatgtttctggagagagataactgtatgaaatgtgaaaacaggaaagagatgatgtttataactatggcttaattgaaaactattgtaagtttggtcagttatttagacttcagcatcattttttttctactacattcttcatataatgtggatacattaaacaaatatgaaatatgcttaaaacttgttttgtattttttccatagtaagaactctgtgtttagaagtagtttcatattcaattatgttgcttagagttaatattgagttacgagtattgctctatttagttttattattgtattatgaagctgaagttaatgatttggaagtatcagctgtataattagtagtatgtttttatttctataggaataaaatgagtcattatagactcttctattcatatgaatgctactcattcctaactaatgaaagcagccattttataagtggaaaaaagctaaagattctgcggcaactttcagtatttaaagcaaagttcccaaattttgtttttctagtagcaagaaaggagactcaaaaaaatattcagtaagtatttactgtattccagggatggggatctttcttttttgcgattgcagagatcaattcctgcttttagttgtcttagagcagtgtttttgaacctctgagttgtgacccttatgggggttgtatatcagatatcctgcctatgagatatttacattatgattcataacaaaagcaaaattgcagttaagaagtacaatgaaataatcttatagttgggggtcaccacaatgtgaggaagtgtattaaacttttgtagcagtaggaaggttgtgaaccacttccttagagtttgagagagataggttttttttactatatattttctttatttagatttcaaatgttatcccctttccaaatttccccgctgaagaccccctatctcctcccctctccctctactccccagcccacacactccctcttcctagccctggcagtcccctatactggagcatagaaccttcacaggaccaagggccagatcagataggtctatgacaaagtattgatatacgtaatatggaagaacaggatggtttctgtttaatagtgggggcactgcgggaaaacttgtagcaggcttagtaggtgagcattgttttaaagtgtaaggaatggacagaagcggattgagtgggaggcagcacatcactgagtaagaagtggaagctggaacagcatcatgtaaaacatagtggggagtatgaaatgacatattacatgtaagagccaccacatcataaaatccaaggtcaagggagtagatgtatgctatttcaagatgaacgtgaagtctcagaatgattgagagtgggagagatagattctaagtgatgttacctgaacataaattgcagctggggtgtatattttggccagagagaattcagacttcaaaacatatatgcttggttcttaaggtaattttcttcaatccagctaccattctcttcactttgacagttgaaatgcttcagaatctcaccattttgagcataggaatacctgttctggatttttaaacatatattaagtattaagagatattagtttgctcttcaatcaagaaggttgctgcaataggctccagatggctttataggaattgcttgcagacctacatagtgaaatatagtccgattaaagagctgttgccactccagaaccaattggtctttctaagttaaaaaaaaaaaagtggctgctgccatcggttccttatcttatctatgtcatctctgttgtcccccatatcaacaagatggatggcatattcaagacatatttcttcacatagttcatttctgagtttgtaccttttattaatgcctttcattggtaaaggccaagccacaggtttgtactgaaattatatgtaaaggatataaacaaatgcagtttttataaactcaattttatgtgaaactgaaaatgtggatgcattaaactgtagagggcatgcctaagtgacattggacagccaaaaatgacagttgccaacaggaatcttttaactgctcttcggatgttagatttttctcctttttcatctctctctcttgctctctctctctgtacatatatacatacacatacacacacgcatacacacacacacacacacacacacacacacacacactcagctatattacctcttttttctttgtaatatatagcaactttctgagactttttctttggtgaatacacacacatatagacgtggatatgttatatatatcctattaaatttgtgtgttatttgttttcatgggtaacagtagtacttggaagcatgggctaaagagcgtgcgtgcgcgcgtgtgtgtatgtgtgtgtgtgtcgagataaacgctttgcaaggtctctataatatctgttataaactaccagtgttctgtagcctagcttaaaaaattttctttcttcttagtgtttagctaaatagaaatgtaagctatgagtatgtgtggaatacatactaaatgatggtatgtcaagtgtgaaataatgaactatctaaaaaatttgttgataaatattaattgcattaatcccttatgaagcaattaagcagtaatccatccatcctcacattctttctaacaggaagatatgaaccttaatgaagaaaagaaagctcctttgcgaaagaaggattttagcatcaagcgtgagatggttgtccagtatatttctgctacttccaaatctgtaagtaaagatacttcccaggcaccaatagaatgaacttagctgtttgcttgaaagtttaaaaaacctcagctttttacattcttgcctcagtgcaattatatttcatatatatataaaatctatctcagtactgaacaattcattagacatgagagatccattattgtaaacaagagaccaatatggaaatctcttaacagaattcaatgaatttgagggcagaggttttctgctcttattaaaagttggcagtgatgtgtgctgtccttctgtttactatacaccctgctacatgaaaatttcagagttgaagggagaaaatgcaaacagcatagctacttttaagtttacattgaagtatctaatttttggaatttttttcatatttggctttgttttgaatgtaaactgttagctgacttatatttggtgtggtaaagttcactttattgtaaaggaaaatatacaccaggaactttaattaaatctgtataaatttaaaacctaaatgcatgatttattattgaaagactttattgtctacaagaaaaacttagtgctttaatagagttaattcactcatttttgttatccttctaaggtttttgaaaagtagtcttcaggtttgattttttttttttggtagaaaaaaatacacttttgatgtggcaaaatatatattttgtatttctgaaaagaattttcaatggcagatttcatgaagtcactgtatgtatctgtatagatacatgttttatacatatttatgcacaatttacatgtagatatttgagtttattttcatttgtacacatgcatttaaaacaaagtattttcactataaaccattgaccactgaagaaaatgttctttactgtagaagtatagcctgagattatttgattatctcattcatactttttagcactgtaattccagtagcaaccgctgaattctgcaattgcactgattctatattgtactttaggccagctaaatctgaatgctgaactatttaaacataatgcatcgcagctctgccagagcagacttaacagcatgttttttaatttggttctggtatccaaaggcagaaatatgtttccagtgataagtgaaatttgccatgagcatccttttcaatagaattaggtgatgcatagggtttttactttgaaattctgatgaatctcttctcgtttttgcactcaagttattgttcccagcaaaaagctttaggaaatgtaggacacatattttcagtgttgttttttaaatgcctaacggcaagtatactggcaaatctatataactagatgtgaggacaaagtggagataatatatgtctaatcatgtggtgctttaatgatgggatttgttagcatctctggcttatttgttgatattgtttgggtaagtgggactgactataatgaagattataggatgttctcattccttgaccttcagataattacatattatctatgcacagcatattttaatttatgttcatactgtgttctcttcaagtgatgagagaaatgtacagttttaaatcttatgcttattttcatattgaaatggaagaaagttaggctgaggcagtagcatagcactgagtgcacctgcctaacccattagagctttgtctctaccactggagacagattaggagatagagagaaaggcggaggaagggaagaggatagctcagagcttattttaactgcttcattcaaatgggagaaatggagtattataagacataaaattttccatttcaagtagccacaaaattagttctactgtttcaatgcccttttttttggtctcatttgacatacttgttagctcttcttcctttacaaaaattccaagactgtagatttttccaatctttttttttgtttctatgagccaaatattttgatggaagacaactgactgacaggcatgttttgaagctttctcaccttggagaaacagtaattagtactgtgttctatcattaaaactatgaaaattgtttacttaatttccttttaaagataagagggctgccattcactgagcaacaatattcaatacgaagcaatgcttttaccttttcatcatgacagtcaattttgcaccaattatcactgaatgtgtggctgttggcccgtgtggagcttaggtttctgccctgctatctgacttacattaggtgttaaatatgctttgtctgccctatacatttttactttttcattatgtattgatatactcattaaaggtgtttcctcatttaatgcaaataggatggtacctgtcacattataaaaaggttttgtctttataaaaagccagtgttcccatctgaaaagtaaaaccagtgttaaagtggaaaaatgttccgtgccacatgtaagatataggaggattatagctaaattttagtgtaaagctatgttttcccctctaactaactgctcttgttcttttatatgggatttaaacaatgaaaaagtgagctgtgagaaagagtcatcttgctaggaaagggcattaagagatgatgatgcaacacacagctatgtgtcagaacctgtttctaaaacaagcaagtctgactttgcatcattaattatgttacaattagtgttggtcaggaggatattaaggaaaccacaagttgatgttgtaaaactattgtttgattctccacacatacttagtataatgtccaataatagacagctatatgagtattaaaggaatagcagattgagtaactccatgttgagtgaacttttaatatgtatgtggagagcctagtctgtgtttattgctctgaaaggcaaatgcttgtcattgtaggaggggtgagggtagacctgacctatgggagctggcatgcatagattatttagtttcaaataacaaagaagattttatagtttcaaggtgcaatgaagaaatgaacagcttttgtgagtattgttaaagctgtcctactaaattattacctagcacactatgctggtgatatagagaaaaacttgcatatacctattagcatatgcaggcactcatgagaaaaagttactcacctcacattaggcagccacatttcctcatccttatgataatatgcagaaagcagtttacttctaattttatgataattttaacgagtacttttgaaattgagattttagaacatgactgattacaattttcacaacatgtgaggcattgagcagtttcagaaaaatctcaatactatagaataaagtggttatatcgactatatctacaggtttgtagacttaataaatataggaagtagttgaaagttgtagtacacatgtcaatatatatgcatttatagtgactgttgttggtttttttttaaaccattattagataatttttcatcaggtccttttcatccatgggatggatgtggtaaaagatgtgaccaaattattttctccatgcttctcttgactaatgaatctcatgtatttctgtatgtgctttagctaaatgaaatctttttcaatccaaataaatcattaaaaggtcttcaatggtccacattttagttgtttcatggactatgaacctgtcttaattgttaacacagactctcattctttttttttggtcccatatctatgataaagaaacaagggacaaatataaccgctgtcttctttggtgggaggaaataatttatgtcaatagcgtatctttcatttcagaggactgttgtagtaccaaagaagacttttattcatctaaataattgctgcttataaacagggtgttaattttttttaaagaatttgcttctcttttttgaagagtctgaaatcatttggattgctaaatcatttctctttttggattcttatgaaatcatttacttggaagctgccattatatttttgtatcttgtgatatctcactaagccaggatacttaatgggctttcagttaaaattgatgtttgttttaaaacactagctgaaaaatttaacacatcttgatgataattactgttatcaaatgaatattattcaatggtggattagttgttttttgtacactgctcaatatttgatcagataactgatttgacttatctttagattttaacatagattatgtttatgttgagtttcctgttgtttccttaaacagaatactgcctcagaaattgtcttatctctcgaaattctgaaccgttttctttgtattatgtgcatttttatggataaagtatattgtttgtcttcacatcatatagaaaactaatttcatacttggaacagtagagtgattgtaatgcatgaaaagccaaatcataattgtttccccttagtctttagactatagattttgaaatgtggcacacattaatatttgtattttgttttagtctcaagatctcaaacattaaatgtgttagtataataagttagtcactaatttattaaacactttccttttgcaaaagcttctgattactaatattattgctactttttctcacaccaccacccttcttcgttgaccactgtatgcagatagttggaagtaaagttctggtaagtacaagacatgttgtgcagtgaacttttgttttggggatttgtgactgttgcatgtaatatttagggtttggtgtttcatttgctgtatattgctgtatattcttacaaattattaaggtaaatattgagatcaagtaattaaaatttagctatgttaagtggtttcttatagttttggagcatgtttaagaagtttgtttttctgtcgcccataccttgggaattatgttaggtatcttgggtagaattgtgtgtcacatgtctgtttctcaggatggggccagggtcctaaagcattggtcttctggttgtacaaatttttgttattatgtcttactttgatatatatatcacactgatgaaagaaactgaggcaatgacctggttttgttggatggtaggtaatgcctctgattttgggggagcttcagatatatgtatttaagttgaaatcattatcttaacttatactttaaggttctttttgttgctatgatttagagattttatacttagggtattacatttttaatacacccctgtagcaagccagacatcacctgcattgtaattcaaagctacttgtaattactttcactccttgagtatgtatcatttatttggagaatagaattagaaacatctttaaagtcacagagaaatgaagtatttagcatagagaatgtgtttaatatttgctttgcttttgaaagttctcttctttttttcttcctttccttcctctcagtggaagatgttgcacatgtttgcaagaacatgttacttccttgcacccaattggctcccaatttccctttataatctcacctgggcttccttaaaatacgatatgcatatatatatatatatatatatatatatacacacacacacatatacacacacacacacacacacacacacacacacacacacacatatatatatatatatatatgtgtgtgtgtgtgtgtgtgatgacacatgtgtacaggtcagaggacatcttgcacaagttacttttctctttccatcatgaggttttaacttaggttgttgggactcctggaggccagcacctttacccaccaagccatctctctgaccttattcttcctttaagaaggcatcttcaggtgtgttcctgtctttatctgtacacttggcagtgcctaaagaaactttcctttaatccttctaaatcaagcatattatacattttaattagagtattcttttcttctttggtagcctagcaagtacctaagtatcaatcttggttaaccttcatgttgctggtgaacttgtcccagataagtgcttctatcccatagcatcctttctttaacattttagaagaaatcttttacatgcctccttttgccaatcaatatagcttctgctctcaagaaactaggtctaaaggggatgaagacagatgacaacagagaggtatatagaacagagagaggaccaaaagaggctatattgtcagcgttgcaaagtgagagaccagcaactgtgtgtggtttctacagtgttttgaatggtaatgttttttcataagtgctaagtctagatccagagtacatcttgtttcatggtcattttctgatctttcatctgtttctcacatttgagctgtcagcttctgctacaaagaagagtaaacttaaggaatcccttctacaggaaataaggaaggtttaatttagaggtaggtgggatgctttatggaattttttttgtttatattctattttgcagcttaagagagagatgaacaaacaatgtataaaatcaccccagttatacaacagctacagaagggcttattgtgtcatgggcacattaatcttcaaatggtgggaggaatatttttacggataaaataagcaggtagaaatttcgtagaggtgctgtagacagtcgaattttcaaataactaatttatgtattgtggttacttagagattgtagcattagttaaaaaaatgagggctggaagagccagtgaaattggaaacatggaatatataatgaagtaggtctgcctggccttttcccttttgtttctgtaacgctgattgcaagctgaaataatagcatttgagattctgctgctgatttctttttttttccccccacgatcagtactgcttttcaattttcatatttacaagctttactttacaaagcaaatctgaaagctgcctgttattgggcatagctacaacttcatccccaggttatatggattctggctttgtgacttttctgctggtatttactgcacagcttttgtgtaaagcctttcttaattctgataccctaaaccaccttctattttcaccttactaggattcctgtagctctttctcttacatatgtatttctttcctatttggtaatttctgtgaccaaattcctaagagctttttaaaaaatgtcattccaagtttacattatagtaatttcaacacttgaacagtaacctctatcattgtttggttctatctttctgtgtccacaggacagatctataatttctagaagtcacataagcaaatgggtttagtttgagactacataggacctgtgtgatctttatttatagatcatatatgaagctcagatttcccattgtgagatgaaaataccaagttcaggatagttttagtggactatttatatttgatatttttaaaatacaaataaacatttcatttatatgtctcatttattttttcattcaatatagtatcttttaaacatgatttgaaaaacataaagcataatgactacagtgtaaactgaaattaagaccataattttttttctttttgttcagtatacaaaatgtagattcaaagatagaactacaattatttctgggtcacaattcctgagaaagattttgctgaacgttagaagaattctttgcttctgttttggaagctgtgtgctacttgttttggattattgctgggctttgaacaaaaagtaaaacaacaacagaaacctccaatgtgtcaagttaacattgacacatttattttaaagagacattaaaatagttaaggattttgtatagattctttctatgaagtgaaaaatgacaaaatgtcttctattacctatctgaaagtatcaaaggatttagagtcaggcagagggagaactgaatgatggctgtgtgtgtgtgtgtgtgtgtgtgtgtgtgtgtgtttgtgtctgtgtaggttctcaataattgtgtgtgtgtgtgtgtgtaggttctaaataagtgtggtagaacattgtgaaccaaaatagtttttattgtttagtaacacattgcataaaacagatttagaaacagttaaaatgattgatttgatttcattgcaagccaggaatagcttatccacaaatataaaagttagctttctcatatagggaataggaacaattgacgtgattatacacgatacattaaaaaatagaaatgtaatgactagaccttacaaggttaaacataaggcaattaaatataataaacaattcagtgcctagggtagcaacagaaacattagaagtgtttgttttacctatgaaaagactagaattcaaatggctctcttagggccaaacatggttttacaggcccagaatatggaaggcagaggcaagcaaatctctttgagttcatggccagctagaattatgtaatgaggccctttagcagaaaaaagtgtaaatttgtgcattcattcgttgtaactgggtagttagagacatggtcctatgcaggtagccaaggctgtgcttgcactccctatctttctgcaatgaccacaagcgctgctattaaaagcataccccatcacacctaactgctttttttttttaatgcaaaatttctaggtatctgttatgtcccaggtgctatgcttggtttttttcaccagagcctctgtccataatgcatgacttcgcatagtaatctagatacatattcagtgataatgaaataaaatagatgaaagttgaaaaacgagtttttccctttttaggctaaaattggggggagagaactaatctcattctgattctgtcttcccttttcaaatatcagtgttctaacttaaaaaagaagggaaggaaacaaaagccttgaagtattcatatagagctttgccttcaggctccatttaaggaactggcaggtcattctttctggtgagtcaactgtttccaacctttcttggcagggcctgtagaaaaccagtgctcagaaccaccatttaaatgtacagatcttaatttccagacctccttgtagtgctaggatgataaactatacaggtagtcctcatggagctaacattttagttggggaaacagacagtaagacacatatcaaatattatgacaggtcttggcaagtgctatggaggaaaacagtttaaaaaaaaaaagagcaagatgagaaagcagactaatccgcagtgtgctgttttaaacaggcaagctctgtgagcaagggatgtttggacagagaactcagggaaaatggagagagccgtgtaggtgtctgggaatgagctttgcagccacagacactgtcaagtgcaaaggccttgaggcagcaatctgtatggagtgttggaagaatagcatggaggacactgtgggtagcatgagatgaacaaaggacagaaagggccatttaataaccaatgccaatagctagttacagtgacagaaatatatattaagcatagttagcagttccaaggcttggaaaggtatgctgtggtcattttaggagagctgaatgaaggacatgccagttgaatagttactgggggaccctgaatatttttcaggcttagaataccagaatcagaggtttctcctgtggagtgctcatatagcattagattttggagagattagactaaggaagagagatcaagggaggtggtttctacagtggtctcaaatgaatttgaactggggtgtgtggttattaggaactaaatggaagatatagatgagagaacaaggaagaccggatgtgtactgtatcagccccagtaaaggaataaaaagggcaaaagagatgtgtacttaaataatgacagaaatttcaagcatggctggctaaaatgaccctagcattcatataaaagtcaagagccagaccaagtttggagtccgagatgatgagttcagttagacacgtaaatcaaggagaaatgactaagatcacaaaagcagaagtaaagtctgaccatgcgaggacacttctttagttttatagcattcacagtttgatttttagaatgtagttcactgttgcagattactgcttttactatttaaaatatcctctctgtacctcgctgatgagaagagctcacatgtcatttgaatatctttaactagcttataagctgaagcccagacatctttactaagtcagcaggctttgtgtatatctcaatgactgagtgggttggcatcgagaacagtaattcatattgcatagtctggagtgttgtttttcagataggcaatcttaaatgtttaaacagtcccattttttaacctttgtaaatgatcacagtctatagaacagactcatcatagtgaaggctcaatagaggtgttacttttatccctaatcaggatgtgagaaccacctttactaattgagtggtccacagggtttttattccaaagtagagcccagtgggtttctaggatcaggatgataaagaaagtaatgccaaggagacaaaagtaaccataggaacttgaggccaagcctgcatcacacggtgaaaccctgtcaagagaatgagatggccagtttcaaaatgagcccaaatgttcttgctgtgcacctgaatgtaaaccatctattactagtagtatccagaaaattacactaagcatggcagtatgtttttatgtcttgttattctatcattaaattgcattttattagtttattaacagtatagtaactcaatgattacttcatgctaatattatactcatgtcaaaccaattatttgaatatatcctgtaatgaaagattaaatcttagttttccatttttccactttctataattaggtaggccagaagggggagacaaaacattgaatattggagcttgaaatagtcacttcatgatgataaaacattgctttctcgtaccccaagttgattgtggttttctaacgagtagacattttagaatatttgctactgtaaaagatttagttttgatggtggaaacaatcttattaaaaaaatctaaattcaatcagaataaaaataatcaatgccattatttttaactataaagtagaaaaactcatttgttaataagatgaaaagaagacccgggtctattgaatggtggcatatattaagaggtcttttaaagaactgcacaaacactattaaaatactcattttactcttccctaattttacattcattagggaaacaaccagctactttctcattttctaatgttttaacagtatgcaagctggcttgtgcattaggcttgttttagataaggatgtagagggtctgggaacctggctcagtggcaaagcatttggctagcatttggttataaaaacaaaacaacaaaacctaaatatcaagccaaggatctcatcatttattttgaaagatcttatttaaatctatattccattttagaatagcttctaacctattcctatcatggagaagcggctgcattctaggcaatgcaggacctctctgcacctgctgttctgggggcccagagcaggaggaacccttgcgttttgggagttgccatattgcaaattggcaacattcatgcaggtaaacacatgacactgtgtaactttaatgggagggaaagagtgaaaaaatactgctgcattagggttccaaaatatacactagaaacaattccatttctaactttggcctataatattttgaagccagtttttctatgcttaaagagataaaccattgttcctttgagttttatatcatccatgttcacctttcctatgcactcttgccttttataattaattccaattaaacattagctttgtttaattaataatatttaattaaaatgcttataagctctcagagggcaaggaccatgtcttagtataccttagacattttcaaataccctaggctgtaacagcgttaaataattaggatccctctgttgaatcactacattcttataacttcactgaagttgaactgcatatgaactgaaattggaagtctgctagttattttataatgcttctcaaaaacagtccttattcttctgagatgcagtccaacatcataaaatcttttttttcttagaataaaaataaaagttttaagtatgtttcttctttattacttttctacattgacaacactttctcattatcaccgatgagcacttttagagcacttgaaggtttcgtggttgttcaggtttttctatttcaagttttcctgctagagctgtcatttttcactggttctcttccttccttccttccttccttccttccttccttccttccttccttccttccttccttccttcctctctctttcttctcttttcttttattggtagaggcacagtctatatattggggcctcagaattgttacgaattcctttataacccaccctgtctcaatgtatttttctcattttactcagagtgtaggtgtgtctatgcaaataccctccttcctcagattagataggggtgaagaatactgagaagggtccaccctccacctcaccttttcctcattatctaacattctcccaaaatagctgttcatcacatcagttagaagcaacctgattgttccctttgaagtttgctctgattgtgtttgctcacagcatgttgtatacagtgaatcatacttacaggaaacctagtatacaatatgaatgcctaatgcagaaattataacagttgaacaaaaggatgcctaattttttaatttctgttacagcctagagtatataaatatgtcaaatgtagactatgacctggcccctgtcttttgagagcttatatgacatttatttaaacattactaattaaagttaatgtttaactgaaaaaattataggccttggacttgaagacctactgtttggatcagggatctactttttatgcatgagtgacttgggataaaaggctaacctttctttagcccatatctctataagtaattttttatattgatagagttatgaaacatttgtaaactgtcaaacaagctatgcatttaagccattacagtaataaccagttaaggagataattcctatggtagttcctaatacatatttcaaaggaaatgtgttgagccacaagtatggctgataatgcatttatacattcatttcattacttaatgtcttctttagaagccaattatgcttttatcctctgcaaaatcacacatttttgacattgctccttggctaaagattgtatttactgtcagtactttatgaaaaggcataagcaactgtgggtgttatccttaattttgtatccaaatatgaaaagatccatatttaagctgttcatccatggcatcatttgtttgctgactttgaactcttttgcttatacatactttataaattaggggtttgataactttctaaaactcaatcatagaaactgagcagtgagaaagattctaacagagtaatttcagattgttggtagtacttaagaactttttcattgtttaagaagaaacataagtataaatagatctacattaccctccccccgtctctctctctctctctctctctctctctctctctctttctttctttctttctttctttctttctttctttctttctttctttctttctttcttggtaaggtcaatgtaattgtgatgagaagaaggggaccaggaggagagggaaagagagctgaggaaatgaataaaataaaaatgaaatatactgacatatatgtaatgaaactcactacctttttgtactaacataaaagattgacttaaaaagaccagtggagtactgactagttttttgtttgtttgtcaacatagacataccttggaagaggaaatagtagtgtagaatagtagaatgccctcatcagaatgacctccaggcaagtctatagggcattttcttgattaatccttgatgtccaagggttccatccatggtgagcagtgctgtccttggtttggtggctctgggttctataagaaagtaggctgacaccaaacccagacaccattacatatgtcagcaagattttgctgaagggaccctgatatagatgtcttgtatgaggctatgccagtgcctggcaaatacagaagtggatgctcatagtcataggatggaacacagggcccccaatggaggagctagagaaagcacccaaggagctgaaggggtctgcaaccctataggtggagcaacaatatgaacgaaccagtacccccagagctcatgtctctagatgcatatgtagtagaagatggcctagttggccatcatcgggaagagaggcccctaggtcttgcaaactttatatgcctcaatagaggggaacgcaagggccaagaagtgggagtgggtgggtagaggatcagggttggggagggtacagggaactttcgggatagcatttgaaatgtaaataaagaaagtatctaataaaataaaattttaaaaaaaggaaaaagaaagtaggctgggcaagccatagggaagaagccactaagcaaaactcttccatggtctctgcatcagttattgcctccaggttcctgctctgaatgagcgtgtgcttcaataaaggactctaacctttaagagaagataatcttcttcccgaggttacttttggtgctggtgtttatcacaataacacaaagcaagcaggaataggaattaaaaataacccataatcctatataccttgcataaaggtttatatgtttatatgtttatgtgcagttgtttctttgctgcatattatgttattaaaattgcttacactaatttttgttgatgcacttttctttcagaaatgcataattgattataataccataaactgatgaagataatttggtaaattaaatatttgatagcaaagtcatattttaataaacccaggtacccttagttcccttaattacagttcctaaaaactcaacatcagaagcagttttcaccttgtgtggttgtggtaggattttatctttacaaaacttgagtatgtgaataactgtggttctttttttttttttttaatgtatctacttatgtagtttgagaaacctgatggaaaattatccatgctctctagcccattgttggattaaaataatatacattgctatcaagatgtgaagtgatacttagtgtttacttttgcaaaataactgtttatagtgttttttttcacacttacgaggcaagagtaacttagaggcatatctaaaggtatgtgattgataagtaggaccataaatgcagcaaagagttccaccaaatttggtaaaccctgcttttcattctttgtggggagggtactgttgagttactatttcaaaggaagcaaggtttccatttggaaaaattacttgtattaaacatttgactaggctgaaatagcttctaaaacagtttaatgtttttgtttttaaagtagtccaactataagatgtcatatcagattgtatgtgactacacaagtgaataatttttttgattcttaattttattttatttttattatttttattttttattatgtattttcctcaattacatttccaatgctatcccaaaagtcccccacaccctccccccacttccctacccacccattcccatttttctggccctggcgttcccctgtactggggcatataaagtttgcgtgtccaatgggcctctttccagtgatggccgactaggccatcttttgatacatacgcagctagaatcaagagctccagggaggagctagagaaagtacccaaggagctaaagggacctgcaaccctataggtggaacaccattatgaactaacaagtgaataattttcattttatttttgagttatcacatttcaggatattgattaaaatcacctaaatatttgttatatttcagcctttcatgcttaagcatgtgtcttagtcaggatttctattcctggacaaaacatcatgaccaagaagcagttggggaggaaaggatttattcggcttacacttccacattgatgttcatcatcaagaaagtcaggactggaactcaagcaggtcagaaagcaggagctgatgcagaagccatggagggatgttccttactggcttgcttcccctggcttgctcagcctgctctcttatagaaccaagactaccagcccagagatggtcccacccacaaggggcctctcccccttgatcactaattgagaaaatgccttacagctgtatctcatggaggcattttcccaactgaaactcctttctctgtgataactctgagctgtgtcaagttgacacaaaactagccagtacagcatgtatcacctaatagcaaggaacttctctgacatcagcagtgcatataatcaaactcaatgcttttttttttttaaatttacactattagggtacagctatataactagatcccatttttaaatatttttccagctattctaatatacttttaaattatagtcttagaatccagttgaagatataactttattgtttctattttcctcaacttagtctggatgcatttgggaagttttccttatcactttgacatatccaaagcagttatttggtagactatttcgcaggtttgatttgtctgtttctccatgattaaatttagtgtaaacatttttaccaaggatattacataggtgatgctgtgcctcagagcatctcatcatgaggcatgtaggtatctggctgtcccatcactggggttggcaaagtgtcccttatatttgaaattggtaaatgatgaataggatgatgtcttgagatcatgtaactaccccattccttagcaatactttgtatacttttcatatctgtggatgaaattcttgctctgaatctattattacttggtttgttacggaatgatcttttgattttgtctttacatctgtatttgtcatataacattcttctgtataaataagcattattagctttctcttcctgcctgaattaaaaaaaatgaccatatgctctcatagattgttcatttaaatttagttcattggcacaacttgataatatgtgaatgcctttcagttttttcttttttctttttttagtaaaaataacatgtaagataaagaaattaaataattgatcatgctcatgtgttagtgtacttggtccccagctagaggcattgttttttaatgttatttgtgagataggacctagctagagaaaatgccttgcttatgagggttgggtaggccttatgggttgtagcctgaggtctctacctcctgatcatagagagatgagcaagcagcttcctgctttcatcaccaaggacccagccaatttagttgcctactccaatagattgtaccgttttaatccatgagcctaaataggtatttcctccccgaagttgcttcttttaggtattttgtcaaagcagtgagaaaatagactagaagagagaggggtattataaacacaaatatatttacatttgtctttatgtatatatcagaatattaagaaacaaagggctttatagggcaaagtcacaagacatagtctctgtaagagttaactacctataggaatgacacctattgaaaaaaattgactcctagccctttcagctttgattctgaggatggatacacttatctggaaatagttccttcttttccatctatgttatgggccttatgtctgtgcaacaataaaagctacttataacttaatgattttgaaagctattgtgtgattataagaccctataatacacactggtcaagcatttgtccctagcaaccatccatctgtttttgaatgtcctagagtaacatattcagatcactcgcaattataatagtgcattgtatacagacagatttatgtttcagcctaacaccttaaaatagatgtgttggaatgcaagtgctttttttattggatattttcttcatttacatttcaaatgctatccctaaagtcccctattccccccccccccgccctgctcccctacccactcactcccacttcttggccctggctttcccgtgtactggggcatataaagtttgctagaccaaaggtcctctcttctcaatgatggccaactaggcaccttctgctacatatgcaactagagacacgagttctgggggtactgattagttcatattgttgttccacctataagggttgcagaccccttcagctcttgggtactttctctagttcctacattgggggctgtcttagtcagggtttctattcctgcacaaacatcatgaccaagaagcaagttggtgaggaaagggtttattcagcttacacttccatattgctgttcatcatcaaaggaagtcagggctagaactcaagcaggtcagaaagtaggagctgatgaagaagccatggagggatgttcgttactggcttgcttcctctggcttgctcagcctgctctcttatagaaccaagactaccagctcagagatggtcccacccacaaggtgcctttcccccttgatcactaattgagaaaaatgccttacagttggatctcatggaggcatttcctcaactgaagctcctttctctgtgataactccagctgtgtcaagttgacacaaaactagccagtacaggggccctgtgttccatcctatagatgactgtgagcatccacttctatgtttgtcaggcaccagcaaagcctcaaaggagacaactatatcagggtcctttcagcaaaatcttgctggtatatgcaatagtgtcagtgtttggtggctgattatgggatggacccctgggtggggcagtctctggatgctccatcctttcatctcagctctaaactttgtctctgcaactccttccatggatatttcattccctattctagggaggaatggaatatccacgagttggtctttcttcttgattttcttgtgttttggaagttgtattttgggcattcaagttttctgggctaatatccacttaccagtgagtgcatatcaagtgacttcttttggaggttcactcaggatgatatcctacagatacatccatttgaccaagaatttcataaattcaatgtttttaatagctgagttgtattccattgggtaaatataacacattttctgtatccactggaatgcaagtgttttatcttcctagaatttttttctaaaacatctcactttctactgaatctaggtagggaattattttgctttattgatctgctttctggcagactttaatatttgaaccagttttttttttttttgcaaataatgacatagattccataataatagatgcagaattttctcatttgaccaaagtaatagagaaatgggaagagtacatatatcattataagtaatttgttcttattaacatgataaaatccatattacaacctaacaacctcattgaatttatttgtacattgtctagtagtgggagagaaacaactccactaagctgctttttaacctccacaggagtgcctcttcctctctgtgtctgtatctctgtctgtgtctctttgtttctctctgtggctgtctgtctctgtctttgtctctttctctcttccctcactttctcccctaccgcctcgctcacaaacacatacacaaaatactcatacacaatttgctctgtgatttctctttgtagatgaatggcatgttgagtagcatgtaatctagtactgtcacctttgatatttaggaagaagttcttcatccactaaagcatgtttaaaacccatataaaagagcagtgtaattataagtacccataattaaacaaatttagtaaatttaatttcattgagtattaatattttaaaaatcatgttgtttgaaaataatgaagtagaggtaataatgcatcaaaaccaagcttaactaatcactttacaaacctccctgaaggggaattgtctatgtcaaaagaagatgtgatagacatgagtttagagaataggagatatgaaattcctgtggaataaattaataatttcaaatagagactttggaaatactagctgtaacatggctgtgacacttgtgtaaatcggcagaaccacggtcagatgactttagatgatgagtagcagtggttgagaatagacctacctcccataggttagccctcctgacatgatcagaacaacatacaaaattcagcatgggtgatggagtggcagatacttaaggcctagcagtctttacatgggaggcacaagccaaaccttagagagtttcaggttcttttgggagagagagcagaaagaataaaaaaaatgaaagaatgtatctaaaatagtatgagggtggactagatttaatagagcaagcggaggaggcaaagagaaagtccttgaatgctacaagggaagaagtgaagacttttgaaagtttgaagaaacctgagtgtttttgaagactgagttgaagagaccaattgatcgaagataccattgtacccagagggccctttttacagaaaggttctaaattctcctgttgccatcagtgaaattgtacaccattccttagtatataaaagagaaaaagttagtgagtgtggtagtcatcaagaatttggcagctgtaatgaattaaatagccccttgataatctctgaagaagttgatgtctgccttcaagtgtctacctgattaccagagagtaattaaagtgctgcagagacaggggccttaggtaattaaagactggaattagttatatctgtgtgaatagctgtgattgtaagcagattttctgagagtaaccagtggcagatacaactgataaataataccaatgtgtatgttcaatgtattttagttgcatggttatttaaccaaagaaatcgatacttagaggagatagcagtgagaaggcaccaagctgaaagccctctccctaggttgtgcgtttgcatctgatgacactgattctcttcttttacctcagtcactgtttaatgtttcttactgcatactatggttcttataaaattaagaagaattgaaaaggtgacggagaaatctggccaattttgtatatgttactgttagtaaattgtcttttcataatttccatgccaaattttggaaaatgtaataattgaagctagaatgcaaacagtagcttctgtaataaaataaatttttattatgtaccatgaggtaagccttattgcttcctttgatttatatgcaaatatttctttttcatatagtttacactgctttcagctgctattttggattttcttgctttagactgtctctattctttccatgattgccacaataaaataggcaagggagaaaaattatgggtgcttcctggctcagtttgtggatttgtttcagtggcaggaccaatcttttaggaaaccactgttgtcaatgtcatgaatttacagtaaacctgtggaatttacatatataaaacatagatgtcatgctggtgaattcaacttacaagccatggaatagaactcttgcagtgaggctattagtttcaggtaatttaaatctcagtgggaaccaagaaatggattttgaactaatatattttttgaaatcctcaaagataggagattgtaatatttctgtgtaaagaaaaaaatctgtcattttcaagacaaagaggtttaaatttaatgaagtgattaaaagtaatttcaagatttatttctcctctataaatattatttttttgttggtgtaatggaaatttgctgaaaaattaggcctgttttcaatataatgccaaataaaacgaaacacatctttaaaggtaggaagctttttgtattcaggggactgtaaaatgacatgtttttgtggctatatagcccgtcctcatcagtcttttattattatgatgatgatgatgatgatgatgatgatgatgacgatgatgatgatgacggtagcacctgctttcaaagggtatatcatactggcttttgtaccaggtaaacttttgtcttgataaattgttgtttctaattttagagctgaaaggaaatgcacgactgttttaaagtacaggtagggactgtaatcttgtggatgctgttgagtctgcctctcaggtgttgccgttttggcactttggcacacatttgttttctatcatctatgggatcaattgttaagatcatcagtcacatgctcgttggctgtgctgttgcttcacctcttttaagcttcttacacgtgtaatttggaattataatgatttatttactactgtatctcattgacggttaggattttatttgtattcttaataaattctgcattgggtttttgatactttcattgatagctgatacgtttcagcaaaactcacaccacatgcagtgaatgagcctgatatggcttacagtttgtaggaagataacatctttgttattatccaaagagacccatgtaaattgtgcgattgagattacatgtcaggaacactggtaatgcccatcatggactagttttacatctgacaattccaagaacacggattgtcgatgtgtgagggttcttttagtactgcagatccatatgtaacaggactgtatatttttttctttatcaccaaatagcccattgttaacattgtaagtatcggatgattattaagattttgtatgaagagtcagcatgaatttattgttggcatacctttccaaacctcccagtaatatctaaaggaagcattttaagagacatatcaaagtgtaaatgttattatttcatatgtattcaccacagacccacatgtatcacaggtatgagtattaactagactgtcactttgggagatttgttaaaagggcttataagagtaagagtgctgagattggatctccaaaggcagggtggtaccaaagggggcttctggtgagagggatttctaagggtggggcagagaggggaggagggagggggctgcaatcaagatataaagtgaataaataatataataacaaaaagattgaggatttagctttaagtgttacattttgttactgtaggctgatatatatatatatatatatatatatatatatatatatatatatatatatatatcaaggggaaaagccaagccctaggtatgtcctagcagaatccatggctagatagccttattgtcttccccttgagagtggtcatgtacaaaggtcttttcctccagtaatgaaaaaaaattaacaatccatgtgtgaccttcatggccatggcaggccagtagaaggtcagtacccaagggttttttgtttttagttttggtttttgtttttcaaattaacactgttctgggcttgagagatggctcagaggttaagagcactgattgcttttccggaggtcctgagttcaattcccagctaccacatagtaactcacaaccatctgtaatgagatctgatgccatcttctggtgtgtctgaggacagctacagtgtacttacatagaataaatgcatacatttttttttaaagagtgctacatagtgacttagtctagcatttagaaaaaatacagactattcaatgtggaacaggttttaatcttaaaatatttaaaacacccatagtgatactcaccttattagccagaatactggggattcactctaaatccatgttcccacactctagccaaatataagcaaaccttccatagaggatagctttaggtttattttacgaactttttaggccagcatggctttgtgtgcctactagctttgctaagaaaattaaactgtaatgtatgccattttttaaaaagtactttaaactactcatatgcgtaatctttaaacagaaagatgaacgcctctcttatttattagaggcgcctctgatgctttgatgatttaagtacctgttcattgacttgcgttattgctgaattccttagttaagcgttatgagtatactgaacatacctgacttcccactgccctagcaaacgctttcaagcctgctaaaaatatgcttgcttctactccatgtcttcttgcaaatagtcagctagacatactcttgctggtagtttttatggagtcatataatattatactgacttttattcagacttcaattttctttgttttggttgttgagtagggatattcaaatgacagaaactatgaaaacaataaaggaaagaaaaatagagtgttccagaaagtcttggcatattgttataattttataattttaaatatcacatatcctacatcctacacacacacacatccatggtgactgatagaaaaagcacctttgtttcatgtttcatgtggtttcctgtgctaacatgtttgctgattttaaaggtttctctcactttgtctttacattaatgctttgggaaagacaattatagcatttccattttccccatagacccccttcttactaccaggaactcagtcttcaaccatttatagtgttgtcagcctttcctctcccctcccaaattaaataccggaaatgaagacacttaatgtgtcttggagagttgtgggtgtcaattcaacctttcacagagttaatgttatgttttgaaaagaaaaacaaattgacaggaagatgtgacaggaacaggagaaggaagaactataaaaaatatagtagtctttagttattttgcagggagaaaagcagtactccagtcttcaatggttttgaagggcatcactctattattacaaagaatagaaattgatcttgatgaggtgccatcaaggggatattcattatattcttcagcagtgcagcctatgtgtaatccattttctaaaagtttccatcaggattgcttagctcccttccgctgtatttaatgaagtattttccaagtacagagcatacacttatggatcactttttgtagggaatgaaagaaccattgcacttggttcttcttatgcatgctcatggaaaaattgctatccttgatttactcagaacttaatatcattaaaagcatgaagagtaattatgccaagtgaatacagtaccagaaatatttggtatgatttgggacataatattcatgttttccagtaacctcacacaaatatttatgagatttattttcaaatggaataactggctaccaataagatatatattattttaaaaagtttcattttcatgaagaatggatagcttaagattttcgggggaaaagaaggaaatgtgattcaggagataaagggctccttaatcctagtgctattcctcaggggagggaagatagttttttatacttgcagagtgtctttagtctttggttatctggcagttgactttatgatctgggaggggaatgatgcctgtttcattatacaaaactctgtccctttcacagcctgtctgtcaggcaactctccaataatactttctgactttttactatgtggtttagggattgtgggaaatacacgtttttcacacatgaatccctcctatcctcattgtaagtaatcttacaagatgatcatcgttatcttcagttcaagaggttcaaatttatagaagataattaatttgtccaaggtcagctgtgcctgacagtgatctcttaactctcaattgcttcacctgtatatactccccaggcactctagtaggatagctgctaggcttactccatttactataggagcttgggatagttatttatggatgttagaatgtgcaacaaatgcaagctggctcctttttcttctaggaatttctagtagtggaagctccctgtcataaatgaagtgcaaacctattatcccttacttttaagcacagagctgtgaaataagggcttgtttgctgctatttactactctccatggttttcttgctgcgttctctccgagcaatacttgattgctcatttacagacagggagccagcttccatgatgctagaactcactgtcattgttgcttttgctatcttagtggtaataaaagctagaaagactcccccacccctcacacacactcacaaacaacagcagtgtgcaaggttttctcttgactccatccttctggccaccgtttccaaaggggtcaggaattaatacttgttttaccatagtacatgttttgattttttttgtttttgtttttggctgaaatgtattgttctgtgtagacttggtaattaaatattttggttaagctattttattgggaggatgtcccagtgcttttatttttatttgtttgtttttaacttcagctgacttacaaacagatttaaggatataatcctcttgtaaattgggaccacttggataacacataggtttggggatactttttctatcatattggatggaatattcttgataatttgaatcctttgatatgtatgaaagtgtacactgcagttagtttaacacttcagttgttataaaaacataatttcaatagtatgtaaatttaatgtaactttggagacttagtcttagtttgttcatttcaatgttaatttatttatttaagttttagctattttaaaataggcctgtgtgtgggggcctggtaatgtttttttattttggtatcattagattttgaaatgaaagtgactttaaactaggctccaaggaggtgttagttaaattattagtaatgagtttggatgctttgaaaaaaaagtatacttgtcaatgaataaacataatataatgtaatcgaatctctttataatgttgctgctacagggcccactacctgttatgcaaactaattttgctatacagtgatagtttcatcagccgtaggatttcactgaagatactaaaaactctgttcttttcagcaattgtaatccagtttagactgtatttcagcttctgttaaaggaaagcttccttgcaaacctggttttgaaactgtagaaccactgatgaatagaaagagattgattgctctcacttgtcatccatttttattttacttcccatcatgtacagaatgatggatgctcattgtgtttgcttttttctttgtatttctgtttcttcactgaaaaagtcataaattaatatacatgttacactcatcttgtagagcagtaagtgaagaacctagaacttctgtatattacctttcttatctttgtgattaaagtcctgggggggggacacttatagagaagaaggtttattttggatcacattttaagatatcccttgtaatgggatagcatagcaatgggggcatgtgtagctgcttcatttcaccaacagtcacaaagcagaaagatatgaatactagtgtctcccttgtgttttccatttgaatcagttcaagaccccagctcatgggattttgctctttatagtcaggatgaatcaatctttgtacctcacttacccaaaaatcctcttacagatgcacagagctctcctaggtgatcctaactaagtacaaccaatcaaattgccagtcagagcatcaaacattattagcatgagtttgaattttagtactgtgagcataacagtattaaggtttgtgtttggatgctaattttcattgttagttactagcatattatcattgtctttttagaataatattcatatggtatgtaatttttcaatagtctagagtatcactgggtgttgagaatttggttctctgtcttcctaaaaaataaaacaaaaacaaaccaccatcacccctaccaccaccactgccaccgccaacgctgccaacacgaccacaaccacaaaacccagcagtccatttgacataaaggaagatcctatttggcttactttaagcgaatgaaaaataggggtggaaagcatgagagttccagagtttggttgcaggtactagggaaaagaagaaaataataatagtgtttaacagaaaaataacactctgtcatatggaaaatcgagacattattagatcagataaatctgtgaattcaggagaaagaaagtaagaggttggggaagagagtgcagaagtcttctgattcctaaacagtcaggaggcaaaatcagggggatcataaattcaaggtctagggtgctctttccagtaggttttttttttttgtcttatattcttccaaaatttctagaaagctgagaaatagtcctctgtcactttgggaactcatcccatatagtctatgaatatataattatcaagttaaccattttattattgaaagacaaagatttttttgtttctatgattgtagtcataaaaattaacctttttatttgtgtaacctttatttgtgcacccatttagctcttctttcacattttagtagaaattctaagtcgattgatattcctgtttgatgacttctgatgactactacaaaatgtatagtccttgctcatagcttttactttccacctttattagagaagtagaaatgaactttgcctagggatacttcctatatgtggtaaggtgtttcatttaatcctcgcattgttttttttattcagactcctttagagatgaaggacaggaagattagatagacaaaggaacttatgattttgtggaatggaatcagaactaaattcctgatctgatactaaggccctggtttgatgctacataaggatgtctaccattcttgtgttctattgtgagactccagtaatcattgcaaaacagtgcattgctgatacagaaagcatactattaattgaaactaatttctcaggaatttattttactctaatgtcaccctgtagccaacataatcattgaacatcttgctgagagcatctctgttctttgactaggaacttcagtgttctcaattgctagccataccatatgttattttatcagctagctaagtatgtagaaagtggaaaatttagagcagaaaaaataaatcctgtttttagccctaaactaggggattataaactaagatttaaaaaaaaaaaaactgtggttgggttattttgtacattgtctgtttttttttttctttctattttttatgttcaaaacatcacagtagggactctaaaaatgtgtggtagaaatggaatctaaatgtttagccaaatgtaaattctggtttagagaaaaagatgtaatgtatgctataaatatgcataggcatatatacatatgcctctgtgtatatgtgttttctgagtcaccttggactgctataagaaaatacaatatgttttgtggtttaataatagattttttttattctagaatatgcaatgtccaaggtcatgctgctagcatatatggcttgacatgtagactgtccattttttttcaatgcatcatcacataacagtgatgagaatttttgctatctcatattattttcataaggtgattaaatttcattatggctactctactcatatgacctcatcaaaatattattatttcccaaaggcccaaccttctagtacaatcacagtggggtttgggttcaaggtttaaattttgggaagacacaaacattcaacctgtaacaggtactttcataacataactaatgtttgagtatattaaaaaaaaacatatggtggactgtaaagtattttagtgccatgttttgaaagtcctgggggaaactgttgatataagacagctggtgagttacaaacacacagaaacaatatgttgttcatatatctgtctgtcataattgatccagacttctgtaaaaaaaaaaatggcacaaatgagataacatcattgacagaaatttattgctcacagttgtggtaattaggaagcccaaagcatgaaactaacaaacttttggttttagtgagggatcaatatgcttcacagaagagcccttgttgctaaatcctacacaaggtccatttcacgtctactataagggtgccaataccattcatgagtgctctactctcttgttataacccccttcccagtggttctcgcctcttagcattttcacatggggagctaggtcttaccctatgcacagtcatccaaacaatatcagtactttagtgctgagtatagcactagacacaaatgtattcagttaatgtatgtagaatggatgaattaaaaaataaatcatgaggccatgtgttggtagcacatacttttaatcccagcccttgggaggcagaggcagaggcaggctgatttctgtgagtttgagggcagcctggactacagagctaattctacgacagtcaaggctatgcaaagaagcccagtctcaaaaaaaaaaaaaaaataaccaaaaataaaataggctttctgagtttgctgtgaacttgtaggtcaagtagaaggaagagtgagtcagtttatttgctttttaggttataagtaggtatattcattgaaaaatgattgtagcatcaaaatgcagtgtatttaataatatcgtgtttgacaagtctctttaaatatgtagatattagggttacgctcatctatggattatattgctaatgttatcactaataggcagcaaaacaggagaagtttattttttttctagtttctgaaagccataagtctggaatagctataaggcaaacatccatttttatctccttcagcttctgctaccagataattctttgttttgtggatacacaattctagtttctgcttcccaattcacattgtcttaagctcatcttttactagtcactaaagcagtgtttctcaacctttctgatgctgcaaccccgtatagtgccccatgttgtgctgaacaccccaaatcataaatttattttcattgctactttattactgtaattgtgctactgttaagaacccagatgcccctcaacagaggaatggatacagaaaatgtggtacatttacacaatggagtactactcagctattaaaaagaatgaatttatgaaattcctagccaaatggatggacctggagggcatcatcctgagtgaggtaacccaatcacaaaataactcacacgatatgtactcactgataagtggatattagcccagaaacagaatacccaagatataagatacaatttgctaaacgcatgaaactcaagaagaacgaagaccaaagtgtggaaactttgccccttcttagaattgggaacaaaacacccatggaaggagttatagagacaaagtttggagctgagacaaaaggatggaccatctagagactgccatatccagggatccatcccataatcagcctccaaacgctgacaccattgcatacactagcaagattttgctgaaaggaccctgatatagctgtctcttgtgagactatgccggggcctggcaaacacagaagtggatgctcacagtcagctattggatggatcacagggcccccaatggaggagctagagaaagtaccaaggagctgaaggggtctgcaagcctataggtggaacagtggtatgaactaaccagtactctccggagctcgtgtctctagctgcatttatatcagaagatggcctagtcagccatcagtggaaagagaggcccattagtcgtgcaaactttatatgcctcagtacaggggaacgccaggaccaagaagttggagtgggtgagtaggggagtgggtgagggagcttgtagctgacttttgggatagcattggaaatgtaaatgaaataaatacccagtttaaaaaaaaaacccaaacaaacaaacaaaaaaagaattgttatgtaaatatttgtgttttctgatggtattttgggggtttcagaccacagcttgagaactcctgctttaaaggcttggtaagtactttccactctaactaatcagagcacaaatgtctctcagccccatgcaatctgcaatagttgagcttattcttctctagtagacatttgcccattctaatagagtctcatctatgtatgtgcagattgctagtcagcattatcttaagtagactcctgtagatatctacaactgtttttctattggggattactcttctcctgtacgatgcttcataaatccaagctgccttatcctccttggtctcttatttttttctttccagctctgcagtactgcagtactctgtgagctttgtcctcatctttcactgtgaaaagtactccttcacacaccgcccggatagctgtaaggctcaatttgtttcctttctctcagggatcacagtcctctgaagaagcctgttgttcaatgtctgaaaacagttgtttcatatagtttctgtgattttctacttgtttacagatggagggcttgtctactactagctactttatcatggccagaagcagaagtgtcttatatatcttttatcattgaatatggtgtgtttgctttttactttttacttaacacactgttgatttggtgttcatttgttccttgaggatcatactttaaaaagtatcctcttcagtaactcatgaacaatacttatatagcccctatctctatgtctctctgtgtttaattcggtgagatgattgtgcaagtgtaagcagttatatcatttcctggttttgaagacacctctatgtattagagaacatttacatgctgattttgtacgtagtctgtttgaagtaaaaagatcattacacttgtgacctactttcctttttccactggattttcttcactgataactaagtgttttgatagagtataaagcaacattttgttagtttctcaaatcccttgctatcctctttgcagaacgagaatttttactccttatgtcatagtgaggaatatagaatgtgaaagtataattgtccatggctcttaactgcaattttaatttgaatagtctcacaagatgcatttcttttcttctagaaataagtatagccccctttgagttcagagctaaaattaagcactcttttaggtcgagtccccaggacacacagtttttcattctaggtagcactgtctcatctttacatttcctgtgttgtctctgtagatggttagaaaggcaatacttcatcaggttgctgccagtactcctctgtgagatggttattaaaagcacatcctttcctcgccaattcagagtgccaggctttcactgatcttatatacttgagctcttctgacacaagggagaggatagctaaacggctctcaaagctgggtttatagcctttcatataatttggcctttcagtgaactaggtaaggtagttcttcatctttctctacctctctatcattaatgtggttgattgtcagagggagctgcagtcaaacaaatgtggaaacttttgtaatttatgtatagctctaaaaaggcaaagaaatgaaggattattgcagttggtgccatccccaatacaattaatatcaaatgcatataaatcctattagagatctgtcatgggtgaaaaaggaatatgaaaaatgcgtgacctatctttattagattcagttagagagagaccatacagagctaaggagctttacgaactgcatattaatcataaccagtcttctgagataaacctatttcttgtaacttatcaaagccatgcagaagattagccattctctttggtcaaggaatgttttacatattggtatgagttttgaatatcacagctttaaaaactgattaacagatattttaatattaaatatgtatctcattaaattatatagcttagataactattatcctgtaataccccctcaatagggagatgctctttttgtcagaacctcaacatcattgttttgttgcaagaagatactctagggagttgtattggagaccatacaaaagaaccttgttatagcaagccatagttaaattgtgcagaaacacttttttcttaaatctttatttgaagcaacaattgctagatgccagcaccattttttttttgaatgtcattttcaatttctgaagtcttttatctttttgagaaggaggagaattagctcaaggggatggttaagaccatcatgttaacacactgtagtactaaagatagtggatgtagaacagctatagtctgacaaagataattaagattgtatttttaaaatgacagaagagaggaagagaatttcataagattattagacttttagataacatataagacacaacagtaatactttggattttgtattatccttggaaactaagaaatgttgattgcaggttaagtgcccaaatgtattaggtgatgctgaaaataacatcaaagtatttcttttttttttttttaagatttatttatttatttatttattatatgtaagtacactgtagctgtcttcagacaccccagaagagggtatcagatttcgttacggatggttgtgagccaccatgtggttgctgggatttgaactcgggaccttcggaagagcagtcggcgctcttaaccactgagccatctcgccagccccaaagtatttcacaatgaaagtttttattttcttagttttaatttaatttttttttgagacaaggtttctctatttagccctgactgtcctggaactcactcactctatagaccaggctggtgttacactaacagagcagacactgcctttgcctccccagtgctgggattaaagcaaagcactacagtgctctgcttgaagatgtttatagttaatgttgtactattttatagcttagtttttctatttccaaagtattaggcctatttaaaaaggtaaaaaaatatagaagtatatacagtaaaacatatcacttttcttatccttcagtataaagaaaactaattctaataattattctaaatactttaagaaatcatttactgatgaaaagttttctaagtaggtggatcactttaatgctctaacagtcgataagctcattattgcttgtaccaacagtgcttttctaagatattttttgactaagcaaacaaattaaacatagtatataatggtccttttattttaaaatcataccattagtaatcctacatattaatgtatatatggtcagatcacaaaaatttgtatagaaaaatctatataatatagtagaggaacaacaatatgaaccagtacccccagagattccagggactaaaccaccaaccaaagagtacacatggagggactcaaggctccagccgcatatgtagcagagaatggccttgtgggacatcaatgagaggaaagactcttggttctgtgaggtattgatgctccagtgtaggggaatgccagggccaggaagtgggagtgggtggattggtgagcagggggaggcggcatgggataggagggttttaggaggggaaatgaggagaggggataaaatttgaaatgtaaataaagaacatatctaaaaataacaatgaaaataacttaaaaatatagtaaactctgatttaatcagtttatcagtagtatatattagattatttctggagtgagcttttaaaaaaatgacagtacatatcatatattaccattagcgtagccatggagaacataggagactatatacattctacataacataatctctgcatgcattctgtattaatggtttatttgaatgctatttatgatctttaatttaaaatcaaaatccaaagtctttcctcaaatgtctacttcttactttttgataccacttactgcctatctggattctttggtttcttaaaattgtatcttcttaccctaatgatattgtctgattcttaaatattttgttcagaagatgaatgttctctgctgctgtaaggcattatgttaccaacttttttctatgtgcccgcatttatatctttagacttttaaccaacttttcagttttaccatgttcaggcatatcacaatatcttatcatgttaaaatatctaaaatgaaatttataatattcatagttttgtctctctttaaatcgtacatcatgtgaccagacttaattgccaaattcccagtttcaccatgtagcaaagagttctataatatgtattcataatatgcaaagaatagagtgatttctttcaactggttaagtgaaaggtaagtgaaagttttacattttatatgtctctaatcctggaaggaattgttatattctaaatatgaaatactgtgaattttaatatttgttctatagtataaatcgttttacaatctacagtttcaggttgttgggcaagttaattttggaatagtaatgtgtagcagttgattattctagatgatgaatgaccatggtttgggtctttatataagtttccaaaaataaagttataaatatatgctaaaatttaaaaatatttcatcccacataaacaagtgatcaatatcattttgaaaaagttattgctttgggtaataagaaaaaaatgtctttagacttaggcactgatgtgctctgagtctaggttaaaccttttgaggaaactacttgctttttaagactgtaattttcaaatgtggaagctaattccttaataaggagatagaaagccacaaatcctttgatatttatgggtacacaacctagagatgttgtgacatctaggtaaattacctggttataatcacaagaattaggcaaaataacatgtgtatatttggcacttactcattctaggtgtgactgtctcaaatttcctaaattaaaagttccgggtatttcaccttgagtcttaatggaggattattatactagaaaatagaaaaattactggcaaagtaaatcctaaaacatatggaagtagaacattccataactagattataggaccatgaatactgtggtataaattagtaatattttaaacaaaacaatcaccatacatcttggaaaaccatacctatatttatcctaatggtaaataaggagaatgaaacaaagaattgtctcttcaaatttcatttcctatgctttctgtgtgtgtcagttatactgatggtgactaatggagaaagtcagtacaagggcagatcctacataattggaaaagataatttcctatactctgtgttttgaaggctattctaagatctcatctaccttcctctttatataaccagaaatacctgccattattccactcaatggataataacatttgaagaaacatttctaaaaagtcactattatacctatacaatgctttgcttagaattttacagtgaagctcatattctctctcatttgatttaaacattagaaggtatgtgctcaacaagatctgggttcaggttgaagatgatgagaacatttctatttgagttgttttcgtgagcgttgaaacatggtggcaaggcactgttctgattgcctgtggcagcaatttgaagctctgatagccaaacaaatgtccaagcacagcgctttttcacagtggattgtttattgcagttgtccctcctatcactaaaggataaaaatgttaaggtgtaggttttagttttagtattcatcttttgaatagctaggacacacagtgctcctgggaataaagaataagtataaatagactaaataaataccatataggatatcccattgtcttactccctgcattattcctttttgctttgctcaaatgtgtcctactgaaattataattttaaaaattaccatcttccctcatacaacttctatcccacttaatttttgtccatagtactcttacctgtgatttttgtgtataaatatattcacataatcatatatgaatatatttatgtgcacacattggtgggtatgtgtgactatgtcttttttttatctgttctcacttaaatgcatatagaagctgctataatgagagttatagtatgattaggtgctctcaagtatacttgttattttttcctagcattattttccctagtttctaagattattaccagaaaactcaccccattcttatctctcttcattgtagtgtatcacaaaatattatgtaggtaactaccatagttcacatatatagatttctatcttgtcaaatgaactttggtgtagtagagataaaagaaaccatcttgaggaaagtgatggctttccagtgcttgctacagaagcaataagatataagttcagagccccagcactcatgaaaaacaaggcatgcttgcgcatgtttgcatcttcagggctgaaatacagagactagcagatcctcgtgcctcactggccaaccactttagttaggccacacagcagccccaggttctgccagagaatcagagaccttatccataaaaactggtggagtgtaattgaggaaatagacaccaaagttgactttgtgtctgcacatggtgcatgggtacaatgtgtgaatctgctctacttcatgtgcctgtgcatgtacttattcacatacatctctctcacacatatgtatgatcacacacacaaagtctttatagatctcaaaaaatgcatgaacagcatttaattttgatttttcatataaactaaaatcactaattatccactagagaacaattgattacttgtcccattgttaattttaaagaacacttttcttcctgacattcactattatataccattctggcttgtatggactttagtaaatgtgctactgactcatttattttcctgtaatggtggctatttaataagttttgagcaaatggacagacattcacatctattattaattacacttaagagggttgtgaattaggaataaagaatttgctgatcaaattaacaaaatgcgtctgtacttcgtggcagtacttatatccttcaaaacacataatcattattctaaacttgcagtgaaaaaagattttctattagaagtaaaatttttgttcatagttcctcattttttaaatatatctgatcggatgatttgaccctttctccaacatttacttaaaaatgtattgcagttcacataaatatggtactgcttaattgtccattaaagatgatatttaatgttctcagtgtgaatattttcctatcctagacatttttattaagtcatttattcaacaaaagaaatcctgaacaaaaaagcaatattgtaattgttttttaactactactgccaggaatttagaaatatactcgaaataatatggtttaaaatggaacttcaatagaaatccacctactagaaccatcattgtcattggattatatttttgcatggtatgtacaatgtttaaaagattctacctgaaacttagctcagcatttctatagttttcccttataatatattctatctattactattttaaattacactgtgctatgtatcttcttcttacttctttctctgcttaaaattaattttgtactcctgtacatggttcagtgttctaaggtgttcttgtaatagatattaatatggttttaggtgggctgtatacatggttaagtggttaagagcatttgaggacatggttggttttccagcacccacatggtggtttgacatccttttctgaattccgcaggcactgtattcacactgtacactaacatatatgcagacaaaatatgtaagataagtatatctttaaaaactgcttgtgtattatttcattagttgaaatataataaagaaaatgagtacaattttggacgttcaaccacaaaattgcccctatcttctgcaagaaatttgtatattgctccactaagtatttaatagagtgtctcattagtctgagttttctggatactatttttcttcctagtagtaactacaagagaatccttcttcttccaaaataaatagcttgcctatttgaaagtaggaatcaatccagtattcccacttactttggcaagcctgtaaatatcatgcccaaagacatatcatgagatctacacttttactacagttgaaagtctacaaaataatattgattgctatataggcattgcatatggcatacttacagaagcttttcacataatatgattgagtaaaatcactgaaaatgaactgctttctgctggtaccctggattctgctttctactttgatcaatttgactaggtaaaacctgttaatgtacctacagtgtttgtcagctagtttcagttaccataatattctcccatttatccctgcttcagcatataagaggattatctttttcatggctgaataatgttctattatttgtatctatttaaggaagagacgatcccttctctaccatatcatcccacttttgtaaaaaaaaaaaaattagtttactgtatatgagtaagtttattcctcggttctattctgttggtttatcccatttttctattttaatggcagtaatattgtcagaatatatttgatttacatactgattgggaaaatcaagtactgaatggaaaattttggcattctgagaagcctgttaacagtattgtaatctgttagctgaatgagctgaacagattagctgtgtgaacagaaaatttctttcacgccaagaggaactttaaaattaattacaaaaaggccttggcactagaaaaaaaaaacgttaacatggtgacaaaacagggataaagccagtttgatttatgaaagtagcttgagggccatgtgataagaatatggatcacataatcagaagccaggtgttgttgggctttttacaaatataaattgaactcaaagtgttgtctttcagatagaattgcttccaagtaggcatctcttagcattgtcattctgataatgaactagaatgaaatgctgagagtacaggctccccttagtagggaggctagttaacttcaagatccagcatttcaccttaagatatttgttttgtcttctcctttgtttgtctgtctttttgtcaatcagtagaactgttgaccttctgcataagtctccatcccagagtttcatgtcttcacatgtgtgcatgcacagtgttttgtggcagaccttacaacaggaattctgtgcagacaagaggctagatgctatactgtgaatgatgatcccgtgtgtgtccctggtatctgagccaatcatttcatatctttgaaatttcactgtctatttccactgaggatgcagtccacgacctccccagtgaatttttgacaccatggacagcagaatatttagctatattctgtgcttccaatgcatacatacatgcctatgccaaactttgctttataaattgggttcagtaagagattaacaagaatttataatgaaatagaacagctgtaccaatctaatataatacaggtggtctaaaatacacaaattgcttattggtatggtttttccatttagcattcacagagtgctgttgaacatccattaccaaaacagaaaagttcaagcctataatggggaactattatgctaaagattaaaattttagtacaaacgctacaaggaattatgaacaccgcttaatttttaatgatgaattttttcaaatttccttatggctgaaatgtaacttttcaataatatataatctaatatcaatgatctttctgtcattgtaagcctatgtgtctctatgcatggcttttgcaggctttgaaagagagaaactggatgtaactgacaattttctgtctctaatactgggtctgactttttgctcttaaaatggtgtttgcactttaaaaatcactttaaggatacattgaactctttttctgaagctttataagccatttatgtacacaagcaactctcccacacacaagactcatatcaagcaaaatctccttgtctgttttatattttttctgtcaaatacattgttttgagtgcttctaaatatcaaaagcatacaaacatcaggttgtgatttcttagtcttgattctgaaaatttctatactattttttgataacatgtagatcatagaagacagttttctgaaaataagccagtcatagtagcacgtacatttaatcttagtacctgagaggcaggcagaagaaaatggactcctgtgaattgaatccctccttggtttatatagagaccagtctacttagcactatataacgagaccctgtgtctattaacaagataaatttatagaagacggaactttggagactttatggctatagaaatctatccaattcatatgaaatgatagtctgtattataaatttatttcatctagataaaataatagtaatgtaatgacaaaatcaaaactgtagaatattggatctgattttctgaacagtgtattcttctctactgtaatttccaagtaccgtcttctttaatgttgactatgcatgtgatacctagaggaagttgaactagaaattgttccctggaattgtttgataaatgagagtgtgttaactcaagggtagttttgatgcttttgagcatacatggtaaaatttattgtcagagagataagtagctaatcatgttgacattcatgactgctgtgtttgtacctaggggaatgacttgtgttagaggaagggatcctgagagactgttctttctgcttacattagaaatcattagagataatttaaatgaacaaagcattgctggaaaattaagaaaatctttggaaaattagaaacggattcactgtatcctcccattctcttgtcagaaccactaagaggctgggagtgaaggtaaaattacacacaaaatgtaatatagtgtggaatcatttttttttaattgtgtaggagcaaaaagaaaagggtatgtgacaaaataacaacaaaagttctctccagatgagaacctatggggacttttatttttgtctttttgtgtttgctgttttttttttttaatttttctaaatctcccttactgaacatgaatttgacttaaaatgaggaaagaggaaaaaatgataaaggagttagattgtatgatctttatttcctcatcatgtttattatataacaactatgaacataataaatactccattttgtcttattttacaaaagaaactattaacttagatccatttcatccacaaaacaagaaatatattttctattttgatgtagtagagagggtgaaggaactattaatagttcttttagatataagtaatctaattatgtcacatgctctatatcatattgacctgaaggcaaaatgtgaatctattattcctttataatctcatttacagtcttattattatcatcttgtctagtcttcagtttaagatgggatatcatattagtaatttatttaaattttatatatgggatcatacttaaatctagtgaatctctattgtcaatgcaatggaaattactacttagaaatagttttgtggcattttgttttccatttattttagactgggaaactaaaagtaatgccttgtaatgggaaacatttcaaacagatgaaacttaactgagcaccagccattgaaaatagaagagcacacatgagggagattgcatgttcttaagtgatcaactgtttggaaatgaaatgctgaggtatagatagatgtgaagcgtaaaacagaaacaagtctcgtagctgggggcatcttccaatctgctctttgtgctacgaatagaagtcccattgtccaactttatggccatagtgcttcaaaatcaaacacatagatgctttgtgttgttagctttggctgatgtagtcaggaagagatgataacagcctgtggatttgtaagagagtatttgcctacagatgtttttcaggacacttttccctccggccttccccacccaactttttttttttttttttttttctcaaaagacatgtctcaggagtgattcaggaaaaatgtcagttgctttgaacttgggaggaattgattcttttaaccatatgattttatcctctgattatttatggaaaggtttaaaatgaacgtgtaccattggacaattggatgttgcatgccagctgacataattgatttgctcaggtgcctcttttaatgaaaggtatcttctagtttgccaagtcttttttgtatgtaatgtaaatattcccttcttccactagtagtaaatattctatatttttctaaaccaattatctcaaaaacttatgggttattagacatctaggttttcctcatttttttaaaatttttttcccttaagaatacagttacaagtgatatatttgtatagaaattcttagattgttttctaggcaaaatatttatactaaaaccataaaactggaaaccagagctttatcttgttatgtctgtcaatgatatacatatttattatcttaaatttatttttccattttctttggccattacataaggatgttttgtactttttatcttttaattttaatttccacctaattttaatttccacattccattacacgaatgaacctctggcacttactacttattatcttttgtagtgtgacctccatatattttctttattcttcttttctgtgtctcctggtctccttaaaactattggtccttcttactgttaccagcatcaccatttacttagttaaaagaactctgagctaccactggctatcatttcatccttttcctttcctctctttccagatagctgttctccatttccatcagctgctcactgcctcctccatgcttacctttactctcataaactcaccttgaagtgcatcttccaaagtgccttcagaatgactttcttttctcagttcgaggagtaggacctagggccttactcatgagaatgtcttttataaaggttagtgttatttataccacttaatatgtatgtaaacatccatacatatatgtatataaggtttacctttataacttttaaaatcctgttcttttttcttttgtctgtttttgagtcagggtctttctacataatcctgacttttctgaaacttactatgtagactagtctggccttgaactcataaagagccagctgagtctgcctcctaggtgctgatatgaatacacacagccaatgaaatccttttctagtattgctatgttatttatattttaataatgttttacattagaatacacagtcatgagttttatcatgtcatcttcataacttagattttatatgtattttcatatctcataattaactgaagcaaaataaatgtaaaatagggttgtttaaatggttaatgctagtgatgtggcgtcaatatgaaatgttccctttagactcatgtatttgggtgttgttgccagctaatgagctttttggaactcatcggttccttatggggttgatctttgtggatttagtatatcattggtatgatttgataggaaggaagaggtggagcccggatgaaaataggtcatttagcaatcaaccttcaggatctgcctctctcttccagttccctggaaaagttgttgagcaacttctttacatcgtattacaatattgtggtattctctgctcttgccatattcctaaaagcaatagagtcaactgactaaagactgattcatatggtacctgagccaaaataacagttccttccttaaaatgtgctcttttcttccttcccctccctttactttccttccccctctcccttccccttcctctcttcctcctttccttccctcttttttatctcaggtatttgttacagcatcaaaatactgattaacacaactacaacatgggaaaccatttaatggtaaaaattgcattattagtagaggatagaaaggtatatattgatatcagttagctaatgtcgactaactgccctttgagtcataaccagtctatgttcttccatatgaactgaacattttgtttctctcattcgctcactttgtctcagtcagttgaggagattggcttagactaagtgagacagtcaggcatatgcctgctctgacaacatattaaattgtactgcatggtttgttccaaccactttttcttaatgaaggaacagaaagtaccttgtgcacatatagagctgtatagctgaaactagagtagtgtaaggtatgggatgaattacattgggaaatgactaaatatttgaaaaagaatagctattaatgatgtatgaaacatagctattttcattaagcccatatattaaaaagcacatttgtagactaattttcttggttcaatatttgtataaaatagtgatgtattaaaacagaacattttcagggaaaaaatccctaggtaatagctaatctatattaatcaaaggatgtagtcttatagctttaataaatacctctactgtagtggctatatagtaaggttaacgagtatccatgttgttttgtgttttttttttttttgtcaattgatttgtgtttgtatgcacatgtttgtacatgagagtgcatttgtatggggtccagaagtcactttggcctattgctcttttaaagaactgtttgtttttgttttcttattgacctgtagctcactgattagattggtctgactgtcccagtctattctttcccaacaccagattacaaatagacaccaccagcttttttctgtgtgtcctggggagcaaacccaggtccttatgtttgcacagcaagcactttatggactgagctgcctcttctgatttttttttttttgagctatctattatctttgaaaacatctgactctgtcattgtagagcaaaggagaaataactaagcattttgaaagagaaaatgaagagcttatatgagatattgtagatagtaaattgacagagttaaggatgctatttgaaaggaagattattgtgtctgatatagtttattaagccataatccaagttcattgaacatgtaaagttaaaaacaaaaagaacacctcaaaagatctggaggagtaatatttaacagaaagggaaagagttgtttgcgaggaacaaaaccgtggtagactaagtaaaatgaaagacaaagcaaacattggcgtcaagtgtgctttatactttcagaattcctgcagactgtgaagcccattctttatatgatttatatctcttgctagtttgcaatttgatttaaaaatgaggaaacgttagaacagaagactacaaagaggggcatgctccatttgaaattagaatggttacagcattccaggtcaggtagcctctgaaaaactaatatttttttcatctctgcttttctcagtactttggcctcattttctcttgccagcaagatatttctttgtttggtagaaaactttgctatcaccagcaaatgaatacaggagttatgtttggatagatacaagtattcatttgatatttttcatatatggatagaagtagtggttggttggtaatggtgtgaagttttccatgctatagttttctttctctctttgaaaatcaaagtacatatttgccatgataagttacttgaaataagatatggtagaaagtttaattatctggagttaacctacaatatcatatcttagctcatatcattacattcatttataattatctcatgagtttcagaaatttttgttttagttcttataattttgatttcactgttaaatcacagagttttctaatattccactctacttcccttttgataatcagagtggttgttttgatattagtgaataaatgagtgaactagagctattttatcaaacacatatgatccgttttcctaccttttcttgtaatatttcttcccttggctcattacatgcagggctctttcttgattctcaggtctcagcttaagtgttacttcctcaaagatgcttttcccactgtaaaatggctcccacttctcatagttctctgttgaattgtcattctcatagatatttatgtttatcctttccttgcctgcttgtgtgctcttttccagaaaacttgaagccatgtatacttggtaattaaaagaattggctgtgaagtcatagctgggcacatgttctggcctcaccattactatttgtgtgcacttgggaacaatttcagcttaatccccatatggttccatttccttatctgtaaaactgtgtaagaatagagtgtatcttatagacttgtgagaattaaatgtactttaacttctgtgttagttactttttccttgctgtggcaaaatatcataaagaatcatgttaagggaagaagaatttattttgggtcacagaggaaaaagttcattatggcaaggaagtcatggcagctggggcttcatctggggatctaggagtctgcagcagctgtttgtttcctggtactaaaccaagaagcagagaaattgggtggtggtagagggttgaattatatcccttaaacacctactcccctccccctgcaacaatatttttcctcacccagtggctaactctttctaggttaagctcaacctccccaaaattctgtaacttctaaacctgcctccagctggggaacaacacccaaacacatgtcacattcaagcctttacaacatctaaactggccaagcagtatttatggtatgttagataacaaaacttcaaaagcaacaaatgagcaaacaaacaaaaaccatccagcaaattaaaataaacactcaccaaaggactactttggaaaagtctcaatgaaggaggtagatctgcatgtgcggatgtaaaatcatgtagattgtgctatcaatgaaaattgctaagtctacacttcaatgttaatctcaaaatttcatgtatctcagaggttctctggctcatgttatgcttgggcatgatcttagactccactacatagtgaaagaaagaggacactgagtgatagcttattgtgtatttaggaagtaccatccttcactaccatactcatgttgcattggccaaaatacaccagagaactatatttgatttcaaggaccaggaaagcacaatcctgtcttcttaaggaagaacagtagaaatttaggagagtatcaattcttaataataataatatcctaattgtgaataaaggtataaaatattagaaaaagtctcattgagatcaataccaaagtattgtttagtttttaaaatattttagggctggagagatggctcaacggtcaagagcacccgactgctcttccagaggtcctgagttcaattcccagcaaccacatggtggctcacaaccatctgtaatgggatctgatgccctcttctggtgtgtctgaggacagctacagtggactcatgtgcattaaataaataaataaataaaataaaataaaatattttagctggtcttattggtcttataataaggatatcctattgcatacttagagaaacccagacttatacttccagttatacctatttttaatttattttatttctatacttttttgttaaaaactaaaatacaagcagcattatactgggcctagtcaaggtcaatttaatataaccacctaccactgtgacatattgttccagtagaaggctgtcaaggtctttaacatgtataacattcattgtcttcactgttaacagtgccttcttctagaattcttcatgaaaatcccacattactttgttttacagttaaattttgtttaataaatagtttcagtataataacaataaaactatagtacagcagttttataaactagcaacagtcatttatagctagttattttgtatccttgtgcttgctattttttcatgcaaataggatataggaggtttttttaatatcaagattgccacaatcattaataataagttttattctgatgtacataggtgataaattttctagtccattatagtcttcctgggaccaccagtgcttatatagtgtgtccttactagatctgttagacaatatcggaccatgcatgaaaattttaatattttttcttggatgtgggttaattacatggtgtgtgtgtgtagcttatgttcctctgtgtgtacattatatctgtgtatatgtgtgcatgcatgtacatgtatgtttgtgtatatgagagactcagtcttgctatatagaccagttttccctatctttttgggaaccagattgggtaatgtgtgtgtgtgtgtgtgtgtgtgtgtgtgtgtgtgtgtgtgtgtgtgaattttataacaacatacaattgttttgccctgcctgccatatgttaaaatgccatggcaaatactactacagttaatcaagttgcgatgaccttagtgtatatcaaatacagatgtaatgtaactcagtcataagtgatatatagaattatttttggatgagggactagtgagtgatgcacataaatatgaatattaatattgaaaatttatatgtgtatgtgtgagtgactgagagagagagatagatagagggaggcaggtggtgagatggacaggggagttggagaggtgagatggagaggaagagaaagagggagagggtgtgatgagtatgaaaccaagagcctctcacttgctaggcaaatactctatcactgagattcattttgtctccaaatcaatgctgaagttaaaaaataaatattttgtagaagaggatagtttggcaaaatttttgggctttctagttacaaaatcttccaggtagttaattgccaagcctgtatgaggagaccactggaatatttttatatcactttgcacttggatattaatatggcatatgtagcataatatatttttgaataaatattagcgactcttcaatgaccttataaatatgctcttggcagttattctgggggtttactgggcttagaaatttttagttttcattctccttaaagagtaaagtataaaatgatttttaagtgaaaatgttagaagtgttatataacagttcttgtcaaattactttgagataaataaaaacatacagttgaatatgatctgcaaacaatgggagaagtattgattgtaggtggaagatcacatccctttaggtttatattgtttgtactgtctcatatatatacatttactttttcttgttattttatatttattttttatttgctgcatacaaactgagatgtattaagaagaattattttgaaatagctgtcatattttttcattcctcaagcttctcattattctacatttcctctttaataattagtcatataattaatatatttaaaaaattgtcacatattgctgtccccatatacatcaaaatcaacatagtgcaaaagaacatctaatgcacaagatgtaatgtaatgcacaagatataatgtaatgtaatgtaatgtaatgtaatgcacaagatattctatcttgaaaaattgtgtgtcctttattttgtgtgtacatgctctcatggatgcacatgtgttgttgcatacgtgagaggtcaatccatacctttgtggagttagttattttcttctacaatgtaaatgaggaataaaaaatacactcaaagttctctacttcaaggaaaattttacattttactttttgatctgttgagaaacaaatggggcattttacctgtacattaaaaagtactctagtgaaaggacaaacaaaagaatgtttatgaatatagcaatgagggaacagataaatccatagtaaatatactagaaattaagaaaaaaacagtaatagtgaataattattacatgcaagtttctaagtgctttcactccataaaccaatttgatgctctcaacaatgttcctctgaaacaagaaacagagtctctcttacatggctcctgagagtgactgcaaaagggcattacaaatcccacaagactattgttttgtgtggaaattcctgttttatgattttagaatttccccaatgagaacctgagttcctgtagtaattgctctttcatcatgtaatcaattctaatgttatatcagaaagatctatagaataggttctgttgttcattgaaaggtggtggagaaacacaattcccgattagcaacctagattttgtaattgttccactattgttaataatggaattttacctatggccatggtaaagaccatgaaagccagacatgaatttatgatctaagttctttctggtaggattatataatctaatgaatttagagaatttttgttcacaatagtttaaggtactcataaaatgctgttaggatatgcaatgaatttttcatgataaatgaccattctcgaagctatattgatttccatataattacataccttgttatactttagtttattaccaaaacagccccagattttgcataatttaatgaatataattaatgactaactgttctttcctctgataggctaactaatcaggctgacctagactgattctttatattcattacagaatagaaaaaaaaaagctgcaaagtattattttgcatgatagctctggttttctcatattcctatcacaggcacattattaagtttagttgaagcaatattaaaggtgtatttaacataaaatggagatattagagttgaaactgaggaaaactaaagtctatagctactctatcccttttcttgggattgtcagtcaaatgatgtcacggagaaggcgttaattaatattttaagtattttctattttacccttaattgctttatcatttaattaagtaaaatgtggatatgaaaatactaactatcaagcatgttaggtaatgaccagtttccaaatgatctttatacatatcttcatgttggaacatgtttacatttcattatttactgatttgtgtgtatagctaaaagagcagctattaaaaaacttcaaggtcaaatgaagaatcctcatggttgaaaagaaaaaaacatcaacaaaacaaaataaaacaaaaaccagtaactacttaagaattttaatacattatggattggatctgagttcaaatctccccaattcgcctaaatgaccaggtcttcctatgcataaataagaggtaaacaatcaacactttatagatagaagcaagattttctgtatttctttttcagtagctagaatagtgcctagagtagtagctagcttaaattttgattcgatgtctttagatataaagttgaattggattttggttataaaaatgtcaatgttgcttttagaaattagtgaaactcattcatacacaattttattttatttttgagcatttcataaatgcatacaacctatttatttcccctaagatctttcctgatcatcagtctgagcccaacttcaggtcttccatttttaactttgataatttattttttaaagaaattcatacatggatattgcatctatatcccttcaacccctattccaactcttcctatgtcccttctcccaaattcatgaattcttttactgttacttacacacacacacacacacacacacacacacacacacacacacacacacacacacgcgcgcgcgcacacacacacacacacatgcacacacaccctattgtattcattaatttttttcttatatatacatgattatagggctgaggacttgggaatagacaacatatgtgggagctaatccctgagggattctgatttttccctacccatgtagacaaggggtaccagtaactagtcatctagtggtggatcatgtggaattccccttgtacttgttggcatgtcaactattctcattacattgactggattcaagtactcatattgttgagagggaagttgcacctgtgaagtctcatgtcttcctgtgttctttttccttttttcctataacctattatgtccaattagtgccacccatatacacatgggtgtgcagcatccacttcagcatagttagcttacaaggaaccatgtccataaatagaactgactcctttcaaggccatctgccaatagctcacgtagaggtgtggtcttcaggccatgctgtactgttggttttgtgcaagcaaggacagctactgtgtaaattcatcagtccagtgcctctgccatatccagaagaatggtttgccaggtcttcattgaaatctaatttctcttttagtgatattccctgagtattttaggtagaaagacatacatacaggataattgtgttatttggaaaaattattgtcagtatatcaaaattgtgtcctttcttaggtttttgcacatatgatttttacattttgttttctacagtataaacacgatatatttatctactgatcccttaattctcatcaggtaccatgctactatttcacatgcttctatttaccagattccctcagtatgtgcttgccagttgaccttataatcttttaagtttcaatgtgggagattctgactgagaatttaagttagctgcctggctagttcctctgtgctgagctctgtgcttatatttgaactccagtgatgtttgtcttgaacactcttggtggtattaaatcttgatattttttgaatgtagaaatagtctttggaaatagcattttttttgccttaaatttgataaatgagtgactggattgatcaaatcctggccttaaaatataaagcaatgagatgtgtcgtaggataaactatccccagagatcatttcgtcatccaaaaaatgctcttcgaaaaatgtttcagtggtggcaagtttagatgattaaggtctctttgttcaaaagcaaactagactggttattttatactcagattttgtgatggcagtgtaaataactttcatgttgttatctaattgtatacattattttaagagatagaaatattgtagtagagtgcaaaatgacaccatttctgttactgtggaatgtctgatcatttctcagggaaaattacaaaattatttagctcacctcagtttctatagcatagcctctaaagtctcatttctttaacagggccttgtgggtgttctaaaggaatgattgaaatgaaaagaaatgagagagtcaaacagtgtaccgtaatagatgaaatggaaagtaattatgttaatgttgactcattatgaagccctaaccgtttgtacctgctcatttctgtgtggaaacctgtgcagctgagatgctgaataagaaattcttgtataaatgagcctagaggcatgtttctaatattggagctaagcctatacagaattgtaatgaatttccctaagtcagtatttaaatgtgctatcagagaaggtgcttctcttgacagaaattttggattctagtgtttatcatcaaaattttacctatgtgcctgaatcctgatagctgcgtataactctcatttgttaattagaaggaaagaaacccctcaagttgcaaagtgtattgatattatatacagtgttggattttctaaaatatgctcatgtagaaatacttcagataaattacacagaggagatatatgagacaaagttagcagggtaaagggatgtagataagtatagctttgcaaatatgtactctggtgtactttataaggaagcagctgtaaattactcacttggcaatttgaatatacatatacattttatatatatatatatatatatatatatatatatatatatatatatgtgtgtgtgtgtgtgtgtgtgtgtgtgtgtgtgtgtgtgtgtgtctattgctgaagaacatggggtttagagttgagccaacgagatttaaactgcctgtttgagtctactatggaattactgtctcctttccctaaatgcttccttccctctttcattgtacccgaatgcttctctgttcctataacctgttgctcaagcattcacctttcagctataacttaggataaaatgcttctacattttataactcaactgtcctgcctgtattctggaaataatataaaacactttaggatctctctgaccatgttaccctgccagttctggtttagttgagaaaaatgacacattgctgtttgtaattttatgagacttatttttccctatgccagggattgtcttctaaaacaattaaattattaaaacaacgagacacctaatttttgtcaagttatgttcacccttttcttgaaaatgtaattgcagtgaagaatattttaccttgggcatgaacttttcttttatcctgtcaatccaaatgcttttaagtaatgcacttaaatttcattttcccaacttgagtgttgatgcttataacattcttttgtattttgaggtaattaatatcagcttagtatttagtgtcaatcttctttgtttggatttcaatttttagatttttgcattactcccacaagcatgcaagaccttgttatacttgaacagtgaattcttatcatagaatatcatgccagaaggagggtaaaagttttatctgcagcagcatgaactgtctacaagaaatataatgtaaaccacatatgtaatttaaaaatttctagaaaccacagctaagaaataaaaataaatattcaaagttcatgttgataatacagtttatttaatcttatacctccagtacattactatttcagtatctagtcaatgtaaaattactgaaaagatgtatcacatcatttttgtactaactcttcaaaatctgatgtgtattttatatttatagcgtatttcaattccatctagctgcatttcaagtagtaggtttctgtatgtgaccaggggctactaggttcgccagtgtagacctcaagccttgatttattttctatccctggcttcctgatgaaattgtacactaagaatagttctagcacctcgtcatggaggagcgcgtgcttctctagtaaggcattatcagaaaatcataatcttacctgacttcttgactttgtccatgaggactagatcaattaaaaacattttgttttacaataagtttatttttgtggattcctttctagtcaaactttttcttcctatcattgcttgttcattttagggatgccagtttctgttgtttcatatggcgtgtaagagaatggaggtaccatttatcagtaatgatagttctgttgatgtttcttcctcaacaatttttattggctactgtggatagcatttttgtggtggcacagaggctagagggcagattttcagagctgcttcttcgcttccattgtgcactctgaggattgatgtcaggttatcagtcttgtgcatcacgcgcttttacttgctgagatatcctgcgagtccgtcctgtgtcatttcttttagaaaatgtctgctgctcctgccttagtttgcatagagtttttagagtatctgccagtgttttatgtgtacttggaatggtctttagcatggttactttgggaagtggttctgacatataagggatcctaggaggaggactttaagacatttgaaagcccctgctttacacaggattaaggaagttgtggaggaactcagaatgggttcacctcaatagattgttattacaagaaggagattgttttccccttagatctctgatttgttttgtcagtatgatgatttcttctcacatggcctcccctgagctgtcacactggatgctgacccaaggcaactacttggtctgtagctttcagttttctttgtaaacttaggcatttttacataggagtgaacctacacaaatagaatatatttgtttgaatcatttaagctacattctcttgaaagtttagctaatcaaaaccaattgcttcagattttgaacagtaatcactcatttttgtctctagactgaaaatcatccccctattgattggtaatgtgatataggtcctttgctacatgtattttagccacactcccactctctccttctaatttcatgctatgttttattctctattgttaaccttttcatgtaactgttcattaacacaaactggggaaggatttgggaaatgaatggaactggttcattccattgtagatcttatccaacttaaggtcatcacatttttttatcatctacttgtagtgtggaacaataagacatagtccttagtagcttggttgcaaaattcaccttttcactatcactgcttgccctagttttcttccctgctagcaacttcccaccacccaggcacgcagcactcaagtccagtattcctttaccagtgttcatcatttcctccttcacaaactgccttcttgccttaaatcctcttaaaggtacagtctcatccttgcttcccatatagtctcttctttccattataaccatttcttgtattctcagaacacttctgttatagatttcttgttacctgtggtaattctgtatctcttactttttttaatagcaaagttagtaggctggatacaaacaactctattgaacagatctgggccatttaaaataaatgagaattccttcaggatgcctaatttagcagtcccatatgaggaaaatgacacatattaaatgtcaactaggtgtttgcaaaaaggattttgtggagtatttgcaataatgatctataggttgtgaagtgctcccattttagagataaaattaatattggtaaagtgattgcattattcagatcacccatttagtaaatgccataaatcaaatttgaatccaggtgtgaatgatgaatgcctccttgtgtttaaaaatacacatgtaaaggaaaaaaattacctttgtggaagtggaaggcaacattgtctttgctagctggaggagatgataaactcatgacccatattaaagtagaggcacttctacttgacaaccctttcttccttccctcaagtttgtactggtattttcatttttccattttagtaaacattaaactttttagaggttatgattgttactgtactcataagagaaattgttttagtaaaagttgactatagaggtaaacttgtaaattagtaaaaaataaaccaaataatggtattacatttctctctttctctctgaaggcagcatggtaggagagagtgggctaacagcatagtttcatagagaacattggatggattgcaatggatttgtgaaagctttcactacttaccatgtcaataatatgtcgataggaaaggcttttacaaatatctgagaacatttgaaaaggaaaagaaaactagcattgaaatctcaatgcagggagtcctcatatcactttgtgagtttggttgccagagatttgtgatgtaggctggaagaggctaaatcactttgtaaaacgacaatataagcaagaaactagcatttaaatacattttttctttaactccctgagaatatacaactcttcagatatgccaaatatggaattttggtgtttttgcaataagtgctatttcattaattatattatcaagcacatttcaaaactagtaaaggatgaaattcagatctgctctatcagtaagcagataagatgtccatttataattcttggttacatatgcaaaatgaaaatgcattgaagctatttaaatcagcatcagtgtattttttccattatatatgttttacatagttaaagtggcttatttttcatgaaggaaactaccttaaatgtagaatttaaaggtgtgatagtcatgaacgttttaaattattttaatactcgtcattcatttattttcctttttgaaaacaagcaaaccatatttttgattggcctttcgttaaaaggaaagtacataaaatataaatctcatttacaaatgtggatagtacaatcttggctgttgtgagggaaaagacctgaagttctagacgtttattttgtcagtccagttcctaaccacggcactgttgggtgcttgcttgatttcacctgagtttttgagaatatgaagcgaattaataatagaaggtttttttttttgacacacagtttctctcctcccccagggaaatttcctggttactgcagtgagaatgttatttcccatcaatgtactagctctctgtaacacccccattcactgtaaacaatgaacacaacatttattacatgagccagagctcttaaaaagccagcagattttaacattctgcttagaattctgaagttataaagtgtgaaaactaatattttaagatttatcttaaaactctttggtaaggaaaacacatttcttctcagtttgtcattaatctgattttacatgtgggttggtcccacttatcctggaggcagttaatcattaaacatttttagtggcaaaaaactctccttctaaaaagatttttgtcttcctgtcatagttttatatgttttttttgagatttttaaactagaaaatactgtaaatattattggacagaattatgagtttcctccaaagtgaaatgaaagatgctttgctgccatttgtcctttataagcaggacattattaattgatgaccgtgtcttcagagatacttagttacacagcaatattctaatatatattggttccatttcacatagtcaaaacattgacaacatagttgaaataactttagtccttttagctaaacccaaggatacccattggcgggggcagggaactaaaatgaagctattaataaatttcggatatcagccagcttggttgggttttcttttgagtaatttgaaattaaatataggttcaaacactgtgtttgagccttgggcacatacatgaaacccaccggatttaagcaaaatcagtggagcctattgtgtttagcagagggtacacagctaaagacagagatttcctcctttcccaggatctatctatagccaatagtgaggagttaaagtatagggacccttgagttctcctcctcttcattcattgttaataggcctgattttgtgagagtccagtgcagataattgcagctgatgtgaattaatgagtgcaatagttgtctgaagtctagggaatggcatttcttagtccatctccagaacttccagcttttacacacttctcacctctttctcaaggttttttggtgtctctacctggtggctactggtgattcactttagtctcttcatttctaaaattggtgacaatgctttttggccctggcgttcctctgtactggggcatataaagtttgcatgaccaatgggcctctctttccagtgatggccgactaggccatcttttgatacatatgcagctagagtcaagagctccggggtactggttagttcataatgttgttccacctatagggttgcagatccctttagctccttgagtactttctctagctcctccattgggggccctgtgatccatccaatagctgactgtgagcatccacttctgtgtttgctaggccctggcatagtctcacaagagagagctatatctgggtcctttcagcaaaatcttgttagtgtatgcaatggtgtcagcatttggaggctgattatgagatgggtccccaggtatggcaatcactagatggtccatcctttcgtcacagctccaaattttgtctctgtaactccttccatgggtgttttgttcccatttctaagaaagggtaaagtgtccacactttggtcttcgttgtgtgtaaaattctttagcaaagcgccttacacatgtagttactcactgaatagtagggtgtatacatttatttttatgtatttatggtcaatcaaaggccacattttagaaataatatagaatgtctttcccttaggtaaattgtgctgttccactcccatttacctcttgaatatgctcttgtattattttagaaatacacggtttaaatatgttgtaatgctgccttttatctcaccattcatcaggttgactgattagaggacagtttgagatatgtaagaaacaccatacctttcttagtgataccctgtttttgaaaacaaaacagtaataaagacatgtagatggcttactgagcattaacatcttctcttatcatggtatagtatgaggttagtaacctatggaaagaaaacaggactgggctcttcttgcaacttctccaatagtaattttaagtaaaaatggtagttgtgatatgaagatttatcatttgattttaattgttatatcaactcatattttgtcttctcccacattaatctgggttatatgacttaggggtgtgatgcatatagatttgatagggtcttccaaacctgtattttggcgatatctaacaatgtgcacattttatagcagaaattgtaaaggatttttgctgaatcaatggatacagggattgaactctgacaatttgaggcattttgatccttttgaaagtgaattgaccatttacgtaaagccagtcaacattaagcttttaaagtaattttcatgtctgtcttgctgataattctttttacttttcgggtggggtgaaggaatatagggaatagagaaagattatgataaatgcttttaccttaggctgctttgttgaagagagtcttaaagggcagagcctcttggttgagagattcttaaatgataaatgacagtgacaagatattttttctttctcaccagagttttggggatcagggaaaatcagagagactgatatcttaaatcttaactttttaagtgctagcaaaactatcatttgttgttgcttgactatcagaaatattttctggaacattattcactcgtgtctttaacttttggataatggctttctgatttttctttttactatatattttaaaggcatgtaaaagagcttcaattgtttaaaatattatcattatttttctagtttgctcacttatagtcatttcctctgagatgcatattacatgtatagagccaagacttacttgtactattttcttttttcttcaacagtttttgaagtgatggtaataataatattattattattgtaattattttgctatcactctaatttgtccattgtctccattttctcatctgttatttgttaggagtttcagtcaactattaaaatctttgctaatgaatgatagaatttggaataactttgagttgaaagcaaaatatttcaaatattgtcagaacctagttactcgtactagttacttagaacatacaaccatccaaaagaaatataggaatataagaccatttgtattgcttgatacttaagtagcctttcagttcttgtacaaatgcagaatattaaaagaggaatagagttagggctgcagggataacttagttaatagttgctgctcttgcaagggtcccacatttgtgtttcatcacctacatcagataatttgtagccgcttgtaattctagctccaagagatctaccaccctctactggttttcaccggaactgcacatatgtactcatagccaaagaggcacatgattaaaataagtaggtcaaataaccagaaatttcttcgactattttggttatgaggactatgtgtttacactgaattatcctgaagatattaattttgcataaattatttatttatttttagaattttgagggctaagaaggtagaaatgagaaagaaaagtactctaggttgttctgttaatgactcatgtgtgtctatttttctcatgagttgaacagttttataagcaattgttacaagaaaatttaaaaatgttattatagactcaaattaactgcagtatatgcttaaagtttattagagcatttgttttatatgtggaagcattaatcaagttataatctttaatttttttccaccatcaagcttgatttttaggtatcattttatatttttgtctttttcagtgttctattactgagaagaggcatcatgaccacaataactcttataaaggaaaacatttaattggggcatgcttggtttactccatcattgtcaaggtgggaagcaaggaagcatagtagcatgcaggcagacatggtgctggagaaagatctgagatttctatatctactgtctccaacaaggccacatctcctaatccattcttatggaaaccaccacagtacttatatttagcagagccacagaggttttttttttttttctgttttaaactcctaatcatcatagtgtaatttttgttagagaatttgccatttccctttcatttattcacatatattcattttaaagatacttctaagtacaaccattaacatccatgtgttaccatgttctattttaggattttactttccagaaatagctgcaaacccttcttcagtattatgagtgtactactgctcaacccatcacgaaacatttattatttgctatttatctaagtaggtatgacacctaggctagcttaattgcagctaagaatatagtaagcatattcttgattctgtgttttgaaagctcttctgctttgtgatgtctagtgaaggataaggcaccaagcatttatgatacttcatatattctagatttaaatgtttagtgcttacttttgacaaccaagtaaagatctcggtactagctctagatttatttttgaagttgaaaaattgtgcttttaaaatgattatgagtagcttcagcttgtatagttgtgcacaagaatgaatacattacttgtgtcaccttatgtgatatatgaaaataataggtgcagtagtattgataaaattctatttatgcctatgttcttattcatttcaatccatagctaaggcttttccctgatgctagatatttcctctgcatcacaaatcagaggttctaatgacacacaaaaaataggtatagaaaccaacaaaagtacgaatggcttcattcatcttttaaccagttagaggaagtgaaggaaaatacatagaatagtgacatgcattggggaaaaaacaaaaaaacaaaaaaacaaaaaacaacaatcctcaaaccttatttgcctcgtctagcctatcttattgtgttatggattttatatggcaaacttgaaatgaaatgctattagttaaaaagacaaaggtctgaaacaagcagccagcaggcttagaatacaatcttttgtttttccttctgcctcaggtgagtgaaagggaccaaatgaatgcatcgtagcagttttcttttctttaaatatgggcttcttaactctaaaattatgaccctcatttctattttactctgcattttaaattttgaccatgtattttgattagtctttctctccactgtttaagatagctttctcagataattaaaatttttattttttcctcagcttttctctgaaatgctggtagagcatgacttatattcttacttaatcagttagtgaaactacaatgtaattaaactcatgatggaacatgttttatccaaatttgaactgatagctgaggctctaactttggcttaaattgtcaaaatattgccattgtaacgttcttcagattaagcctgggctgtattctgtaacaagacaacaagggccatgtggctttctattctataagtaaatatgttgcataatgaaaacagaataatttttgtatatttctttactgagtatgtattttgattgaatgaacagactgttctaaataagaatggttagtctttgttctcaggatgataaggagtcagatataaaaccaatattcatttgaattatcctaatgcttaaaggagacatgcagcagattagagaggcctcatttgggaggacagagaaggtttccctgaggaagtgatatttaagctgactctttaatgatgagcaaagattagataagcaaagaaagtacaaaaatatttttcagtgtgggagaattagagcttaattttttaaaactatattcaatgaatccgagaagtgagataatcagatctaaggattgaaattgtttaaacattacaagctttagaacatcacggaaatagttgaaatatggcaattttagaacttgtctgagaatcaacctaagtgaatctagatttatttaaatgatgctttgaaataatacatagatgtaaactggctgtaactcgattagaaggaaatacagtaagtagccaataagtagcatctactgtaagaacaaaatgttacaaaacaaatacagaccaaaaccaaatccattaacatatttgcgtatacagtgtagggtataattgctcataatgtgaaagatatttgggatcgtttttgatgcaccatgtctcttcataggatacctactaccactggtcctttaataaactactattgggaacgcagtgtctgatatgttgatacaaatcattcaaaattatttgtcccatatattcacctaataggcaccaaatttacatgtaagcctaggacttaaaaactttccagaatattcaaaagtagaggtaaagatattttcatttctccagtgcttatttaactgttatgacatggctttaaggtttgtggtagtattctaagtagtgtagtcttaattagttggatttatacactttagaagaattaattatttattctttctaatgttaaatgagagagaagaaaatgttgagatgcagaggaatgtataataagctttcagctagtacaaagctgcctgtacctgctcattttctcctttgctagtattcattgcatctctctggcgtgtggcaatggggtgatgccataagaaacaaagcaagagcctttgtatttgaattttcaatatttccagtgaaatgaaaggtatgcacattatcactagacaatgaactggaagcagcacgtatccttttgaatttaggatggttttgttttgtttttgtttttaaattaaggcaagattgaaaagccttgctatttcatttcggatgcatcctacatgagtataatgtgaatgcattctgagagcatatgccatagaacttgttgaaacttctgcaagttcttttacatcatttacggctgtaaattatttcatgtttacagcaaggagtgaacactccagaataataatcagctacctatttacaagaatgttcagaagttctaaatattgcttgaacaaatgatagactaggtttatcgtaatagtgaaagttccagagcaatttccagacataatatctatttgagacagttaaaagacatttaaacgttcatctccctaatagttgccatatatatatacatatatatgtatatatatatatatatgtatgtgtatatatatcaatatgaatatatattgatatatatatctgcaaactttaatgtattaaatggacaaatggacagcagaaatactaaccacacacacacgcacacaaaaataaacatatataatcaattgagtctatgtatcttagttcatatgtatatgtgctcaggaatgaccactatagactgtacaacctgtatagcaactagttcctggaagagactgatttttcttttctaatcagccaccgactaccattaatgaattttaaccaaatgaaacatgtaactgaagtatcagtggtacctcaatttctattgccctttatgattaattgaaaccaccaagataataatcttaagaaatatagttgaagataatgaagctagaatagaaattcaaaatcctgaagccatttgtgctttttacttatttttcagcagaaagtggtaattgtgagagttatgaggataaagtcaacagataactgaatacctacatgctcattgctaaagtaagaagacactaatggcatttctttgtagcaataatatgttgaagaacagtgaaaaagaccacattcataatattagcaagatataaattgatcagaataaatatataatgagatttataaaatctacatataaatttagagcattctgaaaactacaggcatagactacaattctagatgaaagatacaaaaaaactacaattctagatgaaataaatatggggaataagtatataaattttccttaaatttatccaattacaattatagcagaatagacattttaattgaattttttaatttaacaagttttatacatatgaaaaataacaacatgcaaaaatatgtaatgttgtttagagaaccatgcaacattgtaattgagaactcatctgataataagataaatcatgagaaacttttaaaagtatatatatatatatatatatatatatatatattcataaaagtaaatgaaagtaaaaactagattacttttaaatatagaaaactatatcataaaatatgcctttgtaaatgacatacaataatgcaaaaacagataagcattttagtactttctctttgtctaataattttacatggcaaatatttctgaaatttatctacttttccccattctcagtgtttaataaccttcagttccatcatcacttttctattttagcaaatgacttagtcagtgttctttttctatgaagagacaccatgaccgcagtaactattataaaggagcacatttaattaggggtggttcaaagttcagaggtttagttgattatcatcatggagagaagcatggcaacatgcaagcaggcatggtactggggaagtagccgagagttctacatctggatatacagacagcaggaagagagagaaccattggacttggcttgggtttttgaaagctcaaagccagtgacacatttcctccaacaaggttacaccttctcaaatagtgccattaatacttctcaaatagtgccatttcataatgaccaaccatttaaatacagaagccataagtcccaattttattcaaaccaccatagcccaccatgtaaattccagcaaaagccacatatttttccctttctttgggctttgttttcagtttgccttttatatttgtatgaacatgtcactcagtgacttcactttgctagaaatagtcgaaagccattagttggacgttcaagggttttcattcttgacctgtattttttcattagcatctgctttcctaccaataaactctgcctctcaaatacttatcttttatagtaatactatatattttataattctgtttttctttcataataatctttacaaagatgtatctgcattcttttctaatttttttctagtctgtgatgagtagtacttataaagagaaatattaatattaaggctaattaatggacatttttattaataattttcctgtttaaaaaatgtcatttttaatagttgtggtagtgtgtcgtgcttatgatcccgggctttgaaaaactaaggaaggaggatttctgagttgtaggtcatcatagtatagagaagaagacctgttctcaaaaaataaaaaaataaaaataagaaacccaaagccaatgaactgaacaaatatacaaatgaaaaacaaatactgttcttagcttcttcaacaagtgatgacacatgtcattattgtctttatgttcccagtgccttgtacatagatgatactttgtaaatttttgccaggcaaattaacttcacttgctgagacaaaaatataaaagcaatatgtaaggtttatttgtttccatgaaaacaagtgtattatcaaaagatggcctagtcggccatcactgcaaacagaggcccattggacttgcaaactttatatgccccagtacaggggaacgccagggccaaaaagggggagtgggtgggtaggggattgggggggtgggtatgggggacctttgggatagcattgaaaatgtaaatgaggaaaatacctaattaaaaaaaaaaagaaaacaagtgtattataaaagctcatggttaatttgaaatcactaacattatagatagaatatactatatgtccaaggtacttttcttaggactcaaagactttattctatttattatgcaaatttttggtagggataacatattatatataaatacttcagattggttctcttttttaggaccaagatttggactttatttaaactaaacaagtaattcttttctggagaaacaatattatttcacctcttactatttggttaaatctcactttctggccctataatgtgaaatcatatcagtttaaaaaaatgtatgaggtagtttatctagtgagtgtttttcaatgttttagattagctgaaaaagttgttggcacatttagcagtaatgatgcatagcattttgtttgaattgctacaaattagctcgaagatgttcatctctaagttcagtaatttctatgatatatctctcaaaaatggttctccttattgaaatctttgttgcagtaaataaatattcttctccagggagcaatagtctaccccagggaaagagggggaattgattgtcaaatagcaaataatcatacaggaaagcatatataagaaaatgtgtacatacacacacacctttacacacacatgcacagacacacagacacacacatacatacacatacacacacctgcgcacatgtgcgcacacagacacacacacacacacaccatttaagaaaaagatgccatgaatttgaatagagctggaagggtacatgggaggagttggaggaaggaaatagatagatatgtaatcataagtttaaaaaattaaaaattaaatttaagggaaaaagtccctactccatcctgaagtttaactatatctttaggaacacaatttttatcacaaactgaacaatcgatattttcacaagtaaatttgcaaattgctaaaatcagtatttttgaggatgcatactaaattcataaaacatattgtggctagtccatgatgtaaagacttagaagaataatgaaacattgaggacatagtatgtttaatataaaaggatatgcttgacagacacataacataaaagaggaaaagtagaaaatttatgtttattagatgcatgttctcattgaaaaaaactgggaaagggaataacatttgaaatgtaaataaataaaatatccaattaaaaaaagatagagagaaatgggtcttttagagatacaagccctcagccttggatatattttgattcagtgttttgtccagatattgacagttagctttgtaatttcggataagtttctggatgtaatgagctcagtttcttcatttgtaaaatgggaataattattgctttgcgtggcagtctttaagtgttagtataataagtatacatcgagtgccacacaatgcactaaagactgagctgtgtctcaagcagtgttgcatgcctgtgatctcagcacacagtatgcagagccattaggaaggagagtttgaggagatcatggactacatagtgtgaacctatttcacaaatcagagggtgagaatgcagctcagtgggactagttgtctaggaagtctaaggcattggatatgctcccaacatgttgttgataatgataataaccaagcagttattatgatccatatgtggaaaaatatatttggtatagtgtagtataatttgtgtttataccctcaaaaacaattatgtaatatgtaatgaaatttagaaaatagccacttgtataatcaaacagccctatgcaactgactgatttaaatcagctttccattattctacagtcagttaccataactgttgaccaatattaagggtcagttaatattttttttttagttctgctgatgttatatgttaatataatttgtgaatatatatgcttctaggttagtccttgctgttatattcaccgcacttggtaggcaggaactttcttgcaagttcacattttttttttcttaacacataggaccatatcctgctcctcctgcaaactcaactcattatattccttgacactgagactctgataacagatctaatattaatccaaaatatgttccaactttgaaataattcaaggaggctacaggctttgtgttttttgttagattcttgcttttttttttccttctcaaagatgcacattatataacatactcctttgagagtgctgttttaaaagtttttttgaccttaattatactggttagaaatgtcaagatagtgcattaacctactgcgctccagatggctggcttttttttttcctcttgtcttgttatatctaaagaatatgagattggcagcagagcactttaattgatgtcagatttggcagtgtaatttttttcattttatacagtgtaaacatccacttaaaatatgagatgcattgatatattcaataagtttaaactttcattcactttgtgccataatttataaagaatttatattaacaattgaagatttttaacatccatatttttatatagtagaagaaagttttttaaggatgtatatgcattttttgtgttttagattttattgattttctcttttaaaaagacacactacggctataattcatagaatgtgacctacaaaatactttttctattgttattattttgatggagtgggaccgtgtgttcgcttacattccaatccacgacagaagtgcttagatgtaagaattttgtaggcagaaactcatggttggaaatctataaaactaatgccattttatttataatgttatgctgctgtttatattggcatactttcaaatgataatatgtgcactttttatgggtgagaaattgtacttttataaaaattccctaaagattttatgcttaatactagttcagtattcttactcgattgttttctcaagttaggtagatagaggtttggagaaaatacgtttttgtgatattcattgtatatactagttgataactaaaattgcttcttatttaatagagatgaaacatttatcagagaatcttaaataacttctaaattcatcacatttatagggaataaatacaaatgtttcaatttgttaagttaattcagtttcttgaaatgaagcctaaaagacctatttctacatattcttctaatttgtatttagtaacctaaaaaaaaatctggcttcttttaaacaccagcgagaatattatgctattaatacattatttggtttcaaagatgccagtgtatttaattaacatgcaaatttagggactagttggttgtactctgaatttgttatctttttccattgtagtaacattttttaatgtgtcagctcatgtacatgaaaattaaagggcctttctttatacatcatcatattgaatatctttaaagtatagttttctgtgttttttatgtttctaaatatatgtccaactcaaagaattttgttttcaaatttatttatttaatttaaacaaaaagtttacttttattttatgtctctgtgtgtttgaatgcctgtatgtatgtataccacatgaatgcctggtatctgcagaagccagaggcatcagatccgttggaactggaattagagctggcatgtagttttaaagaagtgaactatgtctataaaaatacagcaagtgttcttaatcccaggagccatcttttagccccaccccactcccccttttgaggtaggctctcatgatataaccctggctggccaggacattactatagaggtcttgctaactttgaattcctagagacctgtctgcatttgcctcctgagtgctggcatcaaaggtgtggatatccctgcttgtcttcaaatttgttttttaacattactatataaaattatgtatatccatgttatacagtgtgatatgctgcagaatatatgattaaatgtagctaattaacaaatatattatctcacagttattctagtaagaacacacatctcagtatttttcaaagttatattcaactgtatattttcaaaggtatatttaccatagtctatcatgtcctgaacttactcctcctgtctgtgtagacatgtattatttaattaaatatctctccaatcccttatactctcaaggaacctagcctgtggtaactcacataataccctcaatttctatcatataactttatattgtatacataaattaaatcatgcagattttgtctttctttgcatgcttcatttcagtaagtatattctatttgtattcttccatgttactgaatattagagttttttgagtcattcatttgtttcagagtcatggaaaaggtcctatagtcacagggaagttgcacttcccactccagttctcccctccctattggaaactgtggataccaggagggttttgtgtcgaggtatagtcaagacaaagagggtgtaaagtgaacctcatcttttaacggtggagagtgaccttttctatgtcttgtggtgccatggtatgtgctgggctttctctgcacttattcagaatggtgctctttcttatgggtagttgttagttgattttgtaagaaggagtgaggcacaagaactcctgttctgtcaccattaatttcattgctcaggctgatgctcggtttgacaccatctcactctgtcaggtctttttaaaaaggagggcaagaagtaaatgctgactcagagtctcagggtatgctcttttcttttggtcattttgaacgttattactgctaccgaggaggaagtatgttcagtgctaagcattcaggccttatagttagacatatctgagctctaacttcagactatattgcttatttgtgcagtggccttgctccagttttccaagccctagtttccttttgtgtaagatgcagatagatgacactatacatcagaaggctgcctcctcttggggaacatggtggttttttttttgtttttttttttttctgtctttattatcccagccttccagcccacatatgtagatgaaatagcttggtttcttcaatgaatctcttttcttctaactggtacttttagcacatttgtccttgataactaaacagtcattctttaaataaataaaaaaaagccaataaaattgaaatgaaaccatttttaagtgataagtgattttgtgactccaaattgccattcatgatgtaaacagaccgaagggcagacacttttggactctctgtgcctgtagtgcaatataggatgacccagcggtgccacctgtgtttcatgtctgatctgcagttaaattttaatgagtataggcaatatgtggtaatgtcatttgctgtttattttggtacacatactttttcatactaagattatttcattaggattcagtaatgaatgtttcatttctcagcaaaaataaaatcttagaaaaataaaagtagagcctaattaggttttaggacttggttcgaaggtgatagtccaagtaatttagtttatgctcagtgttatcatgtttaaaaatgaaacagcaaagtgctaagtttttctaacatacctcagaaaccattagacaatgtccaagaattcttaacaaagctagcctgtgctctagtttcattgatgtactagcaaatctccaaacatgctgtgtttgagtttttatatttaagtgtttaatatttgaccaaaataacctagtttgccttacatggttagcacttatttgtctgtgaaattcttccatctattcttccgtctattcttagttctctcatgctctgccacctattatgacaatcttttttctgctcattacctacccgagtgtgagctgtgctatgagaacattgggtattaacttctcaatgttccaccatatctgcaaatgtactaaacattaagtggaaatattagaatataagaaggaccctgtatatacaccataacagatactttgtgttcctgttgttagttcataaagacagtgaaggcctgcattattaatgcggttatatataagtattgtggtcaactcaacttattttttaaaagagcatatttttgttctatcactcatgtagtagcctgctatgaatcacattcaaaatagctgggcctttgaaatttcacagctcaatgggcttaaaactttattttatttaactctagaattgcttttctggaatgactcttctgcagaatatgaatatataaatgtgcaaatgccctcattattagtggcacagaagacagactttaccagttagcccacattttgtacatttcctccttaactagtcaaggtttcctacagactctcgaaaaacttttagtcttttacctatgatatgcattcattgtgtttggatatagccattgtgctttaaaatataattttttattgcagttaatgttaaaatgtaaactgttgtcttttaacttagaatttgctatcacaaactatttttacattctattcagtttaatgactatatacatgtacaaacacacatgtatacactgtgatgcaattgtataatggtaattttttccagtttttaaaaattaaaaaccttaattgatattacgtggtatcttataatctttattttctatataactaaaagactttagtgtgtaagaaacatttaatgtatcaaagttgtagagctcaagactatcaaaaaacaaatatatataacattatcagaaataccataatttagtatttggctcacatatatatttgcgtgatgaattaattagttaaatttcttttaagagacatttttgtgtttgtacggaggtgggaatggtatgtgagaacttaggggaggtagaattataatcataatatagtagatgaaaaaaatttctttaatatcaataggagctatctaaatgttcaattatatatgattttttagtattaccacatacttcattattggaaccaatacctagatttgtatgtgtaggacactttgattttcttacttaaatcatgaaactggtatgggaaatggcttctcagttaggttgttaatgttgtaggatccacctatggaacaacacaagaagtctttgtagatataacgcctaatatcctaacttaaactactgtatttttaaaagctagagtaatagataagaaactcacttagctaaagtagccaaagaaacttgacattttttataaattttttattggttatattgtttatttacatttcaaatgttatcccccttcctggtttattttcagaaaacctcccatcccttccctctgcccctgcctccacgaaggtgctcctccacctacccgaccactcctacctcaccctactatccccctatgctggggcattgagtcttcacaggaccaagggcctctcctccctttgatgccctacaagacaatcctctggtacatatgcagttggagtcatgggtccctccatgtgtactctttggttggtggtttagtccctaggagctgtgggaagtctggttggttgatattgttgttcctcctatggttttgaaaaccccttcagctccttcagtcctttccctaactcctccattgttgtccctattctcagtcctaaggttggctgcaagcatccctatttgtattggtagggctctggctgatactctcaggagacatccatatctggctcctgtcagcaagcacttcttggcctcagcaatagtgagtgtctgggtttggtgactgcttatggaatggatccctaggtcatacggtctctggatggcctttcctccagtctctgctccactctctgcccctgtatttcttttagacaggagcaattctgggttaaaattttgggaagtgtgggtggccccatactacaaccaggggccatgcctaacttctgcatatggtctctacaggttctctctcccctttgttaggtatttcctttgcctcagagaagcttttcaatcttatgaggtcatatttgttgattcttgatcttagagcataagccattgatattctgttaaggaaattttctgctgtgtgcatttgttcgaagctcttccccactttctattcaagtagtttctgtctatctggctttgtgtgtaggtccttgatccacttccacgtgagctttttacaaggagataagaacatgtctctaggtgcatatgtagcagaagatggcctagtcggccatcattgggaagagaggccccttggtattgcaaactttatatgcctcagggagctccacggccaaaaagtgggagtgggtgggtaggggagcagggcaggggggaggttataggggactttcgggatagcatttgaaatgtaaatgaagaaaatatctaataaaaaattgaaacaaaacaacaaaaagaatgggtcaatttgcattcttctacatgcagaccaccagttgaatcagtagtatttcttgaaatgctggatgtttttagcttttttgtcaaaggctaaataactgtacatgtgtgtttatttctgggtcttcaattttaatccactgatctatctgcctgtctcataccaataccacggatgttttgtttgtatgttttttaatcacaatcgttctgcagtacagcttgaggccagggatgatgttttctccagaagttctcttatagttaagaatattttttgctatcctaggttttttgttattccaaatgaatttgagaattgctctttctaattctatgaagcattgagttggaaatttgatggggattgcattgaatctatagattgcttttgtcaggttggccatttttctatattagtcctgccaatctgatccatgagcatgggagatctttccatcttctgaggttgtcttcaagttctttcttcagagacttgaagtttttgtcatacagatctttcacttgcttggttagagtcacacaaaggtattttctgttacttgtgactattgtgaaaggtgtcatttccctaatttctttcttgacttgtttattctttgagtagagtaaggcaactgacttgaggtaatttgacttgcttaggtatgaaatgtagtcaatagcactctcttagtttgcttgtcttttgctaccataaaacactgaacaaaaacaccttggggagggaagagtttacttagatttcattttcttatcagaatctattatgagggtaagtcagggcaggaacatccaagaaggaattgaagccgaaagcatagagcaattctgctgtatttgtttactccagaaagtttgctcaacttgctttcccataccatctgtccagtgcaggtaccgctgcccagacagctaggtccttttacatcaatcaagaaaccatagacatgcttacagggcatgttgggagacatgtcccttacatgagcttctctctctccattgactccagttagtgtcatattgacaaaaatctaactgtactctattgcaattgatagtaattgctatctgtgtacatactgtagttgaaagacctatgtgcaatccagtgaccagagcataatacgtttacaactaagatctctgaagccttttctgaaattaaaagtaaatctgtgttacattgaaaaatgaaagaaaaaggtgtttcaagtcactaaactcagaagtggttatatctgttgcatactttggatattcccattgaacattgcttttctagttttgatattgaatttttatttctgggcaatggaggatgtggctcaatgtaccttttagttctctgtgtactgtcttagaataatacactcatagccatacagacaagtttctacattctagtgattttcaaattaaggaatagcttcaaattaggaaggctttctagtcacctagctttggaatagcatggtgttctctaactgctgactttgtctgcattgtttttaaaagatcaaatgggcacagtggtaattttcattaatctcatacagagcagctaattaaaatttcaattattatccatccattatctagttgttgcctttgttcagtattagatcaggatgttaataataagacattcgtgtattacagcccttttaagtacagtgagatttagtttaatctattgcactgttttgtttcagggttatttctttaatattatgttgtactatattgattatgctgacaatactcacacactttaacattttttttaaaatagagatttcagatttaaatacctgttgcttcagttctttattcaatactgggaaaggttgcatgggaagaatacattaattgtctgatgttctcaatatatatacattagttctgaaacctcactaattattatgcccagttaactattccctggattcttgctttttaaatatgtagtccttgctgtcctagaccttattgtgtaaaacagtctagccttgaactcagagatccaactgcctctgattcctcagggctggatgagaggtgcaccacaatgctctgctgggttctttatttctgtaaggaaaaaattaaaagaatttgtctttaagaatcattttaaccttaacatgctatcgtgattttataatgtcaaacagtaacttatgtttaagcccaccaaattgggaaaaaatattattctataacctttatcagttctttccattccttttaacatctgggtatctagataatttaacttaaactttctaatgttaatcattgtggctttctgcctacaatcataaccatttggaggtctgccatagaaggattgtcagaagttcaaggccagcctgggctacagagtgagttcagagaaagcctatgttagaaagtgagccctgccctcaagaaaaaaacacaaagtaaaagaaaagacaaaaacaaaaataatgtatttaaagaatagtagttatatagaaggttgatttctatcccagcgtccctggtctaagtgtcaataaacagcacctcagccgtgaccttatgtgtctattaaaataattctattaaagttcagttagcaaatggagttaacgtttgtttttttttttttttatctatgataggaaacatataaattcatcttttgaatatctttatattcacttatgtactttcttaataggagatatttattacccgtatgccatgcatgagtgaaatggtttataaagaatggattatacagttttgactgcaaacctcgagatgtcctggttcttaatagctgggtagtattccattatttaaatgaaccacttttctgtatccattcttctgtcatgggacatctgggttgtttccagcttctagctatcacaaataaggcccctatgaacatagtggaacacgtgcatctgtggcatggtggagcatcttttgtgtagattcccaagagtggtatagctgggtcttcaggtagatctatgcccaattttctgaggaacctccagattgatttccagagtggttgtaccagtttgcaatcccaccagcaatgaaagagtgttcctctttcttcacatcctccccaacatgtgttgtcctctgaggctttgatcttagccattcagattggtgtaaggtggaatctcagggtcatttagatctcaacattgcttagatgaggagactccattaaaacacactgtgtttgaaaatgccataatgttatttatatatatatgtctacattttattttactttcaagattcaaaggaaaaaaatgttgtctgtctaaagtggtatcttctatttattttgtagggtggcctgaaaaacagcaaacatgagttcaccctttcttcacaagaatatgttcatgaattacgatctggcatctcagatgagaaacttctcaactgcctggaatctttgagagtgtctttaaccagccatcctgtcaggtatggtttttatcattttgataggattcatacattttgcattttgtatgaatatttggtggtataatcagatatgttacttcaacatcaagatttttccatctagaagtataggattatctaacagaagagcattgtctgattttcaggttctaaatttttaaaaatatgtttatgtgtagctaatctgatctttaataatgtatgatttaaaaatgcagatattttggaatatttattttcattttgattatgtgaaataaatacagaagtaaaatattgacatttacatgttagtctatttatgtacccagataattttcattatttaatttgtaaattctatcctgtttataattgtgattatatataactgtgtatataattttatatctttaagttttatatagactacccacatattttttaattcaaaatagtaaaaactattttaccaataaaataatgaaatagaaatgattaataaactaattagtattttatacatcattaagaggcattttcttggtagcaatgaattggcaaataattcttcctttattgacagtaatgggccttaaaattagtaatatccaaaataatattttatgaagaaaaatagatttcagtataatattataatattcttggatctacatactaaattgttattgtcttaagctcagaatttccttaaaaaataggtatataatgaagctttgtaattttattcatgttccctttatatttatgcttagatccagttcctaaatcattgaaaataagttacatatcagtcatttaactgagcttaggtatagattctaatatattgtttatttatattcatactatacttggaaaagtttgaaagttataatttcgtagtacagagttaagttgtgggtttttttttttttttttttttttttttttttttttttttttttttctttttttttttttccattttttattaggtatttagctcatttacatttccaatgctataccaaaagtcccccttacccacccacccccactcccctacccacccactccccccctttggccctggcgttcccctgtaccggggcacacaaagtctgcgtgtccaatgggcctctctttccagtgatggccgactaggccatcttttgatacatatgcagctagagtcaagagctcaggggtactggttagttcataatgttgttccacctatagggttgaagatccctttagctccttgggtactttctctagctcctccattgggagccctgtgatccatccattagctgactgtgagcatccacttctgtgtttgctaggccccggcatagtctcacaagagacagctacgtctgggtcctttcagtaaaatcttgctagtgtatgcaatggtgtcagcatttggaagctgattatggggtggatccctggatatggcagtctctacatggtccatcctttcatctcagctccatactttgtttctgtaactccttccatgggtgttttgttcccacttctaaggaggggcctagtgtccacacttcagtcttcatttttcttgagtttcatgtgtttaggaaattgtatcttatatcgtgggtatcctaggttttgggctagtatccacttatcagtgagtacatattgtgtgagttcctttgtgattgtgttacctcactcaggatgatgctctccaggtccatccatttggctaggaatttcataaattcattctttttaatagctgagtagtactccattgtgtagatgtaccacattttctgtatccattcctctgttgaggggcatctgggttctttccagtttctggctattataaataaggctgctatgaacatagtggagcatgtgtccttcttaccagttggggcttcttctggatatatgcccaggagaggtattgctggatcctccggtagtactatgtccaattttctgaggaaccgccagactgatttccagagtggttgtacaagcctgcaatcccaccaacaatggaggagtgttcctctttctccacatcctcgccagcatctgctgtcacctgaatttttgatcttagccattctcactggtgtgaggtggaatctcagggttgttttgatttgcatttccctgatgattaaggatgttgaacattttttcaggtgcttctctgccattcggtattcctcaggtgagaattctttgttcagttctgagccccattttttaagggggttatttgattttctgaggtccaccttcttgagttctttatatatgttggatattagtcccctatctgatttaggataggtaaagatcctttcccagtctgttggtggtctttttgtcttatagacagtgtcttttgccttgcagaaactttggagtttcattaggtcccatttgtcaattctcgatcttacagcacaagccattgctgttctgttcaggaatttttcccctgtgcccatatcttcaaggcttttccccactttctcctctataagtttcagtgtctctggttttatgtgaagttccttgatccacttagatttgaccttagtacaaggagataagtatggatcgattcgcattcttctacatgataacaaccagttgtgccagcaacaattgttgaaaatgctgtctttcttccactggatggttttggctcccttgtcgaagatcaagtgaccataggtgtgtgggttcatttctgggtcttcaattctattccattggtccacttgtctgtctctataccagtaccatgcagtttttatcacaattgctctgtagtaaagctttaggtcaggcatggtgattccaccagaggttcttttatccttgagaagagtttttgctatcctcggttttttgttattccagatgaatttgcaaattgctccttctaattcgttgaagaattgagttggaattttaatggggattgcattgaatctgtagattgcttttggcaagatagccatttttacaatgttggtcctgccaatccatgagcatgggagatctttccatcttctgagatcttctttaatttctttcttcagggacttgaagtttttatcatacagatctttcacttccttcgttagagtcacgccgagatattttatattatttgtggctattgagaagggtgttgtttccctaatttctttctcagcctgtttattctttgtgtagagaaaggccattgacttgtttgagttaattttatatccagctacttcaccgaagctgtttatcaggtttaggagttctctgttggaatttttagggtcacttatatatactatcatatcatctgcaaaaagtgatattttgacttcctcttttccaatttgtatccccttgatctccttttgttgtcgaattgctctggctaatacttcaagtactatgttgaaaaggtagggagaaagtgggcagccttgtctagtccctgattttagtgggattgcttccagcttctctccatttactttgatgttggctactggtttgctgtagattgcttttatcatgtttaggtattggccttgaattcctgatctttccagaacttttatcatgaatgggtgttggatcttgtcaaatgctttttctgcatctaacgagatgatcatgtggtttttgtctttgagtttgtttatataatggattacattgatggattttcgtatattaaaccatccctgcatccctggaataaaacctacttggtcaggatggatgattgctttaatgtgttcttggattcggttagcgagaattttattaagaatttttgcatcgatgttcataagagaaattggtctgaagttctctatctttgttggatctttctgtggtttaggtatcagagtaatagtggcttcataaaatgagttgggtagaataccttctacttctatcttgtgaaaaagtttgtgcagaactggagttagatcttctttgaaggtctgatagaactctgcactaaacccgtctggtcctgggctttttttggctgggagactattaataactgcttctatttctttaggggatatgggactgtttagaaggtcaacttgatcctgattcaactttggtacctggtatctgtccagaaatttgtccatttcgtccaggttttccagttttgttgagtatagccttttgtagaaggatctgatggtgttttggatttcttcaggatctgttgttatgtctcccttttcatttctgattttgttaattaggattttgtccctgtgccctttagtgagtctagctaagggtttatctatcttgttgattttctcaaagaaccaactcctcgtttggttaattctttgaatagttcttcttgtttccacttggttgatttcacccctgagtttgattatttcctgccgtctactcctcttgggtgaatttgcttcctttttttctagagcttttagatgtgttgtcaagctgctagtatgtgctctctcccgttttttcttgaaggcactcatagctatgagtttccctcttagaaatgctttcattgtgtcccaaaggtttgggtacgttgtggcttcattttcattaaactctaaaaagtctttaatttctttctttattccttccttgaccaaggtatcattgagaagagtgttgttcagtttccatgtgaatgttggctttctgttatttattttgttattgaagatcagccttagtgcatggtgatctgataggatacatgggacaatttcaatatttttgaatctgttgaggcctgatttgtgacctattatgtggtcaattttggagaaggtaccatgaggtgctgagaagaaggtatatccttttgttttaggataaaatgttctgtagatatctgtcagatccatttgtttcatcacttctgttagtttcagtgtgtccctgtttagtttctgtttccatgatctgtccattggtgaaagtggtgtgttgaagtctcccactattattgtgtgaggtgcaatgtgtgctttgagctttactaaagtttctttagtgaatgtggctgctcttgtatttggagcatagatattcagaattgagagttcctcttggaggattttacctttgatgagaatgaagtgtccctccttgtcttttttgatgactttgggttggaagtcaatcttatcagatattaggatggctactcctgcttgtttcttcataccatttgcttggaaaattgttttccagcctttcattctgaggtagtgtctatctttttctctgagatgagtttcctgtaagcagcaaaatgttgggtcttgtttgtgtagccagtttgttagtctatgtctttttattggcgagttgagaccattgatgttaagagatattaaggaaaagtaattgttgcttcctgttattttagttgttaaaggtggcattctgttcttgtggctgtcttcttttaggttattgagggattaccttctttttttttctagggcgttgttcccgttcttgtattggtttttttctgttattatcctttgaagggctggattcgtggagagataatgcgtgaatttggttttgtcgtggaatactttggtttctccctctatgataattgagagtttggctgggtatagtagcctgggctgcagtttgtgttctcttagtgtctgtataacatctgtccaggctcttctggctttcatagtctctggtgaaaaatctggtgtaattctgataggcttgcctttatatgttacttgacctttttcccttactgcttttagtattctatctttatttagtgcatttgatgttctgattattatgtgtcgggaggaatttcttttctggtccagtctatttggagttctgtaggcttcttgtatgttcatatgcatctcattctttagatttgggaagttttcttcaataattttgttgaagatgtttgctggacctttgagttgaaaatcttcattctcatccactcctattatccgtacgtttggtcttcttattgtgtcctggatttcctggatattttgagttaggatctttttgcattttccattttctttgattgttgtgccgatgttctctatggaatcttctgcacctgagattctctcttccatctcttgtattctgttgctgatgctcaaatctatggttccagatttctttcctagggtttctatctctagtgttgcctcgctttgagttttctttattgtgtctacttccctttttaggtctagtatggttttgttcatttccatcacctgtttgtatgttttttcctctttttctgtaaggacttctacctgtttgattgtgttttcctgtttttctttaaggacttgtaactctttagcagtgttctcctgtatttctttaagtgatttattaaagtccttcttgatgtcctctaccatcatcatgagatatgcttttaaatctaggtctaggttctcaggtgtgttggggttccctggactgggcgaagtgggtgtgctgggttctggtgatggtgagtggtcttggttcctgttagtaagattcctccgtttacctttcgccatctggtaatctctggagttagtagttatagttgactctgtttagagattgttcttctggtgattctgttaccgtctatcagcagacctgggagacagattctctcctctgagtttcagtgctcagagcactctctgctggcaagctctcttacagggaaggtgcgcagatatcttgtatttggacctcctcctggccgaagaagaaggcccaaaacaggacctttctcagacactgtgttgctttggcagttcccaggtggtacagactctcacctaagcagactaaattcctaagttccttggagtcccgggaccaagatggcgaccgctgctgctgtggcttaggccgcctccccagccgggtgggcacctgtcctccggtccggaaggtggccggctgtccccggcccacacagggtgctgcctcagcgcctctgtgcttctgcctgttccagaagctgtcaggttctctggcgcaccctctcacctgttcagactaatttcctaagttcggcgggtcccggaccaagatggcgaccgctgctgctgtggcttaggccgcctccccagcgctgggtgggcacctgtcctccggtccggacggtggccggctgtccccggcccacaaagggtgctgcctcagcgcctctgtgcttccgcctgttccagaagctgtcaggttctctggcgcaccctctcacctgttcagactaatttcctaagttcggcgggtcccggaccaagatggcgaccgctcaagttgtgggttttggttgtaagaatctgtcaatggctgctttcttgacatttgtaaaatggtgtgctttaacggtttttataatctcattcaaatatttgagatctttattcgtttttatttctcacagtctcactttgtagttctgactagcctggaactcacaatatccctgaggctgtccttgaatgtctggtaatcctctgccctgtcctgatcagtgctaagccaccacacccagcatgaatatgacttatgtgagaatatgacttatgtgagaagtcgattctcacccactggcacctatatcaatatcagctgcagtgcccttccatattaaaatactcagttacaaacatactgttgagcagttgaaatgaatataaactgggtatactgaattttcagctgtgggagggtgggcctgtgagatttcctgatggtcaaagttggccagggcaatggtgtgtaaaactcattaaaccaagccattaataccaaaccaaaagtaaagtcccatgaaggctactacttgggattatggatcagtggttaagagagcttgctgtttttccagaagacacctgctttcttcctagcaccaatgtggaacagctctcaaccaccagtaacaacatcttcaagggatcagactcccaattttgacctctgggatctctctctctctctctcccccctctctcacacacacacatgcacacacaaatgcacaaacaaataaaataaccacatcccattcaataatggagagattagtatatgtttttcctagtccaaatgcatctttataagatataagatagtgcttgatattatatatggaaggtgtttttatttttctagactatttattctttttatttaattttgttgaagcacggtctctctgtgtagccaaggtctctctgtgtagcatagcccagactgtcatggaactgtgtaaacctagtaggcttcaaactcagatatcttccagcctcagctctcatgagtgtatgagttaaagttgctggacatttggtacagttccctgttttgcaattctgcctagcaacaaaacgtttgtgaaagaggtatttgtgatcccacgagagtttgggagcttaaggttagcaaccgcccttcctggtagctgattggctgcacaggaagtgtgaagttccttgtgaggctgggcaccagcattctgcagtatccatcagtggtgtctacatctgtgttgtcttgggagttagtcatcgagctcctatgaagaagtcacaccaaaagacaacactcttagccacatattgtgtggagatctaaccctgtcaagtcatcaaacctccccaagtccttgagaaataatgagtaagggcaggtttgggagtgaagacagtgtctttggtggtgacggggctagtggagctagtagaagccatatgagcaatccagagctcggatgttggggtttcctgactggaatatggaggcccaacacacacagcattgtgttatgttaagccagtgctaagtgccactgaaattgacagtgtgttcaagattaggtcatttagagttccctgggtctccaacatgaggatgatcatggaggctgaaaaagcttcatagtaaattgtgtacaaaattaatgacatgacctcaacggctattgagggcaggcaggctttggctaaaaggagatccaagtaggatctgattcctatttggaatgtatgtcaaagtgcttggcatcctgcagtcctccgagggaaccagatgagtcaagatcttgagcatctgcatcctggaaaatgtgaacaagctgtccacacaccctggagattgtagatggccattcattgctgtatcaaagccgtgcaggcacagccacagaacgcccgtccacggcccaggcctgagtctgccagggtttccagggtgtctgctcttaacttcatccctgtggaggttctgcatctgattggagagtatcctcaccaggtgggaaaggctatcacctagattcgaacagagctccttggagttacagatgatgccatcacacaagtcatccggcatctgagtaggaagggacacgtatatcccagcctggatcgccagcacctacaagtttctggctgagaaaaaagaactgactgtagtttcggaggatgcttctgttctgctgttttgataattaggatgtatcgactatttcaaacaaaaaagaaaaaaaaaaaaccttaaagaacaaaaaccaaaccaaaactgaacataattttcagatgacatctgttagcaacatgctatttctacctccattgaacttgtgtgttttctgaagatatttgaagaaacagtgatggaaccaatgactgggctttgtttccaaaacaataggaatgccctagggtggatttgtaagagaaaacaaatttgtgctcaaattagaattttattttcctgtttcagtttatcttagtcatgttaagttttcctaattatagtacatgataagtgtagctttactgaaaatgagttctgattttaaatattcacttcaagttattttgagtaatttagttttattaacattgatttgtttctttaaaataagatgctactgtagattgaggcaattcagtctctttgagacatcttcatatactttttttaaacgtgtaagttcagtggttttgctccttcagctaaattacagttcactttccttgcatggtgtatggacacaagactgcatgtttgttgtactgctgtgttacctacactattggatggtctaccagatgtaaaatagggtgttttgcttcaaactaggcatattgttccactaacaagacgtgaacagagatgaactgtaatgtttttattaaacctttgcaaaatttcaagtttcctttgatttttatccctcaaatttattagaaaaagctactagtttaatgttcttaatggttatcagattttattatgaggtgtaaatttttttatttttaacaccaagcattatattttactagtagtaactcattttaatttggttatattaaatgtgagaggcttttaagccattgatcattaattcctccattacacatatagtaaaaatggtgtatttcaaattatttgcttagctaaattagaagaaagaatatagttattctaggaatagatatgtgtgcctatttgtattcagacaggtagaaaagaatctttatccttttcaatcattaaaaggggacacaaaccctataaaatccttttgctgattagccatcagtaatggttttagaataacaatcagaaaatgttggcatctcattaaaataattactaaaaaatcttgcataagaccttgtgagtcaatgcttcttcccctttaaagcaaattataaatgctttaaatttttttagtttattttattaccttttaaacaattctttattttatacatctaagcaccttgtatatgcttgatggtcttggggatcattagagagcatcttattccctggctgcagtgacagagggttgtgaaccactattgggtgctaggctctctaaggtatctcatccctttgaccctttgctgttttcttattgacaaaagtaagcggagttcagaagaattatttgtacgggcttttcattagctcttgctccagtgtgtggaaatgagaaagaagccttcccaggaactgattggaacagtagagggactcctgttgtgtggtgagcagaactgtcagcataccattgaacactgacctcctccatgggctcttaagcaactccatattccaactgacttgattgacattattattcctggggggagaaggccgttacattaatgaatgacacaggaagtatcatattcattgtgatcaagaatcatgaacagataacgaaatagttttcttatgttgtaagcataatttattattattttagcgaattagaaggaaattaggtcattctatgtactaattttatccatggtgcttagtgcctacctgagtaagttatacctgaggttggtttgcattctgtgtggtagtgggcttgtccttggggaattcccatggtgatcactacaatgattccctgtgctccttttttttttttttggcccagaaatccctttagtagatctttcatctctgacatcttggagcaatctagcagcttcatattgctggttctccctatcagatatttttgaaaaaaatatagtttttaatatagaagaaattctgcattacttctttctaaaaccattacctttcctagtgaaaatcacactggaggaaaggcaattaaggacctgctttccataggttcgtggtgctgaaagaaatgatgttgaagataaatcattacattgttataacacctaatataaatgcagaaacctggagctatggatttgctatttatgactgtagctgtaagtcactcttgtaattgttggatctgattcagttggctagtgacaggctctaatttttttcttcctagtctggtactattatctacagaaatatggctccccccaccaacactcaaccttcaccctaaagttcttttcattttggatgctaacctgatattttgtctgggaactaatgttataatatgtacccttcaataaggcagctagctaacctttctcttaaatgttgagggctctgccttcccatatgtattccttaagattcttttagttttttgtttcatgtaacattttcaaaggtaattttcaactgcccagctacaaagtgcatattatttcaattttgtttatagtggtaatggtttttccaatgttccttttccttagtggtcctgtttatgaaccaaaactgtagggataagctatatattttgagatgatatcttcaactgttagccattgtaataaagaagtctaggaacaggagggaggctgagatgataggccattagccatgttaagatagtaccagaaccttggtagtttgtcataagcctcagttaactcaggtgcagcaatttatgggaaaatcagtctttggttcaaatattggcattgactctccagtaatagattatttgtgtttactacatgttttttttgttgtccagttcagattttattagagaatctcttgtttctatttgttattattttggcaaagcctttcatacctggctaccatatctagcttctcagcaaaagtacttgtcatgctaggggcatccatcgctaatcaaattagaaatttattgtctagaaaggaagcagcagaaagtatgggccacagttaattgttctagctctacctcctgagagtgtggctttgggttctgcttctgcaaatgtggtgagctttttaggtaccaatcagcacactgacttgaaagttagtgcatggaaaatgccatcaggtataagataccattgatttatcatacacatttagtatatatgtttcttgtagcatgcaattcatacaagtcttgttattacaagttgtgaccatgtaaacaagggagcacagtactaacatggagtgtatgccagatactatacaaatgcatattttgtaataagagaagaaagaggaaacaccataccctcatattaggataaggtacatctatgaaactgtctttccttagcaataagctattgtttaaatttcattaaaagactatttttgaggttagagagatagtttaaaggttaagtacattggctgctcttctagagtacccacgtttaattatagctctcacatggtagctcccaaccatctgtgtatctccagtcctggaagatccaattccctcttctgcctttctccgataccacatgcacatggtatgtagacatacacacagaacgaacatacatccacaccaaaaataaattaaaaaccaaacattgttcctgtttaaataaatgctctcagcttacttttaaaaataaaacaaaattcatggtgaataaagcacagtaaccacaataaccacaaatgaaagaaatgcaggttattgttacttttatctgagattcataatttctgttccaagaaaaaaactgatatagaaggtagtagaaggaaacaagtctattccaggtgaagcctgagcaaatgcagatagaacctctcctttttagatctcccatcttggagaaataagacagtataaaggaattttatggccatagtatatgatagtgagacattagttggacaattcagagtgtgggcagagtccttatgttcagatagcctgtctggtttcttttgtttgtttgtttgtttgtttgtttgcttttgtttttttgttgttgttttttgtttgcttttatttaatgttttttttttaagttgttcactttacatcccactcactgccttccttctggtcaccccctcccacaatccttccccatcccccttccccttctcctctggtctggtgggaccccttcagtatcctcctcaatccaacttggcactttacgtctctgataggctaggagcttcctctcccactgagatcagacaaagcagcccagctagaaaaacatatcccaggtataggcaacagcttttgggaatagtccctgttccagttgttggaaacccacatgaagaccaagctgcacatctgctacatatgagcaggggagtctaggtccagccagtgtattggttggtgattcagtctcggaaagtctcaagggtttaggttatttgactctgtgggtcttcgtatggagttactatcccctttggggctgcaatcctttctccttgtcttccatgagattccctgagctccaactactgtttggctgtgggtgtctgtatctgtctgagtctgatgttgggtggagcctctcaaagaacaacatactcctgtccctttcttgatcttgatcagatttatatcttaaatcctaaagcagcatctacattttctcttaagaaaaccatctttcataataactggacagggtgaaaccttatggacaatgccatttgaaatggacaaattcaaaagattcaggaaaggatagccatcaaaagtaaatacaacacgatggcaaagactggaagatagtcttaaataaaagtctcctatttatcaatacatatcaatttttcttcttaatattatgaatacatttattgttatgaattacttttatatttacaggctaaatatggtttctgcctaccctttaactttagtaatatgataaatctatgtagtactaaagatatcaggtaatgttgtcccccatttagaaccaacagtaaagattttactgtttttaagttgagtgtatagacatgctataggaaatagttctttcacattctgaacagtttctacattaaagaagtctaattgtattcctttgaggtgtcagtattcactctatagtataccatagaatacactttttacttcaaccagggcaaaaccatcttaaacaaggcaactttgctctctagttccttctactttaaaaggcttagtcttcctttctgaatctaacaaataagcaaacaagccagcacaacaaacaacaaattaatctccctagtggatagaaacaaatatgtaaatgaaatcagtgaagcaacaacaaaaaggaaaccagtgtaaaagtaaaccaaggaccataataaagtatgtgaattaagttatatacatagaataaatagtacatacaaagataaatcaatttgagtacagtttattatgtagccattaaacatcccctgaaattagggatcactgggtgtcattcttttaatctcttatggcttttatagcatcactacaaactgagttgtttaaaagagtaaaaatttcatctcgcacagtcaaagaagacagtggtttcattgagcttcctccaagaccccagagaaggctctttcttgtctggtccagctcctagatttccttggtttgtggcagcctaagtccagcctttgcttctgaatccacatggtttctttatattagactacttgtctatcttttatgaggacattttaattggagttaggggctgatctgatcctgtagaaatgttactgtaatgcctattttataactagaaacatactgttttcaattaaagttctattctgaatttgttagtagataatgttcagtctaccattattatgcaaagggacattaaccttaaatttttgaaacatcaaaataaaagctcagttaattctaggaaatagcattaaatatgtcattaaaactggaaggaaaatataaaattttgttgttttagcctcctttatgaaagtgcactttgctggatttgttttttcttatttaaaaaacaaaaccaaaaaaacccttcattttatagttacaaattctgcgagctagaattttatatggttgagttagactggaatgctagccatgaaattggatttctgttccttatgttctcactaagtcagtgtccttgccatacacctcagttactccatatgcaaatgaattgaacacttccaatataaatctccctatttgatattttcctttgcttattttcacgagtctcagaattaacttactatctaggaattattttataaaggtaggtaattctttctctacatagttagaggcatttttagccattgagtatttattttgtttgctttacccaagtaaagaatgtttgcttgaatgtctgtatgtgcatagtgggtgtgcctcatgcaagtagagaccaaagagggtgtcagattcttggaactagacttatatatgattgtgatctgtaatgcggataatgagaagcaaaaaccggatactctgcaaaataagcaagcaagtgctacctgctgagccatccccccaaactccagattttttaatgtttttagacaatgttttttaatgtttttagacaatgtgatggcgtggctggcttggaactcattatgtagacagggttagccccaaactcacagagaaattcaaccatgtgccaccatgcctggcgtccattcttcagacaattttttaaatgttgaagaaagaagattctattactttcgtgaaattatgaattgaatccaatgtttaaaagaacccaggatttttcctcttatgtctgactcccattattaacagaaattatagcagtttactttgtgttcaggatctagtttctttttttaaaaaaatcatgcacacacacacacacacacacacacacacacacacacacacacagattttactataagcatttaattaatagatattttaaatatttaatggaatcaaacatttcaaagttatatattatttagttactcagatgataaaataccaagaaagtaattcaatgatattattttctgctaaaggcaattgttgaaaatgttcttttgttagctatagttagcttgccatatcacaaatcttttactgtgcattccatcatcatgtataatctataatagtttcatgttcatatgtctgcttttctaattttaattttactctcttctgcagaagggacccacttgtattcttatttgtttcataatagttgatactgtgtaaattatatacaaaaatatgtgatttgttatggatattgacccaccatcagtaacaattttgcttctcaagtagggagaaatagttttcattactctgacaatattttatccccatgcatttgtagctggaattagagtaagagaataaaaggaacatcttctacagaggagtagaatgtgttagcgtgattgaactgtattcctaagttttagacagcattgcctcttaacacgatagacttttttgtgcttatgaatgtgtgtgtgtgtgtgtgtgtgtgtgtgtgtgtgtgtgtgtgtgtgtgtgtgtgtgtatgtgtgtgtgtgtgtgtgtgtgtgtgtggttgtttttcaaggcagggtttctgtatgtagcctggggttgacctggaatttacttcgtaaaccagtctggccttaaactcagaaaaccactttccactgcctcctgagtgctgggataaaaggtcaccacctggcccaatagacttttgatagtttcattgtctcttaatggaatgcaaggtttataattctatttaatactctaaaaaaaaatccatgcacttcagcaatagaaaagcccagtgtgtcatcacatgttacattagactgtgatttagattcaatagtaagttgcttatagacttgtgtttatatgctcttcctaaagtttttaaaaggaagcaatgcctgctgggaaatgaccaatgagtttggaaaatttctccccagtcaaaccattgtaggatacatagatacttggcaatatatttcatgaagagtcaaagaaatgtgaagaaataaagcctgtcagagttgtttctcaaaacatgactagaagaacaaatcttatattgaagaatagtataaagatgtaagagctggaggatcgggggagggttgtgtgaaatattgatcatgacttggttgatgtgttcatgatcacatgttacctgatgttacctgcacaagaacagtagtagaacaagccattcaaaattgtagcaggatgggtaggtggctcaaaaggcctaactccttgctaagaagctattcacagtttatagctacaaggggatggaaagccacttttcttcattgatgtgacctgcactaggttatccatgtttcagtggattgtctcacagtcatatgcacatagccagcacaaattgcaatcagtgggatataccatttaaaacagaaaacatgaagatttgacagaaagtgttctgggggatgtcagagaagggaagtgagggatgtgatcaaaacacattgtatacatgtatgacattctagaagaataattaaacatattttaaaagcagagcatgatataattatgattgcatagaaatgtttttcatagtttttattgaaatagccttgtagcttgagggatatgttagcccatttggaaagttttcttctgatttgcttagtatttagttttctgccaaacacaaggcaaaatgtctgtgctcacttccagcttctttagtaaatgttatcacatctgtgagaagaggaaaaagaaattctttcaagtttacaaatataaagttgtctcgggcatattttttcttgataatttctttcacatagatttaaacatgttctctagcatattaattaatatacgtttaacataatcattgtaatgaaagtagctgactctcgacagcactacaaattagcaacgctattattttctcaattatgagtgttaataattatttaaatggcttgtgttaaactttttaaaagcttggcaacaacagccaacactacttagagaattaatataaaagtaggtacagatcaatactcttagaacactttacagggagttacctataaaaatgaaataattaaagcaagttttatgatgtagacatggaaacaggacttaaaaaacgtaagtaaggttctgaaggtagcattactagaatagaattactaaagcaggttttaatattgatgtcttgagtttgtttgctttaaatttctagtacatgacttattttagaataccagtattgcagaaaataaaatgctgcagtcattgcgactatgctaacttatatgacttctcttcaaatcttggctaactttatcatttagtatcaaacatgtgcagattaatttgacaaaactaccttaaatattaatagactttaaatttttaatcatgaactattaggttaaaatgcaatttttgcttaggcacactcagcatatgttataatcgaaggaaaacagatctttgtgtcctatattagttttaaaaagaattaggcacactcaatgctgatgaagtttttgaagtattgttttaatgggcgaactacagtatacattaagatgaataagatgaatagtggctcttgtgtttgcatttgtttcattttcacataacatgtggatcatgtaaaaatccatagtcaggtttttcatttaagtgatatttgaatctatatataataaccatctaaaattgttagagaatgtggttcattcccaaaagtctggtccttgtggcataacgatctgagtataagtactttatacagaagagttataggtagcaacgtattgcaagacagaattttgtacctggcaaaagattatgcatttgttatttaaagggagaaggccagcttccttgttatgaatgtggataattttattttatgattcttttaaaatggcaggtactgcatatcacaattgaataaattttcataaaaaacagaatctccatgaatgattttttttttcttacatagagccaaggtcattatgtttctacacagacctacagcaatagtactagtttgcagctttcctatatcctaccctgctatgaaggtgtattgtactttggcaatgcctgggaggctctcccccaggcatatctatcatctcagctacacgtttgataggagctggatagctgacaattcacaattaagatgccagctaacacctaggagcgccaagtattctgtgtgcttgttgagagaagattcatgtgcactagacaacagcagttgctcagtgcttctagctgttttactaatggtagataacacttaattcaggagagattgtccacccatcactaagtctttatgctcatagcctttcacatcagacaatttcaacctgaaaaaattgtattgagatttaattgatgataggcaaaattgagaagagaacaggatgttagaatgttcttttacatgcaaacaagcttcggatgaggtagtttagtaacctataacatgaatatgagtttaaagccttctttcatttcaaaacagcctacatctaaaggctagatttgttctgtaaaatccaatgttgctgataatattcatattgctttcagcccctgcactcttctcttctcccccccccctttttgtggcctatatctcttggttatgagtagaagttgagggcagattgtttaatattgtactgaaccttctttgatgtcaagctacctaatgaatttctttgagacccatttttaaatcagttgttttcaatattcatttatgaaaaggtactgacgtattataaacatattttcaaaaattgatgttatcataaatttccccatgtgatttagtatttgtcacagaataaaagaataccttgaaataaattcagatctaaatctgtattagacattaatggatttttctttcatatagaaaatgtttaagaagtttgtagtgttttgaagcccaggattaggaacattgattaaaaatgaaataaataatgcttttaaaatgagtagacctcaaccatgggagagactttaacctccagacacactaagtttgaaagtattctgttagactacttattcatcttttctttctcctgggaacagtgttacggtcagtcgttgtttcacttgtattaatttacttatctactatatttttaacttctaattgacaggtactatttttatatacttacagggtaggccttgacattttaatacatgtatgtaatgtataatgatcagatcagagtaattgaaacataaatcactctgtacacttatcaaatttttttgtgctataaacattaaaaattatctccattatccattatgaaatatataattaattggtactcattattcttttttattatttatttatttgtcacgaaatagaatttatttatttatttatttttaattaggtattttcttcatttacatttcaaatgctatcctgaaagtcccctataccctcctgaccctgctcccctacccacccactcccacttcttggccctggcattcccctgtattgaggcatataaagtttgcaagaccaagggggcatctcttaccaatgatggccgactaggccatcttctgttacatatgcagctagagacacgagctctgagggtactggttagttcatattgttgttccacctatagggttgcagacccctttagctccttgggtactttctctagctcctccattgggggacctgttttccatccaatagctgactgtgagcctccacttctgtgtttgccaggcactggcatagcctcacaagatacagctatatcagggtcctttcagccaaatcttgctggcgaatgcaatggtgtctgcatttggaggctgattatgggatggatccccaggtgtggcagtctctaggtggtccatcctttcatctcagctccaaactttgtctctgtaactccttccatgggtgttttgttcccaattctaagagggggcaaagtgaccacactttggtcttccttcttcttgagtttcatgtgttttgcaactcgtatcttgggtatcctaattttctgggctaatatccacttatcagtgagtacatatcatgtgagttcttttgtgattgggttacctcactcaggatgataccctccaggtccatccatttacctaggtatttcatgaattcattctttttttttctttctgggattaaacattttaactattattttttttaattaggtattttcctcgtttacattttcaatgctatcccaaaagtcccccatacccacccacccccaatcccctacccacccactccccctttttggccctggcgttcccctgtactggggcatataaagtttgcaagtccaatgagcctcactttgcagtgatggccgacttggccatcttttgatacatagaattcattcttttcaatagctgagtagtactccattgtgtaaatgtactacattttctgtatccattcctctgttgaaggacatctgggttctttccagcttctggctattataaataaggcttctatgaacatagtggagcatgtgttcttattaccagttggaacatcttctggatatatgcacaggagaggtattgcgggatcctccagtagtactatgtccaattttctgaggaaccgccagactgatttccagagtggttgtacaagcttgcaatcctaccaacaatggagaagtgttctctttctccacatcctcgccagtatctgctgtcacctgaaattttgatctttgccattctaactggtgtgaggtggaatctcagggttgttttgatttgcatttccctgatgattaaggatgctgaacattttttcatgtgcttctcagccattcggtattcctcaggtgagaattctttgtttagctctgagtccagctttctctgtgatcctttgcttgtgggctcctgtgaacctgagattctaggtgtgtcagagttcttggcagtaaagttcctctgagaccctgaaatgttggtgtgaccagctccttttatcctatgatcctgttgtcaaagatcctgggcgtggttcagtgcctggaagtgatgtctcctttgaatagggtggagctgtctggtcagtggtcctaagattgcatggaggtggagagtcctctaggaaccttgggggttgtctgccgactctgggcccaaggtgacctgatgctggtgccaactggaagggacttgtcaccctggtcaggccaggttttctcactattcttttttgttgaacattggaaatcatttatcatattgtctgctagttgaatgtattgttttggaattattagcaagtaatagtaattcacatgttgattccactattcactctcacgacatttttttttccttccaaatgaacctagttgtcaaaaatatacagttgtagaatatttgattttgaacagcaagaaccagttctataaagattaaaatttcagtcccgtgactatacatttttgaggaagcactatgaaggctactagataaatatgaattaacaaacagttctcttaggattcaagggacatgttagttgcatactgtgagtgttcatattatatgcatgatgctggacttttcagtttgtgagattacaacagacttgaaattacatgaaattatttaactgttatatttaattctaatccttgaactatctttcaatttggaaagttcatttttcccatcatagttttaaatctgagccctgtgtgtatgatctggaatcatctttgacagtatacttcatctttttttttattaatcattttatttgtttcccgatcaatgttatccccctacctcgtctaccctccgtgtgcctcccactgcatgcccctcccctttgtttctaagagagtacttcatcttattcgcccttcttttcatttttgatcagtcacagagctttttcatttcattgttgaactttggtacagaccttggtcctttttgaaagagacattgacaaaggaagaggctggtcatacaaaaacaagaggtcagtgcatttgtggaaatttcagtttaatcactgtaagtaaagcaaaccataaagagaaaatgaagtaaggaagtttagctgaaagtgatgggatatggtagcctgcaactttcttgatggtaaagccatctgataggccaaacaaggactgttagttccatcctaaaagccagtactacacattctccagacacttaatgcattctctatcagaacacatatcaatgagtactatagttttcaaagttattttaaaatatttatatttaagtttctgtgttttgataatcccatgcggtaagaaataaaagtaggttttattttaggtgttttattttgttatgtggatggtggatgggataaacaggatccctttatgatcctcctgctgtatatataaattacagtgtatagaatactatgcaacaaaaagtctatatttaggtatctctactgttttttttattgtatgatagaacaaaaaaataaatataaagaagaagccttacagattttgatttatgcatctaaggtataatttacattttgaaatgaaaacaacttgaaaaattaatatcccctaattgttttggggataatactaggaattaaacattatatattgatttatattggctgtctgacctcccattctccttctctttctccctcccttacttttgagacagaatcaaacctaattgtctatattgtgtttgacttgattccatgttctaacccaggctgaccttgaacttgtgatcttttggattcaacctgagtggcatggattttaggtttcttgcaggaggcctggcttaattgatgattttttacattagttgttgataatgagcttgaataggaggaagctagcaattgaaatatgctagattctgattgtttttgctatttgataaggatatgagaaatgtatatttgacaaggatacgagaaatgtatgtctatgatagacaggtatatgaataagtcatgtgggtactataaatatgtacagttttcaacacttaaaatacaatgaataaaaaattatttaaccatatgcattcagacaaaaatatagaatctccagtttaccccccagttttaagtagatatatttaaaataaaacataaagattaacacagaaaaaaccagaacttcctacctttaaaaatcatgttctcagtaaacaacatttacatatgaaaattcagtccacagagaacacccaaagaaatggttcttttaagaccattatctatgtgtagatatcctgtgctaaaaatatctgtgaacattaaatttgtttgatctttgtctacatagcaatcatcatctataatgagttgttaattgcatggttttcacattgtacctgataggtgagaaaaaaggttgcagttctgttctgtattcatcaaagagcaattgtccttcaactttccttacccttcttaaattgcgagaaacttcttttaccacttgtttattgcccagaaaaatcagatagcaaaatacacaaattgggttaggaaaaggagtttgagcctgagttttatgctaatgatattgtttttcacgaattgcattcaaggacttcttttctttatgacagataaactctatcagctctgttttcattttcaggattttcagattaggaatctgatttcttggaataaatttattttaatataattcaatggaatcaacagaaattggatgtcctgtggagtacatgatagaattttagctatattacttagcttaagagaataaaccaatacatttttttttcctgtggaagttaacattttattgtaaatttgaatggttatgtcactaagttatcagatttagcagctgtcctaaaataattatagttataatttcagacatattaagatgtaaagtatgactgattttggcttgaatatgtggaatgcatttcattcttgcttctctcctatttactgtagagtgatgagtttttttttttcctttttgttcacactgtacatcatttatcccattatagaatatgactttgtattatgcttttataacaactttaaaggcaggagtggaggagaatattcctcactgcttagcctgttgatatttaaaatagatacagttaaagctatttccttgactatctcaagagtaatttaggcagtataagaaattgattttaataaataggaacgtgttttctgagaaaaaaattatagttaaacttgttttgtaaggagctatttttgtgtaacttgaggtagtacagcagtgcagcatcttcttataacagtgtggaaaagaaatttgtttttatataatattatcatccttaaacgaggcatattttctcctcttgaaagtgtatcaatcacatcagacatagcaggatcttgctagtgaacttgatggagagaatgaatgcagacacagagaaagatggcatgtcttctttgggaatttctatggaaattgtaatctattacagcactgaagtcaaaacctctgagactcaaatctggaaattgacacattcaacctttttgtgaatcagtccaaataaagttttcagcaagtgtcagcttcaaagcttatgcacaaatgtctggaaatgccagcactgtatcaaatagtcatattataattgctcaggtacagttcatgcattaaactatgaaaatgaatcttctcacggaattcaaatatctagtactattttgttgttttatatagacaaaatgggtatatatcattctttatattttatttaaactctgtcagatcatacatatatttccattgtattctttttttttttttggttttttgagatagggtttctctatatagcccgggctgtcctggaactcaccttgtagactaggctggcctcgaacaaagaaatccgcctgtctctgcctcccaattgctgctgggattaatggcgtgcgccaccatgcctggctctttttttttttttttaactttaacatttttttgatggatgtatattttgataggagggcaatcatgaagctaatttacctgaatagaacattctttaaaaatggtgaaacaatgaaacaatagtattaaaattagatggttttgtctaaaacttacaaaaagttcacacttacaatgttgttctaactctcttgaacagcttgaattatttgtttcatgtgctgtaatggttgcccactttctgaattccccagaaaagttagaagtatcagtgtagaactttctaattttaccttgatttcttttgaaaggttgctagaaatctagagaatttaatcaaattgaacatttgatcactgtttccttttatatttgtgtatttatctaatagactcctcttttcagcaaatattaaggctatatttcccttaaatgcaatgggctaattcaaaacataaatatatatatttttggataaaatattaaggtttcatgaaactgaaagattttttttttctcggagatcttgatgctttagccttggagaacataatgtagaagaatcttgctttcttttttctttttctttttttctttttttttttttttttttttttttttggtttttcgagacaaggtttctctgtatagccctggctgtcctggaactcactctgtagaccaggctgacctcgaactcagcaatctgcctgcctttgcctcccaagtgctgggattaaaggcgtgagccaccactccccagctagaatcttgctttcttttggatttagtgtcaaatgaaattttttcctactacgtaatatttcctttcctttgatcatgtcaatcagtatcaagcaagaccttctaaaataatgacatctgaaattcagaaaacttggagctaatttttactttaagtttcaatatatgtcatttaaaaaataaatattttattactttttgataattttatacattatatattttttattcaccctatctccttccagatctacttttaatttctatacacacccaactatgtcttcattgttttatttaaatcactgagtctaatttgtgtgtgtatatactcttgggtgtgtagccatccattggaacacagtcaatatgccagtggctgtatcattaaataaaacaaagaaagaaagaaaaagaactactcttttccaggcaggtatcaattatcaatagccctccagctccaggaggtgaacttcatgcctgcatcccccactctatgcagtgattttttttgtctatcttgagatagaataagtcccagctgttgtagttcatatgtgtagctgctatactgtgtcttgaaaacaccatttcattgtagtaatctgctgcctctgacacttaaatttttccaactccttttctgagatgattatctttgagctttgagaggaaaggttgtgatatagatgttatagttaggaataagcatgctatagtcttatattccttgccacttaacaagttatagttcatatagttatgtgttaatcatgtactgcaaaatgaaacttcactgaagaaccttgagagatgcatttatttgagtataagaatttcattgcgcgttggtttaatagtaagtccatttagcaggctaatacaagtaggttctcctctaggtcctaaatgacccatctagttacaggttcttgatcctgataatggtgccatttgcgccatgcatattgaagattcagcctcaaatccactcatgacattcatacgattttgtactactattttgccagagtggtggttataatagcttcagtgttcacagacttttgtagtatgtatagcaacgtccaggactttgaaagctagctagtagtagtgaagtttctagatgaataacagtttgacttctctgtgctcaatggctcaaaaatatggtgtcttgtccttgattttagtgagattgattttagtttctctgtatttaatttggtgttgactgttggttggctatatattgcttttattatgtttagctatgtgccaggtattcctaatctctccaagacttttaacgtggatgggtatggtagtttttccaaggctttttcagcatctaatgaaatgatcatgcatgtttttcccttgagttcgtttatatagtttattacgtttatggattttcatacattaaaccattcctgtattcctgggatgaagcctacttgatcatggtgaatgatgattttgatgtgttcttggatttggtttgagagacttttattgaatattttgcattgtattcataagtgaaattggcctgaagctctctttctttgttggatctttttgtggcttaaatatcggagtaactgtggcttcacagaatgaattagaaagttttccttctgtttgtattttgtggaaaattagaggagtttggcattagctcttctttgaaggtctgttagaattctgcactaaaacaatctggccctgggcttattttggttgagagtctttaatgaatatttctatttcctaaggggttatgagactttatatagtttacctgatcttgatttaattttggtatgtggtatctgtctagaaaatcgaggttctctagttttggagagttgagacttttgtggttggttctgatgaatttttgaatttactaagtttctcctatgtattcattttcatttctgattttgttaatttggatactgtctttgtgttcttttgataggttttttttttaaaggttttatctatcttgttgattttctcaaagaaccagctctcatattgttctctttgtttctaattggttgatttcagccaagactttgtctaggtctggactatagaagccgaagaacaatcaaaggtttgggttttaatattttagaaaaataaatattaactccgtctgcctatcttatatatttgtttttccattttgtggttacaaattgtatgtaggtactgttctcaatcctgcattaagagaacatgaaaaacaaatttcagcctggtgttggtgttgataatatgtaacctagtttcttatgagtttccagcaggaggaatgcagtttcatagaatacaaaagcaacaatgtgagatctacacatgcacacatactcacacacacacacacacacacacacacacacacacacacacctaaatctgtgtttattctcctgtaaaattcaggcattttaacccatcactggcatggctcacaaagtataccccattgatggattgatggatgaaatggtgttctcttaattgttgaataagcattgtgaatgccaatgccattaacatatattttcttcttcttcattcttcctgaatagctttcttgctcaaatttttagtggtaatttcagatagactctggatctctttctttagcagtacttcagtgatttcttataagactcaggacattaaaaatctataataacatggattgtaatgtagtctatataaatatatgaactagactgtaaataaagaaggcatttattctgtgtttgtaggtataaactcagtgtacttttgtagcaatcatgaaatcttcagtgaggtattggaaaaactgttaggtaaatgttatataaaaatatgtagtggttctgttgagtagaatctgttaaattacacatcacttgtgttaattgtgactgagtaaaaaagaaaggaaaaaaatctgattatagatgattatggaagttaccaaatagcattcttcgtattttttccttttgtattattctctgcttttgtgtcccttacatctttgtcatctacagtgaattggaacttatattcaggatgagataatatggggtcatttatttcttaaagtgcattccccaagttagattttatataccattatcaaatgtattattatagttttatatgcctcaattactattctataagtgttgcaattgatatactttataaagcttgtgtcatcagcttgacttctatcctagttttgtatcctctggtagtaaggttgtttttggttgtggggacagtgtataccatagtctagagttgttctcagcccatgtctcacttccaaaagagtgcccgtacttcataaagaaaaaaaacccttttctatgccagtgattttaaaatttaccaagcactacagtcacttttaatcacattcaagcatacttggctgccatctcatctcccctggggattgattctatagttctgtgtatggccccacaatttgaattattagcacattcacaatgatattgatggtgctggtttgaggtacataattagagcaacacttagtttgggtgttatcgttttttaacaaacaaacgcccagtcttgaaacttggccaacatttgttttaattaaagctgtttcatcctgcctttttttttttttttgtctttacatggttttgttgcatatgcctacctacctagtgctacgaatgtcagagagaatacagcaagaagctgtacattgcttgatgtccgagagagaaatggagttggcaagaaaaagaggggaggggggatatttattgaattcctgagtataatcagggttcactgtgtttagttcagacccctaccaccaatcttcatggggtccttttctactgtgaaaactgcagtctctatgtaggttactcttccattatccagatgcattctcagctcagacttcttacttcctaatttgtaataagtaaacttgtccttttacccttaagtttcagattatgtatgtatgtatgtatgtatgtatgtatgtatgtatttaacactcgagattttttatctcatccattccaccctctgactgttccacatcccaaacctcatcccagtcccctgtctccatgaggatgtccccaccccctcccttcaccccaccagacctctaaactccttggggcctccagtctcttgagggttagttgcagcatctctgactaaacccagaccaggcagtcctttgctgttgggggcttcatatcagctggtgtatgctgcctggttagtggtccagtgcatgagagatcttgggagtccaggttagttgagactgctggtcctcctacagggtagcccttctcctctctttcttccagcttttccataattcaaccacaggggtcagtagcttctgttagttgggtgtaaatatctgcatctgacactttcagttgcttgttgggcctttcggagggtagtaatgataggtctttttttttttttttttttttttttttgagcgcttcatagcctaagtaatagtgtcaggccttggggcctccccttgagctggattccactttgggcctgtcattggaccttcttttcctcgggttcttctccatgtccatccctgtaattctttcagacaggaacaattatgggtcagagttttgactgtgggatggcaaccccatccctcgcttgatgccctgactttcttctggaggtgggttctgtaagttctctctcaccactatagggaatttcatctaaggtctctctccctttgattcctgagagtctctcacctcccaagtctctggtacattctggaaggtcgtcctacctcctacctcttgaggttgcctctttccattctttctgctcgcccttagggcttcaggccttttcccccacccaataccatatcaggttcccctcttctcctgcttgtctactttccctcccaggtgcctccctctcttcccccttgtgattgctttcttctcccttccaattgagattgaggcatccccatttggacccttcagcttgatgaccttttgagttctgtggactatatcttgggtgttctgtacttttttttttttttttttttttttttgctaatatccacttattagtgagtacataccatgcatgtcctcttgggtctgagttacctcacttaggatggtattttctacttccatccatttgactgcaaactcaggatgtcttcattcctaatagctgagtagtattgcgttgtgtaaatgaaccccatttaaaaaataacaataatcttttaaaataacaataattttcattgaatgaatccaaaatgctcttaaccatctgtttttaggtagtctggcatttgtgggtgactgatttcaaatgaataaatagaaatcattctcttttgtcatacactttcccagatgaagaaataatcttgataatttaatagtgctgggtataaaggaaacatgagtaatatttataatcaaatataatttctaagcattaaatttaaagaactccatgattttttttccttctcaaatgtcaaagcagatactgaaggctgtaaatacaggtttggttagactcctatgatatgaaggttgctccatgctatttttctatgatcatatttatagatttctctctcggatagattcaatactgcacattatatttagaactgatatccctttatcattgtaccactaagtcactgattatttttcactgaatcattgtgaaaatagctcattgctttggatgactacatgccgaaaacgaatagtagctcactgccagttatagtgacagtaccatactgaattcttctttcattatggaaataaaagctatattcatttaaaatgactttccatacaattgaggatgtgactggttctaattatcggctgttttaaagtataccttcttcaataatctgatgactctcactgataatctgattaaaatattttttttgctatgttgatatgaggtggacatgttttccattaattttgtatttctttgctattataccatgatgaaggcaaaagataggaaagaaatatttattggggccctacagtttcagagggatataattcatcactgtgggaggctagcaaccgtggtgctggagcagtagctgggaggttacatcctgattcagatcctgaagcacagatagctaattgggaattttgtgagcatttgaaatcccaaagcctgccccactgtgacagtcctaagccagcaagccacatcacctcatccttcccaaatggttctattaatgaaggaccaaattattcaaatatatgagcctatgggagccaggcttattcaccaccagaggaagtttaaatactatggaatacataaacacatggttttaatatatggagtatctgtggcatacatgacctcagtggtatagtgcttgcatggtttctgtgagggtttgtattctctgcttattgttgcaacatttatatatgtatgtaggtagtataaattctaatgactattttacaaccttctgtgtacttatttaactttgtgaaacatgattgcctattcttttaatccaaattggttctaaatttaaattagtaaatatttattgtttacaaatatgtcatatattatatgtaagctagaaatatctgagaaaatatagtatatttaggagatttaaaatacaaatgaaatgacaaggtatataataaaagccatgacagacattaagtgataagattatagagagaactgtatcttgggtattctgggcccccgagatctctcaaacattggaccaccaaccaggcagcatacaccagctgatatgaggcccccaacacataaagagcagaggactgctgggtctcagctcaatcagggatgacccatctaaccgcaagagactgtaggccccagggtgtttagaggtcatgtggagtggggtatgtgggtggagacatcctcgtggagatagggcgttgggtaggaggaatgggatgtggaacagtttgagggtggactgggggggggggatgaaatctggagtgtaaattaataaataagtaaaaaacaaaaacaacaacaacaaaaagattatagagagatttcttaaagaattacccaaagatttccagggtatgcagagatcactaatggttaaaaatagtcatttgatacttggaggcctcaagagatgatattgtggttttcttcttagaagaaagaataaataaacagagaaagttctgagagaagtcttgcaatgaccatttgtctgattccattgcaaatgtgctataaaacctaagcctggaaagataggttagactctgagaatgtcaggataagggatcattgaggcaatttcagtggatattgggactgaagaatgttgtgagtgttcagtcagatatcttaaacgtaaaattaataaaagaaatcaaaatatagctacatagatcacccctggaatttttcagccatgttaagataagctaatatagtgttaaaataggttttagcataaaccgtgaaagggacagaggggcatttagaggaagcatggtagaagttgaaacattcgtaactagatacccagtggtttagtgttttcacataagtgatgtgtaatcttctgctgttttttcaacctaactaatacattccttcctacagagttgatggaacattccaaacacagtgtttaacatcttagcaatcagttttctgattactcattacagttctatctatcttcagtgtttttttcaggtagcatcttatcatcgaatctattcctggccacatagtagataacaacatcttgccctttcagttgtttaacaaaagttgtttgtcttcattgctccaatgcactaatgtttatataaattgttacttattcattatctatctctctatttgtaggtagtaggttacaagagggtaagggcttagttatgttgcccattatacctatgttgcatacatacttggtacctcatagatactctgcacctgtttatgaagtgaccagaataaatgaaaaggtgaaagagaatggcaggtcaaacaattaagccagtatttcaagtctgagggaatcaaagggtaatggtgttattaagggaatattgaagagtggaggaggagttgatttgtgaaaacagaaatagtgcgagataaatttagctcataaattctgacttaagtatgtgaagctggtgcaatatcttatgcagtgcagtataggcacgaggaaaccatgaagcaaggtttgggatttagatgaggatgtcagggtcatgtgcagagtctagccttttatcacagaggaaaaagataagagcaggaaggcaggatatcatatttgaaaaccgaaattttatttttcaatatctaatatgctaagcatggaagtgacttatatattctttttaattcttagctgggtcaacaactttggctatgaaggacttggagtcttactggatgtgctggagaagcttctggacaaaaaacagtaagaataaacatgtaaaacctttcacacagggagaaaaggacatgaaacctagtatgacttattttttattacctatttaggcaagaaaatatcgacaagaagaatcagtacaaagtcattcagtgcctgaaagcatttatgaataataaggtaaatgccatttacttctccctctgctacaaaagggggctcttgcttgacactatgtaagtaagcaacaaaaaaaatagtgggtacttattctactttcagtaatatgtttataatgcagattacccgagattttctttaatgggctttcaaggtgtattttgcttcacataaaatttcaggtgtattttttaattatgtcaacagtattaggttagctctcatattagatgatatatttttcctttcatgattatgaagttttctttattttaaaagatttatttttggtttgatcctagcctttaacagctgagccataatccatagactgagagaaattaggcaaagagaaggtctctaggttgggttgtggtatctcccttggaagggtaaatagtataactcattttcataaaaatgcctaaagcagataaactacaataaagatatttagttaacagtgttcaaaagcaacaaagttataaagtgttttccagtatcatgtttatattaccattatgggatatctcatatttctaacacattcatttctgaataaacatgccaaagtttgttactctcagggagaggttgcaggctggaacaatccctttgttttcattacgtgttatttttatttggtttgcttattatagtctacagttactcacttctctttctatcacaccaggatggctttgaaacttaaataaaaatgccatggtgaataaactaaaaaaaaaaagatttatttatgtgtatgcgttgctagataaatttacatacagcatgtgcttgcagatacccattgaggttgtaaaaaatcagattccctagaactcaagttaaaggcttgagctgcttaaggtgggtactaggaattgaacctgtgttctttataagagcaatgtgtactcttaactgctgtaggatctcttaatcccaagtactacgaaaatttaaatgtcataatttccatatagataacaaaattgtattatatacatatggaaatttcaagggtagggataagtttcatctagctttctgagagtgttatgagactgagatgtattttggtgttgaatcactttcagttgtttattatgcataaaagaaatctatggaggatagaatgaatttttatgtatgtataacattttttgtattatacaatattgtggaaacatacagataaaacaactgactaatcagtttgcttaattacataatgtcctttagatgatattttaataatctcaaagtacttaatgcaacactaattataacaatgaccagaaacttactaaatgtaaagtataactattagaaatcaatgcaataatattgtatatttaagcaatatataaaaacactctttctttgtcttgtgtgattatatattactgtctgtatcacatgcctatattaaccagcaaataatattattggtacatgcagtatggaatgagattgttaatgaaatccttcatcacctcacttgtactgatattttttacattgaattatgtataggtatgttgcacagatacatgtgtgtgaaggtcaaagtataacttgagggagtcacttctctttttgcaccatgtgggtcccagggatcaagcttcagttgtcaggcattttattgagtaccttcatctcctgagccatctcactgacccatctggaaatttctaatagtgactcccatcagttctagtacagaatttctgtacatctgcgcttttgtaatttagatcacacatgtcatggcatctaattccaaacagcaatgaacttaactgaacattgtttcttcaaagctcacgaagaatctctttctgaacctaacaaaagtagtaagtttatagaaagaaaacacagcacccgaagtcagagatgcagttcatgttttgccattcctcagtagacacagcctttgaaaaataacttagcctctggctaatcagtcttttcctctataaattgagctatgggagcttttgttctgtattcttattgattcatgttgtcaactatcatagttttataagataacaactcattataattagaatagtgactatagaaagttatgacagtaggattttctatagagccctattcccacaggtagtactcagatatgctaaggctcactatttttttttttcttatctgtttggcagttttgaagaacatgatgatttaatttaaattattctaaacagaaatttttgttactctgtgtttatgagttgaaaatatatctttgccacgtgaataaatgagtcctttaaattataagcatgggaaacaatccatacaatagaccttctgaatagaaaacacacagtgatatattcattttaagttggaatacattttccaaatcgaggaaagtaaatctcatgtgaaatgacttaaatgttatttttttggtctttgaagttgaggttatttacatcagaaaccattttacagtctgaatgttcccttatttattcagacccacagttacagtcttattaaaaagtttagccaggccaacttttcccatagaagttaaattaagaagcatcatgctgttcatatgttatcttgtaatagtttccaatgaaatgcaatgttgccatggagctgtaaaatgaaacaaacttttaatgagatatcagaaatatactttgtgagacaaaggtaaaatacattaaattaagttactataacttaatattaacttttgtcttgaaagtttactaataggcagttgtgagtgcatgtgtacacatttggggtcattcctataaaataactgatactgatacttctctgcccatcttcctgtgatatgtaaggaatcccaagtgctatgtccctgagtccctgatgcttgttactgcctaagagatgaggtatatggtcaagttaaataagggaagcttcacactgtatttgtattactttgactaacatatagtatacatgagagctttttagcattttggctcctctgtgtaccttaattttcaatgcaaatatattggaaaagttaaccccaaatcccacactttgctatggatatgttatgacataaaaatgtctttacaaagtatagtcaatatgtgttctatacattcttgtttgttaaacaagtattgttcccatattatctgaatattaaaaaaaactttcctgaggaataaaagaaatcatttttcttgaagccacaaaaattctaagttgtactcatttcaaataaaatagaaagaataactgcatttgaggggaatttccataattaaatatagcactaccctaaagatattgctttttgaattttctttcattttgggtttattttaaatgaaaactatattccatagacatttaaatgagagttcttttgtttgttttctttagtttggactacaaagaattctaggagacgagagaagccttttactgttggcaagagcaattgacccgaaacaacagaatatgatgactgaaatagtaaaaatcctttctgctatttgcattgttggggaagaaaacatgtaagtattgatatgttctatcttttacgttgaaaaaaaatgacacctgcaaaattagtatttttatttctttttggtaacttgaaaaaaatagtagatcttagaatatttttgattgacatacttactttatatttatatttatattattttacatttcactctttggatattgtatattccaaacttgttaaagaattaatttaagtgtacacatggaattttgtcccactaaagccatcattagtcaataggaaatgtgttaaaaattcaaaaagttactttgggaaacacagggtagacacacaggacacacatacacatacatgcacaagtacatgaacacagtcaactcactgggtgttgtaaatttttctagaattagagtcaatgctattaagttttaagctatctctccacatcccaatttgacttctttaatcgaatcagctacatgcttttattttgtactgttgtgctattatattttatcttgtatgttaatatgaaatgaagttccctatgaaaaaaaagcacagtataatttgtagataaatagcatgtgtgaaaaagagcatgttaaataatacatatattacatagttcatagttactctgcaagaggggtcattcaaagcattgtcttacttattacaagtatttgaaagatttgtctatttaaaaatatgtgaaaattgcaatgccctataaaatatcaaacactaatattaaaatacagaatgaactatgattacatgtatataagaagtatttctcatttctattttctcttgttttggtttacagtctagacaaacttttagggggcatcactgctgcagctgaactaaataatagagaacgattttcaccaattgtggaaggcttagaaaataatgaagccttgcatctccaggtgggttttattttcttatgaattatttgaagagttgttcaactttttggactacctgttattacaccaccttttagctgacatttataaaatagactataaagcacaattacttgtgttaatccaagttttttatttttcattttaagtcacctttattatgcattattatcactgataccataatttcatatttattgggaaatcaaagccttagcactaatgtggactaaagcgctaatacctcaatcagtactattatctgaccaacttaatagagcttgtaggcttttgtggaaatgtaacagaatagtcaggtatggcggcaaaacatttaagcattcagttgtatgggtcagaatttgatatcaaagtgctttttctgttagtgtatctaccacttgatgctccatgaagatcatcacttaaagagattttcctactgtatttaatttttcacgtcattttataataagtacatgtaaaatttttctgcttgatgtgaaacaaacaccatcgattttattttttattgtgttataaaatattggcattgagccaggtgtggtggcacacgcctttaatcccagcactcgggaggcagaggcaggcagattactgagttcgaggccagcctcgtctacaaagtgagttccaggacagccatggctatacagagaaaccctgcctcaaaaaatcaaaaaaaaaaaaatattggcatcatttttttcacagttagaaactttggcagagagaaagagagacagacagagagagagacagacagagagacacagagagacagacacagagagcctgtgggattataataatgtttctttggatattttaaaagtattttacttctatgatgagtatgtcgataaactttttatagtatgcttcttatgcatttgtgtttttaaaattgagatttccccgtagtgttttctaatctatgactgagttattcatgtttttatgttttgtctcaatggactttcatactttgtaaggaaagctctttttgatgtcttctctaatgttttgtccatgttgcagtgttggctgttagatttttttttttttttactgccagacacacatataataatcttgaactttgcctccaaagattaggaagactcacacattttatttacaatctaagttttcattacatttggaatagtttcccatatatggacaagtacatttacattgttcaaaaaatcttgaaatggaatttcagccacaattctgagttatcttcagtttactaacaagggaactgaattgcaagcaggccacgtaatcaatcctcttagaaccacacatcccttatgatttagaatgacggcttgaacttatggctttgggatataagcatctcgatatatattgtatgctcattatagtagcacatccatattaacgtgccattgtcattgtagaatagtttaccccagacaatgaaacactgctgacattctctggccttcatggtgctgcacagaatagaatgattaagtagcaagtgtttaacaagtaccatatggagaaattatagacatcttgctaaatattcaagaaattgttgaatactgattacagatgcaaacatatgcaaactacaatttgaaatttcctattttaatgagctacaaaatttagtaatttattatatacagagcctagtactctcctaagaattgtgaagtaggtttattaggcatatttaatgtgaatgaggaaatatcttctaaaagttataaaatatgttcagaatagtgaaattaaaaacaaaagttaaaatctgttgtttaaaatgtaattcgtgttgtattttaacggaattacttttctattttggtagtatcctgagacttcttattagaatgtcatgaagtaattctgttaaaatactgaactaattatattttaaagtaacttcttacagatgttttcaagctcaactatgataggattttcattattttcagtggttgaagaaacaggtcgacgataaatcacatccacacatgtgctctcttcattgcctttccttctgcttatttgcactgttcagcctcccacactttatttccttcacttcaacttatttacagttgctggcctctcatcttccttttcatttcatagtactcatctctagaagaataatctatatttattttctctgttttctaacttccctctcacaactgagttttctcacagttccaatattaaaacaacaaaccccaaaactttaatgatggtctaatttcaaaatccaatgatttcctaagtcgtggctacttgtcatcattgatcagcatgtcctccttgaaaattttgttttctttgcttctctgggcgccattctttttgcttggcctctgaatactccagattattctgtttttagtgaatttttttcttgcctttccagggacattttgcctattttctatcattcatcttcgccaattatcattttacatccatctacttatacattgatatatttatatgcattagcatttctgtgctcacaaatatacaggtttatcttctccatgcatattttcactgtagcttaataattaactgatttcctgcaaatcacctgataaatgtgaagggcacatttctctccctactcaaattcatgtctttgatgtggacccctacaagttacaaatttaaaatatcctttttaaatgatataccacataatattccaagcaatttacatatgttagctcatttaaattctcagcaaatctgagaagtatagaagtagtacccaattaagcgatatttgaagttggccttgagggagaagaatgtcactgatactgtgctaatagagaaacaatatccaaagattctgggagggaagcaaaacttgtaataggtgaaaatagaagctctatccatagtctgtcactgaattttcaaaagaagatagaagacaatacagacatccatttgtgtggatgtgtgtacacacatatacatatattcaaaaatttgcacaaaagacttgtctttccattgtaacaagataaattctgaattgaagtatcccttaatttttcagtctgtttcaaagttgagtaacggtatttatttttgcagtggtataaaaagcagcagctttggcatgagcgatcaaaactttgtaaatgcctcttctcttcttacataatactatgctcctcttctttttcttctgttttatctcctttgttctttatttttctgattgcaagagtttattttattttacaaattagcttttaaaaaataacgataaatctgaggagaatggcaaccctgtaggaggaccagcagtctcaattaacctggagcaccaaaatctctcaaacactggaccagcaaacagccagcatccaccagctgatatgaggcccccaacacacatacagttgaggactgccgggtctgggttcagtcagagaagatgcacctaaccctcaagagactggagacacaagggagattagagggggtggtgacattctcatggagacaggggctagggaggaagtgtgggatgtggaacagtcggaggatatacaagcaggagataaaatcttgagagagaaaaatataattaattaattaaaaaataatgataaatattattaatttggttcactatagaatttccatacaaattttatttttgcccatcctccatctctgcttctctccccttccctcctgcttgtatcctatggtgatctcctttgtcctcctccatatctctcatgcagcatatttctgagtttaggatccatgttcccatgtacatctatggaaatgaaaatccaaggtttatgagagaaaatttttgcttaggacctttagctctttatttttctccttttgattatgtgaccactgtctttcccatccttctgagttccgctctttgctttgctaatcctttcaagcacagaatgtttaagttctgcattgcctttaactctatgtctcagcctgttctagtttctttgcttccctaatctaattctatttcccccatggcctaatattttcttgtattccttatcattatgtctcaattaacaaacgccagaaatgtaatagttggctttaaattcactttaacaatatacatactgcaatcctaatgtcagatcatggtagatgctacttagctatttttgtacttatttctaggcatagtagctctctgtcattgctctgctgccaattgtcttgttttgttttgctttgccttttgttttttgttttctgttttgtttgtttttattacttccagggcattcattctcctctttattttagactttgttctgattttttaaaaagaatttttaaccttcattctaaccctttcaatcctcttccacaaagtaattgtgctgacatataggtttgttacatcactgcttaaaatccttcacagaattgttatgacctagggttaaaatctagtccttgtgtcctttcttcccaaatgaataaataaaagcacacttcatcatttgcctactgctttttctctaagtgcatagttcactattcatctgaatatactttctgatgtagtcatagtcatactatgctgtgctttatgaacatgttagacaatttcctccttatacctccatacctttgtacataaatacattctgttgcctggaaattcttctccatttcttttgttaattaacttgcactgtacatttttttctagttcttggtaggtacttattttcatgtacaccatctttttccctaactccagctgtggctaggataaagaaagaccttgttaatgtcaacagagtagttaataaggtcaaatgtgtgacagtgtcaataaaattttaaaagcacaatttatcacatctaatggcgatatggataatctgtctgagaatgccctagagttggcaattactgtactttataactctatgacttgtgatcaaacaggcggacaaatgtttgcaggttttgaagcctgttcgttaaataaaaacttcttttattttctagctcttttgctaagatactcatagaattccatttttattaatttattttatatgcatccactcagttataaacatatagtttatgatatctgttaaatgcatatgaataaaatgtagataatataaaaattttctgggtcaaaaacaagttaatacaaacacactgcttattttcactggtttaaaattggaattatggtcctattcctgcacatttgtatttaatggaaaaatttactgacttcctgtgttttttattaaatatttgtttctcattgatgtttttattacaaaacagaaacaaacatgggagacccatttaatagttaaaggcattttaaaatgcaattcttcaaaacagaatctgcatatttgaatttgtgaaagtcaagtacatttttattctttctggtatgaagtgaaggtaaattttatttaccatggtgcattagcacattatagtctgtgtaaacactccagtagtacaataacagtttctattcccctgtttttggcttattagccacgtgacctcagagagattgcctcacttttatagttttttttaaaaaatttatccatgtatgaacccgttggactaaagtattttaggttgtttacttcttatctctcgagatggattattttgaaagcagattgatttttgctctaaagaggacaatagaatttagttacattttaaaagttttatatccttggaatctcagtatcaaagttttgaatctttcattatttgggaatgaggtttgtaattattcaaaccttattttagaggatgctgtaacccttgtagtgggaaatattaaaatcaacctgctggcttatttctgcactaagcccagcactggctagccacctctgtcccaatgctggctcaaccaggctgctctctctagcttgctcccgcagtgcctgatcttggttttcccagctctgttttgtccctggagccactatttctttctcagccataaacccctgtagttagaggtcccacatcccattaaccaaatagaactgccaacctctcgattagatatcacaatacccattaacccggtaaaatcaaaactctgaaagctcatagtttaccagtcatatttatatatcaataaattctctactcacaagatgcccacacaataatttcaagacaattaataatcctccaagctacccacctagtttagatgaattattccaatatacttacctttatgatataactacctatggctgtttaaagccatgctggttcacacatctgcctccatcttggccttcctccttctcccccaagatgctttctgtctctgtaactcttagctctgtctccctttcccctgtccaatcacaggccttgagctgccctaatattttagtgtgattagacagggaatatcctgtcataagcttatcttcattaatgtctcccatgcaatgctattcagtcaaagctcctgtgttattctttatccattttgcccaaggtggtagctataaattacatttgtttgtttgttgtttgtttgttttgagccattgtactatagctagtgaatccaagttcttaatttagttttgatcaaagttaatctgtgattaaaagatcctgtattgatggaccatgtagagactgccatagccagggatccaccccataatcagcatccaaacgctgacaccattgcatacactagcaagattttattgaaaggacgcagatgtagctgtctcttgtgagactatgccggggcccagcaaacacagaagtggatgctcacagtcagctaatggatggatcatagggctcccaatggaggagctagagaaagtagccaaggagctaaagggatctgcaaccctataggtggaacaacattatgagctaaccagtaccccggagctcttgactctagctgcatatatatcaaaagatggcctagtcggccatcactggaaagagaggcccattggacttgcaaactttatatgccccagtacaggggaataccagggccaaaaagggggagtgggtgggcaggggagtgggggtgggtggatatgggggacttttggtatagcattggaaatgtaaatgagttaaatacctaataaaaaatggaaaaaaaaatcctgtatttaatggtagagttctctattgttaatatatgtgaacttgtgcacattcacttgcatgtgtttgaatgtacatttgcaccttggtagacagaaaagggaaagaaaaattattaatttggatgatgagatgctctctatattagttcatggttagttcgtgggtgtatatgggatagaatgtactccaaaccaagcatcattttctcattttgttatatttattttcatttcattatgcattttgataactcttacttattatagaacaacatattgttaatttatttctaggcttttatacttaatgtgtagctataatggtagatcttcttaatttatcaactatgatgcaacagataaatttcatcatcttaaacagccctagaagctttgattgtgtaaatctatgtgtggagtttttacgataactggaatgttcttgaattgttttctatttgtgttaaaatatagccacttagaaatattgttttctttttcaccttatataagttatgtattagctgaaagcctcaaatcctccatgtgagtaagaaagataatagtaacatccgtctcatgttttctatgagaattactttctagggtatattatgtaaagcatctctaatacattgtaatttataaaattaaatagcacagctgataagagtttaaattttttcattttcctctttggatattgtatatttgatccacaaaaatgggtatttactagtaatatattatagctctttaaataattatttattgaatttaggatagtttgataatttaagctttgaattcctaagaaattgctgtctgaaaggcctatttccaaatgatagttcatatattcatttttatactatatattagccactgtatcatagagctttctaattaatattaattcatctaaataaattttcacatttttagttaacttttaaaaatttttatttcagtttcatatattttgtgtaaatgtatcttgataaaagtcaaggaaaggatgcaagttaacagagtgttatcacattatgtaatatgctttaatggatttatttgatatagattggagtgttttaatatgtatgtagaacttagttatcttactatctgaggacagctagatctgaaggatacattttatgaccttttcagaggactgagtgtttattctttgtgaatttggggtattttaaggtaatttaaatatcctttcatattttttactaaagaaaatacacttaactgtaataccattgttaaattatgctaaacaacataatcttgattgatgatattgtttatagtataaagtcataatcatcgtaatatatacagaaatatttgcatttttattttatcatataaaaatgcctttggtgaatgtgttaccttcatgtattaactaaaaatatctttattgaacctaactatataagtgaaatttactttatctttgtaggtggcctgcatgcagttcataaatgcacttgtcacctctccatatgatcttgattttcgaattcatttgaggaatgaattccttcgttgtggattaaaagcaatgctccctgtaagttgaatatatctatttactatgctgttgaacttttaattttttttactcttcaagtaaaagtacattttgaagcagagaacaagtttgtcttttgctttttcctcaaataaaactttagatatatcgtaagctttcttttttatattatgatagtagtaccctcactatataattactgattcttaattcaattaatgatgtgactcaaacataccttttgatctataccaaaggggattattttctcttaattttgagacttcacaatgtgaaagccaagttttttttattcatttatttcaaaaatacatttttcatttaaatatttaatgcctaccttttttatactttatattgatttcatttataatagatttgttcatgatattcaggatactttgcttaaatataatattcttatcaggttgctttagaatttttttcaaagagaaagtttcatctcttaaattgaatgtgaatgtttgttctaattatggttatgataaactgtatttagtataattttgtagtctgtgataaatgagtaccctcactctgtgaattctagtacacagtatttaccttataattggattattatagatattttctgaaattgacttttaaaaaataatgttattacttatgatttgaaaatttcatacagtagattttatattctttctttctgcccagtcctctaagatctttccccacccctatccatacctaagcaacttcatgttctttatctcattgaaacaacatcaaaaccaacaaaaacatggtttgtggtgtgtatatccaatatttcattgatgaaaatttattttccatctgcaagcagctctcaaatgtgaacagcttcttggatgggggtagatatttttctttaactattacatctctgttatgttcttcaaatctctgatttctctgactgacgaaaatggaaagcattatgattcttgtcctgaagttttgtaatgaaggccaatttaaatatgctcttaaatatgagctgagtgaatatatcctccttcaaagaaatactgtcaaaatcatatggagagtgggttagtaatgtatattttgaagataaacttccctggtatttttgattaaaaatagaatctagagcaataaacctttaatataaaggggatcatttcttcactatcatatatttttttcatttttcataattgttatcatttagttattaggatttagtaaggatagagtagtcatacttgagtatgttctagatgttccttgtatgtctcttcctcatagaaatagttcaatccaaaacaagttcttaatttagaaaaagtaaagtggaaataattttattttttacatgatttatatgaaattgtttagaaatatttaaaattcattttacatgtgttgcaggaacatgtttagtaatttttagtgtggagattcaaagaaagaacatgaacacatgtttcaattacatgccttttcatcgtgctcttcttgaagaaaagtagacacaaaaatagaagatttatatcccattttctttgtttatataatttgaagtacactttacctgcatttctttttagaattcaagctcagctctgaacatcataaacccagtttgggtatcacccttgcgcatctatacatgtgattatcggtttgagttttcaaagctgcaacttaatggacaaatattaagagatattccaggtgatatatattaagcccaacaatctctagtgtggcatgcttccaaactttactcatattatttttggggaagttatcagaggtttgtaatgcatgtccttatgatgtattacaaaaacaaatctttgatgcccaagatggtattttgtgatcaggctatgggaaatgggggcggggggaaggcatggtatctcgctataccttgatttaaaaatttttttttgaaataccctttaactgtaaaatcacaaaatatcattcataataaatttgtttatacaattttcaggccatacttgggactgttgtgcttgaatatatccttgcatttgtttttcaattaacacagttgatctatatttgctttattttcttggtgctagaggtacatgcgaaagttctaactgcatgatttccttggtgatctctgatgagtatgtttagtaaaagtgacagcattgaatttgggttattagcaattagtgttattatagaagagatttttaatactttagtgtgaatagtcaagacactggcatgggaagaaaacctaaagaatggtatgatgttctttcatcttaaaataaaaataccttagctacatttctttctcttttaacttttttcttcctgtctatcttcctgtctgtcaccttcctttttctttcttttcttttcttttcttttcttttcttttcttttcttttcttttcttttcttttcttttctttctttctttctttctttccttccttctttctctctctctctctctctctccttctctctctttttctctctttctctctctttttctttctttctttctttctttctttctttctttctttctttctttctctctctctctctccttctctctctctttctttttctctttttctctctctttttctttctttctttctttctttctttctttctttctttctttctctctttctctctttttctctctttctctctctctctttttctctttctctctctttctttctctctttctttttctttctctatttctttctttatctttttctttctctctctctttcttctttctttctttctttctttctttctttctttctttctttctttctttctttctttctgtattccttcctttctttctgtattcctaccttccttccttcctccctccctccctacctccctccctccctcccttcctcccttcctccctcccttcccccctctcgctttcttttaggagatcaacgtcataggtcagtatttgaaattgcatttatgtgcaatgaatcatattgctgtccctgataagtatgttaattttaaattgtcattcatttcctgaattttattttttataatagactcttaaagagatagagaatgaagggcttgatattcagttgagagtgtttgaagagaacaaagaagatgacctaagtgaattatcccaccgtctcaatgacattcgagctgaaatggaatatcctttgacaaacaaaaaactaattacattttgaaaagcagaaattgaggatgattttttaatatccctattataggtcttgtctatgaaacaagttatatgtttttttttttatcaagagtctactatgatgctatgcttcatatatatccatgctgagaaattatccatcggcttttcagaatcagagctgtgcttttctgcctctaatgttttcttccctttcttctttaagcattccaaacaaacttgaacgttatgtccctccttaaaattcccacaatagccttatgcttttcatatacactttcttctccttttacataaaagtattaaatatatggagatacaatgaatagacatcgtattatcatagaaaatggtctctaataatttttctttcaagattagtaacagctatctgtactagcatcactaatacatacaaattgcttttattttggtcaataaacatacatcatattaatttatataatcagtcatttgatctatgctatagccatttaagtgccttttgatactttaacccagaactctcacgtacagtttaaagtagtacattgtacttttcattctactgcccattttatgttttaagatattggatggaatcttacatatattttatgtggactttcctggtcctcagttcatataatgtgagtccacttttaaaatgttttattgatttctaatagcatctacaccactagttttcatatcttagaaaaaaagtattttaatgtccacttgatttatttcttatatgtttttttaaaataagcttgctttatgattgttgacagctgagtgattatttgaaatttcttttatctgataataaatatagaatagcagtgtctctattggaacaagcaacagatcaaggcaatacttctttcactttttggctttccagtttgaatggccctcactattatctgaagttgacagtataatgaataaatgattattgaatgtgttgccacccaagtaagtagtcttggaaacatttctaggctggtttttctaattgacaggatgaattttttgctacagatgtttaaatgctataacatgaaattgaagcattaataacaataatagaaaccaagtgacacttttgatttttaaaaattagctacttcagtcataaatgtactattcatcaagattctttgctgtttttctttactcacttcctactgatattaatgaagtctaccatctgctgtataatatgctgaaggacactgctgcggaaccttacttattatccattctccaacactttctgctcatcagaaatgattactacatcaggtaagattcatatctgagaggactacatgtataatttgaattggatatcaaaagaaatttcaccgagtagtgggaccaaggaaatatatgcattatatgtacataaaatataagggtttttctactttaggcaacattttaaaaaagaattcatttattttaattgggacagaaaaagatagcttcatacaactatggtgcacccaagcaaacagaatttaagcagaatttaacctgtcatatattattgagtttgtaatgaatttttctgcttgatactagcaacccaatgaaaacattggaactgctagaattttttaatttttgtctattttaacaagtaagcttttttcatttcttcttatagtattcagtaaagtgtgtgatctttaaatgtaggaaaatattatggtatatattttagttttatctaataatactattttaaaaataaatggatatgataataaccaagagctaagttttagaatagataattgtgtctctataaaaatctggatacttatataataacaggtttatgagtgactgaaattatctctaagcttatgaccatggtcttaatgttaatgacagttcaagctattcatagttgctttatatatactcttatggcatactagattctttgaattcgcaaaatttactctaacaattttaaaaggaatactaccagaatgttttattgacagtaaaagttgacatttctaaaatagcataaggtgattttttttcttcaggctaatacaatgatttgatcaacatcatgatgttgaggacacagaaaaatgttgaaagaactaatccatgttttcttaaaaaaacagtataaatagtaatacataatggtaaagatgcaataatcatgaatattcaggtacctgggaatatgatttgtccagaataatatgtttcttgataaatgttaataaacaataaacaagctggacagtggtggcacatgcctttagtcccagcatttgggaggcagaggcaggaggatttttgagtttgaggccagcctggtacatagagtgagttctaagatagcaagggctgcacagagaaaccctgtctcaaaaacccaaataaataaataaataaatatataaatacataaatacataaatacatagacaaacaattaaaattcatacatggcatatttttaaaaattgtttgtgtttttgtggaatttgtccatggatttttgtgtgtatgtatatatgtttgtgtacagtatgggtatagatatgttcttgtgaacacagacagaggcaggaggtcaaattgattcttttgctctacattttctgtgaaattatcttatgaaaatgtctttctcactgaaactggtggagtgatgataagttcttctattccttctgtcaacacccaagacatgtctgggtttacagatgtccatcaccatccctacatttttccttgcatactgggcatttgaacccagttgtacacagctggtgctttaatccaccgagctatgtctgctgcccatgtaatcctttgctccttataatattcttgggtagaggtgtaacatatactttcatttcacaaattggataaaggggaaagctgtgttgttcttagtaattcataagggtgaagttaggaactaatattatttatctccagatctgatgatcgtttttgaaaccctaaagaaacaatgccactttcttttcattcttaattttaggaatagccacatgattaaatatacagattaattagagtctgtttttattcattttcaagtttttagtagtttgacaagcgatatttagagatgtttatatcataatttgtgttacataatatctctctgaagtactgttgaatttattagcccatgacaatttgtcttctgcaaattttaatgcaaaatgtcccttatttttatttttccagtcagtggtcatttttaaagccaaaataaccttgggagattaaagaaaaatggtgtgttttaaaacctttgacacgtcacacaaattgcaactgtagctatgcatattaaatgtacatgattttataaaacagattttttttagaaatatgcttcatacataggtctccacattagtctgtaaaagaaatgacacagcccagttttgtaagctagtgtgactttcctgagtaaatgctttgcactaaattcaagacatagcttgccacccaaggccaagaaacccatctctttttgaaaaggagaacttgtggctgtctagaactgtttctgtgctcatagatttaggactaagggatcatttattttcattaactttcgaaacaataccttaaatagatagataaggtcgataagtatttttgaacacaagcatgaatccctgcaaactagaatattaaggctgtacatactttcagtcgattacatcacactcaatttggccccctaatgttcagaccatgtttaagccttagtcatattttctctacagaaatgtaaatgttagtggaattatttctttcttagtgctcaggggggaaaaaaaactttgatctttttgcattctgaatcccttcatacgaaaattgattgaaattttgaaattgattgaatttttgaaattgattgaaatagaaaagtattctcaaatgttttctctttttcacaggccacagtattataaaatcattgaggagtgtgtttcacagatagtgctacactgcagtggcatggacccagacttcaagtaccggcagcgcatagactttgatttcactcatctcctaggtatggatcatgtgcacacttctgcctgagtctgagcactttttaagcctaggtctctcactgaatttctattcgtatctggtaatttattgtttctgcgactgttcaattgttataactgtaagtttggaggatcataagaattctccttacaggttgctatatttctttttgatgagtttcagcagtactgaatcaattgaaggtcagctatcgtaccccacacaaagccatgatgttttaataggtgaatgccttacattttagaaacgtgactcagaaagattgtggggatcaggtggagtagagtctatatagatatgctactgtggttctgaaatttgaggaaaaaatttacatggtaaggaaattatctgatacatttagagaatgccaagtagggatattgttttctgagaagtgatgacaaagttccattttgtggtatgctatcctctagggctttttagttaggggattatattttaaactaatcacaccattattgcttacattgatgcatacatttgattgtttttaaagacaacacatttttgaataccatctttataatactttcattctatggcagtggacagaaaaacaatagcagtcacagattgaatattatttctcatatattattttccatttctaaaccaatccatacttactgtaagcaattcaaagatttctacaaacagcagatatcagatatatcaagataacttcctttataacacagtacatttttaggtagcttttttatgaatgtgtaagtctgtcaatataagtacggctaagctgtgtttttcgtagaacatcgtgaagatttggccatgttcacattaaaattgggacaatgctaatacatgccagtttatgatctatcttggccattttaacctgtattctcttactgttttgctgtcattacttctagattgtttttatgtccttaaaattataaataaatcagctaattgatccctttcaccatgtgtttttattatcagcttaattgaacattcttttttgtaaattctagacattttctcatcaccttttaagaattaattgctattagtggtggttactattgaggtacttttattagactatacatatgtatacacaattgcacacaaaaatattaagtactttagcatcatctatgctatagagggatctcgatttgattaacacttgaacctcagtattctagtctagtctaatttcaaatttttgtttacttattatatttcttatatcatataaatcctttactaaaattctttagtaaaatttgttccagttgaaaccaaaatgaaaatcattgtcaactctggcttgcattacctctataaagcccctttagactatatcattttcctcgttgtgtgtaatattgtgttttgtttttaatctgtgtttgtttcctttcatgaaggacaattttgagattcattcatgttatatttcatctcttgatattgtattcctttatattgtgaagtagtagtcacgtatgcatttttaaacaaattgcatttcttcgtggacatttgcattcgttccatttttcaactgctgtaataaagctgttctctatcatttatataaaaccacagctcagacatagttttttttaattggatattttctttatttacatttcaaagttatttacatttttttatcccctttcctagtttcccctttgaagaccccctatccccttccccttccccctgctcaccaactcacccacttctgcttcctagatctggcattcccctatactgggttatataaccttctcaggaccaagggcctctcctcccattgatgagcgactaggccatcctctgttacatgtgcagctagagccatgagtcccaccatgtgttttctttgattggtgttttagtcctaggaagttctgggggtactggttagttcatattgatgttcctcctatgggtctacaaacccctttagctccttgggtattttctctagctccttcattggggaccctgtgctctgtccaaaggatgactgtgagcatccacttctgtatttgacaggtactggcagagcctcaaaggggacagctatatcaggctcctgtcaccaagcacttggtggcatccacaatagtgtctgggtttgttgactgtatatgggatggatccccaggtgggtcagtctctggatggtcattctttcagtctcttctccgaacttttagacataggtttttcctttggagaaatattagggtaatgtacaaagtttagtctcaaaaggttttctcatcatgtttattaactagatgtttataattttaagttttcttcttttagtacatgataattttgtttccactcagaagttaaataaaagattttcctggaaaacctgaactgaacaacgtgactacactttcctctaccacctctctctatgtaataatgtgtaattttcaaaagaattctgtagtgttaaaaattgaactataattgaagactttcattgcagtgataattatatcagagatattttggataattgtgggttttttttcctttaacactaaagagaaaattgtggtagtaaatgtacattatagtatagaataatgtatctttaataataattcatatggaaagtacagactcatatagtggcagtcataattagccgacaattccatgtcatatatttctaatcatttgtgctttacctgaacagatgcttgtgtaaataaggcaaaagttgaagaaaatgagcaaaaagcaatggaattttcaaagaaggtaagactgataaaactgtagtcctgatttttaaaacaataatttaaccacagtgcatagttaatccattactgcctttttgttttttacatgagacttcataacttgtagtactttcaattttgtagtaatttatactactagagtcaaacatttcacaatattgatttatttttaataagctagttattattccctcttcatcaacctaattcattaggtaagaaaaatcttactcatattatacttaattatgaatgaaataaaatcatctgtccaatagtttacatagttaaaactgaacaagcaaaagaaattccttcattgctttcctttcacactcacatatactacacagttccatggagaactggtagaaacttggtttccctttaaagctatgacctgagctggtgttgaaattttatggttagaatcttttggtagtgttcatgctaggcatgtatctctctctctcttactcgtttgagatagtattaaaacaaaaaggggaaaccttttcagccatctgacagaggcaagtgcctacatttgctcagtcctttaaagttaggacctagcttggagattacatcctcatttttgctattactcagaaaatattccagttacttctggacacttgaggaactatttttgctctttcgtgccttagaacggataataaaaggtagagatgaacacaatgaaattgtgtgaagctgtcattggtaaaatgtgtatatttgtgtaatacaactttattaaactttccttttaaatgaaatgccttaaatttccattgaatgacttagaatctctttaaatttggctagagtgtaaaattggagcatattgtgatgacctatcttcatatttcctgtaattatacaagttatcctgaaataatagaaaatatggtgataattacttacaactttaattgccaatatttagagtggacatgtggcattgatcaagttgccttttgcattaccttaaacttaaaataggtttttttactgtctttagatttttgatattttttgtaatatgcttttataatattcactccctaagcctagttttccaaaatattagactgtgattataagatccaatctcagcatttccattatttccctttgactctaagcaagccacttattttctttggattgtgctctttccaaaattaaaaagggagtctaagattaggaaggtgggaaaggacctcttctcttcataattaggtttgtatcatttttattcttccttgttacatttaacataatattaaatttaaagcagaaaaatgtgtgcttgtgcagatagtatatttgaaaatcactataggagaaactaactttgagaaaagaattatgattatcaacttagggaaatcatattgattaaataaaatcatatcgaaggaattctgtccttttcattctggtatttttatgttgttgttcatttgttttggtttcggagacagcgttatattgtgtcccccttcttggcctagaactcacttgatagtccaggctggcttcgaacttgcaccaatcctactgtctctacttcctgggtgtgagggttataggtatgcattattatgcctgcctaagtgctccatcttctcagtgaagtaggaaaagaagatcactgaaggatccgtagatctttcccctcaagtatttattgttgtggtggaaattagttatattagcaaagtttgttttttttcaccaacttctataaggcattttcctgtacaaaaataggcaggaatcaaaccataaataagcagggtttcaggtttgatgtaaacactgtcatccagtttacccagacatgtgtttttcaacttaccgggatagcattttgtaataatttcctaaggtcatatctagtaggaagatggatatttattaatagagaatgtgttgccctatcatttcatacagtttaagtgcagttctgggtgatacgatatatcacctttaaaaacagaaataatattgtcgggataatctatacaaatataaaatgtcttgggttgacattcacaataaaaaagaaaatgaaaattttagtagcaaatcctatatggtatttgctgtaaatatgagtctaacttgtgtctgtttagagtagtcattgaggtaagagctaggatatagtgcagtaaatgtacatacaccttttgtagagttggggtctttagcaccccatgttttcacctctcattttttccatctctgttttctcatgtacatatctatatgtatgtatgtatgtatgtatgtatgtatgtatgtatgtatccatgtatgcacgtacgtatgtgtttaattgtttatttaatttggatagtctctttctcttttttttttctctttctcttgccaccccattctgtatatttgttggtctatgtttgcctatgcacatcagtcagagaacaacttggaggattctgttttctctggccatcttatgtaattcaaggatcaaattaggattatactccttttcttagtcagggtttctattcctgcacaacatcataaccaagaagcaaggtggggaggaaagggtttattcagcttccacttccgtactgctgttcatcaccaaggaagtcaggactggaactcaagcaggtcaggaagcaggagctgatgcagaggccatggagggatgttacttactggcttgcttcccctagcttgctcagcctgctctcttatagaacccaagactaccagcccagagatggtcccacccacaaaggggcctctcccccttgatcactaattgaggaaatgccttacacctggatctcacggaggcatttcctcaatggaggctcctttctctgtgataactccagcttgtgtcaagttgacacacaaaaccagccagtacacctctccacttctacattcagaaccatctttattcacctcattttcctctcttctgttgttcttgttaaccatctgatataaaataaaacttcagtgtataacattgtattgtcagatattttgaagtactactttttggatgctaggcaatggagatttggcagcagtaatctctcagtgtaattcttgttaatatacatacttcttatcattgtgaaaacccaatctttttaaagactaaatacgtttagaactcataaatacattccatattttttaaatttcactttctaactaaacttaaaagaatggtggcaaatctttaataaacatgatttattctacaaatgaatttctataacaagctattttctattacacccgaagagtgatttcatagtccatccattttttccttttattaaaaaaaaaaaaaaacggagaattacacctgtgtgaatacttgtcagaagaataattaaatatctttctttgtagctctctgaattcaccaaagcaaaaactgttcttcatatttagttcatagtatttaaatctttctcaaacacatatgagtaattgtgcattcattttggtcattgcagttcgatgaagaattcacagctcgtcaggaagctcaagcagagcttcagaaaagagatgaaaaaatcaaagaactggaaacagaaatccagcagcttcgaggacaggtaaggaaacaatgtcgacttgacgtcacaatgaatttagtgatcgaaaattatcttgttagtcagaaggaaaaatgtgatcagaagcagacctttagtttgttgttcacagattcacattttagttgaaataagtacagatttgatttttccaggacagtaaatcattttaatgtttggaaataaataaggcttcatttgctcaaactgccctgaatatttttaccagaatacattatacaagccaaactgtttgtgacatgaaattttcatgatgatgtgaaaaattgtgtgcatagtattttctttcaaaaagaatatagaaatgctcatgaattttaattatccaaaaggcttcttgagatctttaaatcaagacaatcttcaattcagaatgtagacactttatttctagctgcatttctttgcatacattcaaatatatctcttagttaaggtgtctacactttagaactacgtataacctcaacaaatgttgtggcttaaaagaataatatgaactttagaaggtgcctttaaatacttaatgtctaggaggtagtggttgattgactacatctctttctattattatgctgaggaattacttccaaagtccctggtaaactacaaagtccccaccgtggtacccttagttacccacagcccatatatcatgtatgttcaccatttaagtctttgtttttccttctagtattatgctactgctgtctgagaactagatttctcttattttctcattccccaatggcgagatatctctgtgttctctctgcccttggcagttttctctgctttgtatttctttgcacaaacgtcccactcagtttcatatgttcatacatcaccttttagtaggtgtcaaggcttttgagtctatcttacatttgtagctgtccccataggcaagtcttttgtattgaaatcaaactcaatgtttttgatcttttctatttccttaaaccagctcagtctccatttttatttgttttaaaatttaccactattttcttaacacgaaagtttgatttttttttttgcttgaccttttcctgacaaagaatgttagttcctgttttatttaaattctcccagtgcctttttcacctcttcatcaaaccacactcctttcttgtctacttccctcacattttgcccaagctattttaattgtctcctatttgtcttcctgcctatagtttttcctcctccagttcatgttttatgccaatgaagaatgaattctcatagaacattgttccaattattattactgaagaatttattgtgtgcagtgcttgcctgttgcatctgggattaaatgaaacctccttatcagaaatattaaagcctcctggcaggcagggctgctttacattttactcccattgcagcctagcctctgactcctctcttaactctgctcttgttcaatctcctttccttctattagatctgtagattcctggctctatacttttcattcttccaactttatcacatgatggctatatatattttaataattttcacaaagtattccatagtctactaacataagtactcggagatttgcaaaacgtcgcatcctatcaaatagtgtgagctatcctacactgaagaaaccctgttgctcatgtccttctctgactcatgtgaccacaatatcttttcttgttttcatttttatgtttgagacagggactccatttgtagccctgtttagcctgaaactctgtgtgtagtccaggctggccttgcattcacagaaagccatctgcatctgtcttctgagtgctagtattaaagggatgtattaccttgcttgcctgagtacagtaccttctatggttttttttttgttgttgttgttttttttttggtgtcagaaaagcaaccttatgctaacactcatcttgatgaagcttttcgttgtttcttcttctttctcctccccctcttcctctccctcttcgtcttcttcttcctccttttcttctttttattgagacaccctctcactcttcagtgcaggctggtgtgaaactctctgtgtagaccagattgtgctgtcatgccctaacaagctgtagcaactgctgtgctgcattaaattccggtctgattgtttgacttgtaattattaaatgaagaagtgactcatatgacttgatactgagacgcttcaaacttgtgaagtaaatatttacttgagttaaaaccctatgcacttgtacattttttaggtccatttatacagtgagcagtactcctaatctatatacctcaagtctttatggctttaaggaatttgcgattgtgattgtacaaatgacttatatctaatagaggaaaaatattgactgcagcttaacatctttattgaatatttatattccccttctgcattatattttttagtgaaaagaagaaacatagattgtacatcacaagtattcaaaataaactttattttccaaaatacttgtcaaaaaagtacagattttctaagattgaatttttctaatattgtcattaatcttacataagagtaaaaatcaggcttgttggtgcaattcctctggatttctaaagagtatttcattacaggaatggcaagccatttttgagtatacaaatatatgtacatgtatttatatatgtaaacatataagcatgaatatacatatgaataaaatttgttcaattcttgttaacattgtaaaggatatatttctgcaatcatacctaagtttaaataaaaattctaaagcatatttataaataaaattgttatttaaattgtttatccaaattttagttaatattttttattctgaaagttatttcataatttaactgggacaggaaattatcctagtagaaattttatattagccaagataaaaggacttcttcctggtaaaagaattattcaccataccatgaaatttcaattaatgaaatctaatattttgatttaaaaatgtctgctaattggtactagtttctttgaaatattcccatgttcattttgtaaagggaaccactgtgatcagtgatgttttacagtttatttaatccttaaaagtaatgtaggatgtagtgtcatcttcttgtaatcaattggcattagggaacaaacctgaagttactttctgacagttaaaagaagttattctccacttatgaaccatgtgtatgaattagttttcatggtaaatgatactttcattaggagaaagagaaccacattcaaatataaatcctcaattttgtttggttttattttgttttgtttgtttttgctttgcttttccaaaatttcattttgtctgttgattaaatgaaaaactataaaatccaatcagaatttggatttagcagttaagatcctaaaacatcttgaccagtattaactatatttatacttctatacaagcctacttaaagttggaaacacacagcttcagggagagttcatatctttccatcgtatcttcttctttttttttcttttttattagttattttacttctttacatttcaaatgttgaccctcttcccttgtttccctctgcaaaccctctattgaacctcctctcccctttgtctctaagacagtaccctccccccacacactggtaggactgtacgagctgaaggggactggaaccccataggaccaataccaaaatcaaataatggactcccccccctcctgccccccgagctcccaaggactaacccaccaactaaagagtatacatggatggatcatggctcgacttacatatgtagcagagaatggcctcatttgaaatcctcttttttttacaatgtgctatctttgataatctgtctgtctgtctgtctgtggtatctttgattatctgtctgtccatctgccagcctgcccatccatttgtttgtgtgtttgtttatttgttttttgggctgaggatcaacctaaggcttccctatcatgcaagaactctagtaaatgagttacattctcagccttcatttagttttttttgcatttattttccttatcataagcattgaggtaaagatggcgtcaaatgtcctatttacattactaggttataataaggacaaaaaggaatgatggatgtaagatgttgatatgattatatgggtatgcaaatggatgatactgaggattaatcattagtatttgaagacagctaaattagtagtactgtgaaatacttcctataagactaattgacacccaagggatttaatccatgaccttgtcatactttattcaaactttaatcatctaggctaacaattccatgccgtatactatactttttggctgtatttgtagtaaaatatattgttttattatgttatacttttcccccaaaattgtagaaactgcctactttccttctcttaatatattagtagaaatagtcattatctgaattgtacagtgtatgtcaaaacatgttaattataggttccgataaactggataatctggaaagctaaaaaaaaaaaagaaatacaagcttaaaactggaacacctaaagtatatgtatattttgtattatattttctaatgagcattaaacttgtttctgtttcagggagttccatctgcaattccaggtccacctccaccacctccactgccaggtgcaggaccatgcccaccaccaccacctcctcctcctccaccacctccacttccaggagtcgtccctcctcctcctccaccattacctgggatgcctggtattccaccaccacctccaccacctttgtctggagtacctcctccaccaccaccccctgggggagtttttcctctcctatcaggaccaattgagctaccatatggaatgaagcagaaaaaattatataagcctgacatacctatgaaaagaatcaactggtccaaggtaagatataacttcagggccctttttgctttttccgtgattgacaatgtgtgagaaatgggctgctgtacgtgagtatcaggcagtgtaaagatactgattactgacattattactttttcctgtgggcttaccatctttatgttcaccttgaaatgtgcaacctagataacttaccaaatatgttgacattgtactagagacaatggaaaatcatattgaaaagtatttgaaatacatgatgaaatgaaaatataacaggtttattattgtaaatattaagtactgtcaatttctcattacaattgtttgctaataacaggttgtctttggtatttttgttcttcagaatgttaagggttttattcctttaattttatactttaatattgtggaaaggaagggacccaaataaatgggtggataagacagtttggggaagggtaaatggaagcaatgaatttattgtacatgtattcaaattacataataaaatttaatacttgttatgtgtttaaaaaaactaagtataaaagtaatatatatacacatatgtatatatacatttgtgtgtgtatgtgtatatatctctatatatgtacatatatatatctatatatatgtatatatatacacatacacacacacacaagttgaagagatatactctagtatgttgagggtcttttcagtagacattttcatatgtacttttttcattgctgttgggtagcttttctgtatagcaacagaattgtaattgttcctctgaaaatttatatgtgtaattttatatatttgaaattgatttagtagagagatgaacaaaggcaagtaagtggttgaaaaattaaataggaagtcacaacacaaaaccttatcagtgttatttttgtgttagattgagcctaaagaattatccgaaaactgtgtttggctaaaacttaaagaagagaagtatgagaatgcagatctatttgcaaaactggccttgacatttccttcccagatgaaaggtaccttttatttttaaacattataaattcttgtgcctgttatattggaattcatttctctagtaaaatgtgctagggaagtatgaatgcattgttttctcacaggaaaccgggtcaaacataaataaattcacgttttagctacagttttatctataacccaaaagctcttatttgaattttgttttgcataaatattatttaacataaagtataaattgtaccattatttaatatttatggtatatgtagtaaaattgccattttgctgaggaacaggagattaatttgtagatttcccatggaacacaaatttgcatcatggaacactagtacctctgaactatatgaatgatattggaccaagactggtgtggtagcacttaaactttatttattttaaatcgtgtattatatatcaaccttatttttctggaaattttctagatttccttataagcatatgttctcaattaatgtccatatatgatccttagaaaatttggttgtggacttgacaatagaattacttctttaagatcttataatcttttcagtattgcacacatgtagttcaattaatatgtaagtctcacaatgagtcattgtggtcttttgttttttatttgaccatagtgattttagtagttattgcagaaattatcattgagtcaaatgtagacattacattgtgtaaatcagcctttacaacaaataatggggaatattctgtagttttttttttttaagtgactatctttggagaaagagaatcgcaaatagagtggggagatcagaaggactatgaaatttaaacaatttttatttattttagttttttcttatttgctgtcatccacttccaatttaaaatttctccttcagtaccacttatccatgcctataacaaagtatccacagagttgtttgttttaagatgtgtataggaaacataaacagatttcttttttaaacttgtatcttattctgaagatattatattttgtgtttgtaaatattacacaatttaataacaaaattcaaatagctgaaattcttcttctgctataatatatttaggataattagatactcagtctgttaaatgtttaggcatatagtttttgcctttggcaaggtgctgagaatgaaattattctctagcgtaggttaatatgcagaccaagatggctgtagattcatggaaaccatttagcctccagatttcatgtatgagataccatacttgctgtccttttctatttaaagtgatgctgaacgttttttcttcagttcataggccatttttgactattttttcttgattttctcactttgcatctttgaatatttttgctgtgaaacacttgctgttgacttttctgttcaatcctacacgaaacctcttttataaaattacacttttgcctggtttatacaaatggctaagtaagcttcgattctgtattttacaaatgaaggtagtaagattagaaatagaaggacaaaccatagggtagagtgtggtgtatgttcaattgtgtgtgtgtgtgtgatttcttttaaaatcaacccattacaatgtaagttagtaatggtagtgcaaagtgctgcctacttgaaaaaggctgttgaacagagttgcatctactttcctcaactgtaataaaagcaacttccactgactgaattacctcatccataatgggaatagactaatgtttaactaggtaggaaaatgaaatcagcttatatacatttcagcacctggcatcctcactgcttggtatctaacagacacttaataaatgttcattaggttttcacctttatttatctgatggtgggtgtgtatgtgcgttgtttttgttactgacaattactaccaatgtttgtttggaaagagaatctcctgtccttccttcctcgtggtgctcactagatagagctcatcagttacacagatgtaaattttaatgcccttgccaaaacctaatcaaaccagaatgacaccagacaaaattattcaaattatgcactcactgctgtgtatgctgcctctctcattccccttaagtttaattcttcaaatttctctgtggcattactcctattttgttaattttgagtatttaagtatatataaggacagtggaaacctttggcatcattgaattgtttctgaagggggtgcagcatttcaggatcagttaaatattatagaacatcctgtacatggaagcaatagaaaaaacaaattttggtgacccaacacgtattaattacgcattaattgtcttcttgttgaaattctgagttgaaattcgttgacattcacagtgccttgattcataatttggtcaatagatggcaggcttagtaagaaatcagcaggaggttctggctccagcaaacaaaagctgtcctgccctggctctcatagctttagggcaccactttcttctccattctactgctcattgcagctcaatcagcaccattctgaaatgagccaccaacccatcgtttctaagacctatttccaaggctgttagattcagtgttccaaaaccttttgagaactaccccctactgcaaggcctttggagagcacatggctccattcccactaaatgcactataaagcattactagtctataatgtcaagtgaatgtttgaaaattcaaagtagctgagagttgctaaatagaaagaagcattaatgcaccagttttaatacctataatatttagatttatagttattcttagattttttagggaaaatcattttttttttaaaacaatctttttttttttgatttatttatttatttatttatttatttatttatttatttatttatttatttatttattatatgtaagtacactgcagctgtcctcagacactccagaagagggagtcagatctcgttacggatggttgtgagccaccatgtggttgctgggatttgaactcctgaccttcggaagagcagtcgggtgctcttacccactgagccatctcaccagcccgggaaaatcatttttaatcttccactaaaaagcagtttatctctattttagaaaaggattatttcattttattttacaagtttgtaaaatacctagtatgtgcacagacaagaactgatcattgtcttctctgtgcagcagaaagctaactcatcgtctattgactgaggtagagagattaccatattttgtcaggttggagtaaatgttagaatattgaacatttattcaaaagctatgagagcataaaatacatctactgtagaattgtaataaaatgaataatacaggggtggtgctatgaacatttcagtacagtttcaatatagaaagatggaaagaagtctttctagagagggaataacattagcaaaatattaaaaatttagatgactgaaacttaactgaatttattggaacaaagaactactcgtgaattttgtaacacccagggtcagaagagattcatatgaatagcgatcgtttgtatgctaagcctagacacaaaaacagaaatcaggcagcttatcacatgtagacatttgccttgtttgaccattctgtgatccaagcttgactctttgttattggtgcagattcagctggttattagaaaactatatatattaattaggttgaactcagattttagagccagcagcgtcaagccctagtctcctattaagttaacagtgggaggaagagaagtgcgtactgggctgaaagcacacgcagcagctgctggttttggagtgagcaaacttggtgagaacttcacagtgaagaatggtggttcgctcctttttcattaatgtgagcagaatcacatactataaagcttgctcaaaataagagattcttacgaaatacagaaatgaaaacgagagtttataaactcttttgccagacttggatagaaattcttattctatccccaatttgcttttatagcattattaataactaatagaaaaggccatacaaaaattatgaaatgtgtataacactcctcttcctagagaattagtcttctggggtcatattccattttgtttctggcataatattttcagtgagaaaattcatgatccctgtttgtttgaatgatggatcttgcaaattgtgaatgaatatcactagcttgggcaagatataatgacatcaaatagtaggaattctttttatcatctgtaagcactttactaattttcaaatcctgcaattttccttattatgacattgatgttcttataggccatcatattgctgcgacagaaaacgtaattcaacatgttatctgtattaaggaaatagaaacattacatgtatataagtattatacaaacatgagagcagctgtagaagtttttcagactgctggagtctttcagaatatacatatctgtaactattggaatttgtatgttttttagttatattttattcagttagatatttggagatatataaccatgcagactttaatgatagtgttattttgcctttacaaaactgcagcaattatagataataataatattatataagagttaaagtaatgattgttaatattaactaaaattgaaataataatgaaatgtgtagcttataactgctaattctaattagtgtttgtagggttctctagaggctttaggaagaaccaagatagtgcgtgtttggaagttgtaagcaatttctttggttttaatgttgcttggaggtaatataagaaaaaaacataagaggttaataaaacagctttgtcaataacatatttttacaatgctgcttaggtttaataataaatgaaaatgaggttttataaatattttaagtacagataaagtttacttttaatacttgtagtatcatattttggtagaacatagtttgatgatgtctgtacatacaattattaagttttctactaaaagacattttaaattgaatttttaactttgaatttggctggctagccctgaatatatctaatgttgctttatttcttacagcacttttctatattttttaagaaatgaaaaggcaaaagaatggtaaagtctaaattatgtccattttcataatacagaaaattgtccaaatcgctttacaatgatgtactgtcagtctcaccatgtacacactttatatagtgatgttatcgtgtctacagagtaatgatgtcctagcaaacaatttgtcatcatgatgacacacatttcttccagtgctgaagatgagaaatacactgcaagttgtagaggacgccttcacgtacttccttacatggtggaaggtttaagatttctttttggggtctttttctactagatgttgcatctctagtaccatctccttgagtcttagatttttcatatgtggattttaggggaacattatcaacattaattttcagtcattttacaatcctatctttaatccattactttattatatattcattttttaggtttctgttatttgattaccattgttatcttagccccccccccccaattattaacacactaggagtttccatttaggatggcatgaacactttttttttaaactggcatttattagcataagattagggattttagagacagagattttgtcattctttagagagatgttgagatagactaccttccgcattctaaccaaggggattttaaaatagctgaccttacgaattgcaatatagattttaatacttctggtattaatgccatcagtacaatgactactaataataacaggaattattataacaatagaatgataatataacatctcatatatctcaatagctgtgattttgtgaatccatattgtatttagtcgtcatttcaactctatatggtttattgttttatgtcttgattttgtagggagtaagtgagaagaatgtgattttgagccaaggtttgttgttaatgacttctatatgttagagcaatgagttttaatggcctttctgcccttagtaatttgttcattttgttgaatagtttaacagagctctttttcacacatttaatgatgtagtacttttatattatattatcttgtgaaatgtgtcatcctattactcttgcactaaaggcacttcagagcaggaagcagaggtagcaagtaataaattattctctgaagaaaataaatttatttttcctatgactaatttttttcttttgtcattatttccatagaatagtcactgataaaatggtatgatgattttggttctgttttttgtcattaatggaagaatgtagttttgtggtattatttgtctaatgatgctttattaatacacagtggatgcaaacataaagtaatgaaattaatttttacttggaacttttagagttaataatattaacgatgctttgcattgctttatttgctttttgagatatgagctagagagtatctttctccctggtttttgaattctaaacagcgtatgaagtaagcacaataatagttgttcttttgataatgtttgcaaatgaaaaattgtcactcattttgaatcattattctacctatatttgtgttattcagataaattacatcgactagcatataaattttagcagttctatgaaaagctccacaatattatatatatatatatatatatatatatatatatatatataatcttagactgatgagaagtaggaccaaatggtttctgggctttacaaagtatatataagttagagtagagaaattcaatctggctaatgcatttaatatacataatacctaatagacataatacgtaatcagtccactttgatgactttaaacatatttcttccttttaaattcattcttcataaatatgtgagcataacagttttctagtaaccttaaaatatgttcaatagatttcattattaatatcattatgttaaaatactttccaatgtcttataaggtaaatgtgtcattatatgcttataaatcacctcagatattgtatgggaagtaatacatccaacccactattgtgacttttaaataccatgttatagatataatagattaattcatagcaaagccccatctattattattattattattattattattattgttattattattattattattattattattattataacctgacttacttatcacacatttcccctacaattaacaaattaacaaattgatcgcacatttagtggtttggctgtagttctgtctagcatgcatgagatcctggctatactccggactgaaaaaataggagaatacacacaaacacacacacccacacacacacacacattttgcatgcaagcacgcacgctcgcatgcatgcatgcaagcacacacgaacacctcaatttattcttcagagtatcaggaatcctggcagttctcttccaagttttgaacttcaggataccatatcgtgtcatgatatttctttccttgctaaacctcagttcatttctctgcttctgctgttgtgttaatggcattcacatgtgaagaacatatcactgatcattcattttcttcttaaagatcttaaaatcttcttattaatttctaagcgatttgtattttaactcttcctagttcctggattggaagctgttataaaaaactctatatttctgtgaccttattgtatttctttttcatttttgcgaataacttattgtgtggcccttctactagaatacagtcttcacagtattgatgttattatcttgtatcctacattactcaactaatttcttcagaaaggcagatagatagctcttttgcttgtgatgttttagtcttcttagactatactagatcctctggcaagtctgttgagtgaataaccaaagaattacagttataataccaaagctaatagcagaaattaaagaataatatttctttattattggctccaacacacatacacacatgcatacatattcttatgattacatttagattgctcatatttagtcactagtaaaaatgacattcataagtttttcataagtgaccaaatgtgtttcttcaaaaatctttcttatcactgattaaacactagaaatctgcttaaagcctcactgcttccagtttttttttaatgttaatgtgtattttcaagagttaatgtttcacctcatttggagagttttaattttatatttttacatttatattttaaaggcttcatatattgctttgcagtattttaatttcttttaatgtttatttttaaaatttgttgttttgacttttgagaattttttaaattttgtgtgaatggatacttacatgaatacatgtctgtgcaccacttgtgtgcagaggccagaagatggtctcattctctgaaacttccatacagttgtgttctggcatgtgggttcttgctacagaacctggctcctccggaatagcagcttgtacttttagtaatagagatgtcttattagatccaatttagttctcacttttttttctgggtagctcaggctactcagaaattcataatctaccaatcattaagtactggtaaggctacaagtatttactaacacactggagctaaataacagtttaaaatagcattgctgatgctttattaaatatagaaaactttgctgaagcaaatgtttctttggtagtttgttgttcaaatttgaagaaatttctatttcttgttaatgctattgggagaaatatgaaatataatgactaataaactatcagaatgttttgtggaagtgaagataattttatttcatagattcttaataagattgacagttacacagggtggtggtagcacatgcttttaattgaaagttttaagaggcagaggcagaaggatttctatgagtttggcaagcctcatgtacagaaccctgtcatgaaacccctctctccaaagaagacagacggtttctaaattatgtattaatatttatgtatattctgtataaaatatgtggcttatcatcttacaagaaaacaacctgcagcatcttaataagtattagttttatggatctctgtaatgaaaccttaaatgttacttgggctctcataccttattgtctgttctaggctatataggatattaatgaagacctttccttttctcctgagcacagaaagaaagctcaggtcacctccatgctacatgacttagttgtgctacaaatgaagagatgtggaagtcagatgtgtagcccaatttcacaaacttatacttttaaacactactggtgttctctgtggtatacctgtatatgttaaagctctattatcagaaatctcaactggggagtcatagtctccttatctgtctcacataacaaaacagtatgctttgaattcttgtgtattgacgtgtcttcttcttgcataccctatatagctaatgtaagaatttagtgtatatagcttttctaaaaattttagttattttagatattgtaatataattacagtatttttccctctttgttcctccaatccctcccatatacctcttctgctatctttgaagtttatgctaccttttctttaattgaaggtattgatctctctctctctctctctctctctctctctctctgtatatttgtgtgtgtgtatgtatttggatgcactctaaatgcacaaatacaacccctcagtctgtgtatgttacatgaatatatatttgttctgggctgaccatttgctattagataacaagctgtggggccctttgggggagaccataatttctctctagttgtctgtagttctttacatagctgactgaaccaattcatccactaaattctttacagtgtgtggaaatatgtgtctcaatatataatactattccaaaagaaaaaaaaagaaaaaaaatgttgctacctacccttggttaagttttccatgcaaaagttatctttgcttttcttatcatagcaaaattaatactattatgatttatctctgcataccaacatcatttcctaatactgtttccatctattggcatgagtttaacttcgataatttctaatttaagttacttttatatgagcctcaacaaaatatgtgatgcattcaaatggcagacttaactattatgaattatcaatatctcctccattagaatggcttattgagagttttctgtgtctggtttcatgtgataagaatagactgataatcaccaatccttgacactattttttttcttttttttttattggatatttatttcatttacattttcaatggtatcccaaaagtcccccacaccctccttcccccactcccccacccacccactcccacttcttggccctgtcattcccctgtactgaggcatataaagtttgcacgactaatgggcctctctttccactgatggacgactaggccattttctgattcatatgcagctagagacacgagtttgaccatttcctcaggctctgttccatcctcatccttgtatttcttgaagacaggataaattttgggtcaaaagttttgtttgtgggttgatgtccctattgcaccagtggggtcaaaaaaaaaaaaaaaaaaagaatagactgataaaacatgtgttgtttcctagcatgcaatagcttataatggaaggcaactctgcaacatgtgatgccattaggatagtcacaatttttctataaaagctgatgagattaggtagcttttgttgcattaacaggaacaataaagattctatcactgttttcctaagtcgtagtctttgctccttcagtgtcagatgacaggcctgctaattattggcattttcattctgttgcgcatgctcgtttttcttatgcagacaatttaagtgttttaataattgattgcattatcaaatgttaatatatctacatgataaatgagaatatggctctaaaacctttgtgttatagcttttagacattcattttactaattatacaaagtgacagtttttaatccattataggtcattactgaaaacatacaaatgtagaatgatgacaatttcttaggtacagggttttcaggtacatggtagctatattgtagtatttcagagttgggcaaagcttaactctgcgattcttcagaatgtttttttactttctattaaaaataattctagccatattatttttcatcttgacttacaaatctaacccatgaaactgtgaggttttagtagtgtttttagccagaaagtctctcaccaaataacaaaactacccatgtaataaataggtaataaaaccagcatgatgctgttctgattctgttaatagtaatttttaagttaatcctttcatctgtttgtggttaatgctttttaggaccagtgaaaccagtgagaaccaactggaacagagttagtgtccaagttcagaacaaagctgcctgacccattaaactgattgagttgataatcttactgattttagcacagtattgaaaccaatttaaataatatgccacatatacatggggaagatagcaaaagctgttaattattctaagcatccctttttaaagtggatttcaatgggttaatgttgtattcctataattgcagtgtctaagaagagtttattgttatagggctcttaggttcattgttttcctgtttcatttttaaactgtcacacgaatcccagcaatagtaataggcctgttccaccataactagttcattagaagctagaggtcaaagttgagacctaggctttctgttccttaagcagacattctaccacttcagttagttccccaacaccgtacatgtattttgaactgatttttaaaattaagtgatgcaaatgcaattatatttatgtattatatgtgacataattatatttgttatcagctttttcagattcaataatctattaaaataaaactatcagtttccatggtgactatattataattatgtgctagtgtttatatactatgtgttatttacttgggaatatgtattaataagttagtgtaattaattagactggacccttcttagtatgcagaaatctaaagttttttttttctgatcaatttaaattttataagtagctgaaaataatttctctttttttgtaatttagtatttgtatgaagtaaatagttgttctccattaataaagtatactgaatttatataactttgtatttgaagtgaaacacaactatttaagtaattttacttctattttgatatatttagcctataacaatttacaatctcctagactaggggtacttttcccccaaaataattttaaaatttccagcagaagtggaaaaaggaaaattgctatggatatccattttcaaacaatagttttcttttatgtcacatattatatgaaatctgatatttatcacttagttccttcatggaaataggaattactatggctatattccattttgagtgttattttaaatttcatgactatgttattgtagattgtcttaattctacctcatagttttttgtaatttaattcaatagttatattgttctttcaattacagcacctccagattggtatcattaaaattgtaataaatatatgcaaattactttatgaaactttaatacatttactttactccttcagcactgtgccatctgtcagatgattcatgtatattctgtacgtaccatgcatttgtcatcaagaaatacatatatacgattaaaacatacctttttatctaaagaatgaatgtctaggacagttgggactgaattgattcatagggtacttgttatctcattttgttccgaatacattacatgtattcactcaattaaacctcataaaaggacatcattaaaatatattttattatgtccataatgtcatagggagattaattcactcaatagaaaacaacacaactgaatttgaacttggtggttttaatttccagactgccagcttccagtgaattcatatgatgttagaaatttgaattgttaagataggtcctgtttctatagacataaagcatatattgtagaaatcatagtcctaccctcttcatctgagacaactgtcaacttcattttttagcaggaatggcatgagggaaaggaaaggaaaggctgtagattttgttctgaactctaagaaggccttttccgatgatccacaattttgcatctgtgagttacttttgtgtctgaacagtatcattcattcttggtatctaaggttatctcttctcaaaccagatagtgaaggtggcatttgcaatttttgaggaagatgaaaaacttaaaacatacattgttattgtcttaatccctcccattgaatacgcttgccaaaagttctctttaacaattactccaggcctcctttatatgaaaaaataaaggtgttttccaagttgatttcagttatgtcaggggctaaacattctgaaccagtactgatgtttcttttgatgggaatagagataattcctctgagtcatcttttctaaaaggagacactatgcgagattattctgtcactcatgtatttaaactttattttaagcttatatctcacattactgctagaaatactttaatcttactagacaaattataatatcatgcttaatgtaaacattaatgcattcctcacagtcttctgaagtgtgggcatttgagtaccaaggtcattccaaaacacgtggcaggaggtgactgttggcaattgcaagtatgccagcatggaatattgaatcaaagaaatcaatatgtcaccttgtccaaatcctttcttatactatgtcaaaccgattacatgttatcaaaaaaaatacaaaccatttaaatgtttcaggaagctgaaatttacaatatattgctgaattagttaacacaaaattgtattatccttttcatttcctatattaaggaccctgatattatgcaattcttgtatttaagatcctgcaatttgctgtactttcagatgttgtgttagggtccaatttgggaatgacttcaatattttttattgtccgcatatttatttatgttttccatttaattatttattcattttacatcctgatcactgccccacctccaggtctccccttacacagtcccttctcctattccactctccccattcttctctgatagagtggtgtcctctgggtatccccccatcctgacacatatttgaattatcttaaatttgaatcattagcaacaggatataaaagttgacaaagtgcaatcagtaaagcacatttgcttatgtttatcgatttactttgtgacaatttaacattttagtaattagctaccaggttgcagcttactgtgatataggaaatacatattagaacaaacattttgccatatagagttactgaggcattgagcttgtaaagtgcctgtttgtagaatgtctgaaattttgtattattgaaatcatcatttgaatctttggaaagaaattaaaaatttccctgttttactttattttgtacgacaaaaaagcagctatcttagaaccgatgtggtaaattttcactcttaagttcttctctgaaatatattctgttaactcatttacttacagtgctgacattggtgactcgaatgtctctaccatttgttcttgataggcaatataggcaatactgggataaaatttaaaaaaacttttaaatattaatatttggatatataatattttaactattgtaccaaatttgttctttatggatagtgcattttagaaaatgaattctcttatcagtgagtgcataccatctgtgttcttttgagattgggttacctcactcaagatgatattttcttttctttttttttctttttttttttattaggtattttcctcatttacattttcaatgctatcccaaaggtcccccatacacacacccccaaccccctacccacccactccccctttttggccctggcgttcccctgtactggggcatataaagtttgcaagtccaatgggcctctctttgcagtgatggccgactaggccatcttttgatacatatgcagctaaagacaagagctcccgggtactgattagttcatattgttgttccacctatagagttgcagttccctttagctccttgggtaatttctctagctcctccattaggggccgtgtgacccatccaatagctgactgtgatcatccacttctgtgtttgctaggccccggcatagtataggaattttatattatttgtgactattgagaagggtgctgtttccctaatttctttctcagcctgtttattctttgtgtagagaaaggccattgacttgtttgagttaattttatatccagctacttcactgaagctgcttatcaggcttaggagttctctggtgggatttttagggtcacttatatatactatcatatcatctgcaaaaagtgatattttgatttcttcctttccaatttgtatccccttgatctccctttgttgtggaattgctctggctagggcttcaagtacaatgttgaataggtagggagagagtggacagccttgtctagtccctgctattagtgggaatgcttccagcttctcaccatttactttgatgttggctactggtttgctgtagattgcttttaccatgtttaggtatgggccttgaattcctgatctttccaagacttttatcatgaatgggtgttggattttgtcaaatgctttctcagcatctaacgtgatgatcatgtggtttttgtctttgagtttgtttatatactggattatgtagatggattttcatatattaaaccatccctgcatccctggaatgaaacctacttggtcaggatggatggttgttttgatgtattctaggattcggttagcgagaattttattgagtatttttgcatcgatattcataagggaaattggtctgaagttgtctatctttgttgggtctttctgtggtttaggtatcagagtaattgtggcttcatagaatgagttgggtagagtaccttctgcttctattttgtggaatagtttgtgaagaactggaattaggtcttctttggaggtctgatagaactctgcactaaatctatctggtcctggcctttttttgtttgggagactattaatgactgcttctattccttcaggggatataggactgctcaaatcattaacctgatcctgatttaactttggtacctggtatctgtcgagaaatttgcccatttcatccaggttctccagttttgttgactatagccttttgtagaaggatctgatggtgttttggatttcttcaggatctgttgttttgtctcccttttcatttctgattttgttaattaggattttgtccctgtgccctctagtgagtctggctaagggtttatctatcttgttgattttctcaaagaatcagctcctagtttgcttgtttctttgaataattcttcttgtttccacttggttgatttcacccatgagtttgattatttcctgccaactattccttttgggtgaatttgcttccttttgttctagaccttttaggtgtgttgtcaagctactagtgtgtgctctctctgttttctttttggaggcactcagagctatgagttttcctcttagaaatgctttcattgtgtcccataagtttgggtatgttgtggcttcattttcattaaactctaaaaagtccttaatttctttctttattccttccttgaccaaggtatcattgagaagagtgttgttcagtttccacatgaatgttgactttctactatttatgttgttattgaagatcagccttagtccatggtgatctgataagatgcatgggataatttcaatatttttgtatctgttgaggcctgttttgtgaccaattatatggtcagtttcggagaagttaccatgaggtgctgagtagaaggtataaccttttgttttatggtaaaatgttctgtagatctgttagatccatttgtttcataactactgttagtttcactgtgtccctgtttagtttctgtttctaagatctgtcagttgatgaaagtggtgtgttgaagtctcccacttttattgtgtgaagtgcaatgtgtgctttaagatttactaaaatttctttaatgaatgtggctgcccttgtacttggagcatagatattcagaattgagagttcctctttgaggattttacctttgatgagtatgaagtgctcctccttgacttttttgtcttttttgatgactttgggttggaagtcgattttattagacattagaatgtctaccccagcgtttttcttcagattatttgcttggaaaattgttttctagcctttcattctgaggtagtgtctgtctttttccctgagatgggtttcctgtaagcagcagaatgttgggtcctgtttgtgtagccagtttgttagtctatgtctttttattggggagttcagtccattgtggttaaagttggcattttgttctcgtggctgtcttttttcaggttttttgaaggattacttttttattgctttttctaggacgtggtttccgtccttttattgttttttttttgttttttttttctgttactatccttttaagtggtgggttcgtggaaagataatgtgtgaatatggttgtgttgtggaataatttggtttctccatctatggtaattgaaagtttgtttgggtatagtagcctgggctggcatttgtgttctcttagtgtctgtaaaacatctgtccaggatcttctggcttttatagtctcttgtgaaaagtcttgtgtaattctgacaggcctgcttttatatattacttgacctttttcccttactgcttttatattcaatctttatttagtgcatttttttgttctctgattattatgtgtcgggaggattttcttttctggtccagtctatttggagttctgtaggctacttttattttcatgggcatctctttttttaggtttgtgaagtttacttctataattttgttgaagatattttctagccctttaagttgaaaatctgcattctattctactcctattatctgttagtttgttcttctcattgtgtcctggatttcctggatgttttgagttaggatctttttgtacttcgcattttttaaattttatttatttatttatttatttgtttgtttatttatttatttatttattttacattatttactctctagtacctttatttatttatttatttatttatttatttatttatttatttattttttaattaggtattttcccttgtcaaagatcaagtgaccataggtgtgtggattcatctctgggtcttcaattctgttccattggtctacttgtctgtcactataccagtgccatgcagctttgatcataattgctctgtagtacagttttaggtccggcatggtgattccaccagaggttcttttaaccttgagaagagtttttgctatcctaggttttttgttattccagatgaatctgccgattgccctttctaattcgttgaagaattgagttggaattttgatggggattgcattgaatctgtagattgcttttggcaagatagccatatttacaatattgttgtttccatgttctctatggaatcttctgcacctgagattctctcttccatctcttgtattctgttgctgatgctcgcatctatggttccagatttctttcctagggtttctatgcctcactttgggttttatttattgtgtctacttccgcttttaggtctagtatggttttgttcatttccatcacctgtttggatgtgttttttctgtttttctttaaggacttgtaacctgtatttctttaagtgaattattaaagtccttcctgatgttctctaccatcatcatgagaataggtgaatatgcttgctatgtatgctgctagaccattttctgtcttgaaatgttaatatgaaacatattaagctttggatatacttggatctattaaactatgaagattattgtcaatagcattttcacaggttggttggcattaaacctgaatagaactgtcagaaagtaattggattaagggtagtcctaattcttgaataagaaaactacatatcagaatggtttcccttccttttgtgaatataaaccatactatttatcatattcctcttgaatttttggcacttttttctaataggaagtatgtgagaaaaaaaatacttgaacttttccacctgaaacagatatcagattgttagttagaatatggattgtgctgtataatataaaaatgattttgggccatttcccaaatatttgatcattttattgttgtttcttctatttcaggtataatgtatatttttatttgttatttttgtttttgtctaatgatatatttagtgtgtcattagcaacccaaattagttttctaatttatttatttataagaatgtgtgttatcacaatggattagagctcagaaaatgggatgatgtgttaatatcaagtaactgccataatatgctgtaatgatttaaatataaagagacacagaaaactaattttcttgccattcgtgaaaaaattaaggattgatattttattggaccatcagtcatgggatggagaatggttaatggggccctgccttttactgctgaactgttggctgctgatgcattctgaggatagaaagtcgttgcctccaatgttgacccatttccaagcccttcaagctctagtgaatacctccaacagtctcacagattaaattcagtggatcacaacacagaatgaattgactagaacgtgaataacaattgtatgtaaaataacagggattcgcatgggaaagtgtgtgtgtgtactatatatgatgtacacgagtgaactttacagaaaacatttaattaatattaatggtatgtttggaagatgtggcatgaagaagagcttttcaatgttttaatcaagctgtgtttcagtaatgaatacatatgactagaatgtttagaatagataatagtactttaagtaggcttttaaacaataggataattctgagattttaaggatctgaactatggcagtgtcaatagcagtgttaaggaagaagggaaataccaaaaagtagaaattaacaggttttagtgacttactccaagaaaggtgacagaagagggtaagtcaaatatgatttctatgtatcatttctataactagatttatgatgagaaggaaaaggacaacaaattaacctcttgatataataaatttctcaagtaagaaatttcgatgcccacatgctgtgagtaattatatgttgaaaattagtatcagaatattgtctgagtttcagctagctagaaagttggagttacagtcaatctgaacatgtatgatattcatgaaaatgaagttggccatagtggtataaacttgttatcccaagatacttgaaatgttgaggcaagagaattttacctttctcttctatcttgaaatgtagaccaggctggcctacatagtgagaccttgtaccatttgattttttttcaattttttattatatactttcttcatttaaatttcaaatgctaaccagaaagtcccctaactccccccccccccgccctgctccccgacccaaccactcccacttcttggtcctggtgttcccctgtactggggcatataaagtttgaaaaaccaaggggcctcttttcccaatggtggccgactaggccatcttctgatacatatgcagctagagacatgagctctgggggtactggttagttcatattgttgttctacctatagggttacagaccccttcatctccttgggtactttctctagctcctccattggggcccctgtgttccatcaaatagatgactgtgagcatccacttctgtatttgccaagcactggcatagcctaacaggagacagctatatcagataccctggtcttttcagcaaaatcttgcaggtatattcaatagtgtctacatttggtggctgattatgggatggatccctttttggggtagtctctggatggtctacccttttgtcttagctccaacctttcctctgtacatccttccatgggtattttgttccctatgctaagaaggaatgaagtttcaacgcgttggtcttccttcttcttgattttcttgtattttgcaaattgtatcttgggtatctaattttctgggctaatatccacttatcagtgagtgcatatcttgtgagttcttttatgattgagttacctcactcaggatgatatcctcccgatacatccatttgcccaagaatttcataaattcattgtttttaataaccgagtaatactctattgtgtaaatgtaccacattttctgtatccattcctctgttgagggtcatctgggttctttctattttctggctattataaataaggctgctatgaacatagtggagcatgtgtctttattaccagttggaacatatgtccaggagatggaaatcaaaacaaccctgagattccacctcacatcagtcagaatggctaagatcaaaaattcaggtgacagcagatgctggcgaggatgtagagaaagaggaacactcctccattgctggtggtattgcaagcttgtacatccactctggaaatcagtctggctgttccttagaaaattggacatagcactaccagaagatccagcaggatcatttgatttttaaatgaaataaaaataaagccccgaatgtaaataaaatcacccaatgacttaacaataggaaagtaataataaaaacctaaaagaaaaacaaaacaacacaaaccataacaaacaaataaaagtcaaaacaatactatccttatctgagttctgtagataccaaaagtttataaaaatttcgtagacgaaagcccaataaatgaaatgccaagaatatatctcaagatatttttctcttcaatttcctgaagatagaagttggtttaattgagttgactgtttgtgaaacagtcaaatcagaggaaaagagaataaaatcttttaagttttccatgacagagtatatttgttcttttaattgtttcatattcagagtagttaaaagtcatatcaaaatttatttacacctcagtaccactgatgctgctgatgattgttgagatattagaaacaaatcatgaaattttggaaggtaatgaaaggatgacccacaaatctcaatgaagatgatactgagttagaggtgttcaacactagaaaagtacatgacttacaagttaaaataacaacctggcttagaggaaaggatttctagttgttattttctttgcttgcttgtttgttgttcttcataagtatgacctcattagatgttctcatggatatttattaaagataaaatctgatgcaaatcatcatggaaaattagcaagatttattagtgtatattacttaacaacaatattaatgttagtacctcaaaatccgtaaaagggactatatggaacggaatgaaatgtgttatctctgctttctcaaaatagtaaatatttatttacttaatttacatttcaagtgttatccccttatccagtttcccttcctccagcaaactccatatcccctcccccttcccctgcttctatgagggtgttccaacacccacccacccactcccacctccccacccttgacacttacactgggtcatctatggagccttcataggaccaagtacctctcctcccattgatgtctgacaaggccatcttctgctacatatgcagctggagccatgtacatgtgctccttggttggagtcttagtccctaggagctctgggggaaggggtctgattgattgatattgttcttcctatggagttgtgaaccccttcaactccttcagtcctttctctaactcctctattgggaactcaccgctcagtccagtggtttgctctgagtatccacctctgtatatgtcaggcactgccagggcctttaaggagacagctatatccagctccttttagcaagcacttcttagcatccacaatagtgtcagaatttggtgactgtatctgggatgaatccccaggtgagacagtctctagatggcctttccttcagtccctgctctacactttgtctccatatttgttcccgtgagtattttcttcccctttgtaagaaggacggaagcacctaggtccttcttagaaatagtaaatattttaatgtaggttaatatattttatgtctaatataggttacagcaattaatagttgtactttgggaaactaatcacaatgtagaaatcttgtgcatagactgcttcatttacaaacaaatataatggttgggaatgtggaagtgtccataatttgatttaaattatttttgtcacatagtttttgatactagcaaggaaaaacattggatataattgaccttattaatattaatttcatacagtttaataaaagttatgttagtgattttacaaaataaaacctttattcatttatgcttctctaaaatgaccttgtaaaatgtcaaaattgttattgtgtgctttttaaaaatacttaatgatttgtatttgatgcatttaaactctttattgaaggtcaaggattctattagggcatttttgtcagtaaaatgttgacagaaactaactaggtagttcaattctcactgacaacactgtcacatttgttaagaaattgcctaatgataaggccaaatttttgctcattatttttcttagtaaaacccatgaggtcattaaatattgcctcaattagagtgtgtattgtatcaaaatttaggtaccaaccagaattcttatttaatagatactgagtttacgttgtcatggttgaatcattctcagagagatgggtatgggagagagagagagagggtggagggagagggagacagatagagaaagagatattatctaccatgcatttgggtgatgtgaagctggattttacaaagcattggtgtttgcttttatctcagtaatattttgggtgtattcagattgaaattagatatgtataaatcatctaccagcatactccaaattggcaataaagacacagtagaatattataactcttatttgtaaattattttctcatttccatcttatgggtctaaaaatccaagattttatatgcttctaattgtttagcctttgtatatcatatatgagttattagaatactggttattagtgactatagattttaaattcaactgcttttaactttaggagtttgttttttaggttcccatggttttagaagtccttgatgtgttattcatctttctctagatatagggattcatttatacttcatctttcctattttctgtttattttagagtataattttatttttttaattttctgattgttttgcataataaaaccgtgacacactccagtgtggcgttcatgaatgtaaattgtattggggaagcagacacaggatgatcttagaagacaaacatagtctcggtagagatactttcattaagagtctcaaaacactaaatgaagtaacatgaattagcatgcatttttgtgttaaagacagcagtttatattacaatcaatattagtaaagctcacttattttagttctaattcttgtatatcaacagaatgttaaaaagaaacagataccatttggtaaatcgaatttatttcgagaagtaatagcaggctttgaaagcttcagctccaactccgttttaccactacctaattgatactctgtaagatcctcagttgttttgtactcagagtgaggataaaaatgttatctactttaatcttatttagagagttgagttaatatatgctcattttgttgttgtggccattttgtattaatattaatttacttgtgtcatgatcatgttcacattgtatagcatcaggttgccaaatggccattggtaggatggccggagaggagacgagttttgcagggacggggtaagtcaggcacagtggtcacaagaatctttcagctctgactgactagtaatcaggtttttttctttatttatacaggtttcacagaacaaagacagattaattattattcaggaagtacatactctattattttgtccctgagcatattttgatttctcattacatgtcaggagttacgagttcagtcacaattaaaatgtagaaatggaatagattttattttccttatcagccctgtgattctagttcaaagcaaacacatttattatatgacaacattcttttaggctacagttttaaagcactccagacaaactaagtatccgaaacaatctttttattagtagcaaatactaatacctaactccttttatgtatcatttcatcatcatcatctatgctataatgtaggaaaagttattttaatctattcatcgtatttactgagttctattcctctagggatgtactctgtataatctcctatctttgaactaaattttcagagaactctaagcatattgtcaaaagagtctttgaatatgttaccaattctcatggctagtaggaatttgtcaattatgtttgagtttatattattccaattatataccatttgattttgctcattgtcataaaggaattcctagaattttagtgcttatctgtgcttaattcagtctctggggcatacggaatactttcaaatagggccagataaagctatttccctaaaaccagaagggatagtaatttcagatattcctaagaatgtgcagaaataattttcttggtaacagacatagagtgattcataatgtagaaaggccccatgaaaatatcaggccggggccaaaacctaaaagagacattatgacagcaatcacagcttttgtctccattttgatgaaactgtgtcaaaccagctgtgctggcttcttcatttttatgaatagaaatttgttaataaatttaagcaacatatagttcataggtgggggatgagaaactatgaagtgctaagcatcatggacagatatttaatagagaaaatacaaaatgataatacggaaatcagtctactgcaaaggaaattgccattaaaaatgtattttcatggcataaagtccctttcgtactctttttatttgtgtatatgactacactttagctgtcttcagacacaccagaagagggtatcagatcccattacagatggttgtgagccatgatgtggttgcttggcattgaactcaggaactctggaagagtagccagtgctctttaccactgagccatctctccaacccctgtgctagcttctaaactttcactctttccagtagttataatgatgccaccagatggtaatttttttccatttaaaactcttttttaaggtattttcttcatttacatttccaatgctatcccaaaagtcccccaaaccctcccccccactcccctacccacccactcccacttcttggtcctggagttccccagtactgaggcatataaagtttgcaagaccaatgggcctctctttccactgatagcccactaggccatcttacacacgttctcgcgaccggccaggaagacgcaacaaaccggaatcttctgcggcaaaagctttattgcttacatcttcaggagcaagagagcaagagccagagcaagagcaagagcaagagcaagagcaagagagagcaagaaatcgagaaaaagaacaagaacaagaaagcaagagagagaatggcaaaacccagtcccttttaaggagaattatcctccgcctaggacgtattactccctgattggctgcagcccatcggcccagttgtcatcacgagaaaggcagaacacatggcgggaaaactgcccctgcacatgtgcagattatgtttactacttagaacacagctgtcagcgccatcttataatggcaaatgtgagggcggctcctcacaaggccatcttctgatacatatgcagctagattcaagagcttcgggggggtactggttagtccatattattgttctacctatagggttgcagatccctttagctcctctctagctcctccattgggggccctgtgatccatccaatagctgactgtgagcatccacttctgtgtttgctaggccccggcatagtctcacaagagagagctatatctgggtcctttcagtaaaatcctgctagtgtatgcaatggtgtcagcattttgaggctgattatgggatggatcccagggtatggcagtctctagatggtccatccttttgtctcatctccaaactttgtctctgtaactctttccatgggtgttttgttcaaaattctaagaaggggcaaagatggcaattttaaaagttctattttcatgtgtagtgtgtgtgattgcatgtgtttctgtatatcatgtgcttgcctgatacccatgaaggcaagaatatggcatttcatcttctggaactgtatttggcgatggttgagaaccagcttgtgagtactttgtactgaatttgggtcctctacaagaacagcccgtgcccttaaccaatgatccatatctctaactctaagaaggaattcttggtgattgtttatttttgtagaaatgtagtcaattctttgccatgtctgctcacagattatggtcaacatacttaacaactttgattatactattatatgtttaagttccttttaatttctgtgaactgtttaacaattcaaagaacaattttattttgtagatcatgtaggtggagaaactgatggcgagaaaggcatatacttgtgtatggtattcaactaccaactgaacttctgttttgaatagagatctttaaatcaatagtttgttatcagtcagaaagttatgcatgtataatttttttatttcgaatatgttcctgcacagaaagagccatggagtagatgcataattcctaacataaggcatatgcacgttgaaatgagataaatagaattatctttcttatgctgtgttattcgactctgtatttattagcatttaagttgtaataaaattcacacttgagaatgaagtggatttaagttaatgatactaaaataaaaaaatactcaatgatggatttacctcttattttagaaattttaggctgtgaaaaaacagaacaatagcagaaatgtagtatttctaagctgtccactctcttaactaaaggtagaaattaatattaaacattaggttctgtcaaaataagggcctggcaacttgctgaaaatttgctacaagttctgcagcatttttaatcctctagatttaatgcaaatgctcgtgattcatgtcttcactaattttgtggtttaggtttctatggattaaatgtctttataaaacatttaatgttatcgtcttaatttgtgattcctatgcaagtattttatgtgaaaataataattgtgctgctgcgtatagaaacaaatattatttcctcacctattgctatgcccacatatcagtcagttttatctgttgatcacagcctccattatatcagatcattgtgctcagtctctaatgtatgcactgcacttatgcttcaaacagacctgtatgcttgttcatttataaatataactgacctagtagccttgtacctgccagataccacttccccaaatgaacaatctactcctttgatttcatgtctttatgcttacttcatgtacaactgtgtgtacttctagttattccttatgtctgctttgagaatactgaaaattcttaactgtacctgagtggagcctttcattgacttaatatgtgttctattaatttgtgtattttctttcttaatgctttcttctattctccttctcttttacaacctatttttaccttgttgcaggtaggaattaaattaagtgtttgctttgttctctttataacacctactagtgttttgtcaggccatttttttaagtgacttctttagttaagatgtccagcacatgcacatggttttaatttttaaattttatttatttatttatttatttatttatttatttatttatttaatgtgactgtatgtatacacatacttgggtatactgatttgcatgtatgtattaatgtgtgtaaaaaacttgtagaagatgtctctcttctaccccatgtatttttgacatcaaacttcagataaaaaggcttagcaacaaacagctatatctgctgcatgatcatactggctcatgaatgtgttttaaatcatctcacaaagtatgaaactgaataagtgaaaaagttgaagtttatgatctcattataactcatacaaaagttacatatttactgtatagcatagagaaacattgaaacatcccttttgctcattcatgtatttgtaactgttagtaacatgaaaagcctcacaaagtttgggtctttcactttgaactttttccttgcttattcaagcagttctatttttgtaagctatttagtaggcccttcattaaaaaaaaaaaagtaaaagcatttccccaaccctaaatatttatttttgctttcactttcccttcaaataaataatttattatttgaattcctatcaaataccttcggatcaactataggactcacaacagttcataaataggaacttgaaattattccttcatagttctacagaacttcatttaagaagtacatgctatgttgcttagtatttgtttcattaattcatattttttttagtgtctaataggtgtttggttttttttttttggctgaataaaatatgtctccttacatggaaaggtttatattctagttatgattatgaatttaccactcctgcccatgcttacctcacagtaccttatacaaacagtcaggattatttagctcgaggtattttaggacaaacattctcagataatcatggttatgaaacatttagttctagaggcatacattgtcaaccgtaaggaaaataatactcattaacatttattgatattttttactgtataaagattgttccatattatctgtcattcattcttcatatctttttgaagtatataatattttgaagggtaatttgggaaaatatttcaatagttgaagctccagatggttaagtgaatcccataagatctgatagaaagacagaactgggcattgagccggcaaagtttgattctggaggtcttttctgcatataaattccatgcaataaaccattttgtaaactttaatggaagtgaaaatacaaataatgttaaataagtcagtttctccccttgaagtgacaattgtaattaatagctgtatcgggaaatgatagtgctaatttagtgatacttagaatcctctgagtgtagttccataagtgagaaaaatcaccagaatgaatacaaaagatgggtttaaatgttgctttatgaatccttatataattttcagagaataattagctattttgaggctcaggatacaaagctgattttaataatatgtgccttataaagcaattattaatacttaactagaaaaactagttggctgagtaggacttgaagtgtaaagaaggcacaggccagtttggtgaatttaattccttcaaataatagaagaatttttctgtaggaattttgaacttttgccaagacagctttttgactgtggtgaatggatacaaaaccatacaaatctgtacgttcttctcaagaataaaatagtggcaagggttggaaataggtccaagtggttaaaaggacatgatacttttgcaaaggaatagagttaactttcctgcttgcacacagacttgctgtcgactacctgtaattccatttccatgcgaaattatgatctcttctggcctctgtgcgcactcccccatatgtgtgtatacatacacacacacatatatatatgtatatatatatatgggtctcatatacatatttgtgtatatgtgtgtatatatatatatgcatatgtatacacacacacatacacatatatgtataggtggatgagactctcagttttgtggggatgagtgtgcatttctcacacataatccctaatgtttgtgaaatatatcagaatagtaaacattggggaacaggtaaaaattcaccgcagaaaagtaatttgaatgtatggtatgatattctcaagtagagacctctgcaagacaccaccagtaatttgttaacaaagttgctcaaaattcagcattaccttggattattatctggacatcgtttacaaaaaataaaaatagaggaagactttgactaaacacagatgaaaccaaggagacggcagaaataactctccctacctctctcttttcttcatgtgttcattgagcagaaaataagcatggagaaaagggggtggacagctgctgtgttcttgcttgtcagttttcagttggagagaaatgcacagagagaataccaggagaggctcatggtcccagtctgctgtcacttaatagttgtaatgtttgcctttggtaggtattttgtcatctcccttgctatcccttgtcaatttctgtgcttgtcagtatgccttctctacttcaatagttggggccccaagtgttagtgttaaagaaattagagcgtgtaacacctttgtctcttagttactgaattagcatggattcttggagcttcccagcatcagcaggcaaacaattttagtagcactctgtctttcttactgcccatcaccgaaagcttatcttgcacttctgcaattcattccctttgcgtcatttttaattagacataccactgtgtcaggaaagtaagaatatgtagggaatggaaataagtgacattacaaaaagtcccttttttttaaatatgtttttttgaacacttcgacctgtgcattctatggggctatcatcagtacccaccaatccttgtctttgcctggtctgtctactgctattaacagtttgtaaggtcctagtacattatcactcggtgcaaactatcactgagcccaatcagatagacagtaatgattttatgaaggagacatggcaaatgtcaaaggataaaactggtggtgatgataagtttttaaggttaagtaataactgagaaagaaagaatgggtaaaaacacagtttctgtcaagtggcttatgagtcaggttgatgcttgcctttgctccttagagtgactttatatatttatcattgttgtttctattgtgattactaatttatttattctaatgagttttacgtctatttttgtgtcctacttctggcattacttttgctgtgtacttctctttgcttctatttctgctcacactttttctctattctttttcatgaaacatgttttaatcttctttatcctaatcccttcataaattctgagcatccacctttataactccatgaagcagatcgattcctttactctctgagacctgagtacagacagaaatttctcaggtaaaatctccttgcaacaaaccatcagctttttttcagagcagcaaagattctcaagatcaagtatcagacttaatgagagtaaactctggagtcacaagtactggtattatatatcacactgccagttactaaacagttaatcttttctaagatgctaccttctaaatacctgtaaatatccttcagctgtaaaatcagaaaaaataatcatacgattacttcatttgccagtttgcagaagatagtatgcatacaagaaaactatgagctgtgccctaagtatgaattgattgattcttgcattctgtatttagttctgaggatattatattatttttaacatagtcatgtcatttatggtgcaatgggaatacgtacatgtatctcctaggaaggagtttccatagcacctttcacatatttctatgataattccagtgcctctttccttgataactggtcattttttttgaagttcagaaaaactcaatagaaggggaaacacccatgtgaatagagctgacctgccatagattaattgtacttcagagatgttctgccaccatggtacaggtatgagccaagacttgagagaagcatataatgataaaagtttcttacttgcctaggtaaacagggaattgttgcttgcaaaacttattgcatgctgttagcacaatctgggttaaacatttgtgttctctatagtgatgtatccattcataacaggtccatttttttaaacatcaaagcagatcgtgaagaagggaaagtttcttggcaccaatactcagatattttcagttgttgattaattatttcaaatatagtacagcttacttgtactttatgtagcagaactctaattttatttacttgtaaaggagtcagaaaaagcctggaatcttgcaagctaagaataaagttatatgtacgtacacacgtacacacacacacacacacacacacacacattttgagatagcttttaaagatattttcaaacattacaaattaaatatattcgtccatttgtccttactttaacaaaataagtgaggacaagaggaaaggaaaaagagacattttcttctgcaagacttaaattcatttttttctttaaagaagattttatatatatatatatatatacacacacacacacacatttcattccaagcacaaatcatatacagaagttaattactaattagaagggagttccataagacagtcacaaacatgcaagcatagagtcaaacagctttacatatatcagaattgtgcctgtgagacaatgtaatcaaggttttttacacttatgttccatgttcattctcaccataaaggatttcaatcacatttatcagtgtttgtttgatagtgaagccagtgctaactaaattttctgagaagtgaatgaattaactatagtactacacagacaagagcttgaattatccttatcatttaagaattacactgatgcttgaggaataatctatactatatgcaaactaaagccaattcagaaaatgttaacaaaatatttcctctcttagtagtgttctctgtctctctgcctctatctctgtctctctctgtctctcccctgggggcacagcaatgaatgaataaatgaaatattttattcgtatagcttataatcatgtaacttcgtcagtggtatagaagattactaaaacatttcaggcacctttctcttaagtgttagatgaaagagattgctcttcattataaaagctaacaattagaaatagtttgttatcactgccagaattttgatatccttacctgtattgtatccaggaatctcaatgatcaatacctgttaacagaatcatgcttaatgatagacagttattgtacttaaaatcttttacacttatggagcccctctatcttagagtgcatctcatatggatcatgaagactgaattgtctttccctaggacttaaagaaatctagaggtatttgaaaatctttcccatccaaatatgaaaagagatacataaataaaagcagatgaaacatttttaacacctaacttgctttaaagttttttttgtttgtttggttttttgtttttgttttttgttttttgtttttcgagacagggtttctctgtgtagccctggctgtcctggaactcactttgtacaccaggctggcttttcatgtaacatattttgatcatattgtttccccaacacatactacttcaatatcctttacagtgtcttaccaacccaaatttgtgttcttctgctctttccagaaaattccccctaaaacaaaaattttaaaaatgaaaatcaaaataccaataaaagacaaagaaaagaaatacttttttcttttaaaaaaaagttcacttttgtgttggcatactactctttggtttgggacacgaggcctttcttggagtatgattgatagacccatcgctactctaatgaagaattattacattgcctttctcctgtgctatcagttgcaaccatcctcttagtcaggtgtgagactttgtttccacttcccattcacagttctgcagttttattttagcctgtgcaggtcttgtgtgtggtatgctgtcacagtctctgtgagttcatctgtatattagtccagctgtggaattttttctacttttaattttgtagtttgatggtgcctggaaaagatgaaagctattcttctgattgcctaatcatactccaatatcatttatgttataagccttataactatttcatttgaaaataaagagggaccagtatgagtacaactactcaacaaatgttttaattgttgaatgcctccctgtataatggtgaaaattaaacacagtgaaaagatcataagtctcacactatgatgtatcactttttaaattaattgtggtataaagatatatgctttcctaatcaagaataacttaaggctcctgggagacacatccctagaaacaatgttccttaaggagattgtttgaggaattttcctgactctgaattttgaactgcaggtggccctcttgatctttcagcttagatcttatgtttttttggacttcctttctgtccatatcaaagtacttagggaaatacttttacccagattcttaaatttcctactaaaactcctcattactttattattagtttataggcaccatgcctttgtttcctcacatgtacaagattttgaaaatattgcttaatcaacatttagaatgcctatgatgtccttctgcagcaggagtccctaagagcaaattgtattgttggtaatgcttctaaaagattatcccagtgctttgtatgttgaattctatgtaatgtatatcttgtatatattgtttttgttcttttatattcttttttaaatattatttcatttatttgcatttcaaatgttgcccccattcctggtcctctctctaaaagttctttaccacatccctccacccctttgcctctgagtatgtgctcaaccagctatgtcctcacccatccccactcaccccctccatatctctttcctaggctatcacatctctacaggattaggtgcatcctctcccactgaggccagacaaggatagtcctctgctatatatgtgccagcagccaaggaccagcccatgtatatattcttaaagtactgctattttatcccatgatttatttttggaaatccatgatagtatgaggcttttaggattatcaaaataaattaccatgaatattaattgataaagcttcaagtgttgttattcaactccatcttaataccttctcaaagtaattttacaggaatatcctagttctattaatgttaagaatcttaaactttttggaaaattgtgggcagaattaaattagagtaacatgatatttaatgtgaatcctgaacgcataccaataatagtattaaattaaatttttagaagttgaaaaattagaattttcccttttgaagtaactaaagtatatgcatttgctacttttgaaaatattatatttacataaactacaaaggacaagggatagtgtgcaaaatagattgtgcttcttagtgcttttctgtggaaaacatatgtgcccatagccggaacgtttcagcctaagatgttcatcaattaatgaaattataactggaaaataaaatataaccgcaattattgacatgttccttgtaaatattttgtagtcccactctaacaggcacagatacaaactgaccttaaaaatgtcacatgtagcattgtggctgctggactattgtctaggagagacacagaggaggcctcccagggtttatttgtatgtgccttttgtgtaaagtttttgtctagacagttactgtgccaagagtagctatttgatagcacctgcttctggtgtggaaaacagagtcttttatttagagaacatcagtagccatttcattcatcaatggtcaatgcacctacataaagatgaacataccaatgattccaaaagaaagcagatctttcaacatcaggggcacatgtaaacattgtatctacctatgcatccttctgttttactttacatgcaatcacatcctattttttttgaagggggaaataattaattcagaacaatcatagaaaaaaatcccaaacttcactttttaatttaaaaccctgcaatttgtgaaatgctgtggtaatgttatacataagcttgctcatttgcattaatattactttaatcttcttaaggtattagaaaaagtaattgcattatagaagtaatgatgtcaaagtagctatagaatactttttaaaatgtgggattattttcaatgttttattgttcttccatctaaatgatttggggggagtaataatttttttcatggttagccattttcaatgtgatgatttctactaccttttttacttactagttctgtcactgactccatctgtttcccctatcagtttctttttctactgaagctagcgtttttgttttgttttgcaaagattgatccaaggccacatacatgctaggcaagtgctattccattgaacacaccttaccccttgctccctgtcactcatctcttcttattcttagcctttagactgtgtggtgcaaaacctgtgaatacattgaaattttcttgctttcttttttctcttttaaaggaactttcacctatctgctgctcttatcatcatgtaaccttaatccattgccctgatgaatcacagattatttattttttcaacattaatctcttgtggacttttcatacacataaggctatatatttttttcccatttttttatagattctttacaaaagagtgtgttcgtcaggtatatgttacattatatattatactatcacagtattgcaatatataccacatgtacatacttatgctttttcttattgcatatagctaataatagctattatgtggaaggttttgtctagactcttgtccctaattttaagctgattccttctttatgtcttttatttatgttgtgttacatttgaaacccagtaattcaagtttcaaactgaccaaaaacttccatttagagagtatattctgaaatccctctccttttttttttaaactttgtattattctgggtgtgtatatatgtgtatgctggatattcagtttggaacttaatgtatagtagcaagttgtttagtatagatttataattaaaacattacagtatttctcctttatttaagagagtcatacacctacattggttatttcatgtttctcacaaatacttctgcttttccatttatacccctgtgatagttaacagattattaactgaaccttggtctattcaaagagcaggactgtaaataagacactgtcataccattattgaacatgtacaaaccattgtagcctagagttaccagagaatccaagagctatattttgaaagtcttaaacatactgttatacaactacaaatattccacacaatgcactacaataacaggtcacaatgtgctattaaatttctgtgagcatatttgttcttcacatatacttacatgtctataaatcccctagatttgatatcaaatccatgtcaagaaatcaatatgtgagatttttatttgtaagattaaatacagttaaaaatcacttaaagttttaaacattaaaaaaagaaaaaacatctgtacttttgaaatgtattcatttccaaagcaagataatgacattggacaccagaaagaatagatagttatagtagaatgctagtgaatgtctctctaaagttcatctacattcctgttctatgtttaccttatgttttctttttattctattcctattttttctgtaaaataataaatagtgtattatataaattcagttagaaaacatacattatttaaaatatctgcttaagtaaaacaacacaacttctgccaggagtctggttcgaacaccagatatctgggtaccttccctgcaagaagagagctttcctgcagagaatactctacccactgaaaccaaggagagtgctaccctcccaggtctgcttatagaggctaacagagtcacctgaagtacaagctcttaacagagacaactataacagctagcttcagagattaccagatggcgaaaggcaaacgtaagaatcctactaacagaaatcaagaccactcaccatcatcagaacgcagcactcccaccccacctagtcctgggcaccccaacacaaccgaaaatctagacccacactaaaaaacatttttcatgatgatgatagaggacatcaagaaggactttcataagtcacttaaagaattacaggagagcactgctaaagagttacaggcccttaaagaaaagcaggaaaacacagccaaacaggtagaagtccttaaagaaaaacaggaaaacacatccaaacaagtaatggaaatgaacaaaaccatattagaactaaaaagggaagtagacacagtaaagaaaacccaaagctaggcaatgctggagatagaaaccctaggaaagagatctggaaccatagatgcgagcatcagcaacagaatacaagaaatggaagagagaatctcaggtgcagaagattccatagagaacatcgacacaacagtcaaagaaaatacaaaatgcaaaaggatcctaactcaaaacatccaggaaatccaggacataatgagaagaccaaacctacggataataggaattgatgagaatgaagattttcaacttaaagggccagctaatatcttcaacaaaataattgaagaaaacttcccaaacataaagaaagagatgcccatgatcatacaagaagcctacagaactccaaatagactggaccagaaaagaaattcctcccgacacataataatcacataataatcagaacaacaaatgcactaaataaagatagaatattaaaagcagtaagggagaaaggtcaagtaacatataaaggaaggcctatcagaattacaccagacttttcaacagagactatgaaagccagaagagcctggacagatgttatacagacactaagagaacacaaatgccagcccaggctactatacccggccaaactctcaattaccatagatggagaaaccaaagtattccacgacaaaaccaaattcacacaatatctttccacgaatccagcccttcaaaggataataatagaaaagaagcaatacaaggacggaaatcacgccctagaacaaacaagaaagtaatccctcaacaaaccaaaaagaagacagccacaagaacagaatgccaactctaacaacaaaaataaaaggaagcaacaattacttttccttaatatctcttaatattaatggactcaattccccaataaaaagacatagactaacagactggctacacaaacaggacccaacattctgctgcttacaggaaacccatctcagggaaaaagacagacactacctcagagtgaaaggctggaaaacaattttccaagcaaatggtctgaagaaacaagctggagtagccattctaatatcggataaaatcgacttccaacccaaagttatcaaaaaggacaaggaggaacacttcatactcatcaaagataaaatcctccaagaggaactctcaattctgaatatctacgctccaaatgcaagggcagccacattcattaaagacattttagtaaagctcaaagcacacattgcacctcacacaataatagtgggagacttcaacacaccactttcatgaagggacagatcgtggaaacagaaactaaacagggacacagtgaaactaacagaagttatgaaacaaatggacctaacagatatctacagaacattttatcctaaaacaaaaggatcaacattgtaaaaatggctatcttgccaaaagcaatctacagattcaatgcaatccccatcaaaattccaactcaattcttcaacgaattagaaggagcaatttgcaaattcatctggaataacaaaaaacctaggatagcaaaaagtcttctcaaggataaaagaacctctgctggaatcaccatgcctgacctaaagctttactacagagcaattgtgataaaaactgcatggtactggtatagagacagacaagtagaccaatggaatagaatttaagacccagaaatgaacccacacacctatggtcacttgatcttcgacaagggagctcaaaccatccagtggaagaaagacagcattttcaacaattggtgctggcacaactggttgttatcatgtagaagaatgcgaattgatccatacttatctccttgtactaaggtcaaatctaagtggatcaaagaacttcacataaaaccagagacactgaaacttatagaggagaaagtggggaaaagccttgaagatatgggcacaggggaaaaattcctgaacagaacagcaatggcatgtgctgtaagatggagaattgacaaatgggacctaatgaaactccaaagtttctgcaaggcaaaagacaccgtcaataagacaaaaagaccaccaacagattgggaaaggatctttacctatcctaaatcagatagggggctaatatccaacatatataaagaactcaagaaggtggacttcagaaaatcgaacaaccccattaaaaaatggggctcagaactgaacaaagaattctcacctgaggaataccgaatggcagagaagcacctgaaaaaatgttcaacatccttaatcatcagggaaatgcaaatcaaaacaaccctgagattccacctcacaccagtcagaatggctaagatcaaaaattcaggtgacagcagatgctggtgaggatgtggagaaagaggaacactcctccattgttggtgggattgcaggcttgtacaaccactctggaaatcagtctggcggttcctcagaaaattggacatagtactaccggaggatccagcaatacctctcctcggcatttatccagaagatgccccaactggtaagaaggacacatgctccactatgttcatagcagccttatttataatagccagaagctggaaagaacccagatgcccctcaacagaggaatggatacagaaaatgtagtacatctacacaatggagtactactcagctattaaaaagaatgaatttatgaaattcctagccaaatggatggacctggagggcattatcctgagtgaggtaacacattcacaaaggaactcacacaatatgtactcactgataagtggatattagccccaaacctaggattcccaagatataaggtacaatttgctaaacacatgaaactcaagaagaatgaagactgaagtatggacactatgcccctccttagaattgggaacaaaacacccatggaaggagttacagagacaaagtttggagctgagatgaaaggatggaccatgtagagactgccatatgcagggatccatcccataatcagcctccaaacgctgacaccattgcataccctagcaagattttattgaaaggacccagatgtagctatctcttctgagactatgccggggcctagcaaacacagaagtggatgctcacagtcagctaatggatttatcacagggctcccaatggaggagctagagaaagaacccaaggagctaaagggatctgcaaccctataggtggaacaacattatgaactaaccagtaccccggagctcttgactctagctgcatatgtatcaaaagatggcctaatcggccatcactggaaagagaggcccattggacatgtaaactttgtatgccccagtacaggggaacgccagggccaaaaagggggagtgggtgtgtaggggagtgggggtgggtgggtatgggggacttttggtatagcattggaaatgtaaatgagctaaatacctaataaaaaatgggaaaaaaaaagaaaacagcaaaaaaaaaaaaaaaaagaaaaaacatctgtacttttgaaatgtattcatttccaaagcaagataatgacattggacaccagaaagaatagatagttatagtagaatgctagtgaatgtctctctaaagttcatctacatttctgttctatgtttaccttatgttttctttttattctattcctattttttctgtaaaataataaatagtgtattatataaattcagttagaaaacatacattatttaaaatatctgcttaagtaaaacaaatcaatggagaatgtcttactgtaacgatgtctataagtatcatttcttcaaggatatttggagcaaaggattaaaaaatgagtcattgttataaggtttgacttcccttgtggtcacattatcatgtttatttgtatatttttgtttgcttgcttgcctttgaagacaggatctcactatgtagccctcactgacctaaatcttattataaaaattagactggcctcaaactcaaagagatatacctgcctttgcagttataagcattatttttataagttgttagtgaatcaaaaacttactttcaagctctttactcataaatgtgattatatttatgtcttaataattctaaattaatgaatacatactgagttttaaaaggctactatgaacacacacatatctacagaagtgttttatttttttcttttattatttaaatcttcccagtaatcagtaggatagggagctgtgtcttatctgtgaatataatataatgaatatatgacttcagtgttatttgatatttttttacatatttctactttgtgttattagattattattatcattgtttttttttaaaacataggttgattatttttattgtgtttatttctttgtgatactactttagaatttcaactcagtaatgaaaaatatatttgtagtgataaaaataaaaacataaaaaagtacagatattttctgatactacattgtcttagtttatacaaaaattaacatgattaaaaaagtgattgataagtactgtaagaaatttttgtaatttgctttcattcttatgtatgtagatgatataataattttaaatattttctgagtacaaacaagtatgattagattaggcttaaaaatagtgtatatggtaaagacagccttttggcctttttgatagcctaaacttccaaaaataggaaagtgaaaatcagtgtgcaatttttcaggtctgtaaaatatcttaccttgagattgtatagaactggtttgagtgaaaagttaaaacttcatcctccagcaatgttctttcattacattagactagggggaaaaaaaaagaagttaaactaccttgtaatgatttaaaaaataatacacactcaagatctttgcacaactgtgctattttaatataacctttttctattatataaaaacaaaacaaaaaaaaaaaaacaaaataccgggcaaccaactaaccaacccaaactagattcagaccaatatacttcaagcaggaatatattacaattgtaatctccttcaaactttccgcaacttaaattttaaaaagtgtttgtgtttgtgtgtgtctgtgtgtgtgtgtgtgtgtgtgtgtgtgtgttggatgcagtaatctacgaaaagtctctatataacggtgaacatgatatttttctagacagtgttggtctcagaggtccccattaaaaagaatacgtattgctacttctcaaatcttgtcagatactgggtatattacctgcatgcacaatggaggcattgaggataccagtctacctttatgataaccttgttgatacacttacagaacatattgactgttgtatgcattattttagtgctaccagagctttgctgagaagcctttgtaagaaatacacagaggaagaaatcacaggccttggattctgaaatgtctaattcagtcacagtgatacagtgttcaaatgaactatagcagatttaatgagcaatctaggacagagacacatgtactggacacaccagggaaggagattacatgtgcagggactaattagcatgaaatatgaaaacattcatataagttgtcttgatctatgggagtcttttattattgggaatgacttttgcatgaagttaatgaagagaaattcaagctgtataaagaattttaaaatagtatttttaactttttgaatctgtaaatatctacattcaaaaaagttgtagattataaaatgggatgatcaaattaatattggcctattacctacaattgaaatattttaaggaagagaacagaaactgtcctcagatacctagtcagctaatttacaaggactcagaccttggtctcttattaggtaaacattaaatattaagtattgtcttatatcttatataaggaaacttggggataatgtattccaccattagaggcacatttctttaatttagctgtttgcagattgtatatatctttagcaaatatacttgtatgtagattgatatttcaaatttgacttttttcaaaattgtattaattaatttattttaatttatttaatttatttttttactctccaaattttattccccccaccccatatccaccctctgactattccccatccatatctcctctctaccccttctccacatggatgtcagcaccccacctgacctctaaaccccctggggcctccagtctcttgagtgttaggcacaccatctctgaatgaatacagacccagtagtcctctgctgtatatgtgttggtggcctcatatcagctggtgtatgctgcctctttggtgttccagtgtttgagagctcttggagttcagattaattgagactgccagtcctcctacagggttgccctcctcctcagtttctttcagtctctccctaattcaacatcagggatcagcaacttctgtccagtggttggatgcaactatctgcctctgactcttttagctgcttgttgggtcttctggaacgtggtcatgctaagtccctttttgtgagtgttccatagcctcagtaatagtgtcaggccttggggcctcctcttgagctggatcccactttgtgcctgtcactggctcctctctatttccatccctgtaattcttccagacaggaacaattatgggtcagagttgtgtctgtaggatgggaaccccatccctcacttgatgtcctgtcttcctgaaaattataaacactattattataatactttatattagtaatggtgaatattaggcaattagggataattcttttccccttaattttgtgtttaaaactttacatggagatttggaaacataaacgttaaattttataagtctatttttaattggatattttctttatttacattgcaaatgttataccctttcccagttttccccctcccagaaaccccatatcacatcactcctccccctgattctatgaaggtgttttctgccctaacattctcctacattaggacatcaagccttcacaggaccaagagcctacctcccattgatgccaaataatgccatcctctgctacatatggaacaggagccatgggtactctttgatttgtggtttaggccctgggagctttggagggtctggttggttgatattattgtacttcctaggggtatatatactttttttgtttcaagtgatatcattttcgtatatatctaaaggtcttcttatatatttatattaaaccccttactacctaagatattgtttattaatttggttttaaggtattataatatataccattgattttgttgagatagtaatggttgttttttatattcaactgatggaattatataaacaaggatcccttttcataactgacaagttatactttagctacattagcaactgagtggcatataataactgtaatatagacaggctcaagagaaattatccaagttgtgctattcattatccctggcttccattcaaatggagttggatgtgttattttcatattctccatcttgagtctccatctgtgacagtcccttggcagaatttcaaactactcctaatttttaactttgtggttggtactgagccagttttccatgctttgggaaggaggtccccatttatgcacatttagtactgtgaggccctcgtgattgtagagataccagcaactatgttggaaagtcaaattaatgggttcatagctgagtcttgaaactgaagcatatcaaattgtaagtggccctgaaagttcatggtctaaaattctcactgattacatgagagagatctagaaacattgtttttccttactttctcatgcacacctttactgaggaatggagatcttggtaattccttggtaaacataattcattagagagcagtataatagaggttaagtgtagacttttttctatttttactaatttattataatgtatattttagttttccttccctcttgtcttcctagcttctatcccataactcttccctgccaatccactcctcctaaatttcccatcagaaaagggcaagtctcccattgatatcaatcaaatgtggcatatcaagttacagtatgtctaggcatctcttcctcatataaagactggaggaggtgacctggtcagaggaataggtcccaaaagcaaaagttcctctgatctctctgttaggaatccaacaaaaacaccaagttactcaatgtaacaggtatgcagagggcctcatttagacccatgcaggctctgtgattgtcagtttcatctccgtgagcttctatgactccaggtttgttgattctgtgggttttcttatagtgtcattgacccttcaaacatgtaatgctgtattgaataatttagttgtgattttatatttaccattactaaattttaacaatgccatttaggaaattataattatgtgtgtgtgcgcatgcgcatgtactcatgcatgatcattttggaatgtttatactcttattcagactgaggcactattattgaaaacatttattaaacacatttacatttttattcacatggtgagataaaagaaagtgcttttcacaatttatataacttaacaaagcatatctcagttaatttcgtttgttatatcacttatcaagtctacaacggttttgtgtggccatcacttctaagcttggtgagttgatggctagaaataaattgaaccttctgatgaaatatataagttctcttctgaccaaatagggctgtagttcataccatcagatgtcagaacactgagtaagaattcctcttagtagtttatcttgtctggggatgtgaggcctatggttgcatccaatatgttttaaatttcatgtatttcttagctttattagcctatatgttaagtattttcaatttaatttgtagactgatatgttttatatatgttgctgtaggcacatatgaactgctgcattttagaaattgaaacaataataccattgttggctttatttgtctctgcatgtcttcatttggtgatatgcttttgtttatgaatgttaataatgttttatctttacactttcattgctttacaaaaataattttgagaattttttaaccgatgccatggaaaacttatcattctatttttaaatatttttcatttttatagatagtcatgtcttacagaaaacattctgttcttgcaagcttctcctagtcttctaaagaacctagtggggctagagagatggctcagtggttaagagctccgactgttcttccagaggtcctgagttcaaatcccagcaaccacatggtggctcacaaccatctgtaattaaagcagatgccctcttctggggctgtctgaagacagctacagtgtacttacatatatttaacaaataaatttttaaaaaaaagaacctggggtttgttgctgacatctgagtcaggatgctcacaaccacttgtaagtacagctcttgggttctggtgcactcttctggcctctgaaaacacacccacactgcctcatacacataaacacaataaaacaagaattaatactagcaaactgccacaatgtgcatgtactcttcttttccagaccagggttatatattgatagtgtattgagtggaggaccttaaacatgctatagaaatgagctactgagcctgtttccttctcagcaaaatctcgaacatcatttgtaacattttgcattaaaatggaagatttgtattagattgtgaacaatgttgagacattattattgtttatacttcatcctaagttaattatatatgtgtgtggcttttaagaaattcatattgtcttctctatttgttactacttataaattattttatgattgatgacatctaagcctgttttggctcattcattcattcattcattcattcatacattcatatacctttttccactgtattcattgagaacttcccatggtaacacatttaaagaacagatgataaagaaagttgacagtatacacatatacagtgctaaaattgcataaagagtgagaaaaggctttacatggttgggtgattttttggcagaatgagggtgtttttgcttgtaaagtgttcacttcagattaaatgtgactgtcatgttccaattatgtttcagatacttaattgtagagaagtggattgccattttcttttttgatgaggttttccttttataatcccaattataagttgatagttagattctgaacatcgtttttctcagaaataattattgttgattctgaaaaacaaagtaagttaataggaaatttcgttcactttattgttgaattttgctaaaatatgtattgattagtgaggaatgactataatgcttttaggatttttacccacatcaaacatactccttgtctatgaaaataaatcataataaattccagcataaatgaacagaagtgagtttgtagtggacaagtatatttctaaagttggaattcacgatagttgattaaaataaaaatgaatgtattttatattattattttatataggatagacatgcatttgtttgtgcattacaagaacatcacaaatatgcaaaatacagaatcagtctcttagtaggtagttaaatggataaacaaaatgtgatacactttcgcatgcatagtcagctataaaagaagagggtctattattccatcaacactgaagaaactggacaacttaatgctaagtgaggcttgtcagatacagaaattcaaatacctcatgtttttactaaaaagctaatctttaatagaaaattgaatagaatagttgtgagatactggaagggctgtaggcagaggagatgaggaggttttgtcagtctgtccatttgttgaatatgaaatgtaatatccaacattcagcaacacagtaggaaatttttgcttcatagcaattaattgaatatatccaaataacttatgggggtgtatattaatcattttttcatcttatggcatgtatcaaaacaatgaaacctgacatattcatttctcaatatatgcatacttaaaaataccatacaattgctatatggaaataccaaactgtatttcttgtaaatatataattactatggctagctaattcatattctctctctctctctctctctctcccccccccccctctccctctctcaacttcatctattatgtaaacaaaactatggaaaatttcagtattaaaaaacaagtttttaagtcttagattttaaagttgtattcatctggcaatatatacagtttaaatagatgacaatttcatttacttatttaagtatttaaagatgtaagttgttttattaacttttgggtcagctccacacgtgtataaaagctgaccctgtccgctaacacccttttctttttctcctatctttattgaccacacactcaccacttccttgggttcatatatatgtcccttgttaaattaaatggtgaacaaaaccatttatttttatatagggtacaagtctgcagaattacgtgaatatcatcatttacaaaattcttttgaccatactcaaggccctgcatctcagaaaagtttacagattccaactgttcacattaatgtggctggagttgatagttttccgggaatgccgtattgtgaatgtgaggaagcttcctcggctttagcttttcaatgttagagtccttgtgttcaattattttccacaaaaggctctgaatcttgcattcctttgctatgcttgtcttgcagagtactactgatgcctttgctacttagctcagagtgctttcgatatcctgtgtttaaatagagcttagcagaacgacttttataaattttcatggtttttttatgtgtatatttaaggctgagggcttggccattcttacaaacatgcatgcaaagacatgtgtgagtcaaatggcagaaacaagaacttttatatataaattaaaataggaatattgcatcttttctggctggcagttttaatagtgcatttctgaaattagttgaaagtactgtatttacctttttaaatatttacaaagtataacaataccactaattcaatagagatatttttaaaaggaaaaccatctttctatcttctaagcagagacttcctctaatttgcatttagagagctctaaattaaaatgctaaaaggaaagcaacgaattccagccactgctgctggtactgtaaataagactgaattacttgatataattttaaatgaatactcttgatattgagacatcatgttctcacatcatgcaatggtaattcacagaataatagaaacgtttctttggacatactttttacccctattaagatatgagtttctttcttctagatcatcaaattcaattttgtcatctctatacagaaatagatgggtataaagagaagtcactgaatggtttgcctatattaatgttattttatttgtgaatcattgtaactgagtttcagtatacaacagaaattatatactagtgctttgtttttagaaacacttgctacagagtaggaaattgtgacatttcattccaaaatatggaatatctttgaagatttttacattcaaattcctcatacgattttgagatagcattggaaatgtaaatgaaataaatacccaataaaaaaagaaaaaaagtacattaaaataaaaagccaatataccaaaaaaaaaaaaatccccatatgagcaagtaggttctcagcaggttttaaattttcttttatcatctgtgtttttcatcaactacatttctttttaacttcagtatctttttagttctcaaatccaaatcatataatgcacaaaaaaagatatttctcataattcgatcagaaatctacaagccaaagtccaagaacgccatcatcaacaaactatcctgtatctgtttctatattatttcttgttataaatgatagtattttcacctacagaaggctgttcatttgtttctctggttcatgtctaccactaaattatctctgttccccattacataggatttaatttgtcatcataactggatcattttaagcaacatattctatgtctcattatatactctcttgatataaggaaccttaaagtcctgttattattctccatttatgtttctcggagaattgaatcctttggacagacacaagtgtcaatgtattgattgctcttccattccatcttctctatttagttcactgtatttaagctttgttctccattgttgcactcttgaatacaacaacatagagccataccaatttaaggcttttcaatttttgctttacaatttttatttgaccttctcattagcatctgattcacttgattctggtttcaactgaagttttagtgcaggcttccatagttctcttattctctgggtttcctctatcttcacttgtacattcatcctccacttgctgttttcacagttatggctgttcggtaagtgggccactgagtaggatgtgtagtgaaggggataaagaaacaaatacagatgacttcaatttccttcaccttgttcaaagtgttaacatttattgaaaatggagaagaaactgttaagaaatgaacagatcattcttctcttttattaattggtgatcattatgtttttttatttatttaattatttaattatttatactctagattttattccccacagaacccctggtccacccacgacttccacatcccatacctcttcccttcctgctgtctccacatggaagcctgcatcccggaccccacctgacttctaaacatcctggggcctccagtctcttgagagttaggtgcatcttctctgactgaatcctgacccagcaatcctctgctgaatatgtgttgttggcctcatatcagctggtatatgcttcccggttggtggttcagtgtctgagagatctcaagaggtccaggttaggtgaggcttctgatgctctgacagagttgttcttctcagcttcttccagtttttccctaattcaacctcctaggccagcagcttctctccattgattgggtgcaaatgtctgcatctgactctataagcttctagctgggtctttcagaggtcagtcatgatagggccctttttgtgatcaatgttagacagacaccatagtgaagctactaggaaactaatatcaagttgtaagaattaaattggctttattaccgaccattggcaaaaggatgccacataaaatgtgtctgtatgaattcaccctgtacaatattttgcatggagaggaaatggaagtatagaataaagatcctggagccttctgccaattagagacaatgaagatgcagagaatatctgtagatatcctaagcacaatcaatttatctctaatgaatcctttacatgcaaagctgagagaacatcaaagaagattgggtagaaaagagggtaagacctggaggaccagaatgcgacctgctacataagggaaaataatcatgtgaaatgtcaacactgttcttgcttcaccaagactagcataataacaccaccaattgacattccaatttggatggaaaaaattccacatcgtcctacccctagatgaagtaggagaagtggttgatacctgctgagagagggagaaccatcttcctgccagaatgagtacccacaagtttgtgcaatctcaggtgatcattacctggacatatgtatatataagtaatgctcggtacattgtttataggtgtgtgtgtgtgtgtgtgtgtgtgtgtgtgtgtgtgtgtgtgtatacacatggatgtcatacacacagttatatatacacatgtaataataaatcagaagtcataaatttcagatagaaaggaaacgtggaggagttggaggagttggtgaagttgtgggagtgttagagatatacataatcatgtatgtagctagttctctaaaaagaaaagtatggatatcaagtacagaaaatttaggaagctatagctacaaaaataagggtagtgttgtcccatatcccataaaaccagaataatatattccaagaaaattgatttacccttatgaataaaatgctactgaatagttaggtgaggatatggcaaaacatccatgctattgacaaaatattgagatcgctgatgattttaagaagatcagagttagatggttagtaactgtgaaataaattgtatgtgaattaaggtgttattttaagaaaaggacaaaaattgagtggagaacggatggagagttttttgtctatgttctataaagtcatagggaaagattgaatcagctgcttagttcttcgggaaatgaagacatctgtcattaaaatggataagtggattcaggtgaattatgctatcctacattgattacttcacaagaaattgtgaaaatttaacaattgatacccagttaccatataaacaaatgagtgattaaacatcacttaatttttttctagaaatagggcaagggcgatgattttctttgtacttatctaattcgtgtggtatatttaattaagacatgttaagtgataagaaaataatggttaactacaataataatatattttctagctcaataaattggatttacacactaccccttacataataaccatattatatgacatataattgcatgttgtctataatacacattttaatcaaatgatagtgataatttttaggagataaaatgctttttctgttttgttttgtaggtatagtacataaagtatttacttgaaacatttcaaactgatttaaattaaccaagtattgtcttttggcatatagcaaactctggaaaggtgtcctggtctgttagttttgatttttcttgactgagtaacctctgttttataaatttaaactgatgtatcagataattttagatggatcttgactttgttttgtgatttcaagaaaatgaaatttgaagcatttttagggaacttgtatcctagcttttcattcacatgaatcaaaatatggtgacattttatacatacacacacacacacacacacacacacacacacacagatacacacacacacacacacacacacactaaacaacttgcttatgttttgatttatagataatttcaaatataagactagaaaaaatataagcaatgaaaacaacactagcatatgctatgtctttaccaaagtcacatataattcaattattccttttcccttggtcttcaggttcccctattctatatctttcctttttagttttttttccacaactccagttcctcttcaaactcctttactgtgaaattatccctattccaatagcttatcttttctagtgttgtattttttaagaaatatttgtgggcgtggtggaacttgtgaatctagctgtatatgtagcagaggatggcctagtcggtcatcaatgagaggagaggcccttggtcctgcgaaggttctataccctagtatagggaaatgccaggaccaggaatgggagttgctgggttggggagcagggggagagggtagcgggagtggataggggatttttggaggggaagccaggaaagggcacaacatttgaaatgtaagtaaatatataattaaaaaagggaaaaaaaacatgttcataaaaaagaaaaaatagttggtactgtactcatatctgccaacactgtaggttggtcctgtaggttggtcattttgtttgtctgcctatctgcctattctctctctctctctctctctctatatatatatatatatatatatatatatatagagagagagagaacttttcattgcatattacccatgtctctggtccagatgtaggtaatagaaaacttagtatatatatataaagtctagtatcaccagtgtggttgtgtaaatttttgtgaattttccgattttattattcatcgttattattcaatattaaaataatcttttgaaaatattttattttatttatgtgtaaggactggtaaatatacacatatccttccagcgtctacagagtttagatatgtggagtcccctgcaagtagatttatacatggttgtgagtcaccactcttgccttctagtaattgaattctggtcctataaaagggtagttctcgctgggtgtggtggcatacggctttaatcccaacacttgggaggcagaggcaggcgaatttctgagtttgaggccagcctggtctacagagtgaattccaggagagccagggctacacagagaaaccctgtctcaaaaaacaaacaaaaacaacgacaacaacaacaaaaaaggttagttctcagatttgatcattgagccatcgttccatcacataatatcttggtgttttgtttacttccagatttttcaggaacaatcactttatgctatccttgaaacatcccactatttttagaactactgcattactttatagcactacaaatgcattttaatttaatcttatagacacattgggtaatatcaaaattagtgttgtctttgaagaactaggttcctattcatggggcagtgtttgtgaatctgctatttataataataggtagatgattctaacttttataatgcaagaaatcactatttacttttaaattaaaagattataaaacataaaaatttacctgagaataattttctcatttagtacatattaggagcttttcgttgtatattacccatgtctctggtccagatgtaggtaatagaaaacatatatatatatatatatatatatatatatatatatatatatatatatacttttataatatgtataatttataaaacttagaattctatatataatttataaaatgatatatattatttataatatatatcattttagaaatatcaaatacttgtaccaaaatatgaaaaactgctgattaaacattaaaactgccttttaaacattatccattatgttaatatataactgacttacttcattaactgaaataaataagaattgaaaatattaaaaagaattagataaagagttttagtgaggacgctggatctttatgtacttggtcactttatagctattcaaaaaactaattcatcagagagaacaataagtagtcagatatcttatattactttgtttaatttttttattctcaacattaacatcttcagaattttatagcatttcttctaagttgtgattctatatttttgtaagtagtttgtaattgagaaataccatttgctcaaacaaatttacacatgttcagtgaattcattattctgctttatttttctgaagttgtttgcatttattttccttcctgatcctctcataagtatgataactgatcttaatgcaaataggcataaggtgatccacagcaacaaatatgaagttcacattctttctatatgataagagctagtaattgagcacgttgaatatgaaaagcactgcacagagagttctctggctcttatgttcattagaattgctgctatttccactgaagttcatggtacagtccatgccctttctttcctaactgcattagattagcttgccaggttacattattcattaggttgctaagacttgaggcctgagcttgaacttcatagcatgatagtgtttgatgtttttattctgttatcagtgctttatctgttaaggaaaacaagtatacttttaatttgttttttcctagatctattcagtacagatttctcctttgttaatcatttatttttctgaagtgtacattgaaaataatggtgtttttttcccttcattgtgatagtgatttttaaatgcttgctgtttgaaacattttcctggaatatccaaactcagtgtgtcttagttcaatacttcttttcaactcatcctttccctttattgccataattttgaaatgtcttttctttttattcatgcatgtttaatgagtgattacatattctcacttgtcttcttcaacaacaatagcaaaattggagagtatgttcaaggaattttatttggaagtgaccaatctacttgacctcaagtactcacaaataattgaaacaaatctatttttgttcagctatttgaatatttaaaaccatctcaagaaaggaaataatcttaccactaacaatgaaattggactcatcattggagtttatgaaaatgtgttggaaattcacttagcttaagggtacaaatgaactttgttatgctctttgaatgttacattgaactagttcattgcctgaggatcctatttattatgtctgtctgatttaggagttttggtccttctttgtcctttgatttgtcttatctttgtaaagcctatcatttctttgtagcttatttgttatggtgccatggaatacctgtacattaagtatcattagataaattcttttttgaattccaagttaataatctaggatacggtgatatatatttgcagtcaaatggaattaaaaagataacatgattattaggtttgtaaaattattttcttgagagcatccgttttagactatggtatcaggaccctgagagcacttgtgcaagtctatatacggctgtgtatttgaaattcagcagcctttccagccaataatgtcagtagttataccttcttaagaaagtatttttaatctagtcttatgtaatgtgtagaaaaatgtgaatataacaagtcttttgttaattttttaaatcaactgaaggcttgaattttctatagaaaatcattttccctttctgactctttcatattcaggtgatattaaacactgattaaaatattgagattttaattcttaattatataatctccctggccagagttgttaaatcttgtgattcaggtagcatagaaattcagtgtaggcatcttttttatgaacaaagctgtacgatttacattgtttccaggtggttctgggaataagtgactagatcatgcagctgatggcttgatgagtttgaaggctgatgtttataacagatgcttccaaaatgtggattatgaagtatttttaaaggatttgtacatagagataacttctggtttatacttttggcagtatatatttcttgctgtcttgcttttgtctccttttcatttttatttccttcccttatccttttccttctttcccttttcttttccttcttaatctatctaatggctcatggactttaacttttaaattgtatttccattccttaaatatagccagacagatttgtaaggctaattgatattactattattatttcaagaagataatgtaaaattgcagccatgtgtacgtgttagaatcatataggtggaatgtaatggtaacattgcatataatctaatgatgctgcctggaaaacatacactggagtcagtctgatttttataaaattccctttcaaatcgccagttttttttttatattgggaatgtaaatgctatttcagtttatacgttctagataatgcttataaatataataacctatagaatcaaaattatatatcgtattatataaaagattccctttaattgaacaatttttattaattttgaggttataacattcctctcttttttcccttctcaacctcctgtatactcctcttattctcatgcaaattcctgtatcataaaaattacttttatatgcccaataaggtcttcaaagacatttttgttacatgtagactctttttacatccattttccctcttcttgtgttctgacattctaaaatgtggactgttcaaaaattattctttctcactctcagttccatttctttttttcttattttcttattttaaaattaggtatttatttcatttacatttccaattctatcccagaagttccccacacgctcccccacccactcccccctaagttccatttcttataactgctgtcatgatctgtcaatggtatacactgcgtaattcctttacctttatctctcaatcaatgagctaatattccccccctctggggaatgttagttatcagttttatttaacgtatacacacacacacacacacacacacacacacacacacacacacacaggcactcccacatataggcacacacagaaaacacacttgcacccattttcgtgtaaagtttttgttaatatgaagtaattttacttggctctgttacataatcacacaaagcaaaataaatgtttatattaacatgtgctaaagtcttactccattttatttctttaaagtccgtgaacattcatgtttcttatttgtttttagtacccgtagatattttaagtttttcctgagggttatcttcagaaaagatttatggttgcatttgctaagatttccccaacctgacttggtgctatgctttttgattttacttctcttttattcttatgaacatctgtgattttaggttgtacaaacattggtgttttacttgtcaattctcagggaagatttttttcctcttccactccacaccaaacactcatatgggcagttttcctttcatgcccccagagaaaggagcaaattcatatccaatttgctgctgttaaactgagataatagtccagggtgttttccagaccattttctttttctttttccaccctaatcaggcccataccttggtttctatgtcccatattgaatctttgcaaaatgaagctttagctaatcttcactcaaggtcaaaattcttgcttctgaactttatctgcctcagaacaggggaacgccagggccaagaagtgggagtgggtgggtgggtgggggagcatctggcagacttttgggatagcattggaaatgtaaatgaaataaatacccaatttaaaaaatccagtaaatatggagccaacaataacaacaacaaaaattcctgcttctgctgtttatccttctctctttgctttaccctgcttttcggcatctaggtattgcttttttgtaaatattgtttatgttatattattttcaaatatccataatagttaattcttttcaggaaaagcttattatctcaagatatgtattcttgaccatactttcagaaacagaacttcaaggaagaacttttacattaaaatttgatgtccaacttattttattattattttatagctttttggatatttgaataaagaaagtattctaccttgttttttcttgttaaacttaactgaatattaatactcattttaaaatgatgttaaaatagccatcaagtggacaattagcatagttattgtatcttttttttataaaaaaaaacccttgtatttatttttattttctagtgtatctcacttagttcatattcttaagtaacaaaatgatgctttaaataggagaagctgaaaacagcataaatatggtatatgtagatatttgtattatgaatggacaactaattatgaattcatgtgtacgtctatgttacttatggtttattagatcatggcattatggaccttgagtaaaagctgcctacctgcactaacagaaactctgcttgtcatgcagcatggcttcacattagaacattttgtcactgtaaaatctaccacttataatggatttacaagggaaagtcaaatgctaaaataggtttcctacaaaagatggaaattaaaaaaaaaacaacaaattcaccgttactaaatatatatatatatatatatatatatatatatatatatatcaatgaatgcttgctatattgtagatatatcttaatcatccatacaaatgctggagtccagttgctgctaaggacttgtttttaaactttgttaaactataatttcaacttctatctcagaaatattagaaactagagtagtggcttagtacatactggaaatattttgttcttgtggaggacctgagctttgtttccagcatatcatttgggtggctcatacctgcctacaactccaaattcaggggaatcaaaagcctctgcactctacgaatctactgttttgtgtacacctagtcacccactcagtgcccccacatacatctcatatgtgcacacacccatacatgcatatacaattaaataatactagttataatcctttgttacaaatcaaagtagttttcattccacaatataaaaccttttattcagtgagaattatgttcattgcttaataaatattctaaataatattcatttctagtgatataaagatggtagagtcatggatgatatctttaaatgctcatgcaagagattggagaaccagatatctgaagaaaagataatgcagtttattaattgttacactacaataggaaccaactattttataatcaaacagaagaaaatcactaatcctcctttaaaagttgaggaaagaatccctgaggaagtggcattttagtccaggcaaatgtgttccagtctagaaagtacagtataccgaacacttggcaaagatactcagacatagagtctcctcacttatccatgattgataaatattctgttatgtctcaattactggggaactgagatctttttttagtttagtaatacctaaggttgccaaagttataagtgttaccctatttttgtttaataggaaacaaataaaagttagcattaacatcttagtgtttgtaaaatataattcgatactcagcatttagatgcatttttagtagaaaaaatttaaaaaaatgaatttaaaacaaaagttaaaaaacctcatagcactatattaagtataaatatattaagtatgtatgtataagtacatatgtatgtatactaaatatatgtatacaagtattgatatattaagtatatatataatattaattgtattagctatacatcttatgctgtggtttaagtatgcagcatagaagagtaaattgatcaaagaggtatgggctttgaaggtatcgagaagaaaatttcaggaacaaatgcaatgactaatttaataaatactgtatttattgctacatatttatatcaaaaatagtaatagatctgaaagatcacaaagttgttcctatcttaaattataaaatatcagattttgcatcagtaagataaattgtaggaaagactgagaaatagaaattggattatttctcctgtaagaaaacaatacatgcattttttcatgcttagccttatgtagattctactgcaatatgtatgtttatgtgtttcagcttcattgattacatggtttaaagggttttagtgtggctaagtcctgtagattcagctgtaatagccttcagtaatgataaactgtttaatgactgcccaaaatacagcattttattttgactatatcagtaagttttttttattactactattttatattctctattttgtcaacaggtaagtcattcccaaagattttgtatattatggaattttcattctattttatatgaaaatggaggctatatgtaatttttactatggactatgaaattactaaaattgctaaagcaaagtatatacacagatcctttattttaaaaacagtaatcatcacaagcattaaaagaaagctccagaaattcctacagaatagctatcttttgggaaagttaacttattccatcttggttaaattatgatttaatgaaagtggaaatggtaactgatttacaagtctgttcttttattttaagagatgttttccgtgtatcatctttggttctggaatttgctatgcatagtatgcttacctataattaaataacacctatgtttttacttcctactcttgtagattgcatggtttcaaatatttctcgggggccatggaatatgagatgacattttcagatatcccaattaagtgcttttcactttgttttatattttacatgccaattcaactaaacacaatagtaggcaattatggtaacggagacagtttgtcaaaatggactctttaccatgaagaggtactattacagagtagaaatatatcaagtgagaaacatttaataaaatataagatgatagtgtcattaataggtactgttagaaagggagtgaaatatttgccttgggcactgttactgaacatgtcatgtttgcttaaagaggcatagggtgatatagaatttaaagaatcatacacaatttaaagatttaattgaagtagtaatttgtcatcattttggatatgtgtttcttagtgctagtgactgcttcctggaactattttctaccttgtgtattagggtctccccacccaccactaccgggaaatttactcttaattctattgcattgacatcatttgagacagcatgtcatttctgtatatcaatacagaagttgtttgtaatatcttttttttaatgccacaaatgcaatcagtaagtcaagagagtcacctgttgtcttattggcaggccacctacctgatccatctggacttggactgagagaagccttaataactaccattaggttttttatattgtcagatttcatacatccaggacaccctggtcagtggatgacagccaatttatctcctgcagttaatgatgtagacaaatactcatatttcagtttcacctcaatacggcaaaagtaaatagtgttctagtattcattagcagtttgctaggtagtaactctttctatgcccataaactggcacaggccactgtttctgtgcattgaccatcgagcaaactacttttgctcttttattgactcacattgatgatgttgtcatattctttcgcagtaattttgacagagccttgtggaatgaatttgttacatgcatcttttaaagacttcaaatttcattctgatgctagtatagtgctgttatactctgcagatgacatggaaattattttttttttcattagggaaacaagagggtggggtacttgcttactagctgtgctaactttattttcgtatttaattttgttgaagagcaatttcaagaagctttgggccattgtatcaccttgtctcattccattatagatattgatgcaacatggatcactgaacagtataatctcttttgcacagtttctattgatcttgtccagtaaatcattgtatgctgggtttgttctgaaatcatttatagcataaaagctcttcttgaatttgaaaatcaagtaccttcttgtaataggcaagttcatacaaagttagaattcattcattttgttttgttcaaaccatggttagaaatccttttcccactaagcatctgaaagaaggcttgtgtactcactgttttcatttgatgctttcgtgtttcctatagtacatcaccattagtttctttgcaatcactatgtagtctgtaatgaactgttttgttctgagcttttgattttgttggacttagaatatgcttgccctcctctgatgtaacattgtcactttttcttattgaactgtcttagtttgaggagagcacaaattcctctttcttaaccccttttagattatgtttgtcctaattgactatattagtcctgctctgggtctatccaaagtcatcatgattgcaaacactctgaagtaacttggttgtcagattcacatttcctgtaccttttcactgtgatttcttaaacattctgtccctgtagaggaggcatttattgggaaggtaaagcacactcttcttattaatttttgatatgcataagacaatcatgtacgtacccgtgcattaattaagttgtgtaataataggtaaagggttattattgatataggtgaagagaaaggaagtaaagaatgttttatagggacagtcagatcttctttttgtcttaatcaacagagaatgtttcacctgcaatgcgtgtgaagggagataagctcaacttttttcacagatacagttcctcctgcaactttcctattttaattatatttacctttgctatacagtggacaggatttacagatagatggttcaagtgcttccacctgcatcacacacatagaataacagtctgcaaaataactcaccccgaagcaacattctatttaaaagtgaaaatattctaagatcaaaacttcacgcatcttctaaataagcatagttgtttatttgcctatttaacacatattatctctgtggtgtgtgtgtgtgtgtgcacgcgcgcatacctgtgtctgtgtttgtgtgtgtgtgcttttgtctttttgtttttgacattctctaccagattttatgtattgacttcctgctccttccctgtagatataaccattgcttaagtttagattcaaagcattctaggctaaaagcagtgaggtacactttggcagcagccatagggatgcagcaatgatcccccacagtgtgaggactgaagtggctagggtgaagtaaaggccaatctaatggcaggcacagcatgtttgaaatggtttaggaggaaaaagagccagcaggttgctgtcctgatccagacaaattcatttgctgtttgtgactattagcagctgcttctcatcggggctattactttctcttttatctttaataagtttgtggcaaaaccttaaattaccagtatttcttctttattctgccacaatgaaggtttcgtttaaactttatgaaatgtgattttactttcacattgtaatatctctacctatgtttgttacatttttctatcttatacatttctagaaactagtaaaaattttggttggtacacatgatattacagtgtacaatttagcagtattattcaaagttattgaatttatcttgtacataccattataaataacttgggactcttggctatttattttgtgacctcagaaattaatgaaagctgcacagtaggtgacacctaattgttttcagtaagctgctagttttatgttcttgtataagattttattttttgctctagtgttaaaatactttatagcaccaaacattttattattaaaggatagttcttacaggagacactttccataggtgggtcattatccaactcctttttaatttagtccttaaaacttacatttcaaaccatttctgccatctacaataatagagcacatgataaaaatttcttgataaactgaagacattgaatggtaatatatttaaaaataaaatatttgttacccttttatgtagtccaagtctttacctgccttagctgttttgttaacagataatatagaagtgtttatagaattatgaagttttttttttagctactgtgtactttccaatggcaaattttgttctttttcttctactctggtgacagccacaactatctctaaaagggaagaggaatctatgcaataaccatttttgaattttatgtatgcattcagtcttaattagtgtatgaaacatattcctatttattttagaaatctgtatatatgaactatacaaatacatggaacatccttgaattaagagtgtaattgtccttaaatgagttaaaagtgagaaagtcattaacattgtggattgcctacagatgacaaggaatttccctttagtgttagagtttgagatttaaaggatatgcaagatgacttttgaggattgccattgaaagatttccccccttgttcaaatcggggttcatttgtggagctatcacagactgactgtttcatatgctttagaacagttgagtcaaactttgctaataatccatggagttttaaaggtatatccatcctgagtcctttcctatggagattctgacattcttattcagcagttagaattcacattgtaactaagtgatagaaaagaatagaagaacgaagacatggtgtcaagtatttttccaaagtagtgggtgatgtaacaaggaaggataatagattgagaagaaaaagggtcaggagtctgtgctaagaatagaacctttatgcttatttaaattgcattcttctcatgtgtttgtacaattccaaaggcctcttaaatactacttttctgctttcaaatcagaagtcaccagcaggctaaagctaagtttaagaacaaagaagaaacgaaaagttcaggtactctattttaccctcgcaaaaagattttctaatgcttcgatcaccttcaacagattacatggctgtagcctccgaactgaagaaaattactgctgaaagataaaattgaaagctgttggaatccaaatggcaaaagaagagacaatatagctctgcttatttcccattgagctcagccagcaacaaaccaaattgaaacattcagtatcacttttatgtgcataaagcaaaagaagaatattatacaaaattcaaagtctaaattcatgtgacttttggggggtggtagaattcagtttttcagtttactttcagccatttaatcacaagtgaatcatgaccaaacatagtcaagcctaataataataaaaaaagattttttaaaataattccattactgttgatttgctttggtgtttatgttatataaagacacacaataacattatgggagaatataagaggagtaaaacaaaagactgttactttagtatcagacgggctgatccctgtaggatagattcacttaaaaattatgatgactataaatgtgctgtgtaatatgaatgatttttgaaaaccgggtttattagtaaacaattattatagggcattattaaacagtgatttacaaggaacacgttgaacatttactaacattttcaaaagaataaataataacaaatttaactctttttcgaaagaaaagggataagatcctgatcaattatgaggtacctcttatgtcatatgtaagcaaatggcatacttcaggacaaatctgtctgggcatgtggttttgtaaacaagatattttattgtaatgtttccatactcattcattttcttattttatatggctgcttcacattgaagtgcctgagtggaacaaaagtattttggtctgccaagacaaaataaaaaatgtttactcactattgctgcacactttgttttgtgtttatgtactgtgaagttttttcatgtgtattccctttgtttctcataagccacatagaaaacatatattgatcctatatgataatcaccaactaaacatttatacctctaaagttactaaagctttatccttagtatagagatttttacagtactgatgcctagagttttcaaaggctctcatatttgatggtgaaattggagagtggtggtagagttgtccagcctgcctgaaggcattcttcgtcttgatactcattgtacatgttcctattatgagcatgctgttgtaatactctcaacacttgccttctttttaatgtagagattttttgtgagcttttagatccctgatgttgtgaccaaccttctcattaaaattgtttatacactaacagaaacatcgtcatcactttgtcagtcttgattaggcaagaatgaaatagattaaactgaggggtggggggagagaatacagagtgcctcctgctgaattcactggccactaattcagaaacccatttaaggaaattgagaataccgtgtaaagaaaataaattaagttttttacatatttttattactactttcatttttttttacactccagtcattacccacctccttgtgcagctttgagggttaggtgccccttctcccactgagcccagaccaggctgtgtatgtgtctgtgaccttaaacagctcctctatgctgcctagttggtgggccagtgtctgagagatctcagggcaccagtttatttgagactgttgaacttcctatggcgtcatttaagttttagtgctcaacagtacacaatagtgtactttgtacctcagggagaattctattaaaattttttaacttataagccactcaactcttctttgttgccttttacaagtttgtgtctggcgactttgctttccaaaaatgtaaatagctggtattgtaatgtactggatatttggtttcttccaagattcaccaacttggttgaatttcccattaagcgtgatgctatttggtgatggggcctctgaggaagtaatcaatttaataagacataacgtatgatcaggctctaatagtgtgctttgaccacacactgaaatattaaatcttgctctaccaagttaactgcattccatattaagctaaattgagtacaagatttgcaatagtctaaaattgatcacaaaaaatcaaagcaccttgtgtatgatgcttttctaaacaataacctctgcaagaaatgtcttcataatctacaagtattagaatttagcattatatttttcatttatacatttcctgataatcatctctgttttacacattttgttcttatggattattacttgaatctttggctttccacatgaattatgcagtttatcaaaacaggacattttgagtaggtacaacagccaggaaaatgtccattagttcatagaaagccagggaaaacatttgggtaaagggacagactcttacttgaataatgtacttagcataggttaaaagttaatgggaaaaacatcaacctcatttgtcaaattctactttgaagtaagaaccatgctttagtttggggattgaaattaccagctgaaacaaagtttatccctaaaactgtaagacatgtttatttgtccttcctaaaatatacaatatctgccaagatattgaagctgattgaaaatatgcaatattagctattcatgttgttaaacacactgttctggtgacatttagcagtgttcagtaattggcttaatgaacaggtgtacaagtatattagttatgcagatgttaatttgcagtaacatgtgcttcctgattttggggaggggggctgttcttgtataaactacatctagtaagatttgttccttaattaggaaaccattacaaagtgtgtgtgtgtgtgtgtgtgtgtgtgtgtgtgtgtgtgtgtgtgtgtctgtgattgccacccttaggaccattagtcttgttaatgtgcactgaacttcaggaacactcctgataatgccactcctattgctttagatgctatgcaggtgtcaggataaaatctactttcctgtaggaggccttactgtgcagctgcaggcagcaggcagcagggaaaggggaaactgcacagctgtcccatgtagcatggaaaagcaaacaagaatgcaagctctttcttcatgttgcatcagcattccctttcaaggtttcataaacaaatgtgctgctctatacaaagacagctgagcacaatggtgtactttgttacctgccaaactgaataaactttacctacatttaaaagattatcatctttactgctgttcgtggttcctatatttgttcttcaggatttccatgtccatcaatttataaactgttaaaacagactggagcttttatatgtttcatactggatttttatttctgtgtcgcaagagtacaaagccactgaggttaatatagaaagccacagagctaccacctcaaaagagcagatgccacctgtggacctgtgctaggactactggaaaaaagagtataagattgtttttgtaatgaaacttaaaatagctcttcagtctcttgcttcatttttttaaagatggggacaaggacaatattagccatcatttttgaaaacttgtctcgtttgggaactaatttaaatttgctataatacttttattcttcaaaaagtggtacacagtgatgaaatgtttattgctttgtaaatctcagatttttagatgagtcacacaatacaggtaaaatagcctacaattcctaaggaagcagtgtgctatagatacttaagatatctaattttaattttaaacatttgtttaaatgaaaaacaaatggttcagactagaatttagtgaaaaataatagccaaatgtaaagtcactaatgagcattaggtacacctgtattaggcttgagattattaatttaaaaataagataacattcatataatcttcatgtgataacattttatcctgcatgttactgtttaattactttcctgtgttaaagtttaggactattgaagtggggaacattctcttgactactttgattttattaaattttctgaatgtgctttcagatgcaattttgatataattcaaattctctttattcacatcagaaatagctattgagctgtcatttctttatgcagttgtcttaaactgagggagcagcttaaaattagaataaattgaaatgttgattcttacattagaaacacactgtactttcataaggtcctttgaggaacatttatggcggtttataaagaaatatactaaaagtcatttttctttcaccaattccaatgattgtgttttggcaacattgcaaagaacttgacacctgtcacaaaattataattttcaagggaattattatctactctcattagagtgtttctattcttacattgattattctgctaagccttacaatatttaagatatgttttgtagttaatttatttcacgttacttgtctgctaagctaacagtatttgtatatcttacaacttacacgagtaatgatagaatctatggattttcttcatttttcatgcatgttttggactactgcaaaaggctcacagatgctgatatctttctttggcaaagatatatattatgagtgtttccctttcacgattttttttaaatgcatgtgtgaggtctttagccaatatcaaataagttgaaataataataaaaaaaatcattgtcacctccaagtaaacttcattttctggcagtgataagaaaaaaaaagcatgataatcagttgtatgcattagtgatgaaatttaacagtgtttttgagtgcaaaaatacctcttgattgaaaaagaaagtccaccttctgtaatataatttagtggtcccattgcctacaaccttgtatttatcatggaagaagtaaaccagcaatgcttgagtaaaatcgctagagcattttcttgtagttggtacttggagacttcatgtttcgttttcttagcagacagtcaaaggtttgtcactagtgtctttcaagtgtgaatcaggggcgaacacttctgctccttgatattgtacaccttgctgcttcagtcctttcaaccatttggagaaacggtacataaagtgttttgagcaaacctccattttcatggaatcatgcatatgcaaatgggcgggactcttgtacaacttacaaaagctttaaaccaattcttcaaacaaaacccaatgctgacttttactgttacaatccttttaacagctaccattaccttaggtgctttaaagcagtttctttcactgaaaagaataaatgtctaaatattagcatgttttaggagaaaaagcatgtcttcttttttcctaaattagtccaaattagtgagattttacttttatgcttaattccagggctgctccagttacctgtaaaggagtaatttatgttacacattagtgaaaaagcagcaattgatttttagttctatttggcttatcttttctgcttaagtgctgatatttaatttgtagggaaacctctaaacaggtctatatttttatgtttatcctcttccctgagctaatgaaataaacacatttattgatttcagaatcacctttattaatgtagttaacatgccttactaatgttatttcatgtacttggattagaaccattattgtttatgcatcaacccttttatttcaggtcaaaggaatacagaggctgcagaagaaaataggagtgggcctccaaagaagaaagtgaaggaattgagaattttggataccaaaacagcccagaatctatgtatgtaatgtattctgcataggcatggtggtgatggctaactcaatgtaaacaaccttagaaatttgaacagacccactgctagaaataaggtcctatgcaaatataatccaggtttccctatgccacttaaccaaattgaagaaaataaatgaacttcatttaacctgctggaatatattatttctagaggtttggaatggattgttaataaaacttccatagtgaagataatgaaacataatgtaagttattatttaaaatgtagtgttaactttttccatttttatgttactgagtaggtctgggattcatatttttacaatttttcatatttttacatattttaaaactggttgctgatccttgaagcctttaactaagcactgagccattaattttgttattggtaatgtagcgggatagttaaatgcatgaccatactttgacttttactttgacatactttctcttctaagttggacatagaatatttttatcactacagaagggtgtttagatagtgatgataccaaaacactcttgtgtgagaaactttaatacatcctacatttttaattacacacagaataccatggtagttatgtgagaatgggatgaatacaaactgaccattctgttatctggcaaaatataactcatataaccactctactaatagctataaaaaatttgtacactactgcaatgatagttttctccctcaaagtttatttcagtatttttattacacaatgtgatcatattatctagttaatacatgaccatgagacttattttagtattagaattctcattgagtacctgtgtttagataatcatttgcccagatagtgaatattaattttgcttttgctaccagtgcaatcaggtattgcttttcataaaacctcactaataggttttttcacgttctatctctcagagttatttttcttataaaaagtgggtttaagctgggcgtggtggctcacgcctttaatcccagcacttgggaggcagaggcaggtgaatttctgagttccaggccagcctggtctacagagtgagttccaggacagcgaaggctacacagagaaaccctgtctcgaaaaaaccaaagcaaccaaacaaaaaaacaaataaaaaagtgggtttaatgaagaatggtatgaaatttatttaaaaattgtatctgtgtaattgtaatatattctaggtaatattagttgaatacttttccaatatgaccttaaatctatccaatgaagtaaagatggataaggaaataactcagcatatgaaaaacaatacttgttttccacctgaatatcagcaggaatgcagagtacattgatgaatccagcactttagctctttccttgaaatgtgttcagtggtgtcttgctgtatttgtgggtgatcctttccgaaattcgcagtggataactaaaaccacaggtagtattaaacccaggtaatacatacacaaacatacacacatgtgcacacaaacaaacacagacacacagacacagacacacacacacacacacagacagagaagataaagtgtcttttataaattagttagaagtctataacaataacaacaaaacaaaacaatgcaattttaatactggtccttgaaagaaaatttacatgaatatagtttttattcctctcagaatatcttattattcttgtatctctattgttatgatatgaaattatttattttaaaatgtatatgatagcttctccttcgtatattaaattgggcttcataaacacttctatgttttggggttattgttaagaatgatataggcttctctgaagtaagcaatgtcatattttcacagcccatctcattactcctaaggctatttggtcagtaaatttttttatcattgtgaaaaattactagagtgggccaactagaaagagaaaagacctacttttgtgctcattgtggttcaaagctgctcacttcataattatgaaagaaagaaaaaaaaagccgatatccagagagaaagcattttggggcaagatataactttcttggtgattgaattctttgattcctgcctcatcttctaatatactattcaacaatgtattcaaagtaccaatagtatattcatcctgaagtcatcaacacatttctcaaatttcttggaaccaatcacttttctaaagctccatgtctcaaatttcccctaaagagcaagcaggtagtatgagaggttttcggagagcttatcatatttaaggcataagagtcaacagatggtgaaggaacaggtagcatgaatttctcagatgtggtggttaatgaaatggtagtcagagtgtagtcagagtgagatggcatacagtttcatagtgctactgcaagtaaaaatgtaaaactaaccaattaactatttctccaactttctattgaatatttttaggttaaatctgaaaaatatatagtgatgcttacattatgatcattcctgagaaatgctattttggatatatctgaaaagtttgacatttaaatcttattaataaagaaaaaaactagattgaattaaaaggacaactttaatcaattttgggttggtcaatatgtattagcttaacataaaatgattatgcatagagttatgagagatctaagtaggatttttattttgtaaatatgtacacttgagctggaaatgctataacctgtgggattttagattatttttaccaatattgatagaatactccatcgagtagaagcagcttatagttctgtaaattagtatattactaacaaaatagcataatttgagtctataaattgatatatatatccatatatccatatatatatatgtatattaagattcttaaattttgatgctattctgcctttaataaaatccaatttcattttagctatcttccttggatcttaccgcatgccatacgaggaaataaagaacattattttggaggttaatgaagagatgctcagtgaggccctaatccaggtacattggaaatctttagtttaaaaatgatgatagacattttagaagtgtctcttcttgatgttatgaaaaatagttttaatattataaacaagtcatattttcctggacgatttattatcaagtttgatggaggtatcacactttgcctcatgtatgttttgaatttggacctgtttatttacaatagaattaaggcttgattggtatatggtgagtatttactataattatatacctttatgtattggcataatatgttctcaaaaatcctcttgttggaaaaagtaaacatttacaaggtttgatttatttctctgaagaaagaaattgaaaaagatctcagaacctggaaatatctcctattctcatagattggcaggattaatataataaaaatggacatcttgctgaatgcaatctacaggttcaatgcaatccccatcaaaattccaactcaattcttcccagtggtagaaagtgcaatttgcaaatttatttgaaagaacagaaaatccaggatagggaaaacagttttcaacaataaaacaactttgggaggaatcaccatccctgacctcaggcttttctacagagcaatagtgattaaaaactgcatggtagtggtacagagacaggcaggtagatgaatggtacagaactgaagactcagaaatgaacccacacacctatggtcacttgatctttgacaaaggaactaaaaccatccagtggaaaaaaaaagacagcattttcttttttttttccattttttattaggtatttagctcatttacatttccaatgctataccaaaagtcccccatacccacccacccccactcccctacccactcactccccctttttggccctggcgttcccctgtttcaacatgaattcttaaaacctgactttaaaaataagaaacattatgctggcatagacattcagcaacttgatgttttttttttttttttttttttttttttgcagaggtacatagaggaaaactatatcgttctaataaagagaagaataattacaatgattgaattcaaattatgatcctaccttactacaattttattacatagaaaagatttaaaacctttcattaatgaagtgtcataagtttactgtcttgccatgacatattttaaaacagaatgtcatgatccaacaaaaaggggtaacttgtcacatttaatgtgccttgttcacttcaataattgtgcaaaagtcatagttcaggtgagtgcagatgtctagaagacagaggcatcagctttcccccaggtgatgggattccagacaattagatacttccttaagtgtatgctaggagctgaactcaaatcccctctgagagcacaccctctcatcccttgacccagcgcaccagcctgagtattttgtgtttttttcatgtctacttgataagaatttgttgaaatccagattgcttgattgtccaatagagaaccattttgtctcatttcctttcttggtcaatccaaattaattctctcttattcaaaatgtatgattggatgagacatctgagtttttaagattaatattagttttatctggatgattcatatgtctgaagatattatggcaggaagatgcttctcaggtgaaataattatagctttgctgttaccccaaaagtttgcttttcttgtgccaaaaggaaatctctaggactttcaaactagatatgtttgcttcagtgatgtgaaagtaacatcaatttgccattcacatgaagtgtttaccatttatgtctaattaccatgtagcacatcgataatgcacaacattaaatatgtatcatcagattaactttgttgtaagttctgtttgattacagtgctaaacttcatctaagcataatcacagcttgttgctcatgtagcgtggttgtctcttcatggcaacaaaaacaacaaaaagcaattaaggacacatcatttcccaggaacatgaattaacacaggtgttatgtcccctacagtaggtcaataaacaattcctcactagacaactagaagactgcttatttgaaaggataaatgacctacttaaaaatattttttatttagatgactagtatttaggctgtatattgttgaaaataatgtttggatgttagacactctgaaaaagaaataaaagcagtagtttacaaattgttaaatgttaggagaaaaataaaaaaaataaagtatgcattatttgagataataagtgcttacaaataattattaaatgctggagaaacattggtagagaaattatatttgccaggcatggataaagtaagatttacataggaggaaagcatattgtgcggaaacattttcaaagatatgttaattcagtacaattggaaaggactcagcagtttctgaacatggttgtatcaaatattgcaaatttctttgaatgtagttctaattaacatattgcattttgtttaattaaaactacaaagagtagaccaaagtagtaaaaacagtacttacaaatagcattaatagcagtagtaaatattttctttgttcattccagttgtgtcagatagcaagaaacattgtctatactcattactatttcaaaattaaagtatttattagacctgccactagatctcacatctattattatatacaacttgctttggaaaatatgttgacaactatttcaatacaatttgtttcatttataatgaaatgcatttgattttatactgagaatttattaccacatgcaagaagtccatggaacatgcaataaggtgagaacctattagacatgcttccaagggtactgtggttatggttgattttttttgtggatcaaattcaccttgaactagactttaaagtattaccaggattgaataagtggctattggttggcgaatatttgaagactatgaagacttcataatttcgaaatatttctggattaacataggatagtggtgagcaagcatagggaaataattagtgaattggttggggtcctattataaaaactgagatcaaaatgtaatgactggtagtctgcctcaaatgtcaaaaaattgaatatgggcacattcaactaatctctgtctctgtctctgtctctctcgtggtggtggtttctattaatagaataaacaggaaaatctaaagatggcctagtcggccatcactggaaagagagacccattggacatgcaaactttatatgccccagtacagaggaacgcagggccaaaaagtgggagtgggtgggtagaggagtggggtggaggatatgtggacttttggaaatataatgaaatgtaaatgaggaaaatacctaatttaaaaaaaaccaaagtactttttaaaatacaaaataaagaatgccctaaactatacaggcatttatcggggtggggtgatattgggaagggtagtggtggtaaatacttggatttaaaataaatattcattgaaagtttggttacaagatgtttttaatacttggattttgttttttaatggagaaacaaacgaggtaggagaaaaaaatctagaatacaggaaaggattataagaattattatagtatagtatgtttcaatgatagaattgaggtcagtaaaaaaaaaaaaacaagatcagagggtcatttgcaaagaacggattcttaaagtatgaaaactactgaaattcttgaggcttccagtgatagaaaataacaagtagaaggtcaaggactgcatttctgtagactacttatggtgaggcaatgggtggtgatagagaaatcagagtaaaagtaatatacataccaagccatgataaattatgacatagacactgtagacctataaatagtgactgcaatcagggagagaaataccttttgcttttatttttaaaatttgttcttgtcactattaacagtatatcagtgtcacctactgtgcccctattgcatagagcttcttttaatatctacaattacaattgtaattgtaagtctaatattggttgttctataggtccccttaaaagcatgctgaacgcaagtttcctatacttttaaagcagatgttgtatttatttatggtgttccgccctctacctctcttcatttaagaaacagttccagaggatgggccttcctggcttttcatcctttgctgtctcttcacccacttcacttgttctacctttttctcattttcccgtttcttctctttacattttaaaaacattctttatgtagagaaggctaaagatatgtaccaataatgcctcaggctaaatgcagctctacaacacttcataactgaaaacccatgcagaaggatatttctgctcacttcctacttatatcttccttgtattctggctgctttatatttctgaaacacaattgaaaatctaagacttcagttcatgcaagacatacaacctacacctttccacatgattatgttttctcaaatgtgatttttacatctcaaagtagattacatgatctatataactcattcctgaatactgacaaaatgattaggtagaagcaaaggtcattcaatccatcccctgaattccaggcagtgctatacctaagtcatcaaaaataaatggctatctattgattctgcaagaaaaaagattgttcaacttccctcaattaaccagttgtagtgtataattattcttatagtcaggaagttcatgcatgtgtaatagtagagctcatttttgtctcttcaatccgtctttgtaattattgatctatttatgtggctatcgcccatctgtattttgttggggtttgtgagtcggcatgtgtttgtgcgctttagcagatttgatagctttaggacactacacctatatcaattaaggctataaagccattgggattatagaattttagaccaatttttttcttaaacagcaatagttcttcacatttgctttcttaattctttaaagaaaacaaaacattagaattgacaggaacaatcttaaaacatttctttcgtatttgttgtcatataagaataaatatttgtgatgcttctgcaatatacttatatttttatttgtgggttgttttttctttttttgttttcaaccttggcctctaacttttcattagatggagttataaaatgtattcttttgtctgttttgacagcagccttgtttttgagcagtatgtactaatttcaggctattgttaagctgaatttaatcccaacaaatattgtgtctgctcatcatcggttcattctatgttgaattttttgaagcagagtaagtatgttatttgttactgacactggttatgttcttatttgcaaggaaaggaaggatagcattaagaaattaatctttgcttatagcatttagtgtgaaaaatttacccttcgtacaatttgaataaaaatgtttttcttcacagttgggtaaaatgttgcttcctattattttatgtttcataacttgtacaattctaacaaaaattagtcctttaacttgataaagaaggggaacagagagtaaaatgtgttggagtgaaggaagatttgcttagcaaactatttcataacccataacacttgactacattttgaaaagcattgtattatattccaaaggtggcaattacaaatatcagaataaatcttcacatatcttttttccaggtttctgtgactctgtattttcaaagcaaattagaatttacctagtcatcatatttaataaagatacatgataactatattaaaatttattctaatataatatggttagcatactatattaccatatattgtataatgtttaatacaaagatatgttaactattttatttcagtattacagatgagcagtcaatgaggaatgaaaaggagttaaatttgtggttgacatattgattcactttctatatatgtattttatagctccataacaaaacaaatccatttaaaagcctttagttaacgaacacaagtaaggtatatttccttactttggactgttacattgtgagcattggattgtgggattctctcctctagaagcttacagctgcactcactatcagttttgattttagtttctgtacaatgaatataccatatctagtactgtccccagttgcaaaccatggttttatgaattaatttacctttttgatgtaaaagtagtaacattttagaatttgatatatatacaattaattcatctttctacgtttatttcaaacttgataacttaagttttacatatttgattagtataaatcacaaccaaaatcataacttatgaaatctgtttctgcttctcactcagtttcaaaattccgtggtcaggcattgtacattagagaccacaaatattctcagttttgaaacatctaattatattactatgaggtggctttttctcctttatcacatagtagcatatttgtgtggtttatatatagagcttaataaaattaacatactcaatatttgctagcttagcttaaatgtatgccaggtaaattaagtaatattacacaatcaacctggaatcaaaactcagttcatatgattagttcattggtgtttttaacacaccattgtttacctacctttctccctattgtgtgttatataggtgagtgactgatttgattttactgttgaaaaggaataatacatgtctactaaagtcttcttgactaaacacattataaaatatctctcattagaaatcagcattacattcaattacattttaaaacatcatcttcaacacatgatgtgcatacatcactgtttgtactctgtaataataatatagttagttaacaaggaatgagggcctattattactaaatgcaatgaaagaaacattgaattctatctatcaattaataagtattcttttggtatgttgaacgtattgttttactattactgttatcattatttattttaatttaaatgaaggattcatcatgatgaactcatctaaagaaataatataaccactcagttataaagtaagaatattttgttctccttataacttctctgcataatatatatattatatacacatatgtatatatgtatataatagatattatatagatatttacatattaaatatgtttctatatatatgaaatctttgcttataccatttagtttgataaatttacccgattttccttctgagcccagcagaagctggtaagggctctagagtgctttccactccacaggacttcgggatcacatcagtaacactggtgagtggaacacaacatcagctccaaagaatcacagagggtcttgtgccagcaggaacggggacgaaaggaaccctgcccgaccagaggctgggatccattcaggtcaggactagccctgccatcttctgtgtgaacctgaccgagggcatctaggaaaccagaggactctccacgccacatgacccctagcatactcaagacctcctgatcacctgagagatcctgggtgatacaagcaacaaagcttcttggtcagtgtcccctcaggccttcatcctcagccagaaggcggagctgagacccagacccctgggcacaatccttgccataggagagtcagcctatagggagggttctgactccagaactcaggaggtggatcagagatccagacttctggacacctgccctgcaagaggagagttggactcctatgagtgctgacagaggctaacagaatcacaggaggatcaagctccaaccagagacagcttgatcattaacaccagagatttccagatgtcgaaaggcaaactcaagaatcttactaaaagaaaccaagaacactgggcatcatcagaacccagtgcgcccaccacaacgagtcctggataccccagcacacctgaaaagcaagacacggatttaaaatcatatctcatgatggtggtagaagatttaaagaaaggcattaataactcacttaaagaaatacacaagaacagtgctaaagaggtagaagcccttaaagaggaagcacaaaaatccctcaagaaattactggagaacactgctaaagaactacaggcaaacactgctaagcaggtagaagaaacacaaaagtccctttaagaattacaggaaaacacaaccaaacagggtatagaattgaacaaaaccactcaagatctagaaatggaagtagaaacaatgaagaaaacccaaagggagacaactctggagataaaaaccctaggaaagaaatcaggaaccatagatgtgagtatcagcaacagaatacaagagatggaagagagaatctcaggtgcagaaaattccatagggatcatggacacaactatcaaagaaaatgcaaaatgcaaaaagatcctaacccaaaacatccaggaaatccaggatacaatgagaagaccaaacctacggataataggagtagatgagaatgaagattttcaacttaaagggccagtagatatcttcaacaaaattatagaagaaaacttccctaacctaaagaaagagatgactatgaacatacaagaagcctacagaactccaaatagactggaccaggaaagaaattcctcctgacacataataatcagaacaacaaatgcactaaataaagacagaatattaaaagcagtaagggaaaaaagatcaagtaacatataaaggtaggcctattagaattactccagacttcttaccagagactatgaaagccagaagatcctgaacagatgttatacagaccctaagagatcacaaatgccagcccaggctactatacccagcaaaattctcaattaccaaggatgaagaaaccgaagtattccatgacaaaaccaaattcacacaatatctttccacgaatccagcccttcaaaggataataaagggaaaaccaccaacacaaagatggaaactactacctagaaaaagcaaaaaagtaatcctttaacacaactaaaagaagaaagccacaagaacagattcccaactctaacaacaaggctgcccactttctccctacctattcaatgtagtactctaagtcctagccagagcaattagacaacaaaaggagttcaaggggatacaaattgaaaaggaagaagtcaaaatatcaatttttgcagatgatatgatattatatataagtgaccctaaaaattccatcagagaactcctaaaatctgataaacagcttcagcgcagtagctggatataaaattaactcaaatcagtggcctttctctacacaaaggataaacaggctaagaaagaaattagggaaactacacccttcacaatagtcagaaatagtataaaataccttagtatgactccaactaaggaagtgaaaggtctatatgacaagaacttcaagtttctgaagaaagaaattcaaaaagatctcagaagatggaaatatcccccatgctcatggattggcaggattaattttgtaaaaatggctataattttaggaattcttttaggatcatgattaaaaaattaagtcatctatatgtttatatagcaacactaaatgacagtaaaccttcatggatctgcagagatctgctccaaaggggtgtgctattacttagtaattgttatatatgtttaataataatagggaaaacattaatagcacaatctttcctaaaatgaattacttacagcctagcttaataaggacacacctgttgcaaattataaaataatccaaagcagaccatttcagaatgatcacctgctagttattagcttgtcccattatgtcttctgacacatatctttttgtctttttatgtattttatatatttttgcgtatatctttctaaatacaacctgcttactctgtgatgcttctatatatattttcagggttgaccatttagaattggataaccaaagtataaatttctttcttcttaaactgcttctaactttgtatgctagaatgctgttcatagttatattttttcaaatttatttttatctgctttttctactatgccattactgcctattcagaatgtaccaatatctttgccttttttatgtttattttatatagtacctttagtatcagtcagttaattcagtttactgcttctatggtaattgttataataagtttgatacgtatgttaactttttaaagaaagcataactactcaaaaagaagaaaatgttggttgttgagaaattatagtttggcctgcagaagttatttgctgttctaaatttatgaagaataatagaggtaatatagaatagatactgaacaggatagatgtaatgttaaaattgctcattctctttgtacaggaacagtaagagttccagagaacacatgaattttcttaaataattctgggggaacttccagtcatttgctatacatcccaaacatggatttctcttttgtggttttaagccaacgattttgttgttgttgtttttttaacaagtggtactctgtcagttacaatgaaaaggacagacactcaggagtttggtaacttaatgcagatggggcaagttatcacattgtagggacaaactgtaactggacaacatttggaggaaatgttaggttaacgaaaaaggaaactgcttaaccaacataataccagtcatgccttaaaaaaaaccatatttttatactatgttgtgtatttaacattaagtcattttattttgggaatttgcattggcatatattttcaaatcatctgtacatgccatctatcagtattgttttgcattttttgtagtgtagggtaagagttagctatataaatatttataaatacgagcacaaatcgctagttgaaaagaaaatcctattttgaagattgcagagaagactgttattgtttttgtatctgttagaaaatcagtgctcctggccaaatacatttttatgcattattttcatagacaatttgaatattgctttgaggtagaaataggaatatttcaaagaatacaaaactggacttttttggcaaaacctaaatatctgtttgatgagttcgcccttatcatgtaaataaatggcacaaagcatgacctgtttatgatcatgtgatttttttccttattcttttaaaagctgtggatttctccatgagaatatatgtcagatattttagaacagtatacaaatatgtattaatgatttctgaaacaacaaccatgacaagattagacttgaaatagttttttgtgtttatttgttttgaaatgctttcatagttgttgtttagagtaaaaacaaactgaaaatgggtatattcttttgaaatgtgaggaacataaactagaatatataatcaagtcttacagctaacaaccttctacactggtggaggttctacacttctgagctctgtccagggagtgtgttgtgtcactgccttctgcctggctcaacagttggtgcatacaatggcctatttagacttgtcatctaatagtaccatagtacctaatagctaatgtgaccatcgcatagaggtaagcagtattactgggaaatacatgtataaagcaaaaaagtaagggcaataccaggtttggtactgtttaaatgaaaattgtgttttctcataccagtcagaatggctaagatcaagttccaggacagccagggctgcagagaaaccctgtctcaaaaaaacaaacaaaaacaaacaaacaaacaaacaaaaccaaaaaagccacccaccaaaaaacaaacaaacaaaaacaaaacaaaataaaaaatctcagctgagagcagatgctggctaagatgtggagaaagaggaacactcctccattgcaggtgggattgcaagcttgtacaaccactctggaaatcagtctggcggttcctcagaaaattggacatagtaataccagaagatccagcaatacgtctcctgggcatttactcagaagatgttccaacttgtaataaggacacatacatgctccactatgttcatagctgccttatttataatagccagaagctggaaagaacccagatgtccctcaacagaggaatggatacagataatatagtacatttacacaatggagtactactcagctattaaaaacaatgaatttatgaaattctttgaaaaatggatttatctcgagggcattatcctgagtgaggtaacccaatcactaaagaacacacatgatgtacactcactgataagtggatattagctcagaaccttagactacccaacatataatttgcaaaacacatgaaactcaagaagaaggaagaccaaagtgtggatacttcttccctccttagaatagggaacaaaaaacccatgtaaggggttagacaaagtttggagatgagacagaaggaaggaccatccccagactatcccacccatgatccatcccatatacaaccaccaaacccacacactattgcatatgccagaaagattttgctgacaggacactgatatagctgtctcttgtgaggctatgccagtgcctggccaatacaaaagtgaatgctcacagtcatctattggatggatcacagggcccccaatgaaggagctagagaaatgtaaatgaagaaattatctcattaaaaaaaaagaatataccatgaagcacaaccagcactcgggaggcagaggcaggtggatttctgagttcgaggccagcctggtctacaaagtgagttccagcacagccagggctatacagattaaccctgtctcgaaaaaccaaaaaaaaaaaaaaaaaaaaaagaaagaaatacaaccaaaaaaaacactctctggaaacaaggatagaaaccacccagttgctgtagctgctattttgccaatctccttaaaaatcattgctaacccctcataaactgttttttgtctaccacatttgaagcagcattaattatccattatgcctaacccatattgggtgcgaaccataagcatagattaagttctcaagctcttcaacccctaaaaaaaaatgtgtttttatttaactttatgaaactcaaggagaatgaagactgaagtgtggacactatgcccctccttagatttgggaacaaaacacccatggaaggagttacagagacggagtttggagctgagatgaaaggatggaccatgtagagactgccatagccagggatccaccccataatcagcatccaaacgctgacaccattgcatacactagcaagattttattgaaaggacgcagatgtagctgtctcttgtgagactatgccggggcccagcaaacacagaagtggatgctcacagtcagctaatggatggatcatagggctcccaatggaggagctagagaaagtagccaaggagctaaagggatctgcaaccctataggtggaacaacattatgagctaaccagtaccccggagctcttgactctagctgcatatatatcaaaagatggcctagtcggccatcactggaaagagaggcccattggacttgcaaactttatatgccccagtacaggggaataccagggccaaaaagggggagtgggtgggcaggggagtgggggtgggtggatatgggggacttttggtatagcattggaaatgtaaatgagttaaatacctaataaaaaatggaaaacaacaaaaaaaaagaacaagaccaaacaaatacaattttaaagctttaaatatgatgtcatagtttggttttctattgcttcatgaaacaccatgaccaaagagcaagttggggaagaaaggatttatttggcttacagttatataatatattagaaggttttgcagagagatttgtgcattttgtctgcaacttcttagttctttatatgagtacacagtagctgtcttcagacacaccagaagagggaatcaacttctattacacatggttgtgagccaccatatttttgttgggaattgaactgaggacctcagaaaagcagtcagtgctcttaacctctgatccatctctcgagtcccatatttatgttcattatcaaaggatgtcaggactggaactcagacaggatagacacttataagcagcagctgaaaaagaagtaatagaggggtgctgattactggcttgctccacattgtttgctcatcctgctttcttaaagaaaccaggaccaccccattcacaatggactggatcccaagggacccttttatagctgtctcgtatgaggctatgccagtacctggcaaatacagaagtggatgctcacactcatatctataagatagaacatagggcccccaatgaacgagctagagaaagtacccaaggagctgaagggatctgcaaccctataggcggaacaacaatatgaactaaccaatacccccagagctcatatctctaatggcatatgtagcagaagatggcctagtcgtccatcactgggaagagaggccccttggtattgcaaactttatacgccccagtacaagggaaattccagggccttgaagcaggggtgggtgggtaggggagcagggcggagggagggtatagggaactttcaggatagcatttgaaatgtatacaaagaaaatatctaaatataaataaacaaacaaataaataaataaataaataagcgtagcatgtagaaaccaggaaaaaaaaaatgctttacagacttacttataatctgatctaatggaagcattttcttaattgaggcttcctcttctcaggtcacattactctgtgtccagtttacattaaactacctagaacatatgcacacaacaactttttaagcttcatgctatacaaaagtgtggaaaaacatgccctaataaggaggactaatcaagaaattaaattttctgttcaagcaattatagaaaattgtgttaaaatagcacagacatagccaagtgcttgagaaaaacatccatttcttcattgtgtatacttatcagtagaaattaataaaattttactagccttgtatttatcctcctgtatatggcttgaaattactgcaataatacatttttaaagaaaatactgggcctcatccagttatgtagttaatgatagacttaatccctcagaacttggttcagttctgtactactaaaatgacttaataagatataagacagaaagaaagaaagaaagaaagaaagaaagaaagaaagaaagaaagaaagaaagaaagaaaggaaggttatattttgtcaagaaggaaagggcagtatggttcaatacctttacttaagtaacctttacatgtgcaattaacatttaaaagaaataaaattttggaagcattatagagtaattgcataaatgtaaaaagtagttagaaacctgtgttctgttaggagaaattccttcaaataacactgacagttatcagaaagtgaatttatgatgcataaaagatgagaaaaaaaatctcatcatttggtggcatatttactgctttctcctttgttggtgttcttctaccttttttttttttaaagtaaacttcaactcactgacattttctaggattttcatcctcacactgatctgatctttaaagcacacattttgaaatagttgttgggggtgagggagcatgctattgagcagcagcacaggagggagaagaggaattcatcatgctgtaaaacttacagaccatttgcctatcatccaatcattttttagaatctattacattgaaaggttcatcttttgtttgtttcttttttttttttctactatatctagctttctgcccctggaacatatggtgtgtatatgaactattaagcaatctttgcaatttattcacagatcagaagtagttgcaatatgaatcaaacactaaattcaagagctatttttttcttgggaagagaccttggtaatatgaattttataataccaatttgatctgtttgattacgtgtctatatagtgggtaattgttcctggtaactctggtagggctttgtttgtttgtttctttgtttgcagaagcttctaagttgaatgtttctaagcacctctgcaaacaactttcccactcgccaaatgaattttgccattaccatgtagcagctcaggatgatttttccccatttcctatataaaatgattctaggagtaactgtagagcgacagaaagattaccacatggtatacgacagaaagattaccacatggtatacagaagcatttgatgtcaagaatatatgttttttttaatggaaaataatggaagcatgggcttttcctttcatcattttcttggaggtgggacatttaagggttggaatcaaaaccaggacatgagacatatctctcctttctaccagtttcatgggcatgaacatgtttggagtaattagcctgggcttgagatacattgaagagacaaatgtgttgcaccctaaatcattctttagaggttttctggtctcagtctgcttgttgcttctttggggatccttgggtctcaggaggaagctcagtagtctatcatacagtgtcaacctgattctcaggatcagcccattcttttcatactgactctgctgatccttcttcctcttcctgtcagaattttatggggtttttggctacaggttgacaatgtttgtataattgcctttaggcatttcctctgatgattgcttgcagcatggattttcctagttgttgactcattgaagcaatccgtgtgtgtttcatattgtggtatcttgttttcatcattattcacatacagaacctacaaaatattactagttatgtacatgttaaactcttcttatcaaatgataccttaagttagaatatataccaaacccattgaatgcttaaatatttcatgtagtttttcatagaaaggaaagatgaatcatctctatggagcctgttttcatatgaattaatagattatagtgaaacataaaataaaatagtataattttgacatctgaaattctattttagacttgatattttttataatcatattcatagtttaaataagttgaaatttaaagttttaaatgtgcttaattacattatttgataatttattaatgttgttatcccttttaatttgattgcccatagtgaaaattactcatgttacccaagtggatctttgtttttcctttttttgggtttttcttttctttctttcttttttttttttctttttctgctttcttgagacggggtttctctgtatagcccaggctgtcatggagctcactttgtagaccaggctggcctcgaacttagaaatccacctctgcctcctgagtgctggaattaaaggcgtgtgccaccacacctggctgttttccttatcagtataccaatagacacatttttaaaattactaattttcaaaccttcaagatataagatcctagctactggactggagagatgtcacatctcagtgcttaagagagctcttttacaggattagttactaatattcacaatatatagaccacacttgtttataactccagcacattgggatctgatatctgaacttcttatacattatatacatataggcaaacaacacatagatacatatatacaaagtgtttgcctggcatgcacaggcatgcacaggtgtttgtccttttactgctaaaaatattttttaaaacaattgaaataataccttagtgattatttttcttcgtataggacaattatattagtgaatggaaatatatgtatttgatttcattttattttcatattatatatgattatatacatattttaaatagtatagtatttttattagatatttgctttatatacatttcaaatgctatcctgaaagttccctataccctccccgcaccctgctccactacccacccactcccatttcttggccctggcattccactgaactgggacatataaagtttgcaataccaaggggcctctcttcccagtgatggctgactaggccatcttctgctacatatacagttagagacacgagctctgggggtactggttagttcatattgttgttccacatatagggctgcagacccctttagctcctttggtgctttctctagcttctccattgggggcccttttttccatcttttttaaaaaattaggtattttcttcatttacatttccaatgctatctcaaaagtccaccataccctcccccaccccacgcccctacccacccactcctacttcttggccctggcattcccctgtactgaggcatataaagtttgcaagactaatgggcctctctttccaatgatggccgactaggccattttctgatacatatacagctagagaaacgagctctgggagtactggttagttcatattgttgttcaacctataggattgtagacccctttagctccttgggtactttctctagctcctccattgggggctctatgttctatccaatagctgactgtgagcatccacttctgtgtttgccaggccccagcatggcatagactcacaagagacagctatatctgtgtcctttcagcaaagtcttgctagtgtatgtaatggtgtcagcttttggaggatgattatgggatgcatccccgggtacggcagtctctagatggtccatcctttcgtctcagatccaaactttgtctctataactccttccatggctgttttcttcccaattctaagaaggggcaaagtgtccacactttggtcttcgttcttcttgagtttcatgtgttttgaaaattgtattttatatcttgggtattctaagtttttgggctaatatccacttatcagtgagtacatatcatgtgagttcttttgtgattgggttacctcactcaggatgatgccctccaggtccatccatttgcctagggatttcataaattcattctttttaatagctgagtagtactccattgtgtaaatgtaccacattttttgtatccattcctctgttgagggacatctgggttctttccagcttctggctattataaataaggctcctatgaacatagtggagcatgcaatacctctcctgggcacatatcctgtgttctatcttatagatgactgtgagcatccacttctgtatttgccaggcactgacatagaatcaccagagacagctataccagggtcccttcagcaaaactcaataatttctgggtttggtggctgactatgggattgattcccaggtggagcagtctctggatggtcaatcttttcgtctcagatccaaactttgtctctgtaactcctttcatgggtattttgttccctattctaaggaggaatgaagtatgctccagttggtcttccctcttcttgattttcttttgttttgcaaattgtatcttgggtgttctatgtttctgggcaaatatccacttatcagtgataatgacatatctaagcatatctaaggacttcttttttgattggggtacctcactaagcatgatatcctccagatacatccatttgcccaataatttcataaattcattgtttttaatagctgagtagtactccattgtgtaaatgtaccacattttctgtaccaatatatacaaagagctcaagaagctggaatgaagaaattcaaacaaccccattaaaaaatggggtacagagctaaacaaagaattctcaaataaggaatatggaatggctgagaagcacctgaagaaatgttcaatatctttaatcattagggaaatgcaaatcaaaacaatcctgagattccacctgacacaagtctaaatggctaagatcaaaaattcaggtgacagctgatgctggctaggatgtggagaaagagaaaaactcctccattgctggtggaattgcaagcttgtacaaccactctggaagtcagtctggaggttccttagaaaattggacataatactacaggaagcttcagcactacctcgtctggccatatacctagaagaagttccaacttctaataagaacacatgctccacagccttatttataacagtcagaaggtggaaagagcagagatgtctctcaacagcagaatggatacagaattatatagtattttaaatagcatggtattttaatacttgtgccttaatacaatggcatctattgtatatgaaagcattagtagagagacagaattgattgggaggaaagaaaaggtgaatgggggaaaattcagtcattgtcatatagtgtatttggtttccctggtttctatttgacactgacttacttctttcctagttttgttttgtttttctgtacatatgaagcaatgtcttcctttgttttccaggacacctaacatatattatatacttgtttcagcctccttggtcctgaaattatagtctaaacctaccataccaggcctctgcgtatttttttttaattgtgaaaaagtaaataacatctttaaagaaaaaaaaactttattgacttaacctattgttattaataatcgaatgataaacacattccactgttctgaacacatcacatctattttcaggacttccttcatcttaaagagaatctctgtagccagtaatcccccaggttctcattgtccaggatcatcacttgtgctttttatcactctgaaattggcttcttctagatatatactatgaatcacatactacaatatttctccctttgccgtctttcacaagtaaaacgtttcaagtaatgttgtccctattgtactaagcatcaaagcttggttctgaacatatactacattttgttggcctattgctcatatacagatgacattttccatcttctagaaaatggataacaattctttgaacatatgtatacaacgctgctttcagttcattcgtgtacagacctaggactatccaaagattgaggaaggtatcggtataaagcaacattgtgagaaactgaacattacaattgattacaaggagactggctggggaagtggcttaacctgagatagcagctagcagagcccacaatttgtcatttgaaaaccaaatgtcctggaaaggcagtggtgtgattccacacttaagggacccccaatctgtggggtgctaccctctggaacctggattaggcacagtacattctcaaacaccaattttccaacacaaatcaaattcaaagagatcctttattaaacaaataaaagattaacaaggtggctgaatttaaatcaggcagaaacagcattggatagctttgaaagcgttaattttaacaggaaaaaaaaaaaaaaaccgtggtggaagcttatgttagaatgagctaccacatgttggtaatttctgatgataatatttccaggccgttggtcgtgggttctataagaaagcatgctgagcaagccagtttaacagcaccaacctgtggcatctacatcagacctgactcaaagttctagccctgtttgacttcctagcccgacttcctttgatgatgaatgatgatgtggaagtagcaaccaaataaatccctccccaacttgcttttggtcattgtgtttcatcacagcaatagaaaccctaactaaaatatcagcatgttttattttcaatttttttatagaaaatattgtggtaaatatgaaataatggttttgtgaataccattttgaacctgttgtaaatggaatcgaaactaaattgaattttacatcatttattatctctgagaagtgtgtgttcgtgtgtgtgtgtgtgtattttgcttcatatgaggtcatatgatctaaagacaaaacataagtttgaccttttttgtattaattttcattgctgatgagaaattttttcctagatacacaattttaattgtatttctcaggttattatatattgataaattatttgatttttctctgactccaatggttgcttttgaaacgtcaggtgcttgtaaagccacttgtatgtgagaaatcatttctcttctcttactacattaagacttaactagtttttaactagtttactgtgtactgtaatgtggctcaatgaagattactatgaggttagaatatataaattgatgaagttcctaagtgtttatattcatgtctatgaccttcaggtttaatcattggtttgtttaaaatatttttttctattgctttttctccgtttttctttcttttgaaaatagtgtgaggcaagatctggtgtacagtatatgaatccatagttctcaggctcgattttctcctttacttacccgttttcctgaatttgtgacccattttttaagaacttgttcatacatcatttctgcagaggagctttctactgttatctagaactagttttgatgactttagtctcttacattttattaggatttttctgtacactgatctatgacctatcctagttatttaaaaaatagcctgatcatataataataaaggaataatagcaaagtaaatcacatagaaaataataataactgagtattagctacaggactaatgaaactaactttatgaattaattaagttgtctaataaaagaattttaacaaaacaaacctgaaaatgtgtaattatgagtgatctagaagtaatttacatacaataacaataccaaaaacatttgcaaagccagtattaaaaatgattcaatcatgcatgtttaatcactgacatagaagatagtattgaatgttcgaatcagaacgtacattgtaaataaagttctcaccagtctttaatgttattgatggttttcctttctttagctggttttattagtgttgttatcaagttagcaaatactccttcctctttattttaaactatttgtgaaataattattttgttttgtttaattagttgagacaattcctctttgaatccataaggtccttgctttttctttatttgaactttctgatttgtgacttaatatctttcatttatcagcatatacaggtttttcatttctttttaagtctgtttttttctttcgtgtagaaattagcttttttcattctagattatctgatttggggatatatagctataaaggaatatatgggtctctaatatattgacaccccttcctttcagacctactttatacatttttaattaaaaagattgatttacaaatatgattatttgagttatccatgaatgcttaacaattttactggtcaaccactgatgttttatatttttctttttagaatcttgtaaaatatcttcctgaccagaacgcactccgagaactagcccagcttaagagtgaatatgatgatctctgtgagcctgagcagtttggtgttgtggtatgtattgatgattccaaagtcctatgagtttacatctcatgaagaaaagaaatatattagtagatgtcttttgctttaaaacattataattaaactagctgtctcttgtgagactatgccggggcctagcaaacacagaactggatgctcacagtcagctattggatggatcacagggcccccaatggaggagctagagaaattacccaaggagctaaagggaactgcaaccctataggtagaacaacaatatgaattaatcagtaccccggagctcttgtctctagctgcatatgtatcaaaagatggcctagtcagccatcactggaaagagagacccattggtcatgcaaactttatatgccccagtacagaataacgccagggccaaaaagtgggagtgggtgggtaggggagtcgggggggggggagggtatgggggacttttgggatagcattggaaatgtaaatgaggaaaatacctaataaaaaatatttaaaaagggggctggtgagatggctcagttggtaagagcacccgactgctcttccgaaggtcagaagttcaaattccagcaaccacatggtggctcacaaccacccgtaatgagatctgatgccctcttctggtgcatctgaagacagctacagtgtacttacatataatagataaataatgaaaaaatattaaaaaaggaaaaaaaaaaagaaattccgtcagatctggctgtagggcattttcttaattagtgattgctgagggagggcccagccattgtgggtggtactatgcctgtcctggaggtcctgggttttataagaaagcagactaggcaatctgtgagaagcaagccagtaagcagcatccccccatagcctctgtatcagcttctacctccaggttcctgctctctttgagttcctgtcctgtcttcctttgatgtcatacaaagtgatatggaagtgtaagcccaataaacctcttcttcctccccccccccaaaaaaaaagagaaaagaaaagaaaagaaaaagaaaaaggaagagaaaaagagaaagagaaagaaaaagaaaaagaaaaaggaaaaggaaaaaaggaaaagacaagaaaatccagagtgttcatgtggtggggcatgggtacctgtaagagtcatagcttccatcaccaacatctcttatatgaacaataaaggtcagagatattgtgttttacaaatacacattaaacttgaaatggaatatttcctctataaatcatatatcagccagtgacggtgactgtaataagtaaatgtggcctaaaagtattatggacactgctcaccatgcagtgaagttagatttaatttgatgtataataagaaattttgtacaacatgttttgggctattttaggcaaagatttagtgcaagcctcaattctactggtatttgtaaaagtttatactcttcctctaaagtcatttgaatcaacttcattgcatatattaagaaataaaaaacaatctttacctatagcattaaaagtaactaggttacttttgacatttataaaatatgccaaaacatcatgggatagtctctttaacagtgctgatatttaattaatttaatatattaatgcatgcaaactggtatgctatattgcactgactaattttcttcccctaagattggaaggttagaatttagctccctcaaaactttgaaataaaagaataatatctatatctatctatctctatctctatctctatctatatctaatagaaactgtttttactatattgtgtaaaaagaagcacaagaattttcaaatgttcttgagtgtccttaattaattgagagtttgcaatgtgctatttcttcaggacaaataacatatagatacctcaggtactttaatcatttttcttatccccatcatatgaagtgccaaaaaataatgactatttatataggatgtagtcatatatcttaaaatatcacaaacttcttattcaaataattagccacaaaggtagtataaagggcataaagtttaagggttttcttttttaaataaaactattctttccagagatgggggctgaatccacagcattgccctttctagatgagcactcttccattcagcctaatttccaacagctaaaagatttttattattattcttcaggtgttcggggcagatttttttgctttatgagtgagcaattattttatagtttcttgttaattttgccttcctgatatttttctatttgtaagcaaaggggtatttttttccaactaccattggacctgtttttctaagagtatctagaaagtttcatccaaacttttgtgtaatattccaaaataattagcattaacctgagttcctactttgcagttttaaacttttgttcatatatccctcaattagatgggactgagtatgtactttttagcaaatacagtaaatggttttttttttcatatttacagttcttttattctaggacatgctattgcctaccttgaggtagaaagatttgtcaaatctttggaaaagaaatcaggcaagcatatttgggatcaaataggacatatcatggtcctagggagcatatttctctcatttttaaatcagatctattagtcaactgaattggctctgtattatttattaactagtcgcactttaccagagtgctaaagaataaaatttgtagccccaagtccacacttgaaacctaagctgctcaaatccatcttataattgaagcagggctatacactatctgagatttcagctgcatcctcctggttatgagttttacagtaggtacgctacacagtttctcagaaaccatttttccctcagtgcagtttatctaagaagatgtattagtttgtcaagcaagtccttcaggagaatatccttggtacctcactgaggaaatgaaattgggtggagggggcataaaaagcaatataccttcaggactaaaggcaaaaatagaaaatggaagagatttcttgtttatgcccattatcataaatatttaagtctgtgtgtgtacatgaactgtcctagtctccccctttactctcactgtattttgctgtatattagatgtggtgggatcagagagaatctacattattcctaggcagttcacactatgtaaattgctagagaaaatcaattgagacttaccaaataaactttaggcacactcttcttaatttatactaataaccctaataattaattaatagtaattactaataaccttagccttttaaatttatgtaagtctctgtaaaataggcagtaaatatttttgaattatgaggaatatttcatacaaaagtgtgagtaagagactttaaaaggacagaaaagtaaaacatgcactaaaatattatccaattaaattagctctgtgagaatatactatcatcctatttagactttgatttatatcagctgcctaatgtgaagaaagcattaataggagaatcctcaacttgataaaaacccatggcctcagctttcttcacccattgccaatattgcataggatattcttatcaaaaactcctatttataattccaataccaaaacccttcagtgtttccttgacttcagaaaataaggttcaagcaccacattttcctcctttctttcatttctcacatttcttcttctgcctgtcttcccgttcttttcccttcccatgaactctttcttgtccgtgacatgacaaaagcacttctggacctcctgtgtctcttctgcctccgaagctgttttggatttgtatcacccagaattgtctcttcatttatgggcttcagttagcctcctgtgctgacctcttaggtaaccacatatgtacctgctcagtgttgttctcggattaatgctgttgttgttcatgaatgagcccagatttcccacatactggccttctcagtgactttctctgctctcctctttgctggggttatggatatatgaatctgtgtcttttcatgggtactaggaacttaactaaggtacttgtgttcatatagaaaacaattaaccacccgagacatgttcctagccatcaccaaagtattaactgattttagcctctcaggcccattttgtcttcatgctgccaacctttcttagctttagctattaacctttgtggtgcactgagctcactgtgcgcatacatactgaatttcatttgttgggggtgtgaacttatttttttcttctcagaatcatatcatctctagttcccagtctttaccaatagttttgaaactcattcttgaaatcttagcatagccatggggaccccaatggaggagttagagaaaggactgaaggaactgaaggggattggcaacccataggaaggaaaacatcaaccaaccagacctcccagagactaaaccaccaaccaaagagtacacctggagtgatccatggctacagccacatatgtagcagaaggtggccttgctgggtatcagtgggaggagatgtccttggtccttggaaggctcattgtccctgtattggggaattccagggcagggaggtgtaagtaggtgggagggtgaaggaggacctttatagaagcagaggggggagggagaataggataggggatttacagaggggaaaccgggaaagggttgaattgtaaataaagaaaataaccaataaaatattcctttctagaaagtgataatttaagtaataagttaataagttattttgaggttactagttaaatattagttaaatatgttctctaggttataagttatacaagtagatgagacatattgatatctctcatgatttgtacctaccaaattattgctgaatatgtttgcccagatacaaattacagtggattctttcctctcctgtcttactctcagttcacatgccagtttctaacattgacagatttaaacattttaatggaatttttttgtcttccttttttcacccagtgacaaattcattattgctttatttcagtaccacttgtccagtacactatagaattcccattaatatataaccccctagataaaatggagtctcatcaactagggaaagatgagtgtcatacatgagattagttctttgatattgattaaaatattactacctataagaaacaatgaaatccacaaaacggtagatatgttttcacggatataaaataaaacttacctgagtcagaccctgtgttgtgagcttctctaaccttttgtttttctgaactgtcacaaccttgggcttgcatataatcacttgtaatcaactgggaggaaaaaaaaaaaggaagggattaaactgaaacaaacaaaatcaagcaggagaccttccctctgtggaggcagacctcccagctagagggacatgctccttcctataccttctgtgatcaataatcttcatctttaaaggaatggattggctgcattgcttcccactgacttgtccttcaacctacctcctacggaattgaatttggtacacacattgtaattatgtgctgtacctttactggaagaacagtacagatctttgaaagctctgacagtcagaacccccagctggagcttttagatgcttccgagtgtgtttgcagctcagctgctctcaaacctcagagctatggaaattcccacttgtcttgcactggggacggaggcccatactgtgtatatctattaaactagcatgtcttcggaggaaagaaggcaataattagttctcttagtaatcagtacttttgtttttctgacttcaaaattacccatatttttcaattaaaaacattctcaagctataatctagagggaaaaagatgttttgatagcttcgtagttgtaaatcattaatgaacagaacagattatgtgatattactgacagaacaatgctatttttttcttacttcttctgcacaaataaatgaaggaaaaagaagaattagaactgcaactataagcaacttttgctttaattgttttaaagactgaaaaaagagcttacagaccctaataaagaaagcttaaccaggtgaaaaggagactggtaaaaagcttccatccccctctttattatatcaaaagcaagtagtttagaaggaaaattgtaggttttgtaagtattacatcattttctgcgtttgcatattcattagaaaaaaatcacatttttcttcattttgctggaaatctgtgtgttcagtgttttagcaagcaacgctcaactgtttctggtttcatttgtctgcacatatgaatgccagctttcacttgtagatgtgaataattttatctgaggaaagggcatcttaatttttgattaattgagagaaaattcactgagtcattcacaaatccctatatttatattaatggtcatttcactaatttctcatattaatctattctcatgataagattgtttgttgcgatcaccttttataataaaactaggcaaaaatcaaaccacctgaaaatttaatattcctggtagttcagtgcttgtcaatcagttttgtgaatgattactttccattacattttaaaatatcaaaatttcaccatcttatttattcccttatgtgtctaatttcctgataaaatagcacagcttcacagtagttttaatagtcatttgtggcctcaaataggtgttttgacaagaatattttgaaattcctattcaacttctcagtgtgaatcctccgagtttacagtgtctttgggggcagacattgttattgtgttctgttccataccaaaggcgagtagatgtttctcaatgcataatttccacatatcactatctttggggaaatattctctatcaccacatcattatttttctgatgtagagtcagttttccccactctattttttaaagcttcaattcacagattaaccatggcccttatctctcatgacagctaatgtgaaaacatttccctttgtctacctatagcaggaattcttgtattgattactttctctacgtactggatttagtgcacggggtaaagcaataaagaaaagcattcctgcccttgaagaaatgattgtgtgttacaaaataagaaaattgtccttttaacagagcatcccaaatgtttctgcttcatctctgtaactccagacagaattttgcctctgaatttaactgtgaatcgaagagaaatccatcctttaatgtccctgaatccctcctgtttatagtaaaataagaataaaccttttgtaaattcagtgaataatacctgttaataatgaatttctctctccatataataactggataataacagaacagattctgttaatttcaaaggactaaagtttctgtttggctcaaatatgatagacattaatcaaaggtgaagtaaataaccctaaaggttacgtcattcatgcatcattcttagcactgctgcttcttatctttttctttgcattctcgtggtattttgctattagatctatattcaccaggtttatagttatgaagtatatacaattcaaattacatcaatgaaactgtacatagctctttggggaaataacctacttgtagttctctcactaaagctgtcgatgcatttttttaatatagtgcacataagctgaaaaatgagagtcacttgatgtgatttgatagacaagtaacttgtaacacaaataaatcccctacataatacaacaccctggtcagcatcccacatcacttcaagaagtgaattataaaatataggatgccagtcaactaaaacgctgcgagggacctccacagcaaagaaagcatacattcagcagcgtctgaacactcaagcacctctatgagacatgatccttttaatagttgtatatgtggctggggatgtagctccttattattcgtaaccatggctatccatgttactcctttaaaaaaccaaaccctctgatggcaaatcagcttttgcccatcaatacctactgatccaactgttaaaattcacacttaagattgaaacaatccgtgttgatgtgttctggagagagtaattgatggatagagatatcctcaaatgaagtcactttctctacagtctcttgattttctttaatgcggtaagaaatatacattatgtatattgtgtacgaaaacaggagcatgatattttcagtctagccagtggataatgagccacattcttcattaactaccacagacacacattacttaattgtggatccaaaaagactttatctcatatttggcagacacattaagatcctgtgtccttcttgctaggggtttctaaggattaataaagaagatgaagctaacagcggtgactatttccctgtgcttaaatggtatcacttgacaccacagacatgttccatacaatatcccattgatgtcctatggaacatgcaaaaataatttaatgaatgtgttttgctcataaacactagctaactttacgttggtcactgtattagttagggttctctagagttacagaacttatggatagtctctatatggtaaaggaatttattgatgacttacagtctgcagtccaactcccaacaatggtctgtagcagctgtgaatgaagtcaaaggatctagcagttgttcagtcccacactgcaagcagacaaaggagagagagccttccgtcttcccatgtccttatatagtctctagcagaaggtgtagcacagattaaaggtgtgtgccagcacacctttaatgccagatgaccttgaactcagagatctctctgtattaatcttctggaatccatagctactatgcctcaagatctccataccaagatccaggtcagaaacttctatctcctagcctccagattagggtcacgggtgagccttccaattctggattgtagttcattccagatatagtaaagttgacaaccaggaataaccactacagtcacatagctataaatcgacaaaactagagattgggttcactactgcaaaacttaaaaatctgtatcttcagccaggcgtggtggcgcatgcctttaatcccagcacttgggaggcagaggcaggcgggtttctgagttcaaggccagcctggtctacaaagtgagttccaggacagccagggctacagagaaaccctgtcttgaacacccccccccccaaaaaaaaagatctgtatcttccttgtcaactaatgtaatgtctatggatagtatagatattttatttttgctttttcttggaattaaaaaaagatttctcttaaattctaagcttaaaaaactttatatttgttctgagtattattgttggaattaaccacctactgtcaaatagtgttttgtaagatcttgtagccttcgccaaaccatctgtgtcttctttgtgttttttccttataaaatctcatgtagccaggccgcagaggatggccagtataggggaatgccagggccaggaagtggaagtgggtggattggtgagcagggggagggtgaaggggataaggggaggaggtttttggagggagactaggaaagaggatagcatttgaatatttgatatgtaaataaaaatctaataaaattaaattaaatttaaaacaaaaaagtctcatgtagcttaggctggacattaacttgcgttgtagctgagggtgactttgaacttgtgtttcaacctgccatctactgtaattttaggccagcaccaccatccttagattttatcttctatgcatcttcttaatgtactagtggttcccagtttgtgcaaatgaatatattcagaaatttttaatcatctatcatcatctgccatatattaaactggtgtatgtggtgagtgaatgaagaaaattttgctaaattaatggtacctaaggctctgctgcggttatcaatttcttctgaagtcagactgactaatgacagattactatctaataattgctattatacaaatgcaattcatttttatttgatggttggcatcataactaatgtcattatttgggaacaataaactagcatctactcttaatttcattcaatatacaatctgtctttcctgaaaaaatatctgggatttattattcatgtaaggaatattagtatatgttagcaaatattcaattatttaacatatgcaaggccctttactatgtgcttataattgtactaggtaaataattggctcttttctccattccatttcttatacttgccttcgcagcgattttgtcttctaaagtatctattcatataataattaaattcaactctatttcaaaattttggtaaatacgattgtagtatcatattactccctggtcataaatgtatcattttattaccaatgtgaagatttagagggtaaaaggttgaggctttagatcaatcagttagggaattaaagtagtatataaataaaataatcaagtataatatatatgtatagaacatacacacataggtagatagatagagagagagagagagagaaagagagagagagagttataggatcagtctgaatggcagcatgttcaataaaggacatgttaaaatgtgggtaaagccaggcgtggtggtgcacgcctttaatcccagcactggggaggcagaggcaggcagatttctgagttcaacactagtttggtctacaaagtgagttccaggatagccagggctacagagaaagcctgtctcaaaaaacaaaaaacaaacaaaaaaatgtgggtaaaaactgtcaatatgcagtgttgcatgagcgattataataatttgaattttagtctgacattgagaatcttaataagcagtagctaatagtgtctttgttagtaaaaaaaatgcagtattggtacataaaaaaacaccaaccaaattcacttcagtcataattacaacatgcagaataacagtattttcttgtaaacgttcatatttgcaacaagtatctttcattctaccttcccacaacttagaaaaataatcacaataattttcctatgtttccagatttaaaaagtgataatctgaaaaataggtagataattacacccagaaaattatttttgacctatattattgctaaactgcattctgtctgcctctgctgtctctcttagtccttgatttatcctccttttgtttatatcacagcagatcccaagcacattcatctttccacaagccatgaaacaaaatgaacaagcaaaaactcaccaattccataccaacaccaacttcaacttctaaagtttttaagttttatttatttttttagttttcatccatgtggtagagacaggcagtaggtgagacctgagaacagacatacacacccacagtaatgaagtagagattgaacagaaagtgatatgagactataaacacataaagtctgcccctagtgatgtaatttttccagcaaagcatatttcataagcctgcccaaacagcttttccaaagagtgaacaagtgttaaatacctgagcctatggaggtatttctcattcaaagcatcatacataaatagttgtagtgcaatgacaacacacatttcctaggatgttttggagaattaaatcattcatgcagaaaaatgtctgacagaaaatcctcaataaatgttaagtgttgttattgctataactattcttactacaatatacttgttagctatactatttctgctgaaggcaatagtaaaaagtgaacaaaatcaaattcatactctgaggttttatgttaagaattgaaatatagagtcaaggcagaataaaatataaatgtacaaatgtgttattagcacttcaacaagactgaaagctcatgcatatctggctaagttcacattccttgttgattttagaccaatgctaccttggtggactggttcctgtaggatctctacacattccaatagagcagagagatgttgactagatgctgacacaccctgaaagtagatggcattttccattagactagggtacaagactgaataaagtaagaaaagaaaagaggaaaaagagatgagtgtcagcattgttttctttctacttcttgtctgtaaatacaatgtgaccaatcacctaatgttcccactaccaagccttccctattatgatgaatctttttccaaggtagccctttctcccttaagctgcttttggtccagtatttgatcgcacaaacaagaaagtagtcatagaaggtggtttcataaatgtatatgatggtgtacaacatccagagcactcactgtagcaggccagttttgcattaactgaaagaagaaatggtttcaggagagatatggagacagacacattgtgacgtagtaatacatacagaaacttgattttctaaacatgtatacacagagggacttgtacatgttggacacagactttaaagtgataattttccagtctcatttactttatatggactacatgcagtttcttatgtaacattcctatagttataaaaacatatctgctcaacctgtgaaccagttctcatataaatactgtctattattctttaggtctctttcctgtgtgttctcttttacatatatgtaaacaaactgaaacactagtgtattattttctctattgagaagttcttattaaatattgcagtggtttaattcttccaggaaacttctcttgaacttacgatgtctttacctatctagaattgtgtctgttttatttcctgcagtattcgtcacatgtctgtttcacgtttttccagatatatgtaagcaactgaaaataggtagtgtgcttagcgtttgccaagagagtactgaagaaacatgagggcaatttgtatacttgaaacagaatagtccaatgtgttgagaggtatataaatactgaagcagggcaagagtcactccatttactttatatatctgccaggaaatggtatgaagcaatagacttcatagaagtcaattgttcacatagagagacagatacccacagttactaggcaagttactgtaaaaggtgagcctcagaagtggtttgcctcactactatagccatcatagtttacccaggaattcatgtgtaactattgaaggtgaggtacgtacatttctcataaatgtgacaaacaatcttacagaagggagacaagggttatttggcgtatgttttcagatttaattccatcatctcaggggaaggcatggcagggcagagcagttaatgatggttggatgtatgtggcagaagttgtccacaccacagtagaccaggaaacaaagtttgtgacagttgtacctttccaaatgctgcacctcgtaagtcacttcccccagctcagtcatacttcttaaggtaccacaaatttccaaaatcatgccaacagctagtgaacatgtgcttgaaacctaatcacatggggcatgacagaatgtacaatagaagggtgctctatgttttcaaaacagttcctccgtgttgcaattgcatgtggagctctctggaagactgagattaaaaaaagatcaaaagttgaaaaccaactttggctacaaaatgagaacatatttaaaaccaaagaacttttgttcatgcattccatgaatttcatgctgcttgcagatatctcagtgcctagtctgtgctcagcatttgcatttaagtgatgtgccaaattgagcataattagcatgtttaatgatttctattcattgtgtgtgcagaaaacgctcctgggtacctagtctccacccatccctttctctgatttcatttggtaaattaaaactaattaaataatctggagctaatggaaattcaaacctcaaaataattattattggagttataccaaagagaatttgaaatgtgcattaggattctgacaaaaatataattaaaacacaagttgaactgttttgaataaaaccaacaagaaaattttgaataatgtattattaacactgacatttgacatgcaggtgaaaaatctttaggacatatttaaatattcaccaaattttatgaatataaatactaagcacaaaaatatgaaatgattaattccagttactcctttgactacaacattatacgggcagatactttctttagaaaagatggttgtattttggccatcatgtacaccctctattcacttagctcaatttcataatataagttttccttctttatctcaggaagacattttgtctatttgtatgctatgaatgatgaaaggcattacaattaacatgtagaagctgttcacacttagctgtgtttgatttaggttataatcttgattccgtttcttgtttaacaaacctgacctcttttgagctttttaaactttacctaaatattccttggaaagtttagaacaaacaaaagcagtatattttaaatgtcagagagaactggctatacttggaatattgtccatcagtttatccccaataaatagatgaaagaacattataaaaagatgttctcacagagattccttatcttacagatgagcacggtgaaaatgttacgtcctcgtctcacgagcatccttttcaaactcacctttgaagaacatgtcaacaacatcaaaccaagcatcatagcagtaactcttgcatgtgaagaactgaagaaaagtgaaagctttaagagactcttagagttgattcttctggttggaaactacatgaactcaggctccaggaatgcccagtctctaggttttaagattaactttctgtgtaaggtaagacaccattttatagtattaatttataacagtcagtttttggtatgtgagttgaaattaactaaatggaaataatctatcaattctaaatcacatgtaattggagcgatgttgagagcatataaactatatattgagcaaaataaatatttttatatatttttgaaacaaaattcaaaacactaaagtcttttttgtttatgcctttctggttgaatcttactagggaatagataccctataaaatttgtctagataaaatagatttaccctaatattccacgctgtttgtggttattttatgtctctggaaagttttttgaagacttaaattagatgaggaaatcagtaatttttcttcagatatgctttgaataatctactatatgaaaatgaaactatttattggtaaagttgagctactaggagcacactgattatcacaatagcagcctagaccattaaaaatgaaatatgaatattactcctttgactggacaattcttattatttttgagacttatgaaaaggagacaaaaaaacagagaatacccagagtgatcatatgtgtccaagcagggcaagccaacttatttatggaaaagatctgtctgttatacacagacaattgaaaagattctgaggtgaagccctttgaggaagcttgagatgaaaatgtgtctgaagagaagtaatttttctttgacaactccccaagctttcactgtttattccgctttcatatctgaaaacactgcagaggtttggctacttctagacacgtattttaacaacaatcccacatggtataaagtatcttatttttcatacattaacccatgccagttgcaaatccagaaactatcattttgatatgcatgaaaaatgatttgactgtgataattctaatatatatatatatatatatatatatatatatatatatgtatatatgtgtgtctctgtgtgtggggatagcatgtataaatgataacaatgatacataatcatatatatatatatatatatatatatatatatgtatatataaaatgagattttgactatctctttactcctgatatttcttagttataaaaaaagataataacaaaaaatcaacagattaatttttattccctatttttgttgtagtagggaacacatcatttcatcagacaatatcatgtagaataaggtaatatttacaataaataagaatacctatatctgtatttataaggtaaaattatttcaggcttgttcattcaattataggacatttatcccatcctaccttactaggatgctaattggtttgagtatattctctaagtatagtttataaatctatacatttactttactattatgaaaatattgaatattaaagaaaatgtcagaaatttctattatacatatttaaagcatactttatatatctatattacatttaagttatatataaaaaatcttaaacaaattcttctaatttgaacaaatataccaatttcaaagtgccatatttttaacttattcatatttattatgtaaatgattatcttgaagagaaaatgaacaactcatatatataaaagaacaaaagattatactaatctcacataaagattttatacttatgtcttgtattttggatagagagatttctttctgtcatctccctgtcaaataaaagtttttccatatagcactgatctgacatctatcactagaggtatgctcaaaggatttagcacaaagatttttgccaacttcaaataaaataaaaaatcgtcttggggaaatactatcatgtagtaataggtattctaaaggaaaaaaatagtaaaggttttacaatattccgccacactttcagttggatttttatcatctgggaaatactttgggggaaatatatgtcattaatacagagaaatatcatatacatgcacgatattcccacaatgtttaggaataaaaggttgttcctaaaatacaaagtattctgactagatgtaactgtctaaaatgacaaaaatttactgaagtgaatagaaatagttagcttagatctgtaatcttttaagatggaattaacttaccactgatacgagattagctacaattgctgttaaacttgatttataaaagattacttgtatgattttctttctttaacaaattgcagagggaattcgttctgaaaaatactgattatgcttcaaaagtgataccatttttcacctaaatttttctaatgataaatctttttctttgatttaaaattaccatctactgctttttacaagaactctaaaacacattaaaatattcatctcttgaaaaacgaagcatgatgtaaataattaaatgttatcagatgtgtttcaatgcataatataaaatatttggatgctcaaaattcactgccatgttatttaggaataaaaggaaaacaaatggattaaccgaaatgccaagtaacatgaatggatacagtgactataaaatgctttgttaatttcaatagtgcattagctcttgtgaatcaccaaactggtgtgccctgctcaaaaaaccaaaccaaaccaaagaaaaacaaaatcaaaaaatatgaaaactttttaaatgagtgattttctacatataggtcatgataccttcgggggtctaatgactctttcacagggcttgcctaaaccagtcagaagtcaaagacatttacatcgtgattcataagagtagttacattacacttatgaagcagcaatagaagtttgagaaccactgatttaaatgaagctgaacttacaatacaagattttactatgtttcactgttagccattggaatgctgagtgtaatagcatatataatatacatgccctgaaaatatcccaaaataccaagcattctctatacattggacatagtactatcggaggatcccgcaatacctctcctgggcatatatccagaagatgtcccaactgttaagaaggacacatgctccactatgttcatagcagcctcatttataatagccagaagctggaaagaacctaggttcccctcaacagaggaatggatacagaaaatgtggtacatttacacaatggagtactactcagctattaaaaagaatgaatttatgaaattcctaggcaaatggatggacctggagggcatcatcctgagtgaggtaacccaatcacaaaagaactcacatgatatgtactcactgataagtggatattagcccagaaacttagaatacccaagatacaagatacaatttgctaaacgcatgaaactcaagaagaacgaagaccaaagtgtgcacactttgccccttcttagaaatgggaacaaagcacccatggaaggagttacagagacaaaatttggagctgagacgaaaggatgtaccatctagtgattgccatatccatggatccatcctataatcagcttccagacgctgacaccattgcatacactagcaagatttttgctgaaaggacccagatgtagctgtctcttgtgagactatgccggggcttagcaaacacagaagtggatgctcacagtcagctattggatggatcacagggcccccaatggaggagctagagaaagtacccaaggagctgaaggggtctgcagccctataggtggaacaacaatatgaactaaccagtaccccacccagctcttgtctccagctgcatatgtatcagaagttggcctagtcggccatcagtggaaacagaggctcactggtcttgcatactttatatgtctcagtacaggggaacaccaggaccaagaagtgagatttgatgggtagaggattgggggtggagggtatgggggactttttgggattgcattggaaatgtaaatgaagaaaatacctaattaaaaaaaaaaagagttgccttggtcatgatgtctcttctcagcaatagaaaccctaactaagttggtgactatctgattcaagggcaaagttgaggtcgttggtaagatccgagatacctcaaccagaaaataaagtaaaagtaaagaagttgacctttaaaggaacaagcaggttttaaaaatggttcagtgtttaagaacagtggctgttcttccaggggaccctggtttgattcctctctcccaaatagtagtagctcacaactctgtacttaccattaaatacatccctaaagaatatacccactgtatgtggcagtgaaatttgtatataatccagaagaaaatctgaggaaatactgtcatttaagtgtcatgcaaattcttgtaaatgttcacagtgtaatatttttattcaaaacactgtgaattgcatcattaacgtttaaattttagcataaaatggtaaaaaaaacacaaaaatatcaacaacaaaggtctaatgctctgagaggtgaatatttaagccagtgtattagacaatgcaggtatcgtgcaaaaatatcactgacttggtttaaataaaagaaaaaaagtaattttcttatgttttataagaccatatttcaaagaccaagatgctggctggtttcctttatttgactagagataatgactttcccctgatgtcctaacatgtcctcatacagggactttgtttttctgtctcaactctgaactcttcaaattcatgtcagttcttaggcctatacaactctcaatcaatttggcttgtgtgaaaccaagtagttggattaaatacaggtttattgctagtctttaatacaaataagaaaccttctttttaccgatgttcatttatcataataatgagcctactctcatggtaaaaaattattctcagtattttaaaaataagaatcttctctgcagagtaatggcttataagtgatcattctatgacagcagactcaaatatttcagcccactgcagtattttcaagattatctctgactcttttgcccgactataatgcattattttcttatcaatgtttatcattacatgagttgaaggaagtttttttgacagcttactgagaaataaatgataaaggcttataattggctgtgtaaaataaatcctatgaaaagaaagattctactcttgaccgtgtatagaatgggatgaaatgttagattgtccttctagattctgcctccccatgagtcctttaaactttccttacttttgaattcttttcacaacatgttttcgcatcgtttgttgataatcagtgatataagattcagagctatagcaaatgcaggggaattcattcatggcacgtcatgtttaaaatgtcagcatataacgacacaccatacaatttattcataattcatgaccaccggacataaacatttcagtttaagggtttgtctgcatttcattattctacagtgaagcaagaacttcaccaaattagaaatttgaaataaataagcaccatacagcagaatgacagaatggcagtgacagttttaaacagttgccattcttaaacttctggattgctcgacttttaattatacccattgtgctttattgtttttcttcattggagtctcatctttgagaaccaataaatactcttgaacacaagaagaatgtgtattattgctgtcttactatgctactgctgatattgtagacttacttattaaaactgtcatgagttttgtttcctacaagttttcacatataaatcataccaaattttgaaattataaagcaggaagcacttaagtcagtatcactttagccagtaaatctataaactttaaaattaattgaaagttcatataaagttaaattttgatttttttaaatgaacacactcttattaaagttgtttaattcctattatattactgtatatatggacttgtacacattagcctgtgttattggcaaaagattattttagacatcttacttcttcgttgatgaagatacttaagttaccagctcattaattcaatagcaagcctttacctctactgctacaaccccataggaagaacaacgatgtctactaaccagacccccagaactcccaggaactaaaccaccaaccaaagagtacacatgtggggacccatggatccagctgcatgtgtagcagaggatggccttgtggtcatcaatgggaggagaggcccttggtcctgtgaaggctcgatgccccaatgtaagggaatgccagggtggggagccaggcgtgggttggggaacaccctcatagaagcagggagagagagaatgggatagggggtttctgagtgggaaactgggaacagggatagcatttgcaatgtaaataaagaaaatatccaaaaagaaaagatcaaaatgtaattaaaccccactttgaagttatgttttagagttgtactcataaagtttggatgtaaatgactgtggcaccatgacttttttcacctatgaatacagtattatgtgctttgactgtaactactcttttcccatttctgaaacatagagtaagtatttgctttccttaccaaatatagtattgctgtgtaaattggtgcctaaaatagaaagaaatttgatgaaaagagttttcaatctctgacttgataaattgtttctaaagtgataacctcaactgtttctaaatggttacacattttgtagaattagggtaacctgttgatgtttcttatccttgatatcctagtaactgaaatgaagcatgtctggcagtgtagtcatgtatccttggctatttctgaggttgaaagagaagatagcaggattaagaattgcctgagctacatgcaggaggagttgaaggcaaatttgggcgatgtagggagcccttgacagataatcaaaagtgaaaaaagaaaaagtgcttactaccttatgagaggctgaggctgaagcaataggatgtcgcaggagttttaagctgtcctgagctaaatcttgagttaaacacaggactagggagtgaggccttgtctgtcaaaacaaaatggtctcatggggaaacaggaaaaaggaaagggagacaaagagcagtagtaggatggaagtgggagggagggagagacagagaaagagagacagagagagacacagagagaggcagagagagacagagagagagagacagagacagagagagacagagagagagagagagaacacataagaactaatagctgtttggatgtgaattaaacctagtatagaaaaacaaagaccaactaacaaacttgtataggaatgcagtttgtatattaaataactgtaaaaagtcattttgataaagttttaaacagaagaaaaagatgaacattttcttcttgcaaaattcttcttcacagaacaagttttaaaatcagtttttctaaataggtcactgtgagaaatgtatgcagtgactagttgtgagattaattttcatagaagccaaatatagcaggtgttaagtgtgtttatgtacgtcttcaaattgtagctatgaaggaatgtgcttattagattttgtcattgatgttatagacttgtactttgagaaagaaaaaaaaaagcagctcttagcttagttttcctttctccttccttgctctaaactttagttctacagcatgtacttgtgatcttattaaggactattttcaaaattgaaatattcatttgtagtcattggtgtaaacgaatctgctaatactttaaatgtaacacttgcttgttttcttggaatttgattacatctttttagattatcacatttacaacactatactttaaattgtgtaaatgtcattaaatcctgaattcttcagtttattagattctttacagaagtgtgttttgtgagttcagaattgattggtatcccttgttcattctatttaaaagtcatatttaataactttttgtctttattaaagtatttctaacacctgtctaaatatacactccaggttttttgtttttgtataaaaaagtatttaagtaataaaaaatcagttaatatagtttcataactatcttagtgaacaattgtgcccacatagtaatagtgacagtttttagactgcagagtatagctaactgaaatgaagaattctctacttttgaaatttttaaggacgtttcttgatgaatctcccatttatttaaagtggttacaaacattttcagcaccagaatagagaaaaagtgatgatttctgggactagctgtaggtcttacttggttcaccatgaaaactgttttcatagaggatttaaatgaacccagctggcttaggattctgtgaattgctgtagtcattttctgagtttaatcttatgactgattttgaaattctcacagtgggggaaagtcgaaaacatgagcagcatttagtgaatataattagtaagtttgaaaacaaatgcctttttattctataaaagctctgttcaaaggggatttaaaccctgtttgaaactgttgttcaagataaaacatggctactgtgactgaatgtgaccagtcatgttacaagctggttttctagtcaaatgaagccttcctaatgaatgcattgcacaaccttaataaggagaaccaatgacagtgaaagaagtttataaagtgatagtttataccaaaataaaggtctgtgattactttagacaccttaggaattatttatatttatttacatactttttccatgctggtaattatagacatatttattgaatctttactctctgtgggacccaatgctaggatttttttttgctgggaaaacaaaaaaatcaaacatatttccatttttttaatgagctagctggtgcatatagagcactgtaatgttaaaggcagacagaaggaacaatgcttatggggagggccatatggaaggtcctcaatacagcagcacacatgaagaaataaatgatgttaaaaacataaagaataaataaataaattatgttgctcataaatgctgggtaactaactacccggtaataatgtgtcacgtgagatgacatcccagactgtataacaactgtattcctgtgcaaagggaagggatgataccagtcactagtacaacatagactttgaacctcttttttcaatttgattgtctctgaagcctcttaggagggtaagcacaaaagattaatctttttgttttctttctctaagttcttttgatttctttatttacattatggtatctcagaatatatatttcctttaaaactattttaattttcatgcattatgaatagttggcctgcttgtaactgtttgcactacgtgcatgcctgctaccttcagaagtcagtagagggctttggatcacctggaacagaagtgacagatagcagtgagccaccatatggacacttagaattaaatacagtgaaaacttgtcaacttgcaaacaataaaccaactctcaagccccctacacatttctttttattttattttattttttttttgtttttttgtttttttgtttttttccattttttattaggtatttagctcatttacatttccaatgctataccaaaagtcccccttacccacccacccccactcccctacccacccactccccccctttggccctggcgttcccctgtaccggggcacacaaagtctgcgtgtccaatgggcctctctttccagtgatggccgactaggccatcttttgatacatatgcagctagagtcaagagctcaggggtactggttagttcataatgttgttccacctatagggttgcagatccctttagctccttgggtactttctctagctcctccattgggagccctgtgatccatccattagctgactgtgagcatccacttctgtgtttgctaggccccggcatagtctcacaagagacagctacatctgggtcctttcgataagatcttgctagtatatgcaatggtgtcagcgtttggatgctgattatgggatggatccctggatatggcagtctctacatggtccatcctttcatctcagctccaaactttgtttctgtaactccttccatgggtgttttgttcccacttctaaggaggggcatagtgtccacacttcagtcttcatttttcttgagtttcatgtgtttaggaaattgtatcttatatcgtgggtatcctaggttttgggctagtatccacttatcagtgagtacatattgtgtgagttcctttgtgattgtgttacctcactcaggatgatgctctccaggtccatccatttggctaggaatttcataaattcattctttttaatagctgagtagtactccattgtgtagatgtaccacattttctgtatccattcctctgttgaggggcatctgggttctttccagtttctggctattataaataaggctgctatgaacatagtggagcatgtgtccttcttaccagttggggcttcttctggatatatgcccaggagaggtattgctggatcctccggtagtactatgtccaattttctgaggaaccgccagactgatttccagagtggttgtacaagcctgcaatcccaccaacaatggaggagtgttcctctttctccacatcctcgccagcatctgctgtcacctgaatttttgatcttagccattctcactggtgtgaggtggaatctcagggttgttttgatttgcatttccctgatgattaaggatgttgaacattttttcaggtgcttctctgccattcggtattcctcaggtgagaattctttgttcagttctgagccccattttttaagggggttatttgattttctgaggtccaccttcttgagttctttatatatgttggatattagtcccctatctgatttaggataggtaaagatcctttcccagtctgttggtggtctttttgtcttatagacagtgtcttttgccttgcagaaactttggagtttcattaggtcccatttgtcaattctcgatcttacagcacaagccattgctgttctgttcaggaatttttcccctgtgcccatatcttcaaggctttcccccactttctcctctataagtttcagtgtctctggttttatgtgaagttccttgatccacttagatttgaccttagtacaaggagataagtatggatcgattcgcattcttctacatgataacaaccagttgtgccagcaccaatataaacaaactcaaagacaaaaaccacatgatcatctcgttagatgcagaaaaagcatttgacaagatccaacacccattcatgataaaagttctggaaagatcaggaattcaaggccaatacctaaacatgataaaagtaatctacagcaaaccagtagccaacatcaaagtaaatggagagaagctggaagcaatcccactaaaatcagggactagacaaggctgcccactttctccctaccttttcaacatagtacttgaagtattagccagagcaattcgacaacaaaaggagatcaaggggatacaaattggaaaagaggaagtcaaaatatcactttttgcagatgatatgatagtatatataagtgaccctaaaaattccaacagagaactcctaaacctgataaacagcttcggtgaagtagctggatataaaattaactcaaacaagtcaatggcctttctctacacaaagaataaacaggctgagaaagaaattagggaaacaacacccttctcaatagccacaaataatataaaatatctcggcgtgactctaacgaaggaagtgaaagatctgtatgataaaaacttcaagtccctgaggaaagaaattaaagaagatctcagaagatggaaagatctcccatgctcatggattggcaggaccaacattgtaaaaatggctatctcgccaaaagcaatctacagattcaatgcaatccccattaaaattccaactcaattcttcaacgaattagaaggagcaatttgcaaattcatctggaataacaaaaaaccgaggatagcaaaaactcttctcaaggataaaagaacctctggtggaatcaccatgcctgacctaaagctttactacagagcaattgtgataaaaactgcatggtactggtatagagacagacaagtggaccaatggaatagagttgaagacccagaaatgaacccacacacctatggtcacttgatcttcgacaagggagccaaaaccatccagtggaagaaagacagcattttctttttattttatagtatttaaaattgattctgaagttattatataccttctgcatttagtgtttgctcattttcattagcatctcttatacagtgatgagtttcatagtaacatatttaagtcaaagtatatcatgtatccacttcccattatcctattcctcctctatctcttcattaaatgtcagggttttttaaaataaaaaaaaatataaaatttagcgctatcttttcaaaacaataagtgaataactgaaactattttatgtctagtctcagtgtgatagcatgcacttagttcagctgtgatttgatgtaacagggaggtttggtacccatggggtgggggagctctgcttctctgagaaaaacgggatggaggagtggggtagagggtatgagggggctagtatgagatgacactgggagaatccaatttcctattaagccaaatgttaaaaatgaccaaaacatttaaaaaaaacctaaaaaattatattttgtgcataacccccatttcaataatcaggtgcttcccatagaaagagacttccataacttttgtttaggtaactatgaacgaaacatttttatatttaattttcagggcaaattatctgtgtttgatgagataaatataaactacttggaggctgacagcttatagaaaggaatttattcttcagattcaatgaagtctttatcatggacacctgtatcttatcagtttgttgttgcagtgacaaaatagcgagtcaacacaactactagagggaaagatagattggaacacacagcttcatggtttttgatcagagtgtgttgcttttgttgtttttagttagaaccaagatagaatattattgctggagtatgtggtggaacatatcagctcacttcattgcagaaaggaagcagagagaacttagaagggaacagacataagatatacccgttcatgccatgcccatgtcctaataactcattataaagttagaagtctcattttctaatcacctgtcaaagtgctaccatctggggaccaattctgcatcacctgagccttttaaggtggcacatcacgtccaaaacatcacacgaatttagaatataatattggtaaatctatacaaaggaaaatgaaaaatattataaaccatttagaaagaagagatgtgaaagttacaaactgtgtagaatatacatgtttaaagtttattttaagatgacaagaagttctgattatgaatagggggatatgctgcatatgcatgtaatatgtttagtgctgctaaactctactctgctctaagatgttgaaaatgctaaattttatgcacatttctgacaatgaagaagaggattcacagctgcattgtctgtaataggatatcactaatgtcagtgagaatcatttccagaggtgcaaaaacagaaattgatgaggaaaatacccaatagaagaatatatttaatattaactcaatttgcattgtaaaattatagagtgcattgaagatgaatggatgattaattgaaggaagctactaacatcaatatatgtcagcaactcctaagcagttatttctcagtgctattgattttggttttcaaaggtatattgttgaccacctgagttccacgtacactaatggaaagtctctgagtcattcacctgccgtattgcctatgctgtttcttagtgatgttaataatcttcgaggttatgtccagggaaaaacaccaaagaactgatttcacttactttcaaatttcatatagacaggtttaagtaaaaatgctcattacaataaaagttgagtgcttttattatttgtctaaaccaagccttattgaagaagctgtttaaaacccaagggatgctatgcttctacactatttttgtaccaatttaaaaataatttgattttcttaaaactattctcagaagaatttgtttggtagcttgattaactgaaagcacttctaagcagcagacctgcttttgtttgtaaagtacagccatgtttcattaattcattgtggcctttcctaaatgagcataaatggctgttgatttgacactggtcctgactactccagactaatgcatccggagtgcattcaccttgaataagtggggctacaaggaaacccctgacaaggggagcattgagggtaggagagaagaatttgtcttctctgagaaactaacagcacaaatgccctgctgggcctgaaggtggcaattgagatgaatccttattacatttaatgttgtcatggtttcaagtttaagctctgctttcacagattgctaccataaattaagttaacaagtggaaagctcttaaattgcatgactttttatacaattgatatcatctgttcccttttttgttggaagtgccattataatacagaaatcaagagtgtaaaatagggacaatcaagcctacataaagaattaggacatcttttccagtataaattacatttgactggattagtgtcaaccgtggtcatgtaacaccttaacaaaaaacaagttttggtgacagattcagaaataaagccaggaaactatgttttagacctgtctgctcgtagctgcagagctaatgtcttcatggtaattgcaatccttaaaagtacattatctttctcaatgttattgtagcgtgtgggggtgttggagaaagcaataaattgtaaacaacccttggcagagagcacagaacttaatttttaaaaaaaataatagaaactaacattagaattcatgtgccgtatcaagactggcaagcagtagtagttgttttgatagatgcactagagcattcatgattgctgaaatagtaactgttccatggatatataaatataatagggagaaagaaaccgtaattaaggatcaatttaataaaagaaataaagttgaatgatctgatcacagtgatatattaagtggtttcatatcaacaactcaactagactctgcaaagaagtatcatttgttcttaaggttaatccatccagtataggtgtgtcttgattgtgttctgttggtatgtgtgggctgtttccttcacatagagtgagtgtgcatctatttattaatacagggcttgttaagttcaatgagttcctttttgccatttctataaatataagagaaagagagcggtctaaaagggcatccttattatatagtttattggcataggcctctcactcacatttaagttttagcaccacctcaatgttatacttccttaaaaatatatagaaatgattcactagggggtatgtcaattgctttaccattgcatttcttttattctttatgtgcaaatcgttttttttttttcctatgttcactatacattctacagccatttctgcaagacaaatctcatgaagttagctaagtagattctctgtaacactctgtagttacagtgtaagattgctttggggcagattcttaaaacccactgttttgttcctatataacaacacattctcactatttactttccacctgaaattaggatgctgactctggtaacacagtatctctgtattcctgcatcatggaaagtactttatcattttattctcatttgttttccagagacacagggtggttgcattttctgtaagtatagtctgttgtgtatggctttagagttaaggcattgggttccttagagcaagtctaatagccctgaaatgtaaacctgaggaacatataaaccttccagttatttttgaggtcaactttgatgtccagttttccacaacttataatttgattttctgatttaaggttttacttaaacagagtacactggtctcaatatgatgtgggagtataattttagtacacttttaaggaaaaatgggagatggtttatacgacttgagagcaatatatctgaagccttcacagcatggcccacactgatagattggtgtgctcttgtaccagtacgtggtaagttataatacagattagtgtcattttctgtgaactaatcaagaacacttagatctgtcctttattagccacaaattgctagatagttctctagttttaaattgacactacgctttgaaaacaaatcaaacacaatattcattattttaaaactcggaagattttgtaggtaaaatgtagataattgcctgagtagcttttgacctggaatttttttcatcattgtggatctcaaactttggaatacatcataattgccatgcagaatacatcagaatcaccacgtagcaaggcatactgttgagtttctaatttagttgatgtgaatttctaaatactactcagatgaggccactgctcttgatcaaaggatctctattttataatgtagccaatatccatgaattattttcctgctttatttttaaagtactgagaattgaacccagtgctgtgtaagcctcctgataagctgtatccccagcacaggacccatggattcttgattgtctatttttatttcttttaattcctactctcctcaggcctaattatgctgaacttattcagaatgataattataataacttttgccactagcctcaccattttccagctgttggctctactgccccctctattatccagctattatccactgtcaatattttgaataaattatccttacacattacctccttttcctggctatcctttccatttaattttatgtccttggcagtattctgaaacaatacttgaaggtcaccaaagatttctctaatcattgaattagccttaattatctttggctcgtttggagcatttattcattgaacattccagggggaaaaatctgatcagatcatagtcctcatttataaggaggtcacaatctggtggatgatactgagaatataaacaaaattatgtgttgtgaaataactgatacaactaaaaaacgtataaatcactatggacaaacaaacatggtatttattaatcacactcagtgaagttggaaaatactcattattattaatgaacttgcttcctgcataatgtttcccctttccaaacaccttcttcataacccattattaaatccagtaaatattcaatctcaatatgtataagtgaacagggtgtgttctggcacctgtctttattaagtaggtgaactctgattatactctctgatttgcctgttgtcttggatagggtttaattgctgttatgagacaccatgacaaagacaactcttataaggacaacattcaactggggctggcttacacgttcagatgttcagtcctttgtcatcaaggtgggagcatggtaacatgcaggcaagcaaggtgctagaggagctgagagttctacatcttgttccaaaggcaaacaggaacaccatgacttccaggcagccaggagtgcttcttcaagcccacccccacaatgagacatttcctccaacatgggaacacctactctaacaaaactccaactcctaatgtcactactgcctgggccaaccacattcaaaccaccaattcactgaattattttgaggatttgtaaaagtacctgttctataggcatataacatgtggagaacactaaagcagagagaatgttgcttatatccagtttcttacagacgatttacacattgctacttttcctttctaaaattagcttactctgaagttagtatatccatacaacttaaaacatgtggggtctgacttttcctattttcacttcctgttattcattgacaaaaatacatatttttttcacaatgactcaaatgcatccagttttcctcttatgtctgacaactctttataattgcatcagttcttggcatttgccacaaagttagtcaacatattttcacttttctatgcaatttcatattttctactgacttttatttagttatatattttataaaaaagataaacataattagccttagaaatgggtgttgctataccaagggtactttgtatatatgtactattactgaatgttagtaaagattaaagaaatagagttcacttaatttcagttagtaatctttatataacaattaaacctactgtatgtatggttgattagtgaagtgctctcagttattgcaatgattcactcttattttcattaatattcactaagtcaatttggcaaaataatatacagatttaagcttttcaaactacttgtctttgatgaaagtactattttgcttttagtgtttggaaatatgcacaaagtagggaattatggagtagtctccccatggcagttcataaaaaagatatcagatatctttcttgtgtccttgctcattgctgcttgaaaaaagaataagctgaaatgcagacaaagttgccaaaaggcactttgcttctgtctagaacagtccttgaaatgcttacaatgtagttgcctctgagacttaggcaagatctagcttagttaccaccttgtttagatatttgagactcatatacatttttaacatgatttcaagaaaccagcgttcaatgcaaattaagtttgtatcttagtaaactaacccaagtattttgacatgattttatatatatttaaattacatttatacaatttggcatcttgaatagtgtgtaagaatttgctgttctttttctctgttgatatatatttgtctccaaagacttaaaaaataaataaataaatttccttactattggggagggtggcgggaattttcctgcaatttacctccttcttttaggatctcagatgttaagttgtaaggggtttctttaaatgtcccacatactgtaaaaatgatgcattttgtgagcatataacacagtaatccaagctaaacagttctctttggggaacagagccccccattgattactctatagctgctagctttgcttaagataaactggccttgagttcctgttgctttttgttcttacagcttgtccttgggtggaagttttcaccttttaatgctaaaaggcgtttggtgaatgagcatgatttcagcatttgaaatatttttggtatatggaattctgtatttgtagaatttctccaagaaataatgatgaccactggaacattattactcccatggctcatcttctttatatttgttcacatcatgaggatgtaaataccctatacaaagtttaacacagggcatatttgatatgaacctgatttagtaaatgctatgttttttatctttagtcacaaaacggtaaggattaactcattttataattacctaactatcctctgcagcctttcctaaacctgtttgtgaagaacacatatttattctaaacagaataatccttaaagccaaaaactccaaatcagcatgaacaccagtggataaagccatcatgcaaagattatagaattaaaaatccaacaaactgaaaagcgtgatgctttgcatggtatttatgcattgtttctacataaatccttgatttcatttgcaactgagccttgtgtaagggatataaaaatgaaaacttagagccatctaaattgttctagcttatcctttaaagatttgtattactctattaattccatcatttttcttctagtgtctctcaaaaaaaaaagtacaatgttaagcaaataactgttaaattctgtcatgttaccatgattgtgtagtaggattttcatttatcattctgtatgaaacaactttttgattttttttcttatggcacatgcaaataaaggaatataaaggatgatagctagaaataaatttaatgtcacaaatagatggagctttcaagaatacctttttatactaatgcaaataccagaatgtcgttaacatcaacacacattaactggtactactactataactacttaaatgagtgttcgtgtctagtaaaaggaaaattcattttgctgtaacgattcagacatttttgcaaatacagattaaggttgaatttggcacttttattagtgttatttctcttttataaaatattgagtgtaagatcctcagctatgtacctagttgccattaggaagccaccaacaacttaatagataaaaacaaaaaaagtgccatctctagtcattcatcatctgtctcacttgtttaagaacagtatctctttgtgttgctttaaaacgtcttggtttgtttgtttttttttccagatcaaagacacaaaatcagcagatcaaaaatccacccttttgcattttcttgctgaaatctgtgatgagaaataccgggatatcctgaaatttcctgatgagctggagcatgtggaaagcgcaggcaaaggtaatcaattagcagctgccttgagactattctaggcttatgtgcttttgtttaagtaagatttaaaaggaagctattagcactattaatcataaaagttctgtttgtgtaaggaaagtagaaaggtagttttgattggcttatatctgactacactgtacatttaaataacctgtctttctctccattttttttttaacactgctatgtttttgaagctatggtacctctaatcaaatagtatgttctttacattgagaagagcttaaatgtatggtgaatgatagtgttctcaaaatggttctaagacgtcgctccttaagtgtgttttaaagatactgttctagaattgagataaagaagaaatgactatgggttgggtagtatatgaggatgaagatttcctaacatggtaaacagtttcctttccagagacagctcaatagctgcaagataaactagcaggatcatttaggacagttgaaaggaatatttaatgatgaggctgtgggagtagcgtatgcatatcagaaatatccaaggcagactcaggtctcacatcactttatactgtattaaggaattaagacagaggtgagacagaatgcttgtaagatttccaggcagggtaaatctccctgtcaatattgtccacacttcataagtgattaaaaagttaaagaaagatagatcaagaaaatatttttccgtggttgatattatatgggtgcaaactttattttctcttttagaaaagattaatatttactgttgtgattatattctgtaactgtggggattaaaggaaattataatggtattacttactagcttcagaatattgagctagtaatttagatatcctagaaaatgacaaaagtaagattaaataagtaagttagcatatacaaagcatacaggaaaatacttgccacgtagtaagtacactgttgttatactactgttgttagaaatgaagattttcatagtgttaacaattgacacaccactatgaactttgcattggtttgattgttagatttgatgagaattatcttgtatatcttatagttcttcatggttcagctaagtatgtattctactcagccttgtttcttttatatgtctgggctttttgataaataccttcatattttgttttctaactgtatcacaaccttctttctcactgtctatttcaacagccaaatgtatccattgtgttttgattgcttgctttgtatattgatccagccagtgtagtcacagggctgttgccaaatacccttttcctatctcaatgtttgtactgcagcaatccccactctccacttgtttttgactggctctttttctttcctgtgaaattcaaagagttctctactcaaaaacttcttaagcacaccctgcctgcttgaagccactttcatttcctcctagttctcatttcagtgtacccagacatatattctcttgagccatttttattcctttataataatcctgtctgtgtgtacaatttcctgccgcatcccctgcctgaaaatctcacctgccttgtcctctaagacaactgactatcatttgtcaaaacactgttcaaaatccatttcctttctttctaacttctttttaccaaaggctctggagaaaagactttgaagtttagcctctacaggaagaaaagcaatagtgaaaggtcaagctatttatgtcttatttatagttaaatgtttttccttaatatttgagtctaatttgtctttgctttcttaatataaatttaagagttatttgattcaaattttgtcaccttcattattgtgtataaactactatatgtataatattcacattaccccagtgcaaataaaaaagatagatcaacactatatataattagtttgcttttgaaaatgaatctgctccttgtgaattgttaccctacctcaaaaaaaaagagctttttaaaaatttgaggtacaggaaaaccacaatagcaagttaatgaatgtattatattgcacatataatgaacaattgtgtctttgtgattattagaattcctgtatgtaggttatgagaaatggatgttttctgcccattatggcaacaacagatattctcttccaatactaaaaacatagacctcaaaattactgataatgtgggggagtgccatcaccttaagctcaatgataaacaaagaattatgtagaatttagggagaactttatttgtataattgtctttatacttcacaaagatcatcttataattatgcacttcttagagacacatgcctttggtatcaacttagcatattttcctaaagctctgtaactcaaagatattgaagaaacacatcatttttacattaaaacagatatatattacagagtagaatgcaaaaaccatatgaatttttaaaataaaactgatgacttcaaagaaatttcacacttgcagcagatccctaggggtgcgtgttcaatcttcggttccattaggggtacttttgtgagagaagtttatgaagcattgcctggagatttccaaagtggttttgtttttatttgaatttgtttagttatttcgttagctattattgctgggacagcagaggcaagcaagttgagtgagaaaatacactagtttcttctgaacaggaattcttataaatctcaagttcagaagcaaatattattatacacccttacttattaccaatgaaattaataaataatagtgtttgacttattttattctgggggaaactttaggcctgcagatactttcattacttagtgacataccagcatgttcaaagaaagaaaatattgtggctatacaaattttgatatcttcaaacaatcaaaaagaatcctttataaaacacaatcactttttttctaattattatttttaattgttatatgtgcgttatgcattagcaagttatatgtgatcttgacaaaagccagacttcagggagaaaacttaaactgagaaaatgcctcccagtagattgcctgtggaaaaactgttgtggattttcttggttgattattggtgggagacagtcctgctgattgtgagtggtgccatctctggtctggtgctcttgagtgctataacagttgaaactcaaggcaagattctggatgcaggaatgctacttactcgtcttgccttgagcttcagccctcatttcgcttagtgatggactagaagattattttggttttggtgttttaacacagcaatagaaacccaaactaagacatgtgaaaatatttgtgtgtgtgtgtgtgtgtgtgtgtgtgtgtgtgtgtgtgtgtgtgtgtgtgtgtatgtatgtatgtgtatatatgtatatgtgtgtgtttgaagtattaataatttactagatgcatttggtgaattctttatctactctattctccataactatcactttaattttgagctctgagaatttttatagtttgatttaaaacctttactgttttataggttagctccagggattaaaccaaaagggttagtaaagtttaattaaaactattctgttcaatacaggatactatattaatgtatttgaaggcactattaatcctaagatttttacataaatccaaaatgggtttcacttcagttaaatccatgccatcttacaagataaaaactaattatgttttctatgaacaattcatatatattaaattatatatttttcagtcagctctgcatttcgatatgtattgtttacatgttgtgatgttaaataacttatttacttactcttgaatcctttcaggattaatagtggggaaacttcacactaaagaaatcctttttgaaaattctaaaaattaaaaacataaattagagtagagaataaaagttgaaggtaaaaaggaaacgacattttaagaaacagcaagtaggaaaagttaaatatgagagtataaatgttgtatggaataaagcatggatcaagaatgtgacatagtcacagtgaaaatagtatgattctccagcccccaaaccctccatgatataaaggaatattattaacaaataaaagatgcagtaccctgacaattaaaaaaaatcagggactttcgagccagtagaagctttagggatcacctagtccctgctaaaagcagcagagtaccatcgagtacagcgccatcattttatactggaagaaactaggcctcctaatgatacagtacttgaccatgttctcacagctctatggaaatctattcaaatttcagccatattttcataattgagatgtacatagagatattagaaaatatacagaaagtaaatgctgagcaactaaacagcctaatataattctaaatgccttttcctctttgtaattgtctacaggttgtcttgctcaaatttcacagaatttgccttttttttttttattggtgtcattagcagcatttgaattttattgataatagcacacattccacatttggatttgtatgaaattgtgtactgtctagactgataacttagaagctcatattaattattaattcctgattattcttggtcttaattcacacagcaatatggatatatctatgtcctcaataacatttttttaaaattacacaattgatattttaatgcattatgtatttatcaaaataagacattatagatagttggtattcaccatattcaccatagagaaagcaaagcaaatcaatataaaacactgtggcttaagaatatttcctaccctgttgattacttctaaacccattgtaggtctttaaagttactcacatttcttaagacatgtctgcagatatttgaggcgttaatagaaaagtttttcacaaatattctcataaagtatctaagataaagttatcattgtattagttatgctaggggtaagtttgtgactgggcttccggcaatactggtcatggttggcttactgatctagacattgtgcacgtatacattttatggaaattcattaaccaggtcacatacatacatacgtgttctgatgtaaattaaacttcaataatgtatgtaaaattataattcatgactttaaaatacatcatggctgaattttacatacaataatgtatgtaaaatggctgaaatttacatacaataatgtatgtaaaattataattcatgactttaaaatacatcatggctgaatacatcaaggcatagactacattttaattcaaagaatcctttttatttttaggcatgcttcataaaaacatcgcatgtgttgcataaatatgagtaggcaattgttttcaaagttcatctgacattattgtaaataattgatgctcttcagcaagttatatgtcacttaaggattttatcaaagcaacttttaatctgaaagtgatgtttaggctttctttacttagtaaaagaacaagatccatcaaccacattctatacaagtaaagatcaaggaggtctttactccaactgttatcaatatgatgttgtctgatgaattttaatatgcctatctcacggtgaattaaaattcctacaaagaaacttttgctgctgtcatcttttttttttttttacaataattgtgtcttcagtgtctgaaaataggatgttgattaccaatggtcattttaatctcatttttgaattccaagtactttcttaaaagtcagctactcatgcatcagttatcctcacttagttggcccttaagcaaacacaaaatattggaacatatttcatgcaacagattaaacaattgatattaagtcatattgtcagtgtgggtggggagagtaggcacagaagtaagaacagaaatgtagaaataccagccattcctgccacaggagtcatatcagaaaacaagatacactgtggtcctctttgactattatgtgtaccactatggaaaatagctaaaatttagttatcatcttggatatcattgctatgatttcattgcatgaccttagtcatttggtgctctaatgtgttatatgtaatgataggctaatcacaaggacatggagggataactatttcaagtaagtaccagaaccacagcagagttattcagaaagttgcttacattctctacttttgacacattttaaattagctataacacaaggattaaatcatttaaaaaaattgctgttgctttgatttcctcttaaatgttgggttgtgtaagttgatgagatattcatagtaaacacctaatataaactcttggtttgcaaattttatatgaatctaatcccttagtaggacatgtcaatttgatttgccgactcattgagagtagttatgtgaaacctcagtactcttttgaaagctgatcactatgtaacagatagtgctggtatagtcatatgtaaaagaaacctgctaaaatgctgtgtccaggaataagacatttgacatatataaattcctgtttgaactttgtcatcaagctatatgtttgatcatagtttgtcaacttaacttctcagtgcatgttttttcattcgtacacattttcaaagttgtaaaatacagattgtagtgtgtattccctgtagtgattatgaaattcaatgtggaaatgccttaagaaaaaggtgttatacatatataataacttaattagttaaacttgtatgtgcatattaatttcagtttgtttttgaacaggttttagttacatttgtgcagaatcattttaaaacttgaagaataattactggggttttatctcagtggtcgacatgtctgcctataataaataatacttaataaataaatgtaaagatcaaattagctcttaacgtcctaaatatttctaaaatattgtatggttccattaaattttattttctttacacattctcatattctttgcatttgagtcctttttctggaagtaatattccaaatatatatttttcttaagatttatgtcttatttgtacactcacatacacatacacatacacacacacatacacacacacaaacacaaatatacatgtgcatctatgaatgagttgtacaccatgcagattcccatagagactagagtgcatcagattccactggtcgtttgtgaatcatctgatatgattgttacctaaactgtgaactaaccccacgtccttagcaagagcagtaagctctcttaaaccctgagccatctctccagacccaaaattcatgttattttgaatgaaatctctaatctttaatagaagaatccttggtctgcaatcaaaagtcccaatacctcataatgttctagtatctatgttttaacatgtgtgaattatggaagaaataaagaagaaatgaaaaaaacaaagaaaataacatgatactttacataattgacaagaaaattttaaggggcatataaaatatagattaaaatataaaataagaaataaaatgattaaaaactatattcttttatagtatatattttaaaggagtggctactgattacatcctcatcagaaaattaaaggtaatatttttcttaactactgttgtttcacttaattgtgaattacctgatgcctaaaattgacagtaataatcactaatatctatcttagaacttaatgtgatctatgtgttatatagaaaagaagatgtgtctaaaaatgtcatcagcctcaaaattgcacaataaattttagctaagtttttataaactttctaatgattttactatacagttctgaaaataatattaacaaaattagtaaagcaataaatatttttataaatttaatataaaataagagttagtggttttattcaatatatttaattggaatgtttttataaatgtacatatatttctcaatattatgtaattttaacacacatacacacagagatactgacacatacacacacaacttttaactgcataaaagttatatcaaagtctagatgccaggctcagtgcttaagagcacttgttgttctttcaaaggacaaatcttcagttcctattgcaatcatccataacttcagttccaaggtatgtaacactgtcctctgaacaccaaggacatcatatacacctattatacatgcatacatacatgtcagcaagtactcctacatataaaatatgaaactaaaccaagtatttttttagttaggtccataaaatttagggctttattctatcgatttttttccttcaccgtatattaataatcatatactctattatgctttgcaaataataaaacataaacagttctttggtccaccttcttgaagagtgttatccgtaatgaaacatgtttatttgacaatgcttgtattgagacctggagttttttaattgtgtttatgtatatctccttcaaatatgtcagttttcactttgtaagtatttattggaactagttatatgctttaaagtaaagtttcatccattattgtgccccaccattacaattcatattagctaaacactgttcagagagaatacttatacccaggcaggagggttatttttacttatctacttgacaaaaacgagactcactgggaatttggcctcagaaatgcctctaggggattggccttattttacttacttatttttttaatttattttttcaattagatattttcttcatttacatttcaaatgctatcacaaaagtctcccagaccctcccccccacccccccccacacactcccctacccacccactcccacttcttggccctggtgttcccctgtactgaggcatataaagtttgcaagaacaatgggcctctctttccactgatggccgactaggccatcttctgctacatatgcagctagagacaggagctccgggggtactggttagttcatattgttgttccacctataaggttgcagacccctttagctccttgggtactttttctagctcctccattgggggccctgtgttccatccaatatctgactgtgatcatccacttctgtgtttgctaggccccggcataacctcacaagagacagctatatcagggtccttctagcaaaatcttcctggtgtatgcaatggtgtcaccgtttggaggctgattatgggatggattttacttacttatttacccctatttatttctttattttgcatcccaactgacgtcccccctcatcttctccttccaataccccctattccaatacctctcctctccctgaatcccatccactcctcctctgtgtctcttttgaaaaaggcagtcctcccatgaatattaaccagcagtggcatatcaagttccctcaagacttggtaccttctcttctactaaagctagatgaggcatcccagtaggaagaaagggtcccaaaggcaggcaataaagtcttaaacagtccctgtccccactattagggtcccacaagaacaccaaaccacacaagtgcagagggtctagatcattcccatgtattctgcctccttggcagttttgtgtcctcaaacccctatgataccagattagttaattctacattatttattgtactgtccttgacttctctggctcagtcaatcctttctttcctttttcctgaaggattcaatgagctctatctaatgttttgcgctgggtctctgcatctgatttcattagttgctgtataaagaaaacagtggtctaaaaaccaatctatgagtgtagcagaatatcactaggaatcattgccttgacttttttaggttcatatttggatctattctgtgtctctgggctatccagcctatggttcttggcccttcaagaagtaccagggattggccctatctcaggacatgggtcttaattgaggtgggaaaacacacactctagactaacggttctcaaacttcctagtgttacaaccctttagtgccgctcttcatatgtggttacccagctatgaaattattttgttgctactttataactgtaatctttctactgttatgaatcataatggaaatatatgatatacaagatctctgatatgtgactacccccaaaggtgtcatgtctcatgggttgagaaccactgctctagatgatagtttccctgctaggatactagattagttaagtcaggaaagagaactaagtaacaaaatgagtacatgtctctgctttccgatcatgggcatgatgtgagtgatatggctggctgagctgatcccttgatttccctaccatgatgctctggactataaactgtcagtccgaataaaccccttttccttaacctgctttccacagggtgttttatcacagccataggaagagaaactatggttccagggctacagatattcatataaccttagagtgcttttggataaattcaaagaacaaagtataatagcacatgttcatagaccatgaaatactaaagctgagtcctctgagtgcctgctatcaattagtacaatggctcattttcctggactaagtctgaaaacttaactgctttgcaaggtcaaacaattaaacgtttgtgtatttaacattgcatctcttgttttccccaaaaaagtctttttctaagatttacttttaattgatatagcatgtagaaatatacactcatctatcatgtgtttttgaatgataatgaagagcaaatattttggaaagtgcaaattcttctgcagtgcctaatcaaggtaaaacaacttctctgtggacaaaatcttctatgaagaaagatctgtcatacacatgaaaagaaatatatctgtaattaatagtttttgcttcccaaagaattattgtcagttaatgatcttcattctcttgcctgactctggccttctactgtatttttcttttttaaattgaaagtgtagatgcaaaacaaagtaatttggaagatgatttaagataatatttgggtttaaattattattgttaaattataagaagacatctgaactaagaggaagcaaaaagagcttagtctgtcataattactgaactatacagataacagttaatatgagttcaattgtttctcttttaatctgtttgtgaaaactgaacttaaagtgggtaactacagtcaagaacagccattacattcataggctaataattatttctccatcattgtcactgacaactaataaaatgtccagtgtgtttggctatagatagctgagcacagcatcccttagctataaagttaagaatagggttggaagctgggtggtggtggcgcaagcctttaataatcccagcactttggggggtgggaggggaggcagaggcaggcagatttctgagtttgaggccagcctggtttacaaagtgagttccaggccaggacagccagggctatacagagaaaccctgtctagggaggaacattaggaggaggaggaggaggaggaggaggaggaggaggaggagtaggagtaggaggaggaggaggacgagggtaggaggaggaggagaagaggaggaggagaggaggaggaggagaagaggaggaggaagaggaggaagaggagaaggaggaggaggaggaggagtgttgtaacttagctcagtaacagaaggcttacctaaattgtctgtagccagaggtgtgatccttagcgtcattaaatacataaacaaacaaatacatcatagcagttacagttattgattttgctttatcttcctatgtaaagtatgtgttttacaaagtcttttttattttatattattttcatgaaagaaaagaacacctactccttttacattaaagagaaaaacaaattgctaattagatggttgtgaaacagtgttatcctttttagttttacactgacttttcaaatacagtggcactttaacagcttttgaaaatcagaatcttcagggaacattattacttctgcagattcactgaccatgtctattcccagggacattgaaatgaaaagcaaggccaggcaagactaacatttatttcgtgaaagtttcactggtgctcttattaaatgaagataaaggttgaaatgtttctcagggaggcatatgacatattcatatattcagattttttttgtcaaacaaaacagaattttgaaaaaccccaggtagtgctttgaaagaaatacagaagtgtgtgtttcaaataggttgaaaaatggtttaaatgtactgagctgttcacagcctctggcttttactttttgtgtgagttatatctaagcaaggattttattatagtcagtgttgttcatgcagctatagttagaattgccagtcccattacaaatccactatttctgttggggttcataactcaactctagaagtcaccctgggctaaagattggcataccaatttagaaactgtggttcaatggtgtccatgaatgtgatcaaatatgtagtaaacattcaaatttgcatatgctacctttatagtatattttataaatggataatggattatggttctttcattatagaaactatctgagaaatgttaactgagtcactgcaactgattaacaaaattagccaaaacttttcttcagttcttctagtcaagatactgagaacttactgtagaagccatgagcaaaaaatactttctgctagtagatgagttaacggcttcagagagccactcagaaggaatcagaactatggccaatatatataattaatttgacccgaagtttagtaaatgtcgtgagaatggaataaactggcagtttggaattatccattagaacaggtgcactgtctactaaggtggttgttgttgttattgtagttgttaagtttttgtctgtttggttagcttcgttgtttatgtatttgttgctgttgggttttgttttattttgatatacattcctattatgtgatcctaactggcctcgaatattctacatttcccaggcttgcgttgaacttatgtctttgctgccgcagcctcccaagtgctaagtcttcaggtggccaccacaacacccaactgctactccagttgtcaaaatggatagataatcagtttctcatcagtttaacatttttatcataaaatcaaccaatttctttacttagaacaaagatgctttaaattagcaaatgttataagaacatgctttctttgatcttaaatccggattacagatggactcacaatctgatttcagcacccttcccaccccaggcaaaggagcaaagacttgtctatgttaacatttgtagtcttcctggctgatcaatacacctactgtgagtccatgaaagtttaacttatcacatactgtcaaagaatttgaaggatttaatttaacttggttactttggtttgcttaatttagaagaagatgttgataaaactttgtagaagcttagaggttgctcacaatcttggtcttctagttgtaggtagccctttacagacaacttaagaagggtacctccttaaacattaacagttgggactatggcggtggacattacagttatatatagctcctgtcctcatcatctaattagctcagggaggaaatgagtatattcatattcatatactcatgaattggaataagtgctatgagatatatggctagtgttcctttgttagtttgaaggtgatctatagatattgtctgaggatatgacatggccgatttttcaggaagtggaaatcacaagggaagtgttgaaaggcagaaactattcagtatactctaggacctgaagagtagaaaatgatagaattacagagaaagaagatactgagcagcatggtttgagctaaaaagatacaaaaacttcaagactagcaacagaagccccagctaaatgtgaatattcccttctttctacatatttcaaaggaaacattctttcccaagagatttctttttccttgtaaaatgaaaagacttttctttgttttttagcttttgtttgtttgttttttttttttagtctgttcatgtcacaatgacttgtcacagacactaacacatataaacacacacacacatttatttatgcatataattacagatggttgttttagttaggaaaatttagtttctgtgatatatcaatacttgactattagtttactaaatataagctccaattgtagttttcaaattaagaaaaaagcaacttgtagaaaatttgatacttttttaaaatgtaagtataatgtaagtattttctcttttgttgatcagagttcatgttaattctggctttaactgtactttattatctcatgtaaagtaatgagtcaatcaagaaaatcttttttccttgaagcttcttttgttattttcagtaaacagaccagtgtaaatgacattttaccttttgttgctgttgcttaggaacagaagtgacaatcagaactattctttccgtttagatttgtaaaagggcaagtatgttggagatcatcattgcttgaagaaacatctccacctagcaccttcccttccaaaccttgtagtcactgaatcatcaaaaagtaatgcctagcctttctccaccggaaagctgcactacttgaaaaatcacagtaaaaataaaacatttaagagatattattttacttgagaaagagctgaaacgagtgaacacaaatcatatgtggctcttttccattttgcatataactaatcatgttgctattgaacagtcaaaattcaaagacattaatctgaaatcacgttcatgggtttagaaatgtctcttaagacaattaatctctgttttctacagatgaactgaatgtcattctgctcattagtcactgaatatacctttatattcctgtctgttttctttacctgtctattttttcaaatatgtcacaaagctaaatctaatcaggtagattgccattttcttgaagtaggttatcctgattacaacaaatggaagtagaagatcttctattgaacttttattttgtctattcctagagaccaccaaagtatgtgcttgaacatagctacagctacgtggggatttaattttccctgtaaaattattataatatgtatctgtctttcttaagaaaagtgatatcacatgtggatatatagctgtatatatatttaaagtgagaataggagataaatagaataataagtaaaataatagtgccaagtaataaattgatgctacattcatcaagaatttagcagctgatgagtttgttttcatgtgtttgatctattttgtacttcacacaaaccatttgatgtaaagtatagttttagaaatgaagaatcttaaacttgataaggtaacatagcttatgtaaagtttcacaggtactcagagacctatcttttaactttccaaggtataaaagttgaagttgaataattgccacaacaagaatgctacattttgaaataatattttaggatactgagagaaaagttagagaaattatacttgtgtcatcttcgaagtatgttaccttgaatttgatgaagagaggttctagaggtgttttagaatgtagtgatgtgaaaagctgggagaatacattttagctgtcagagatattaatggaaaagaagtacttcaaactagtatgattgctttatgcctccaaacctattttcccatgaaacatttaagtaatatagtgctgggagatgcttcagaaatccaaatcgtggtgttatattattacaagtttgcatgtaaaaagaactgttaataaaaatacaatatagtgatactctactgtgttacttcaattgtttttttctttttttttttaacttttcctgtattctaagttctaaaccagagcagccacgttaaaatatttacaaaggtgaagtacttgaaggagttgcccctgacatttgttggtaacttcttagggttaaatcctagcttagcaaggactatgatagaaacatttgataagcctgctttttgccatgcatttttgtaaaggataaaggaaagaaaagaacatagtcaacttgaagtgaacaaagattgagaagcataaaaagaggtgctagtcttgagttttctaaagatatccagccaccagaatagcctgttttggcactggatgagagtattgttaatgcccatatccttttaatacttaagacacatacactcctttatggacctattttcaatagattaacaaaatgatgtaacaaataccgtatagggttttatgaccttagacaaaattactgaagaaagtgacatttgcattttcataatcactgaattccaggtgctgttcctccagtacataataaacttgacatttcacatcatcatttaaatagtatcacaataggtggtgtcatagttctgtacttcctgacattatacaaaatgtaaaatataatgtgccatttgtccagttaaataaaaggaagaaaaatatttttaaaatcctctcaactctctttttaaaaaattcatgaccagctgattttttttcaccgaactgcactattctattctctgctgaatataatcccttcttgattttgatagaagcaagatggaaatgtgtgctagatcttaatgggaaattgtgttatttgtaacacttatgtctgccttcatggagattaattactaaatttatattaaagtattacttctgttgaatttgctgcctttttaaaactcccttcctttggccatttctactgatgatattcagtaaagtatctgacaactacctatgattagttttgccagatgctactttctctggtaaattcattttaaacacttgacaagcctgcaaagattagtgccagccaaactaaaaatatttttacagaggaaaaaaatgtgtgaaatcagttactttgcaggtatactgatgactatgtaaatttaagtgacagcatatcttctctggtgtttatttgtgaattgttgtctcctttacagaacagtttggtccagttattattcacaggcctattcacaggtcatcagttggagtgcttagaactttctgtatgttattctgttctcttacctgcttgaacaataaaaatgaagaagcacagtataaagttaggacatctgcattagagagtagcatgagcatgcgacctcctttctctccatactcctatcatttagtatcaagaatgaacctttttttaaatctttgaatacaccatttttaagaaaacagctaagcgatcgagtcctacatatctctgagccatgatgaccaaattgcttactgtttcctcattatggactcccctttatattaaagcttttgctttcaagcctcctttctccccacttttatacatatattatactagcaaatgcctctgggtatcagtttctttaaaacaaaaaaggcgatcgagtttgcataaataaaactgatttggtgattttggttttatctattctttgctggacactatttccccagtgccactgtttataatacccttgaatctcctttcttcaaggagagccctgtattgcagtcttagatctgatacgattcgtgctggaattaccgtaacattttacattaattcctaccattttttttaccaataggaatatttgtcttctaccaattcaatattttttcaaatatttccaacgagaaaatggtgtgggaaggataagaacctagtttggcagataggatagtgttttatccaattggctctagacttttccaagttgttggagtttggaggtttaaacttttttagtttttgtagcagatgtgcagctctgtctccatgcaagtccctcaacaactggagcagaggctctctgaagctgatgcctgaatatggatcctgtttcccaaaagggctgatctttctagcctcagcaagagaggatgcacccaaggtttcagagacatgataaagagtgggagaatacctatggttgaccccacccacttggatgagcctggaagggtggatacatggagaaactctgaagaatgggagggaataatatttgggaaataaatattttttttaatatttcaaagtgctaaccaaacactctcccacatcttgttcctgaatttatactccctgtgagttagtatgtccttcttctcttttcctgttttttcttccaccttttttcttcttctctgcttcattaaaaatagctatattatatttttccttgaaattttgttcataaacatatgtatcttgtgctctgaaaaccctgtatgaaacaaatttacaaaaagtcaaaatgttaattgatttttcttaaaagtgaataatgtcctaggttggcaataagaaaaccttgatgctgtatctaaccttgaacaatgatattaaaagtctgtatctagtgttctgacaataatgtagtatttctctataatgcagactgatcattttaacatagcttaaaagtctacatgacatttaggactttcttaaatattagtacacagaatgtttggggtagtagatatcattttggcataaatgattattgctaatatttagcaacttctatacatacaacttttctgagcaattatttaaaacataatttaaaacaataatttaaagcatgaagtcacgatcagaatatgtttcaattttattttaccactatttcatgaatgcttccagaaattacagtctagaaactttactagcagtatgatgctggtattgagaattggaatctttttgaggtgaataagtcttcacattggttgtttatgaataagattcaggcccttataacagttgcctaaggagttgatgtgtaacatgcatggacaaagtgatctctgagaaagacaaagcagtatggtgccatcttggaagtcacaaaaatcctttatacatatatatatatatatatatatatatatatatatatatatatatttgtaaactatcactacattgaccttaacttctcagcctcccgaactatgtaacaaaaacagatttaattcagtctctactacacatctagtgatgtgccttgaagatctttaatgtgtgagcattatatgtccattgcttaagtggaagtctgagattttaaatatcaaaagaatattagaagttgttttaaaaagattgatttgagaaataggaagaaaatagattcaggaaaaaataaactagaggaactaattattagtttattgcaattgcccaagaatgaagaacttaaagtagaatattgtagctggtaatagggattattattcaacaatacttgatatatatgtgtgtgtgtgtgtgtgtgtgtgtgtgtgtgtatgagatatacatagggaatatcaaatacagtttttagcctggatcagtttctatacatctatatttttgtatcttttattttatataaaaatagagagaggtatcagcgaattgtgctgacatgctgtgttaagttagaaattatttcttaactcctctggcttgaagattagacagtgtacagctagagctacatactacgtagatgctagaggcaggagttgataattacctaatttttagtctattcatgtaaagattataatttggttcatagcattgaaagagattagatcaaagaatctaagaaaagaaaagtagataaataaataccaagagaagaattttggtcaattcctctttcaaataggacttcctggcttaggtcacattgaacaggttcagtagactgggaaatattgtcaactgattgtaggaagttaagcaagtcccaggtgagaagaagttaacgtcaaatttctgtggactgcagtctttttaaaagctaactttgcttatttttgcctctaaaacattaagctatatcatgaactccatttcagcatcttatccaagacgtatttaaaaaaaaaatcattttttcgcagacttttaaagctgtaatttcagatgttgaactgatcagcatgagacagattctctttagcaccatttctgttctggacaaaattcaagctggatattacttattactctgaaatgcaaatggtgctgttttgttttacaactatcatttaagaaaccatatactcattaagataaatatgtgctgcatgaagaagaaaagagaagaaagaaaatagattgtatttaaattttttaggctgtctgatagagaactgaatatactaaccttcaaatactaatgagcaacaagatgtaattttcaaatgcagaattaatttctgaatggtttctgttcatttgtagtactctacacccttaccatttccatttttagaggttttatttaccagtatttataattgctaccacaaaatcattcttagcaaaagtattatactatgttatactgcatcctattaccatgaatctggttggacattgtgctgcttctaattttttttgataattttttgtcactaatgccatgagctgtcatttttatgtctttttcttttttcttttgtttactattttttttatatttttcctttttttgacaaacaggtataaattcttgatttggaaacctgcaagtagtctgccagtgctgtagtccaagtaatatctcaaatagggttgctgtcacctcactcttgtcttgttttctttcacatttattgatatatatatatatatatatatatatatatatatatatatatcacaaatacatgtctacatgtatatcacagcatagtgagaaaatgggttatacagtataacgttaagctcaatttactgatatgtattttgttctttaacctcacatgaggaaatagctagtctcatatcagaaacttaagtcctaaatctagctaaccatttatgcaaatatacatatacatatgtcttagtgaatgcaatcattatgattgacaagtatattgcaaattttatcttattagactgcttagaattttgattacacaccatccaaattatatttagaataagtaacagaatataaaatggtaggaattattgaagcagtgatttaccttgacttaaatctctgtttatttcatggaaacatggaatcttgtttgttggaacaccttagaggaatctgatttaatctccttttcctaatggtacaatgacatggaaagtcttcctttacatggtcataagatcctttcactaaaaatatgccacccctcatatattgagaactgtcactttccaagttctcagttccaggttaaggacagtctaggctctgagatgtcacacttcttcatattagccaaatattttaagctctttgtatgttatccatattttcatggtacatcttcacagtatgtttgtgtaattttctcaaatgtttttcagtgactctcccatccagattagtgagtgctcctgttatttctcatttcctcatctatataatctgtggcagactgatatttcagcattagtagtcatcttgtctccctggaagcacatgctgggtttggtttgtggtcagctaaaagctttaattcagttcgtttatatttttcaaaacaaactgttggcaagttggattataacaaatcctagggaaatatatttcattttctggaaaaaaaaaaccctaatacttgatttaagcttacctctattacctgctacaaatccctttgagtgttgagtcattagcagaattaataactcttagttaacaatatattgaaaataacaagaacaagaaaaatactccttaagactcagagaagaacccctcctgtgttgtcaccaatctaactagctaacagtgccaatgcatttaattttcacatccactatttttcattgtttccaaggtactttcttacaatacataggtttatctttatcaatctttccttaattatttttccatcatgtttgttactctttgtttttttttttattttttactctcctatttaatctctgaaggctatgattaattgattgattgtggattcattaattcattaagtcacttggaaggaataccatgactctgttgtcaactgaaaggtcttactctttctgtttttatttttgaaacacaatgtagtatgtcttcatattttaaaacctagtgcctatgctgtagtgttggcataaatattttctataaatagactgtctatataacaaaagtggaaacaaaatggaggaagcaagggtatgcaatccttctctatttctggactatggtggacatctttaaagagcttcagttctactgtcttgaaatgtaatacacccctgtaaaacaacaaatagacaaaaatatacgtgtgtgcgctcacacgcgcgcacacgcgcgcacacacacacacacacacacacacacacacacacgtgcacaggcacacatgaaactggcagttaaattaggatatccaaaatcctcccatagtccccattatttcttgatttttttcatgcaatattctgtaaattcatcaagcgctttgatatattgaagaatgagacaaaggtaaaagtgcttcattttcttgatggtagtttgggtttgtttgtcttaagagaatctcacacatacagaagtttagttttcaaaactccatatctttcttagtaaaagtaatcataaaaaagcccttggaatagatggccttggaatagatggaggttgcatataaaatcttagaaaacaatgactgaattttggatgtggttgaaaagaatttgcagtgtcagtcttacaaaagaaaaggaaactaagcaggtgttttaggagcctatgatattttagaatatgagggagtttaaacaaggccatcaacttccctatcaagttggaaaatattaaatactaacaactactatcaaggtttcaaatttgataacagcattgttattgaagaccttttgccatagccagggagcaaattaagtgtatattggaagggcttgcatattgtgaacaacagtaggaagagaagcagtaggctattctccttaatataaataattgtgtaagtaagattcctagacttttattttgtgttcctgtttaactaatagttctgtggatgaaagtggaaggggaattacatagagttgtagaaaattactggaagtttgctatactgttttaattgattttaacatcagagtgttcaataatgagtacacaatttaaccagcactggaatgaaattaattgagttctttgctctgcataactttaataacagacagatgttagatttccagtaaaagcaatgaaggttattctctaaattactttggatttacaatgctacagagcattttaattacagtcatatgtgcatactttaaaaataatttcaaaccattttattatggtaatagaatcacatttatgactcatcatgcaacatggaaagcattctctgtgtatataagttttgcatttcaattttttgctttgagatttccaagatcatttacattttctagtaatccagttttgaattgcatgggtatatatatgagtacatatggatagggtgccaggacaaagacttagtttttacaaaggcatttaatattcagagagttggcaatattttttttcctgtactatgacaagacaactgagaatgaggcagaaagggcacagataaagtttggaagatgtagaaaatattaaaaaggctagctaataattcagatatttgaaccaagtcaagattgaagacattatcctgactattagaatgcagatgccaaatgaaatgctagctaacacaaggccacataggaccctaggttaatcaataactggaatgactcaagattttctaccagtaagatatacaagaccataagaaacattgtctatctccaatgaataccagaaacatgggtaattaattataaaaccatgttttcacaaaataatttaattggaacatcgtaagtatattttatattatagtttactggtatatgatacataatgtgaaaatctgcgacaatttctgtcatcattttatagagaacatgttagtcttctctttgacattctagttttattttagcatatgtgctatgaaattgagcactataaatgataatggaaatatctatttcaattactgcatataaggtcattttcttcattaaatattgacagcctaaaatggctaataaccttaagtagatgaagaaaaagtaactaaaaacatttctctatgcctagctgaaaatacaatgaaaatgaacatgtagtggaattcatcatgagtacatgtaacctttaaatctagcatccagtgccagttaccttcctttgtaggacaaggccccagagagatgtttaactaggcacctttgatgatggaagggttcttaaggcaagagcagaggcagacattgtcaacacgtgtgcagtaaaggctgcctactcaaactctgggcacttttatgtggcttgttacgttgcatgcaatgtgcatagatatttaagctcagtgcttttatttacaaacaagtagcagaaacagactcgaaaattaattctttggtttccagtaattttttcgttatcgccttctttttaccaaatttgctgtttatttatggcattcctacaccattatcgctgtctatgtattttcttctgcccccagaatgcccataatataagtgatgcaagtttttagttaaagaggtgtaggtcattagcatagtaggtatatactttttctcgtcaagaaattgaaataatcctaatgtaatggaaaaaggatcataaagttttagatgtttttctctcagctgctccttatttgaataaagtataatgtttaagaagttttcacacaaacatacacacacagagagagaaagagagagagagagagagagagagagagagagagagagagagagagagagagagagagaatatcagaaaaatgatatggtgataagccatacaatgactacacacctgtgatgctctagagcaagaaagtggcgaggtggattctgtaaaatgactgtgtattcatcacccaacctccattatctgaaggcagaaagcagtgctcttggtcttgagcctacaaatgtcctttcacttttccccttaactcattttatgctctgttgttctagatgtcctatagaaaaaaaaaaaaaaacattacacatgggttacactttctccttcagcaattggataccgtattttgcttttaagtcctgagtagggtaggttctggtgaggtattttgcattttcactaggaagcagcatgaaagcgtattgattaggaaggtaccttatctgcaatagtacaaaagtatgctcaagtataactctatttctgtttggctcataattattttacataaattacattcctatgtgtggaattaagatatcttctatggtctaggcctctcaacttaccatttatataatattcgtttctaatgaaaaggaagatgaaacaaagaagaaagttactgcagaaaacaatgaatttaatgttcttcccctcagtggtgaaattattttttaaaaaaaagaggtgtatattaattcatgtaacaaaaaacctaataaatctaatatgagttcatactctgcacatatattttagagaacatagtatccataaaagaatgtaagccatagatctggagaggtaaagattcgccaagtctccagatgttctaaaactacactgaggctaaaatattactcaaaagccttccttgatctgtaattaaatggtagcttggaacatttgtacaacaagaatattgagctaaagaaacttacaaatacataaaatttagataacttttcccctgctctgagagtatagttttaagacatccttcttttgtgagaaatgatggtagacagagagagtttcttctcaagcactttatcctaatgtgataatgtagaaatctgtggatcctgagctctgaaaacaagtggcctagtttaatgtcttattacacaattaagaaaatcaaagcacggaggagtcaaaacaggtgatcaaacgttcactgcagaaaaatcatcagccatcaaatcgaaactcaccattcatattcctaatccagagctatgaatgaagtagaaaattgcttgatattttccctaaatatcacatttctatttttaaattaaccttagctttgtcgattttttcttctttcattaaattcacacttcctacattttgatattcctaaatgctgcttttgattaccctcattatgcagttaaattagtttgtcaagtaccttttaattattgatttgtctcttattttattaaaccaaattaaaggtacatttgtctgctaaagaatttaaggccttttcattgcccttgcactaagcctgagtcatctcctcattggtgtcatttaataaagcccctgattacattctacttggatgcctcctggtgctgggaagttgtttcatttcctggcgaagcttatgctgacaagttggatggaatgggtactggtatcatgcatttaattacaagttacatccagttactggactgtgcttctttatccagcagaattttagcattctgacaaattattatctgaacccaggaattacctcctaagtttgttttctctgcagggactagggtatcaagccatgtggaaaattcctggagctcatattttcatagtcttttgtatttatataatacattatataacaaccatttatttctatattgtttttagcataccttttcacacattgtcacactattttttccagtaacattgtgaaggcatatttgttcttgttaacatttttgatgatgtaactatagcaactctacctcaaatatcttacatattaaaactaaccacacacaattaattaacctgaaagttgcagtgtcacaacatataacccaaggtcccatgaccacaagtcttacttatgtttcatattccagcatcatgctgaggcatatcgttgcttattatttctttaaataggttctctattccccgcctaacagtgatgccatgtttagaatctcattcccattttaatttcctagaatattttcaagttgttgaattaatttaagtgtttccacctgctaagtaggataagctacctcaaacactataatgagaggggagaggataaaataaatagtattgttacaggatttaagcctgaattaagtataaaatcataaattcaattaagtgtgattaaacgaaccattttatagcttaacatgatcaagggcatattaattatgtcagcaagagaaagaacccatattcagacttggaaagctggcttttatgttagatttgccaaatctgtatcctgtattctatataaactccttccttgaggataaattacttaaccagtaactgaaataatttgatctggaagttatgtcctaatctcacaccatatactaaaataaatcccatattgactcaaaatataaaagttaatgaaaagcaaccaatagagatgagaaaataaaacatacttgagtattgtctaatattgaattagggttagacttattcaacatggaagtttaagaaaaaccaagtacagacaaattttcttagctatcttccaattgaataattctgtaattggaagattatagttaaaactaaagaaagtgaagttctttgtgagatagttgaagtagatgtaacattactggtaccacagtaaattgataactaaagcctaacataagttcagcattttctcctttagatatatttagaaactgacattggtcttattagttacatacatcatggttaaaagtagatagatgtccagtaaatggaaagtagtaataagctaaggtaaccagcaccagtgtaccgtgctgattcacttttcacttagcatacaaaagatcaaagctaaagcactgtatggggttggctagcattgttttactatgctctaacctcagcttgatatttttctctgagactaggtctcattatgtagtcctggctgttataaaattcactatgcatacataccaggctcacttcaatctcaatgagataggcctgtcacttcctcccctaaacagcctgttattaaagtcatgcaccaacatgttcaactttcatgttgtatgttcttgttgaaatatcaatttgtattattgaaacagaagggaagcaattatattcttttatatcaaaagcactagatatgtatcgagcaatagccagtgtaattttgcattcacacatcaagtttatttccatttctacaaagatggcatacgtaaataaaaacttagttgtttaatatgatgaattgttttcctaaacacaatgtaaacgcaatcatggaactctttctgactataaattttaccagcattaagttcttaaatacaggacacaaaatatgaaaaaatatcaactaatatctttaaaaatgttattcatccaaaacatgttgagacaaacacatataggattacaaattttgttaacttatctctagaaccaggattcaaaacaggaattttagccataagaataaaaaatgtttgttgtatgcatttctgtagttttagtatattgcagcacatagaaaaaggacaataaaacgggtgctttttcattgttttttgtgttccttccttcagttctgtgttactactattgtatctgttctgaagtcaagcaagatatggcagaagattgtaagcattagaatattttcagatgctaacaaaaatatatatggttatagtggtctgaaattcaaaaaaccattaacaagggatttgtcatcaaatgttaataaacagagaagtggtagagctatcaggaaagaaacctcaagtgcttcgattatgagctactattaagagtttgttataggaaaaagagaaagcaagttcactctaacctgtgccttcaatgtgctccaagcttatcacgtagaaagaaattgagctagatgtccctataatatcttatccttgattttgtttttttcggattctctttcccttggccaattttcatgtaaatatattgaatagaaattccagaagtaacaaactcttaggttttaaattgcattatactttgagtagtatcttgaaatagcatattgtcttacttcagccagcctagtccataaatctgtccagcatttctgtacaatttgtgttactcagcaatggctcatttactggttttctatccaactgccatttcctggctttttatgactttctgtgtcagtattcagtagcctttattcaacaatatctacatcattcactttatgatattgtatatactttatattattaaaatggtgtaatataatacacagattatttggagaaatcctacttttattacaggctactgttggatttttctattttattttgttgaaaatctctcacataacctttatgtttcatcatgaagctttatgtttcatctattgtatccaatttatcccatttatttattttattttggttgtaaatctcttacacaactcattataaatgaagctttatgttatatatatactaaaatatgttgtatttgtagaattcaataatgctcagaatttcagaacccagtggaagtcatgggaatacatgacccttaaataagaataattgtagttaattcatttaatgttgagactgtagatatggagctgatatatagtgagatattttattttgggaaaattttggaatatgcctcttatgataataaattgattctattttccattattttattggaaattggagagttatatcacaatgaaagaaacttttcagggtgtataatacacgtggcagttaaaaggtatattgatattgtctaatttatgttttttcaatatttctatatagatcaatagatagatcaacttccgtgtgactcaaattacattgtaaatgtcaccttatttactacttatgaattagttaaacttttttgttctggtatatgagaagacatagactaacaatataagcatagtgaataaagcagccaggctgttgccaaacaagaggccttctgtgtaattctccttctccaattatactttttaaatatatttccttaattcttccttctaacccacaaaatgcatatgtttactttgcatatatgcctcattataaaagcatttctaattataatgatctaggaagtagataaatttgaatgattattcatcttgtaaaggatagtatatagctttttgtgtgaacttccttcatgcacccacaaattgattccatgcataggaaatgtagttaacctactttattcaaagagaattctatcatagaaaagagctatgtcagtactttaaatgtagatgtgaacactcatatgtatgattacaaaattagtgccttcaacgaaagtattacaactcagctttttcctgcccaaggttaagtttaagaagtagagatcactcatttcatgttttccttgaccacatctaatttggagacaaaaagcgagactattttctaatgtcacttgattagattcttatctccatttcccaagccagtgtgcatttacacttgaatataggaggggaggggatttgctactcaatattcagaagcaaacaagttatgtttgtatcacttagacagtttatggaactcatagaaagactctcatgttcatgagagtcagctgaaagacatttgtttgtttcagaagatgagaatgaatgatgctattgaatgtgtcatgaatgttgagaagcccaacttgcagttaaaaaacatactgactagattgaatgactctagaatggttcacaagaagcataaagaacctatgttttgtctaaaatgcaacaattccaatgaagtactttaaaatatacatacatacacaaacatccattttcacatacatgtttaagtagatatatgagtatgtacacatatatacatatatatgtagggtattttttaaaaatatatagctttaagttaatattttatactattatgtatgatcacaaaaatctattccatacaaatttttgaaatggattttcttagttagggtttcattgcagtgaacagacaccatgaccaaggtaactcatataagaacaacatttgattggggctggcttacaggttcagaggtccagtccattatcatcagagtgggagtatggttgtgttcaagaaggcaagattcaggagcagctgagagttctacatcttcatctaaagaatggtagcagaatactgtcttccaggcagctaggatgagggtattaaagcccacacccacagtgacacacttactccaaggccacacctactcaaacaaggccacacctccaaatagtgccactccctagactaagcatatagaaaccatcacatggatgaaactaaaacctattaaatatggatacatatgtagacagaactgtattttaattttccttagtatatttgtattcacacaaataaaaaatttcatacttaaaatatcactatgagcttagtaaaatatcagcaacaccctaagtatgttgtttcttttaatctttatcagatgaaaattatctgtgctttaagctagttatccacacctgtctcttgatgatattggtcagtgtagtgctgcttacaggaaaaacagtccctgataagtttacttagatagcctgaacttcacctatgtactttgagcaatgtgataccatgttattgtcaaattacagtaatttccaaatggatacttctactataaagacaaatgcgtagacagacaaagacttcaagcatatcagaacaactgggtagaggcatatagaatgcatttacttaaatgtccagtttataatatgtacatatctgaatcatatctacttaaatgttgagtggtgtttaaacatacagatttaacatttgattctttatgagttctgatcacattatgcttaaaatttatttaagaattagtaaggtgttacatttgataaaattatcaaaatgagtttatcctattaaaggacaggtaatgattttaacatgtcttgggtcaggatatataaggcactcagggatgtaaggcatccttgccaggaatgataacacctgacagaatattttgaccctgtgtcagtgtttttagtaggaactatatgcctatgttttaaaaacatacactagaattttggctattggaattcctcttacctcccaaatattggagttatgccgtaatcacctcactgttccttcctgatatttgtcacagcctctgtcttggatgattaatgaacctatagtcatcttaatgaattttcaacactgctcctaactagtccttcaatatgctagtagtgtctttattagtatttttatcaaaattaatggctaaattgaatacttactcatttagttaattagaaagataatactttattcaatatattagaaatctgatcagccttactgcataaatgtgatataacaatgttccactgaaatactttagcattttaaacataatgataaaccatagtacatttgaaacattattagaaagggtgtctatgaagtttatctatgggaccagcactgtcctgtatgataatataagtaacaatattatattataatgtaagtaaccatgatctggtccctgcattattattttaattgaactcaagaacaacaacatagaaaaccatgtaatcatgctgattttatatttatctactggatgacaggtttacacttaaagaatcaaatagttctgtaatcctgattgtaagaataaactttatttcgcgatagtatttttatttgctcaattggtctcactctgttttaagtttgggttggaacgtactaatacagtagctcatcttaaaagaggatccctttactattgccaggtaattttgccaaaagagaataatcagcgcatgtcctcataaatttaatggaaaaataatgtgtctttctgaaactacatatatgtgtgtgtgtgtgtgtgtgtgtgtgtgtgtgtgtgtgtaggcagaaacttaaaactagaatttaaaacatgatttgttggaagatttcatccatgtatacaatcattataataaagtatgatgccagcaagattttgctgaaaggaccctgatatagctgtctcttgtgaggctatgccagtgcctggcaaacacagaagtggatgctcacagtcatctattggatggtacacagggcccctaatggaggagctagagaaagtacccaaggagctgaaggggtctgtaaccctataggtcaaacaacaatatgaactaatcagtacccaccagagctcgtgtctctagctgcatatgtagcagaagatggcctagtcggccatcatgggaagagaggcgccttggtattgcaaactttatatgccccagtgcaggggaacgccagggccaagaagtgggagtgggtgggtaggggagcagtggggaggagggtatgggggacttttgggatatcattggaaatgtaaatgaagaaaatacctaattaaaatgggaaaaaagaaagtatgagtttcaataaagtgtcaaaaacttttatctatgtgtttatgttactaaggctttcaaacatatctaaccattaaaaaagaaacacataaactggacggaaaagttttatttttcggtacacatcaaaacttgtgctaaaaaatgtacagaataattttcattgtaagtggaaatttgttaatattaatgataggtattttatctttttaaagtttttaattaatttcattactttattgaaaatcatcaccttatatcctctgtccattttctgattgagattaatatttttgctttttatttatatgaggtatttttaaaaatcatgtttattggaaatgttttcttattttgtttattctaattatatttggaggatcgtaattataaatccttgttgaacatatgactatgttttgaaatacttgtaattgcaaataggaatgtactttaatttttcagtgacataattatagatttgaaataatatttgctaattgagtttagaagtctattacagctgttttatgcccactgctttggttggtatgaccatttattgctgaaattttaataattttcctgaaagtttttaaaatttctcttgaaggaacaaattttaaactccatttctctcttgtttttctaaaattatattttctttgtttattctgaaccgtcacaaacattatatgttttcatgaggtctgtgacaatgatgagaggctgccttatggaattaacataggcatgtggagactcttttatggcactaacataacaagaaactcgttctggggcatgattgagaccaggtgcaagtgaggttcaacagtttctattccacagagtgccattttgtcccaaatgattgatgacattctcttgccctattctccacagattcgaagagaatgcagagcttctgtagatacccgcttcattaagcatgatcccaaaatgtcatttaatttatttcttagatcgaatgtctcattaaactctgatgaggccatgagctactttgggctagacttgctatgaagcactcgtatcttaaaattttgttctgtccctcttggcaaaggaaatgtacatgacagtgaaatcaatgcacagtgcactttgtctttgacaaattgaagtattgtttttgctaaaataggcctgtgggataaagagattaaaatatcacataaagtaaatcaacatggagtatgaatgtacagttagacacattttgctgtgaccttgcattattttaatgtcgtttcacctccattcaacaaacagatcattcctgcttaattaaagaacatggtgatgtctataatacccacttgtaaagtattctaaataagctaagtgtgcagttgtcagttttgttaaaaatatgtattgcagttgttatttttattacataaatgaaatgattattccacaaaagagtatgatttttcataagtgtacttccactcttgattgtagggtcaaggacagcacatagtcttcttaagttgatatgtgtggaaagtaattgaaagggtgaattcttgagttaattcaatggaaagtattgtaagaacaaggaataaagacttagacctgggctaatttgtaaatataactgataataggttttgaatactttttttgagagtttaggatcaagagttgacaactgattgcttatatagactaattcaattttcccattttgacacagtgcacagtcagtattttcctctctgtgcctgcccatagccaccacacaactcctcatttcagaatctgtagtactctgttcttttacctacctgtgcgtcactgcttattagaatgctgcctcacagtattagcattttgtaaatcagtaatggcactcagtgtgttgtgcataagtacttataatgattttgaggcatctcactccctaaaatctgttagcttcctagtatatgttaagccatagtatatgtacccattgtaatatgaagagaaaattaagcttaaaattaacaataataatatttacccataaataaaaggaacatattagctagttatcagtcaatctccttgtggagaaacagaagagaaaacagatagaaaccattgcaacatgaatttaatagcatcgtgcagttcttccttttaatgggatgaaaagtcttagttatattattatggaccattattaacattatattaatattaataattaatattatcaagttccttcttaccaaaaacatacacatatctgtgcatgcatgcacacacacatacctgtgtagtaaaaggtcttcatattagatttgcctagaaagtttttttcttttaaatgtcctttctgactggagacataactcctttgataaaatatttgccttaaatgcaaaagtaaacctctggtgcctttgatacccagcatcaaagaaactgcctagtggcttttgtctacaatttcagcacttggtaggaagaagcaggaagattacaaaagcaatgccatcctctcctaacagaaggaatttagtgttagcctagagcctaggcaacatggtaaagagaatcttaaaatttaaaatatttaccataaactgtgggtactagtcagtttctgttatttaattgttgggatagtctctacaataatacataggtttagattttatttggtttttaataacatgtttgaagaaaatgcaatgacctcatcaaatttgtccccacccccccaccccccacccccccacacacaaaaagaaacattgcccttctgatcttcctcttaggatctttctaatatgtttttcttgaatactatgaggctctggtgtcattgagtctttgccattgaatgctttaggggcttgttactagttggctctacattatttcccatggagttgtttcttccctagtcctgaacaaactctgttattaaccatgacatgaagcgttcatgtatactaagagtgaaataggatcttgttgcttcaaaaactcttaatttctagttcttaccatgaatagctctgagaagtgaatcatatcactgtctgtggaaaactgaaatggctacaaagttttctagaaaccattagccctgtctacattgaacataaaagctaagaaaatgaattctctattcaatattctgtcatttaaccaataggccttcatatgcctttttggcacctagattataatggtttgtaaactctattttatattaaaatctatttaataaataatgggtgattagctgctttctgtcatactaagtagcgcctctttttggtgctttaattaatttcatttacattgtggaaaataacatgtttacctatagtggtgtttctgattgtaatagttttacaattttttaaaattaaaattggcacagtcaagctattataaaggaagtaatgtaaattcagtatacatttaatggaaattatacctccaatttcaattttgatcttttcctttgatagtaatatgtgacatggtattattgaacactggacataaggagggagctacaattcttagttacctaagtaatgaactgtaccggttgcttttatgtgtcaacttgacacaggctggaattatcacagagaaaggagcttcagttggtgaagtgcttccatgagatccagctgttgggcattttctcaattagtgatcaaatggggagggcccttggtgggtggtgctatacctggtctggtagtcttgggttttataagagagcaggctgagcaagccaggcgaggcaagccagtaaagaacatccctccatggcctctgcatcagctcctgttttctgacctgcttgagttccaattctgagttcctgtagtgatgattggcaatgtggaagtgtaagctgaataaaccctttccttcccaatttgcttcttggtcatgatgtttgtgcaggaatataaaccttgagtaagacaaattagtactagcatagtggggttttcctgtgataacctgaccatgttttggggaggactgtggaagaactttggaactttgggctagaagatcctttctgtgttaagagctctgtgggatgttgtatagaatcttggaagataatgttgagaacagtgcagaagatggaggcctggcttatgaaatatcagagggaagattaaagactcttatcaaggtcattgttaatttgattgtgaagattctgtgaatcaggttagctggggctgaagaatcagctttgattaacaagataccagaactaataaaggaaaacttttcattactggactattgatgctggttagctggagctaagaaattagcagtgattaagaaaagaccagcatcattgatgtgaaatcttctcggaagtgtttcctgagagcacaaagaggttgtattctagagatagccgaggttgaacctcttgctgcagtgggacttggtaatgtgtaagagtaacccaggtggtgcttgttttgaaggcatgaaggggtcatgaagggcagctgaggctcggcattgtgagaggccatggaagtctattagtgaaggtgcagcctcagttggaattgatggcacaggtctgaaggtgtcatacaaaggagttgaggtttggcaccatgaagaaagcccatgagaggctattggtgaagcctagttacaacagaagacagcagtgttttggagatgtcaacaccgtcagatgaccaccaagaacagcagcaacagcggagtacaggcagatagagcctagaagacaaggtgtgtgctacaaagggcagagctgaagaagtgacccaagcccttggaggagcccagaagatcttgagttggatcccagacagtggacgttgtgactgtcccctggtatttttcctttttgaaggaagaaattattttagtggaactcacagttaagagacttttaattgtaaaaagactggattttaaaagagatttggacattttatcgggaattaaaattttaatatgtaagaatttgcaaagactttgggacttttaaagttatttagatcttggggatgaataagaaagtaagggttgaggcttaatagtgatgtgtttgtgtgtcaagttgacaagggttcaattgtactggctgattttgtgtcaacttgacacaggctggaattatcacagagaaaggagcttcagttggggaagtgcctgcatgagatccatttatggggcattttctcaattagtgatcaagtggaaagggcccctttagggtggtgccatccctaagctgatagtctttggttctataagagggcaggctgaacaagccaggaagcaagccagtaaggaacatcactccatggcttctgcatcaactcctcttttctgacctgcttgagttccagtcctgacttcctttagtgatgaacagcaatgtggaagtgtaagctgaataaaccctttcctccctaatttgcttcttggtcatgatgtttgtgcaggaataaaaaccttgactaagacatgaactatatcttatggtttactttttcaaatttaaagagtgcttcattgattaaatacctgaaatatagttcactttaagctattctcaattttaaaaagatttaatgaggtgtaatcccacttgaagctgaagtacattggcagaaatgtgtgtgtatatgtgtgtgcaacacatgcattcatataattatataaataagtatatatatatatatatatatatatatatatatataattcttatatttatatatgaagcacatagacttttgtctgtaaggaaaatctagtatatagcctcacaatttaatgctgattttgacctcaggattagtagtctaatcctgaggtcaaaatcatacagcttcccactctttctggagcagatgacccctttctggttgtgataagaacttaattcactggactcaacgtctgctggaagtattttaaattaatggccacaccagcccatgaactatcatattcatttgagtgatgttaaataaaatgtttcttagcaaggattgttcttataaaagtaccaatactgagaacctataatatatgcctcatatatagaaacatctttttagaatgattttgccttctttaaagatatgtcttgatcatacaaaggaatgccacctgggttttagataaactggttaaacacaggttttctaaataaatcagtaagtatttattaagagaagagagtgataacaggaagtaagacctacactctaatgtgtgtggtcatgataggataagtacaagtatcagacaaaatcaaagctgctttttctgccccattgccaatgatttccaccaggggcagtggtgtataactttcaacaactaaatgattttggttggtttttttttttttttttggagttttgttagggcactcaagatttgttttgcctgttttgcttgctcagttatcactatatatatatatgtatatatatatatatatatatatataatatataattatacaatatatattaatgttaaagtaatttatatattatatttattatatatagttatttatatatttatatattgcataaggtgaggaggaacagacctgaaattccagcatgtaagaaactgagagaggaggatgagtactttgcgtccaagaacatctacatgatgagttacaagtatcctgggtcataaccaaactttctctaaaagattaataataatagtgatctatcactttagctataaaatactataataaagattaacatccaagaaagtaagtatgggaatcaaaatatatttaatcctagttttccaagccacatatagaacaagaattctgcctaccatttccactgtcctgctattcataacttatcatacagagggcccaggcagctaattatgggattatttcttattatttcaaattcacctgttttcttccagctacacagaagagatgaataatttgctctaacacatcctccaacgcctacataattcttgaacccctgacaaggaaacttgtggcctacactaaaaaatcaaacaaaacaaaaacacaaaaacaaaaaacaaaaccaaactatacccctgatttcagattcttatgggttctcccactttcacagttactttctaacctattctgtttgtccttcccatagtctgccttgcttttacctgttgcacttattgtattatcttttatttctttttgttgtgggtatacatcttacatggactactgtggcagttaaagagccaccttcagaagttggttttctccttccatatctgtttgtaagtctcactcccagatacttaggctttcattatgaggcttttcactgcatagctattttagtgtcacatgcatctgcctacttcactccagcactgtgatcatgttcactcccattttttaagactactcttctttttctacgctgattaagatggagaattttctttcctgacctcattggttttgttttgtttttataactaatcaaatttggcttaaaatttcgctatccttttccccttttttaaaattcaaccacagtgcaattagatgccttacaagtatattcatttttaaactagactcctccccttgaagatcttaactaaataagagaaattaaatattctttatctatgtgaaaaaatcaaatggctattccaataatatctttatttagttaagactataaattatgtggtaaaattcgcatgagaaatatcaaacttcttccatatttctagaattacttatgaaaattattaaacctttttgcaataaagtatgtaatatatatgtatattacatatttaattatatatactatatactttcttatatatattatttatcaaatatatatctatatatacatacatatggaagtagcaaactggtataatgttacttgaactagaaattatttttctgtattttcaaatgcttctgaaagctacaattatttcagtaggaagcctcctgctgtatttaataacttaatgctttctattgtgtacaataaatacacatgtgttatttgaccatgttttctttccaggaattacatagaaaaattaaatgtaaattgttttattgttggatctgtgaaattaaatgttagaattgtttgtgtcactttccagaaatataaaataagttaaacagaatttcttccatgagaccttaggaaattctaaaagtaatgataaaaaataaaaatgtattcaagatctgatctctcttataagtgttgtcattttcaagattaccatatattataggcatgtgtttatattaagaaatcagttgaataaatatgaataaatattcacatacaattttacatgttctttaatcaagaatatcagtactattgaaatagaagcaaagcttgcaagaaaaactatcatgtgctaggtctatgcttactcatagtcatggttttatcattacctcaagataggctcaatttctgcaccatcatttttaatctaagtcaccaactgaatatcttttatagatgtcagagttattagatttaccatctgcaaaatactcatcattcagaattatagaccacttagaagattggcaaggacaagctaaaactgaaaataggtctctcaacaggcatgcaaaatcataacagcgattcagtacattcgtcgagctattttcctttcatggtagaaaatggaggcagtttatatttgagattgttttcagaataaacactggaagcagaaaattacacctgtacttattgtcaggccacatttgttagatcatgtgttgtcctccttcctagatagacccccacattctgtcaaaatattattactatgactgtcctttgttgcatggtgttcagttttgatctgactcccagaatgctgctgcttttttgcttctctctcagagaggtggaagcaatgctttagagattctcgactgcatgtaagattctttcaaaaagtctgatccttgtcagtgctcatcaattttacaaagtaaaaagagaaatcacacacttgacctttaatgtcattacatagcttgggtcttgaggtgagcaatgaaagcaacaacttgatgatagagatttactgataagcacttctgttccaccatctgctccctacctccccatggcagttaatatggaatgagatacctgggcagggcttcaggggtcatggtacaatggggatgaagaggtgtaagcaggctaggtggtgtgggagcagatggtggctgggaagagaggcactccatggcaatgttggcatgtttacagagaggtaggtgtacagacaagctgtgccaattcttgaatgtttcaaaactccacttgtggcttctggccgcaaacttttactcatttgctgtcatacagcttctcaattgccagcaattccttttaaaagtcactcttctccttgtcttatctataagctgtttaaaatatattctttatgtgtgcagtataattaatatactggaacgaagagaaaagtatatgtactgtccttgttccttccagatgaataataataagcacatatcaaattgataaggaagtgtgtctacatgtgtctttataaatagctcagctcctaaaatcgtttatatcacaggagcaatactatccaaaactatttagcagtcagtcttccttttttttcacttcggttgagggactcatatgagcaattgcttgtctcatcttcagttccatttctcgtttccattaaaaaataaaaagaaagaaatggcctaatttaaattgaaataagtccttggctaaagtcttattttttccctaaaaatgcatccactgaaaatgttactgccattcctagtatctaaagtgtccttagaggatacgcataatgagttgatttgaagttttggccatatggcatggttagaacaaaacattgtattaggtcaaaccatgtgtagttgctgaaagtcaccattttgaaattgggaaataacagttttgtgtgcttctgtcttgttatacacttttattcttatattaaattttgtaaaaaagtaaagaaggaatgacttataaactttgccatgtatatttgatcttccagctaaataaagataataggcaacttgccaaactgtctggtccagctcaaataaaaatactgttttcacagtgtaaagttctgtgttagaagtgttctgagggcaatagttggctaacagattgtctttttaatacatctagtgaaaggtaacttggctatatacaaagtatttggttacagagagatgactatatggtatcctttctgttaaaaagtaagaggggttattttatgtgttgttcactgggatttcttgttgaaacttttgtgccaagtaaacttatttaacttttcccatggttcaacaccataattctttttttccactgctgcctgcctcatctgaaatgaagtcactctctaaagcatattaatgattaatattaaatatctgtctttgtagtctaaatgtgtatgttttttctaacagaaatgaaaattaaattgggttttgttctaagaatttatatttagatgaagttatttcaacagtgtccactgtatttaattacatttctgtagcaaacatcattttatcacacagaatggaacaacatatttgaaaagtatatcaaccacatcaagctaatataattttaaaataagtctgaagatcatataatctatccatccagttctctgagtgtacaagcatttcttcaaatatctctaagtgcagatcaggtcagcatcaccattctgattgaatatgttttcaagtgatgaacaaataaacaaaattttcatatgtaattcatttttgctgatttcctcactagaaatgtcattattcttaacttcttgacattctcttcttacttcatgtttttaaccactaaatcatgcaggataattgatcattaataaattttctcgagttttgtccttaaaaaaactttatagccagagatcagttcacacaggagagctcacaagtggaagaagctatatagcttctggaaaggggtcctttttgggctttcatcttcagccagaggcagagctgagacccagaactctgcacacttttcccaccagaggagaggcagtctccagggagagctctgtcctcaggatcaggtaggaatgccatcttgtatcccaggtcccaaagagaccagtccacacaggagaacacacaggtggcttttgggacagggtccttttcagccttcatcttcagccaggaggaagacctgagctccagaactctgcacacttgtctacagggagtattctgacaactgagactcagaagagagttgaactcccaaggactgctgacagaggctaacagaataacaggagaaacaagctccagccacagacagctataacaactaagccagagattaccagatggcaaaaggcaaacttaacaatcttactaacagaaaccaagagaactcagcatcatcagaactcaacactcgcatcacagggagtcctggatacccccaacacacctgaaagcaagattcagatttaaaatcataactcatggtgctggtaggggattttaagaaggacattaataaatcacataaaaacatacaggagagcactgctaaacaggtcgaagtccttaaagaggaaacacaaaaatccctgaaagaattacaggaaaacaaccaaacagatgatggaattgaacaaaacaatccaggatctgaaaatggaagtagaaactataaagaaatcacaaagggagacaactctggagatagaaaccctaggaaagaaatctggaaccatagatgcgagaatcagcaacagaatataagagatggaagagagaatctcaggggcagaagattccatagagaacatggaaacaacaatcaaagaaaatgcaaaatgcaaaaagatcctaactcaaaacatccaggaaatccaggacacaatgagaagaccaaacctatggataataagagtagatgagaatgaagattttcaacttaaagggccagtaaatatcttcaaaaaaattatagaagaaaacttccaaaacctaaagaaagagatgcccatgaacatacaagaagcctatagaactccaaatagactggaccagaaaagaaattcctctcgacacataataatcacaacaataaatgcactaaataaagagagaatattgaaagcagtaagggaaaaaggtcaagtaaaatataaaggcaggcctattagaattactccagacttctcaccagagactatgaaaaccagaagatcctggacagatgttacacagacactaagagaacacaaatgccagcacaggctactctacccagcaaaactctcaattaccatagatggagaaaccaaattattccatgaagaaaccaaattcacacaatatctttccaggaatccagcacttccaaagataataacggaaaacaccaatacaaggacagaaactatgccctagaaaaagcaagaaagtaatccttcaacaaacctaaaagaagacagccacaagtacagaatcacaactctaacaacaaaaataacaggaagcaacaattacttttccttaatatctctaagtatcaatggactaaattccccaataaaaagacatagactaacagactggttacacaaacaggacccaacattttgctgtttacaggaaacccaccaaggaaaaagacagacactatctcaaagtgaaagactgcaaaacaattttccatacaaatggaccaaagaaacaagctggagtagtagccattcaaatatccaataaaattgacttacaacctaaagttatcaaaaaagacaaggaggggcacttcatactcatcaaaggtaaaatcttccaagatgagctctcaattctgaatatcttggctccaaatgcaagggcagccacattcattaaagaaactttagtaaagttcaaagcacacattgcatctcacacaataataatgggagacttcaacaccccacttttatcaatggatagatcctggaaacagaaactaagcagagacacattgaaactaacagaaattatgaaacaaattgatttaacagatacatccagaacattttatcttaaaacaaaagaatataccttcttctcagcacctcatggtaccttctccaaattgaccatataattggtcaaaaaacaggcctcaaaagatacaaaaatattgaaattatcccatgcatcctatcagatcaccatagactaaggctgatcttcaataacaacataaataatagaaagccatcattcatgtggaagctgaacaacactgccctcaatgataacttgatcaaggaagaaataaagaaagaaattaaagactttttagaaaatgaagccacaacatacccacacttatgggacacaaggaaagcattcctaggaggaaaactcataactctgagtgcctccaaaaagaaactagagagagcatacactagcagcttgacatcacacctaaaagttctagaacaaaaggaagtaaattcacccaagaggaatagattgcaggaaataatcaaactcaaggctgaaatcaaccaagtggaaacaagaagaactattctaagaatcaaccaaacccagagctggttcttccaaaaaatcaacaagatagataaaccattagacagactaactagagggcacagggacagtattgtaattaacaaaatcagaaatgaaaagggagacataacagaacctgaggaaatccaaacatcatcatatccttctacaaaagcctatactttacaaaactggaaaatctggatgaaatggacaattttctggacagataccaggtaccaaagttaaatcaggatcagattaatgatctaaacagttccatatacccaaaagaaacaaaagcagtcattaatagtctctcaaccaaaaaaagcccaggaccatatgggcttagtgcagagttctatcagaccttcaatgaagacctaattccaattctcctcaatctatcccacaaaatagaaacagaaggtactctacccaattcattcatgaagccacaattactgtgatacctaaaccacataatgtcccaacacaaaaagagaacttcagatcaagttcccttatgaatactgatgcaaaaatacttaataaaattcttgcctaatgaatccaagaacacatcaaaatggtcattcatcatgatcaaataggcttcatcccagcgatgcaaggatggattaatacacggaaatccatcaaagtaatccactatataaataaactcaaagacaaaaccctcatgatgatcttgttagatgctgagaaatcatttgacaaaatccaacacccattcataagaaaagtgttggaaagatcaggaattaaaggcccatacctaaatatagtaaaatcaataaacagcaaaccagtagccaacatcaaactaaatatagagaaaagaagcaatcccactaaaataaaggactagaaaagcctgcccactttctccaaacctattcaatatagtacttgaagtcctagtcagagcaattagacaataaaaggagatcaaggggatacaaattggaaaggaagaactcacaatatcactatttgcagatgagatgatagtatatataagtgaccctaaaaattccaccagagaactcctaaacctgataaccagcttcggtgaagtagctggatataaaattaactcaaacaagtcaatggcctttctctacacaaagaataaacaggctgagaaagaaattagggaaataacacccttcacaatagtcacaaatgttataaaataccttggtgtgactctaactaaggaagtgaaagatctgtatgataagggcccctaatgaagaagctatagaaagtacccaagcagctaaaggggtctgcaaccctataggaggaacaacgttaactaaccagtaccccccgccccctgaactatgtatctagttgcatatgtagcagaggatggcctatcagctatcaatgggaggagagacccttcgtactgtgaagatcatatgacacagtacaggggaattccagggccaggaatagggatttggggagcagggccaagggagggtataggggacttctgggatagcatttgaaatgtaaatgaagaaaatatctaattaaaaaaaaaagacataaaaagaaaaaggctttacaacaaatggcctgtcaccacttgctgggattctagatactggagttgaccagagttcatcctgatcagtatcaattaaagcttgcttcaaatttggttcaaaagataaataaataaatattctctatgatgtagtaaatgtcataattccactgagttaattttgtcctgatatttggaaatcataacttctattcaatgttcaactctttaaagttttttttttttcatttgtaggaacatgtagccatgcatagaaattgtttgccagtggcaattcaaatcacagtaattagatggttttggtttaattgttttatgcaagaggcgtggcaggtaatctaatagtaggaaacttgttggtaaattattcttgtttccattttagtttaaaactaaaagtagactctacgtgtaggtacatgatgactaacaggcagagtagcaaccattttctgactacattagaccgcagccaactatactatggtattttcatgacggtattttatgtgtttgatgtaggcttttgtcctggttgttagatgttgttctgataacatcagttttcagcttttgaagaatctcaattacataacagtaactaaggttagtgtttttaattaacacagttttaaagagtaaagtcactatatgctattccttaattattgtctggtcatgtcatatctgcttaatctttttacatgttaataaactaagggaaaaattgagatcattagatttccttctataatttagcactgtaaagattaagagagggattgtggccattagaagtaaaatggttttatttatggactgagcacaataaggcccatcaataaattctttctgccactaatgatcctctgtctctctaattgtgtgcaagtgtgacaacaaactaatttccttcattcactcttgcaagaaataatgttgagacatatcaagtttgcctatgaattaatttacttctttgaattgtgttctgtgttggtaaatgaaattagccgttgctatgtaagccgatgacctttaagggaaatacttatagtccctcctagattatcaacaaatgccttcgggaagatcaggtgttctagcattagagtaacttgcatatcactggcatcttaagtcttacaccagccattagttttagtaaggtagctagctgtctcctcaatccgtgagtcacggtgtctgactgagtgtactaagggttgaacatcctttagcaagggctttatgaaggttacagctcttgccaaattctcccctttatgatagaaatgctcatatcctacccccttataatgagtatttgtaatggacttggtgtgttgactgaggttcaagacagccttgtttgtgaaactactcgactatctactataacttcctgatttttctgaggtcattatgtgtgactcaactgtactttttctccagaaattgtacattttgtaatttctttccaatagtaaaattatttacttcagttctatgttatgtaaaccaagaaatcaaattacatatataaagatgtgtatttttataaaagttgtgtgggttctattgaaaattattggtttggttattttaaatttgcttttatatcacatgtaatgtattaacctaaaacatagactgaatttcacaaaggcatctgtcctcagaatccttcaggactttgaatttcttgatattcaaattcagaaaccagtctgcaaactggtttagaaaatgcatttttttatctagattataatgtaagtgaagatctactgaaagaaacgtgaataaaaaatcctaacttacatagaaaatgttagcattccatctataagattgatatgtaaatcctatttacagtgtgtctgtttaaatatttaacaattgtattttgttttatgaatgtttactgtaactgacctgtgtgattgagcctccttgattttctgatgattatttccattttaagacataaaaaaatttattgctgttctctagtattcccaaaaactcttaataagttctattatttctctttgatataaagtgccattgcctgctcatacctttgtgtgtggatgaagttctaggcatcagatctaggacctcacactagtcaacatctccagctaacattttttgtattgttaaaaaccatttactttccccaaatataaactcaagtctcataggctattgtcattttacccagttatatttataattgttatgaatagagagggtttccaccaaacctaatcacagtaatttctaagagaaaatatggtttccttattccaagtaattgtgccttcttacacatgggatagtatttaaattttttaaaataataaacatttagagaacagtgaaagaatcaaatatttaggaggcaaagtagattataatataaatattctaggaactataaaagcagagactcggcagcattggcatatgcctttaattccagtactcaagagacagagataagagattaagtgagagagatagagacagacagacaaatagacagacaggaagagagagagagagagagagagaaagagagagagagagagagagaataaatttactgtacttcaaatgtctgaatgaatagaagaaagacataagaagaaactggttagaattattaagggaatgacctttctatcataaatttgatagtggctgatgaaatgtaagactctcaagtgaacactgaattatgaaatgcatgatataattagaaacatgccaggacatgtttgggaacagtaaaagataagcatgtatttgaaagaatgtaatgtcagtgtattggcagtagatgaactaaatggattttgatttagtagcctagagtcaaaacttattctatatcacctctacattgtcacagctatatgaacaatcataaatcccagtcatatagtttactgatacaattatctaaagaacacgaatcatgagaagtgtgtgtgtgcttgtatagatgcatgtatttttatgtgtgtgtgtatgtatgtatgtgtatatatatatatatttatatatgtatgtttaccaaactatatattaatatcatatagtatatatgttaatatattatattcatatatgtgcacaaaatctataataatatatgttaatataacatattaacatattaatatgcatgttcatatgctatatactgcatattaatatatgttaatgtatattttacatgatatcagtataaaaactatgctaatatgcaatcagtcatgtaatataattacccttaatataacacctcaatattatgaggtggctataagacttgcaaatccattatagtattatgaatcaacatgatatgtgaatttgtaggaatttttctatgtatccattcattatttatgagaccccatactatatactataagtaacaaatcactctaacagtaacatctttgttcaatctattcaatatgtatttccatattctgactgtatataatgcactatggtaagcctattgaataataaaaaaaaatactcttacctttaatcaggaaaaaagaacatgattttcttgataaatatcattgtaaaagattacattaggttgacttataaccaagataaagatgttaaataattatctcaaatataggtttcagtttattagctgtcaaagacagtgaggcttcacttgtatgagactttttgttagagtctcaccattacaaaagaaaaggatgaacctaagtattaaaacaaaacaaagtgacattacctcatggaactttctgaatttggagagtacacagactcatgcttgacacccatactgaggattctgtcattccagtttgaagggttccattatcctcttctgacttccatgggctcctgcattcatattgtgcatctatatatatatatatatatatatatatatatatatatatatatgcactcagatatatacacatagacagatagatagatagatagatagatagatagatagatagatagatagatatttaaaagaagtagtaatctgaaaatggactggtaggtaatataatcatataaaattatacagttgagatccaacttttaaaggacccatgcaaaagtaatgattcttcaattatttgttgccgcatagtgagtccaaatttatgatagaaaattcagcagtattttttctacctaatatataaactttaactactttgagcccttgagtctcaaaatgattgaggtcatatactagactcagtgtgtacaggagaaaatttgaaaatatttttatgaggaaaaaattcgtgtggaaaatgaaatctgttgatatatgataagaaagacaagggataaaaaatacccagtgctgcttgttgctctgctgctactcattagtgtttgcttatttttttttcccctaagatcataccctttgttaggcagcaatattctgctaatggaaaaaagaaatgagcagtttacaattatttaaataagtcatagttttgctatttctaaaaagtagtagagagaactcttccccttaaatgaataaaaatctcaaataaaattagaatcctcgtacctctctagtcattaaaggatgacattaccaacaatttacagagaagaatctatcgaaatgcaataaaatgagattatcttggcaaaattgagatttctctttctatgtcatgctagaattgtaactgagagctggcctttataagatcaacgaagaatctctgtatgaatcatgacttgcatattttttttccattttttattaggtatttagctcatttacatttccaatgctataccaaaagtcccccatacccacccacccccactcccctacccacccactccccctttttggcgacttgcatatttaaagaagtaatttaagttgtagtttataatccacaccacacagagaaaggagtatactacagacatactttgattcatgtatgtaaaggagtacagtttaacacttctttctccagagacagcaaggttgctatatagtgttgataaaaactactttcattttttgttcaccatggaaataatggttgatttttatatttaggcaacatgtaggtttaattaacttagcagttccatagtaatctgtagtacttacttgtcttctatcttaaaaatattttcatttgtgttcaagtaattaatcacattcattagtgtctaattaaagtcaaaagcctatggtagctattgggacttcagatatagtacaaggcttcaattttacatcatcaaatcaagatgtgatatggtgacatcattgttctaagagttatttttccttcaagttattatgtttatggactaaaaatatggggaccagctttaagaatctaacagttaaccaaaagaatctaacagataattgtaagcatcagaaaagtgccactcccaataaaatgacaaagacagatgccaattaaactatcatgatggaacaaattgaattatattatcagcagaccctaataaaaactgtgtgtgtgtgtgtgtgtgtgtgtgtgtgtgtgtgtgtgtgtgtgatttcttaaaagatggacaacaaagactgttggagaaataatgatctgtgcttcttgttagcttgttagaactaattaacaatatgttttaaaaatataaatagcaaagcctagctatccagttttaagtgacgagatcaagaataccacaatagaaaaaaaaagacaattaaattagatgccaaattctgaaggaaagtggtcttctaaacttccatattcaatttatgaatctgtaagtcaatgtgtagttgacataagaatggaagatttctttaagaggttgttgtttaaatatagagatgttcatcttctatattataacaaaatcctttatcaaagaaaaatgcattaagaaagagagcttttagaaaaaaagagaaaatggtcctggggaatgcttccatctaaatggcaagaggcaacataaaagacaggaaatgaaactgaaaaacccaaacactatttagaatgaagggaatctgcatttggagtcaagctaatattatactgagcgaaatatgtattccatgtataaagtagtcattttgtttatgtaaaagaaatgaatttttcacagatattaaaaggaagggacccagatcactttgctatataatattgtctaaaatcaagcataattccttattctaggtggatgatattatattaaacatcactgtcttttgttgtagaatacagagattcttgtggagtttgctgggaaaatagattttatacttttaagaatattaatattaaatatacttatcaacttttttcttcccttctgtctctctccgctttcctccctactctcctcaaattggttccctcttcttccccatttagtattgttacatatatagatatacatacaatctgctgagtctatttatgttgttcctgggtatggcttcagggctgactacatttctttgaacttcctatttaggggacttatcccatggaacagcaaactctcctactctcagcagtcatcagctacctataatttcttgtccaatgatatttcccccttctacattacatttggcattgcctctttcttttttatccagccatttttgagaaggttttatagcagcatttttgatattctgattcctacactcttcacacggctcctttgttgttccttgagctaaacatagaagaggtgagatgtagatgagtccattgctactgggctcctcttggtatagttgatctctgtattgtgtccagttgtagggtaattttgtttgttttccattggctctaatagggaaacttctttgaatccatacagttatctgtgcatactaaaataagatataaaacatagttatgaattatgctagcctcgggatatggctgtagtagattctcttctaaaatccataacctcagtcgtggcagttggctaggttcctagaactgggcattatttccctcctgttgaggattcctgcaatccaattatatagctgttgcttactactgccatgtgagtgccacttactgcacctttatggatatcttgccatgtgatcactgttgtagttcataggtgtcgcagctggcctggagtattaagtgttttgtctctgttggcagcttgcatagtatttaatttgaaagggatttttatacaccatttcttggttttctaaatattaagtccttccataaaaacttaaggtgtagccctgttcagatatcagtttggttcctagggcaaccttaatagtattagcaactaaacttgttttttttttttttatcacaaacaccctttacaaagagtctcagataatttttaccttgatatccctaaacacacatacacacacatgcacacacacacacacacacacacacacaggcactcactgacatacaaggtcagcaaggcaggcagtattaatcctgttttgtaaatgaaaaacatataggacaggagactatgcatttttcccaaaatcatatggaaaataaatgggacttaggcgtctgagtactagacaagttctctgtttttgttactttgcaattgtgcatttgttattcagttacctaggactcctatgaaaagctttaggattccttcaaagcttatcaaattatcaagggaaatgatgaatttgctatttgttatatataattaaaatttcaatatctgggattgcatacattgggctatgaatctaaagttagtgatggctcttttggatttattttgagttttattaattcttcctggcttttattgaatgaattgtcttttaaagggtcctcactgatacttcctgggtttcaaagagttaattgacttacaaaacatgttgaggttgcacccaggaaattattcacttatctcctaacatctggaatattgtttttttttaatcattatgaatttatttctgtatactgtggctatttatgtcaagtaacgaaatatgtcaagtaaacattatgtattattactaataatttggtgcagttatcatcattttgaaaacattcacaaatatttctttattttgaaaatatgagcaataaaattgttgaagaggtttgagtgcatgccattggaaaaaccaaaacatatttttattgatctgcatctcctcaaaaaatatcattgttaaaatgtttgtcatcttttcctaatcatatccacttccacagacttttttcccacttctaaaccattaatcaaacaaggaatgatactaaaatgtcaactgtgaaaaatttaagaaaagagagaatcaatatgaaacaaaatattaaatattccttttcctgattactaaaaaatgtttatgaactcaaaattgataaagctactatttcccatagtggggcctcagctccatcaccatgtttgttttttttttttttttttcgtctccatttctgattccacaaaacatgggaccattagacttttctgttaaatgacatatggctgccatcaaaagtcctgtctttagaggatccattttatccacttgcttcctcctctcccgtggcttttgaagctatttgcctgctgtccttgacttactgcctttacttatattctcccccttttctctgtgttcccttctagttgcactgggcatacaacatacacatttcaatcataatatccagcatcagtcccgtactttttccttaggccatcttatttttccttcctctttctttttttttttttagatttatttatttattatatgtaagtacacagtagctgtcttcagacacaccagaagagggagtcagatcttgtttcagatggttgtgagccaccatgtggttgctgggatttgaactctggaccttcggaagagcagtcgggtgctcttagccactgagccatctcaccagcccttccttcctctttcttattgctcctttcaaatcccaacttctaagtgggagactgaagtcacactgccaacctaatgcaatgaaacttttaaccctacactgccataaagttagaatgtcttaccatttttacccctctgttctctgtgctctcaaaacacaggagtccattttctatattcatagataagaatagtcttcctttttctttgtgaatgagaaaatatcacttttatttactgtcctatatctcacataatatattatccctctcctttaataattattttctttttcggtatttagtagcactgaagtctgaccatgactctaactttattcaaacaacttgcaacaacataaacctcatgaagtcagaggtagtagtgtattcccctctcacatgtttgtccttgctatttccaaaggacaatactgtactattgttagcttcaaaattgatgtgttttatatatgtacattagaagaatgtcagctacttggtttggctatacttccaatgtttagaagtactattaccctacaacgtgttgttactaagaaaaagtagagcaaattggttagaaccataggctagattatataactttggatattggttctgccattacgtgttatatgaccttgaggtcatttttaatgtctaggtttctgatattaagttagtaacaagatattttgtatagggagctattgaagataaattttgtgtgggaaacataattattaacactgagacctgtagctttgtaatatcttgaactacattagcttcctttttaaagcctattgtaactgtacagaaatcagttataaagaatatgttcaggtcagttcttaaatttttaacaactctaggagtaagccatatagtgacataacagagaggttaattggtatgaaaaatttgatttctctgtcttattttgtacaatgataatttggtaattgagaagaaatttgttttactttcttgtagctgatttttctgcttttattgcctggaattataggatctagctatgaatttctgcatactttatgttgtttatgtttatcttttatttaatttgagggttttagaagaaaaaagttccccagcatgctttgctcttgtctatatttttgctatataaaaacgtgttgtttttcctccatgcttatataggaatatattcttgttcatttctgtgaaagacacataaccttctctacattgtggaattgattatatacattagacccttcaagggatagaaactgtctctacaaagatatcttatagcattgcgcttatagaagtatctaaaagacagaagtctgcctccatccacttctttattctataaaaatccatatttgatttattttttcatatccttatggaaaatctggactgggaatttgctggtgtccctctcaagatagcattttttaaaaatctagaacatgtatcagcaaggtttttctacaaaaagcttaacattaaatattttagatcgtgtgcaccagatagatctcctgttacaaggacttcacttcgcctctgtaccgcaaaagcagccactgaccatacataaatgaatggggctggctggattccaacaaaactttttttttactcgaccaattatgcatgtccccttcagtctttgtttctatttaaataatttattaatgtaagataattcacagtaaagatcacagtttacaaacttttgcgttgatatttttctcttcatctaaaatcaaaagttctattttactaattcatttcataagttttacattaaagtctgtattctttcataatattgtactaagcttttatcagtcattctcttatttctggtacttttgtttacatcatgtttatactactataaataataccttgtaaatttctttggtgaactttttgttttctttcttttagaaagttttttttttaaggcagtttgaggctagcataccctagtatagccagtgagaatgacagtgaggccaaaggaagttgaaacttttattggcttaatacttttcccttcccttgcatcactgttgataggccaattttacaatttaggaatagaaaacagtttgggctttgaagtgtatcctcctcttcataatcaaaattctagcaggtatttttatagttttcagaccttgtaggtttttctttttttaatttaatgaactcctgtcacctccaaatgcaattagctttctgcttgttattggcaacatttgtttcaagagaagtgttgtagcaagacttctcagcaaggcaaaacatcttaatagaaatatccatggtgtcagtacaagagtagaggaactcagggaaaggggcacagagaaaaaggaataaattacaaacatagccaagagggaaatgaccttaaccaacatctagaaatgtttgtacttgaaacgaggcaggggtgcagaaattattacctagatttatagagccagaaagtatctacagactaaattatatcatagtaatatactgaaacaatgtaactgttctgaagtcagatcaatatgcaaatgcctgtgggtgtccagtgcccaggcagatctgcttcagcaggcagctgtttatttgaaatctcagctacaatagtccttgtatttaaaactaagtaggccacagttaatgcttgatcacttcctccagagttctgtccgttgctggtgctaaaaacctgggaatcattcttaccaattctttcattacccctcacatttcatctatctcaaatgcaaactatctctggtatctttaatcatctcctggaagccttccgtatctttctgaccatacttagggtaacacccccccaaaaaagaaaaataaaaacagaacaaaacaaatgaaaacccttattacagagcctcacttacctttctagcctcgttgttgtttgtttttgaaaccactctttgtgatgaggtaaaaatatctatttctactagatttatggaatgatgataataagataaataatcaagctttgttttatgtagggatcagtttcagtagtgatgaacgccaagaactatcaaaatcatattccttttacttcccttagtttacattgccttatttctgggcacctagcaatcctgttagtctctatagttagttaatgaagggtgacaatttagccatagagttaataaacccctgcaagcatctcctgtctgacctgtaaccctattatccagcagaacaaatgctaatccaggcagcagaaatgtggaatagactgaaatggctccagcattctgaccccagcataatgtcactgatgccatgacaacccttgttcaatttaagtgaaattgatagctttgtacttgtacttacctggagacttcatacattaaacatgtttcccccccaaaagaattgggtcaagtacaagaatatccacactatatcatataatcctagtaatttccctaatgagttcaagaatgcagttcctgaaaaatttgaccgtgatcagaaacagtagactaaggaatatgatcatttatgtagcattttagctttctaaaaacactttatatatatttagttcttgctgagaaaacattgaaatagtttactaatccatctgcttctttcacaccttactaagcaaataatatactggaagaaagcctttttttaaatgactactctcatgaagtcattgtgaacacacacttaaagagtaagaagttaagactggcttcatagcaatagctatgacatcagccctggtgacaggcaattattggaggatctgggattttggcctagccaggattacacagtcaaactcaatctcaaacaaataatcaaataacccaaaccaaagcagatagtttgagagtgtcttgatgagaaacaatactaattttatcaccctagattatcacaattttagcactattaaatataagactttttttcatgtgcttttcatctctttgattttgctgtaataattactaaattgttagactgcagaatgaagctcacaaatagtttcgtattgaaaaagttaagattttttaaattttggatttcttaaactttttattttccttctaggcttagtcaacatgctttcattttatatgagttttttttataactttactaatcattttaaagcctctattgtcatatttaatagtgtcttttgacagtgtttgattttgttgctagttttctgattctgaggtaaagtaagagtacattgcatacattttacaagtgaaggtattagtataagacttcatgatggagaaaccctgtctcaaaaatagtaaaaataaacttaaaaataagaatagcacttccattacttaactctctacaggagtacagttcaaaatagcccaataacccctcaataaatgctctacatgacctattaaaagttgagatgtgagtgatcagaatcttttttttttttttttaaggaaaatgttttgtttttgtttggtttttttttgtttgtttgtttgtttggttttggttttcctctccatttattttatttctttgaaacagggtttagatacataacacaagctggataagctgggctcctccttctgagtgctggttttttaatagaaacattctttgaaataaatgttgctcttctgataataagagcaaatatttccaaagagtttatatccagcattgttttagagaagtttcaacttgctacgtacttcccagtcttagccttgagctaatactgtcagcaaaagcaggagattttggtttgttttcacctttgattcaaaaattcacacatagtatttgctgtaggcagaataatggttgcaggggagtcagcaggtgggggaagtgaagttcttcatgggctgctgtccactactgtagatttgtagtcaggatatagaattttttttttttttgcctaaaaatcattatttaaaaagtttcttccttattccccaatctagctaaccttttagctatttagttaccttctcctagttattggtaaattttctttctattctgtattcaaagtttagtttctttatttaaacagattgtgttcagattttggttttcaggactagaaactcaacatgtcaatgtacccagatactgaaatgtacttacggaattgttaagagttaaacaatgtggtagtggttgtgtttccttactatagttctttcacactctgattcagttcagaccacattatgagctccatttagaaaactaccttccactcacggggacatgtgatagggatatgtgaaggggtcaggggagcacatatttttaaattatagttacaaagaatgctacttaaactgaaatagtggcacacatgtatgatcccagcctgtgaaagattcatggtgagtttcacgccagtgttgtctgtatatcagtaccccccatcccaaaatagaaaaaagaatgctaaggaatggtagctaagttgctaccatgttctcttaaagttttaaacaataattttcttctatgtgccactttgtatttcattttggagtgatatggattaggaatttcatatctaggtcctatttcccatttatgttctttaaaatccaaataatcccttggtgatgagattttgccattgtcattgtataaacatattggctttatttccatatatagcgttcttataaaatgaatctgttagcttatacatgcatttgagaaagcatacaacaatgcccattgttcaaggtgcttttaatatctcacacatgctttctggatgagtcattttaatggtgtgtggttcagctgatagtaattcaactgaatgtattcagttacggaaaattagcaaaggcttgtagtcacttttgagcctgttcactcatagtcttacatgaagaaatttttacttgcactttctttgagctcagatgtaagaagagccctgttactttgtcactgtttaaaattgattaaaaatttaacacagaaggaaaaaaaataaccaagttcgtttgaaaagctttttgattttataaataagtacattgtaaatataatctagagaatgtcatctaagtactatgattttatttctttaaatgtgtattagttctcctttatactatgtaattgaagagtctttccatccattttgtcacttaaaatatttatctcatattttgcttctcttaaagtcataaatttaaaataatttgactaaagatcaggctactatcatatatttgccagaagccaagaaatgcatgcatatatttttcaactccagcaagtagataaataaaatttgaaaggaaagtttctcctacatataactcaagagagtatactatgcttaaaaggttatttatggagtacatgaaagaaagctataagaaagaacatggtagctataatttaatttttactgttacaattcagattcagtaattcaatagcagatgtaaaaactgaaatgagaaaaaaaaatgaattgccgaattgccaccagactgactaatcagtcattaaaaatgtccgtagtggggatttacttggatagaaaatgtttgcactgtcataaaagactccgtaatttatattagtgaactaatataatgacaggcacaaaaatacaccctcagcctgaggctattccaaagacaagcatttgtaatccaatgtagtacataactagttttggatcatctggtactgccactaccaggaaaagtaccccacttctctctctagtagagtaggagctgcataaatattcattatagaccttgactgttaagtctgttgttgttttttttttgtaatattttgcccatttcgtttttcactctgtgtgtgtgtgtgtgtgtgtgtgtgtgtgtgtgtgtgttgtacctacatgccatgttgcacatgtagaagccaaaggattagggttgggagtaggcttcctatttacttcttgttctagccagtctccctcttttctgttgttttgaacccttcctacttctcttgcttgtaaactggcttattctcctgtcctgccatgggcattgctaggattactatttgggattcctgctttctcatgtagatttttctgtggtatccaggaattgaagtcaagttgtcaggctttttacccattcacccaactcattgactccagctcttatacttcttagattaaagcagtgtttttaacaagtaatttacctgataaatccattatcattcttaacactttcgggtttgttcagtatgttcataaaattctacaaagccagaataacttttaaatgtttctagggactcttacatgttttagtttccaaaaacatttgttaaatttgaacttccttatatttacagtaattatcattactttccagacttaaaagtcaatgtatcctgtaaaagtgatgtacagagaacacaaattaggtttagtacttttcattaaatggaattttattttttctaatattaaattatatcagagcacagtagggctaaccagtaagggagggtctccttattttcttagattatgactaccctatttaaattttaactagcatatgtatgcccagcagaattgtaacactgggagatagactgtagagggaagaataatgacatacacaaagaatctacttccataaaaacactaattgaagaaacaagttatagcttgaactgatacttttcttgcaaaatgaagagtacccttgattactgttttgacaaggcagatttatgactaacaggtaagaatttatataagctatataagtcaaaaaaaggaaaatagtggtgtaaattgccaaaaaaaaaaaaaaagctaataactaagtcactttgattataaagaattttgtgctttggatctagtatatgatactctatattgactaggtattctttttgtaacatatatacatgtatgcacaaacacatgcaagcacacaactaggatctcagaccaaatcagtctgttatcatctcaggaaatatgtgttgaaagaagccaagaggtaggtgaaatgtgtattccttcccaccaactcttataagatacttttgatttttttatggagataaaagtcaactccataatttgtaagacccaaggtataatgacaatgtgggctggaattgaaaataattttattatcgagaatagtaacgtcaaaatgttaaaccaatcctgtggtcttttaagcatttccctgccaagtgatggtatatgtgtcatgctcatgaagtcatgaatgatggagagatttttctgagacactaagctgtgaactgcagctgctgtaaaattatgggaagcgctgtaacttaagcctcctttatttactttcttttattctctatgcctgtttctccggaattatctactctcatctccgaacccaataaaattctagtatgtaaactctatcataagctctgttttacagacaccttgactatataaatgacttttttcagatttccctttaatatcacttctaagtcaaagtcaagatgacttccaccaatgtaaagacaaatgtgtaatgctagaaaggtttgcatgtgcatataaggtagaattcccctgttattctatctcgagcgttttatcctttggtttagttacagtataaataattcattagaaatgtagtgcagaggaactaatacagctttctataactattcttctttttcccatttccttgctttctcactgtgtaaagtatatcctcctgtcctccatctttctaggcaggtttcaattctacacttccttttatatgacataatagttggtataaactgtggatcattattatatctaacctatgctgcaatgttagttgtggaaatgtacatatacatatgaagcaatgtttcttaaaatgcaaatattaattcaataaccactaagcatttgtcttaccactaccttgccattgccaccctgcatggcacacaatgagttgaacctttagctcacccattataagggtaataatcaacacaagataggataacgaagggaaaacatagctaacgtaactaatacattgtaagatatggaaactttcagaaaaaaagaggtttaaagtttatttggacaatgtaaagctaatagaacagagaaggcaacagatcaagactctccaagaatctgttatgctgctattgtagcaatccttcctcccaagtgaaagttttcaagaaaaaaagagagggaccttcctaggtaataggactggtttggggttgaggaatctactttctgtgagctagctacattggaagagggaaagttagtaagtaagtaaagggcttgctggagctatcaggacaggatatcaaagagtggttgtttctgggggctttcaatctcctaatgtcaaagtactcagcatgccaactatattcgttctaaaccccaaccacagctcaagattttgtaaagttttaagacaaattaagacataatgtaaaagatgataatgaaatcatacagaacttagagaatggatctggacaagtttatgtagaattgaggatctgatgtgtaaaattgatcaggacgagtctagaaatattggttcattcacagatcagtaagaaaatataggttaataaaatattgcattcaaatttttagatggggatctttcttaaaaagactaagagcctaaacctcagtgttgacttttcattgatttggtgaagaatgtagaattgtaaaggtctgtgggcagaagaagaaagaaaatggtggttctcagtgtaatgcagtgaaagtaaagacctatattttctcctttttttttttctcttcagagattagcatgctcttttgctctgctttcaaggagaggcacctgtcactaccttactctactatgtcttcaacctccctcccctcttgttcttggaacccacatgactaaacatctagtcaacttcacaccttttgtttttccagtaatcggaatgtgaaaggagaaaccttctggatttttgggaagactacagagaaagaacctaaatgtcaaaacctcaattttaaaatcagggatttccttcacaataaacttgtcctttgtgaacagtgatggctgtagcattagtaaagttttggcaaggcgaaagttcttcaaattctctcaaagaatattttttaaacttgtcagagctaaacaaatggagttgtattggacagagccatttattctaactgattagtagaaaaaaataatcttcagcgttagtgtttgattttcagtctcttaaatttctatgtatattagggtgattttttcctcattgaatgataaaggtaatcttgtcagggtgatgaatttggatcagaataatctggctgaaatttgccaaagggatgatttagtcagtctgtttatttttttattgtgatgctgatatgtctctgaaagagaaaaaatgtgctggaataagaaaaatgtatttttctagttgtgttccacagtctttaatgaaaacagtgtttcctagtgttggctttagaaaaacagtgtcacaggctatgtatcaacttgtaacccttcccttgtctcctcaactagaatttcatcagattctgttaatactgatagaagtgtctttgtccataattcagttatttttttaattgtcttcctaaaatgaaagcatcatgaaaaatccagaaggtgtatatgtattaaggagcagcttgaatacatttcaatttattaggtgtcaataaaagtagaggaaaagtgcagagcatattaaggataattaaatcagctaatgaaagtgtttgaagggatgctgaatctctgtggatatgcctgtgtattcaccttttgtatcaacaattgtttttctgtctctattgagtatgaaatcttaaagatgggaattcttccacaggtgttggtttataaaactcagagttttcacaaaaaaagcaaatatttcattctttcatgtaacttacccttaaatcatttacatagacaaggaattcattaataagataaggtctctttgaaccttactttctctttaatcttcaatttagattttaaagaatgaaatattaggtgtcctatcaataaatttaaataggaatgggttcgtctgaactaatggctgagtaaaatgatgacatttctatattaaatatgatgatttggtatattacattacacattttcatttacctcatagagagtagaatttttatgagcagtaactcagaaatgtgtgaaatgagttcgtggagccattctctccatttaggaaaatcccttagcagatactggttttagttgttttgtggaatacctagtaaaagattctaaattttctgtacctttttctttagtttcagctcaaatactcaagagcaaccttgtagcaatggaacaaagcattcttcatctggagaaaaacatcaagaatttcccaccagcagaatcgcaccatgataagtttgtggaaaagatgatgatatcctttatataatcaagcatttgtttctgtgtttgcatgtgtctatccatctttttactttgtggttagttctagactcactattctgtaacattagatgaatctgcgtgtatgctgcttttgtttttttattagcagattaaattttatttcacagtgttttgaatttggtagaagcaagagaacaactggatcaaaaaattaccagttttcaaggacagatttgattttgtttggaaaaccacaagatatacaaggtaaatcttaggtggtttaattatatctgaaagaacaaagcaaataatcttctttagtaatcaagcgcttaaaagataggatcattgtgaaaaaaatgaccttttaaagggggttataattatttctctcttctatggacatattcacatgcattgtctgagggtatccatgcattttgggtgactaatattagtagactgaaagataaatggatagatacatggatgcgaagagaaatgaattgatcagtatttgatggatttaaatcagctgaaatacatgaatagagataacagtaaatatatcttgatatatacatatgtatgtcttgatatatacatatgtatgtgtatatatgtatatatatacatacatatacatatatatatatgaaaaaggaaactgtgagaaactatatttagtttgaattgttgaatggtaaagctggtgtcttaagataaactacattcagagctgattttctttttctattctgtattttcagtaagagccatattttcctcctctgggtttaaataagtaactctaactgcagattgattcactactttatatctctagagggaataaatactgcaatttctttatcagataataattccttcaacaactatatggagtaaccttcgttcaaggttaaacctatcatctttttcttcttgcccgtgtttctttcctagccatcttagatgttataatactgaacctaagaattacttaaggttgctacttggcatttatatacaaattattttccacacttattcttttgccttatttaataagtgtgtatggccctttagtgatactacatttgtgaataggaacattggatgaacaagtttgtcagccagtgaaaataggcaatgctcacttagccagggtttatgtaactggctgtagtaagaagctcaatatgaaccttgcactttattggtgattagatttatttttctttcaaatatgtcatattgtcctttggctggaaacaaacctttttcattttgactcttgcttcatatttttaaaatttaatttctgatccccttgttctatagagtattttcttttacagttggctgatggccacacaacagcttgcgacattgagtctttgttgttcattttgaaaaagaaaaagaaaaagctaatttcaaaccctcatgaacttggcttggactccctattttatttttctctttatgcaggtaattaatcattttaaaatgaaaatccagagccttctgtatctatatgttacagatgaacagctattcttcatttaaagtgtgactgtttgtccacaagaggattggaaactgtattaaaatgtataggattgttactttgcatttcgtatcaagacaaaatatgacaatttattacagaaagtggaatatttagcatcttaaaaaatataaattaataaattatactcgtgaaattattgtacaaattagtattgttctggaaatctccatgagtgctcagtgagaatttcactcttctagaaagacacatcaggcccttccggtcattgccagcacccagtcacctagggcgcagagtcggcggacacccccacggtccatagaggactctccatgagatcttaggatcactggtgaatggaacacaacttctgttccaatccaatcgtgcgagacctaagacagcagaagggaagcagaaaagcagcctgaccaggggcacaagtcccttcaatctgtaccagcaaccggtcacctaggggtcacctaggacacagtcagtggacacccccacggtcactagaggactctgcacgcaatcttccattcactggtgagtggaacacaacatctgttcctatccaatagcaagggacctcagacagcaaaagggaagcagaaaatcctgactgaccaagggcactagtcacttccggtcagcaccagtactaggtcatctagggcacagaattagaggacacccccacagtccccagaggactctccacaggatcttaggatcaatgaccagacagctttttggccctcaaaagagacaccacttccaggcactataaagcaaaacgcctaggatcttaggacaacaggatcccagggtaacaggagctgggtcacaccaatatttcagggtctaagaggaagcttgaatgccaaaaattctgacacacccagaatctcaggttcataggagcccacaatcaaaggatcacagagaaagctggactctgaggagaccttaatcaactgggattataggaaggaaaggctccaatcagatatgttgagggtagcaagcacttatgataaacatatggcaggagacaagcctaagaacagaagcaacagaaaccaaggttacttggcatcatcaaaaccaaactctcccaccatagcaagtcctggatacaccatcacacgagaaaagcaagacatggatcaaaagtcacttctcttgataatgatggaggactttaagaaggaaatacaggaaaacacaggtaaacagctagaagcccttaaagaggaaacacaaaaatcccttagagagttacaggaaaacactaccaaacaggtgatagaattgaacaaaatcatccaagacctaaaaatagaagttgaaaaaataaagaaaacccaaagggagacaactctggagatagaaaccctagggaagaaatcaggaaccatagagatgaaagagagaatctcaggtgcagaagattccatagagaacattggcacaacaatcaaagaaaatgcaaagtgcaaaaagatcctagctcaaaacatccaggaaatccaggacacaatgagaagaccaaacctatggataataggagtagattagaatgaagattttcaacttaaagggccagtaaatatctttaacaaaattatagaagaaaacttctcatacataaagaaagagatgctcatgaacatacaagaagcctacagaattccaaatagactggaccagaaaagaaattcctctcgacacataataatcacaacaacaaattcactaaataaagagagaatattgaaagcagtaagggaaaaaggtcaagtaaaatataaaggcagggctattagaattactccagacttctcaccagagactacgaaaaccagaagatcctggacagatgttacagacactaagagaacacaaatgccagcccaggctactctacccagcgaaactctcaattaccatagatggagaaaccaaattattccatgaggaaaccaaattcacacaatatcattccaggaatccagcacttcaaaagataataacagaaaacaccaacacaaggacagaaactatgccctagaaaaagcaagaaagtaatccttcaacaaacctaaaagaagacagccacaagtacagaatcacaactctaacaacaaaaataacaggaagcaacaattacttttccttaatatctctaaatatcaatggactaaattccccaataaaaagacatagactaacagactggctacacaaacaggaaacccaccaaggaaaaagacagacactatctctgattgattgattgaagaatgattctggaaacagaaactaagcagagacacattgaaactaacagaaattatgaaacaaattgatttaacagatacatccagaacattttatcataaaacaaaagaatataccttcttctcagcacctcatggtaccttctccaaattgaccatataattggtcaaaaaacaggcctctaaagatacaaaaatattgaaattatcccatgcatcctatcagatcaccatagactaaggctaatcttcaataacaacataaataatagaaagccatcatccatgtggaagctgaacaacactgccctcaatgataacttgatcaaggaagaaataaagaaagaaattaaagactttttagaaaatgaagccacaacatacccacacttatgggacacaaggaaagcattcctaggaggaaaactcataactctgagtgcctccaaaaagaaactagagagagcatacactagcagcttgacatcacacctaaaagttctagaacaaaaggaagcaaattcacccaagaggagtaaatggcaagaaataatcaaactcaaggctgaagtcaaccaagtggaaacaagaagaactattcaaagaatcaaccaaacctggagctggtttttgtgagactatgctggggcctagcaaatacagaagtggatgctcacagtcagctattggatggaacacagggcccccaatggaggaactagaaaaagtacccaaggagctgaaggagtcttcaaccctataggtggaacaacaatatgaactaaccagtacccccggagctcgtgtctctagctgcatatgtatcagaagatggcttagtaggctttcactgggaagagaggccccttgttcttgcaaactttatatgcccaagtacagaggaaacaccagggccaagaagtgagagttggtgggtagaggagcagcgggtgcggggccgcgagtaaggtataggggacttctgggatagcatttgaaatataaatgaagtaaatacctaataaaaaattggaaaaaatatgaaaaatagaaaaacacagcaaaatgatcacatatatgctctattttttacctttgaagccattgaacaaagagatgtaaaacctggctggcatgggagattagaaccaaattcaggtcctatggtagaacaacaaattctcttaatcaaccactgaaaaccctttctaggccatggattctgtcttaaaatgaacaccatgttcccacatataatacaggactctaagatatttctatcacttgccaataaacttattttttttcaggttactaaccctttatattcagtaactatagtgcaaatatgatagcactttacctaatgaactataatctagctgtaagaactttgagtttaaaaaaaatggacaacccttccatgtcctggcctctacccatagtgccagaactatgggtaaaagcaggggctcatgagtgcaggttgaatcttcactagttcaccaagtcagactgtgtccaacatcatcccatgcttaccctttctctttgtcagtattaactcaatgcttattataccatatgtcagacattgtcagatgttaaactacgatggtgcacacatggaaaactccattttaatatacttgcagcctggcatttacatgttctctatattactctacatttagcagagattatatcatatttcttaacatctatgtacctatcaaatattcaccaccaaccccaatgtatgcactcagcatatgtttgttaagtcattgtcaatcagtaatgcaagcccggaagttctccatctaggagaataagaagtagtaagcattgcatacgattatttctcaaaatttttccatgtaaatattgtctgtaatttaagtcatattgaatcaccattttaaattttgcatttgaaaaatacagtcaatttaagatgttatatccatacattctaatgtaattgttttgtttttaaacctagaaaaaatagcccatgagatgccacaatggtgatgcaaacttgaaatgcattggttttcgggctatagcaggagcattaccataggttccaggacaacctgagtgacatagaaaaatatttttttcaaaaaaaggaaaaaattttaaaaaaataaataaacgttttcctgtgaatgtatttgccctatttatagcttctggaagccaacggttttataatgaagtatgtctcctttgtctctcctttttctctgactcagaataaaatagtgtaggaaaacaaaaaaagatctttttctttctctgctgcatgatgtgttgtttaatacacctataaaaagacagattaaaagaagagtatataaagtcaatgaatgtgggacctgttataagacccttccaaaggggggtagtatttttatgaacagttacatagaagtctgaagtaaagccaattgtgatcaacctgtaaattgcaagggtgagagatgagttagcaagatgtggtgttcagatacttcttagtttgtctgtatgacattccttacctcagagtagagggcagaacacatgctatatgtcagaagacttaagaagataaagagaatgatgtttgtaacttctttttatggtgtgttcgtgagatgaagagttaggtaattatagtttctgtgacctgcttcagaaggttctgccttttgagtttacctcttccatctccatcagcttataacactcattccttcctcctactatggcctaaatatctctttcccatctgttttctgttaaccaataatctatataaaggggtggttccttttggaagtgattagatataagaataaaaacaattctttgatggagaaaatttgttcttcaatgaatcactagaggagagagagagagagagagagagagagagagagagagaccactttgctcttttgggcctctagcataggaggacacatcagtaaggcacaagctactaccacctgacataaatctggtgatgccttcatcctgaattcttagcctacagagctatgagaactttctcttacttataagttattcaaagttattcatgtataaactaaggttaacctaaacaacccaatgtgccatgtttggagttagaattttttgcatcccacaaatgggaagaacaaaaccaataaaattaagtttataggattataaaccagagagtcaggtatggtagtatctgtgtctgtaatcctagcacttgggaggttgaggaaggaaggtcagaaatcatggccagcctagggtacatgaaatactgtctcaaaaaaaaaaaaaaagcaaaaaaaaaaataataataatcaagattcagcatacacatttatataagcacaaagttgaaaggtcatctgtcagggaaatatttattcttccacactaacattctcatcacagccctaatcatagaaggtttgttatttttgttgttttcttgagctagttaggatctagctctaacctgtgtgcatgttaagtaaactctgtgctaccaagttgcaatgcaggccttagactgtggattaaaataagtaggttgctaagatgttatttaggtttctctttccttttcccttccctcccctcgcctcccttcccccctcccctctcccctctcctcccccctcccctcctctcctctcctctcctctcctctttctttctttctttctttctttctttctttctttctttctttctttctttctctctttctttcttttgtcattgagtagtgggcttttgtttttgctattgttgttgttttgccatttttattgaaaaaaattcttccaataatgtctggttaggcttttcccttccacaactttccctagatcctctctacctccctacccatacaactccattcgctctgccctctctttaaaacacaaataaacacacacacacacacacacacacacacacacacacctacacatgaaaaaaaaaacaccccactaaaccagaaatgaaatcatgcaagcaaaagaccagaaagactaaaaatgcacatatctacatgagagagaggaaaaaaaaaggtctataaaataccctggagtttgttttgtgtttaccatctaattcttggtatgtggcctatcctcaagtgagattaatattctcagtaagacaccactgaagcagacaaattttcctttgtaagtagttaccaattgcagatagtgtcttgattaggaatgggaaaaataaataaacagtactaatatttcacttttgttgattaactacttaatatttgtcaaatgacctaattttatttatttgatattttaaaagctcatgtttattatataagaaataatttctatcttcaatattaaaattaactatctctcctacaattatgacaggaggacttcaataactcaaaatattccatactgccactgtaatatccaaaataaattcaagactactcagtaccttcccccttcaaaaggacttttgaaactgagctagcaagacaagtcagataaaaagctggctgactaaacaaatatagaaacatagttttaacggacaaaattactaagcttccaaaacaagattaacaattcccctgctccacttcacacactaaaaatctcaaggacagacaaaagagagtcaccctatacaaaccaaccaatgtctaaaaaggttattggctacaccaattaaaataagccaaactaccctggtgcttttatctggaccttacaaatgtataaaaaatgtgatctttctttgttctgggtctctcctctagcctgggtgcttagacggggttccccaacatgttggataagtaaaatcctcatgcgttttctaatgatgccagtctctgtggtctttgtgtgagtgagggtcttttgacaagctacaccaccacattcttaattcatttatttcaaagggcatctctcttgttgttctattaaagttacaggagttctgtggctgtgtttgaaacctattgaagatattggtgagctgaggttcagaatcatatcctgataaataaataacccatgcctgagtgacatgagaaagccctctgagaatgagcttcttacccaattatgcttcctctttgaagatgtatgacattgatattatctaaaacattgcaaccgttgccagcactgtaattgtgagagagctggggattttgcttgttcaggggcttgcttttggaaaagaaatcctgctattttcttcctaacctataacatgattgatggttgacatcacctgtaaccaaagacaggttaacaagagcatgagaaatttatttaactgctttatgtgacaaaggagccttccagacatgaaggctccagaggaaatgtctatttgcatactatgtgctaaagaaatgtctagttctagagaaaagtaatcagataaaagtggtatgaaatgctgttaataatggggggggtggttatttacaagattctttcatgtgtctctatccatgtgacaaccctgacaccatgaagcaagatagatacttttctccagtggggaaggcaaaagctagtaaccttccttgttgttatgggttaagggatgtgaattttagtttcactgctctggggaaaagtcagcaaaaaaatcaaaaaggccttgtttctgtagacttcctattttctctctcattgtcctcccccctccccctgcgcgcctttctccctttttttttcccttctagggctctcataaaaggcttgtactatttattgtgccagagtttctcaggcaagaaagaaacccattcttaaaaggagagctcttcttttaatcagcctgctttttcatgtgcttgtttttatttttgtttttgagactctgtagacctatcctgccctgggctctatataaatcaggcccacaacccacagagatctgcttgcttctacatctgaagtgccttagtagtagtagtagtagtagtagtagtagttattttctttactttatttacatttcaaatgttattctctttcctggtttcccctctgaaaattccttatcccctccccacttccccaaccgtcccactcccattcctggtcctggaattcccctatacttgggcatagatccttaagattaaggctacaacaccacaatgccctgctttcttctactttgaagaatgtgcttcagtccttagtgtctaaaagtgtctaacaaagcacattaatcatggtgttgaccttactgcttatactctgttgacaaatttcttaccacatttactcacagagattttgtcaatgtcagggatgtctctggtccaaaatcagcttagctttttgattgactgctggctaaatcattttcccaactggaggacaagagagtgactgagcagcaggagcaccattaacacattgacaagaagagctgacagaatgttaatgacattaacaccctgtcaactaactatcaacacctgggatttcctcatagtgtgagggagagtcatttgaagtagttacaaatcaaattactgaggaagcaccttgtcctttccagaaaattcagaacagatttggggtcaccacaatactaccattatgttaatttgtattacactattctgcattaggagaatattttaaaatagatgaaaaaactcagttactatgcagccagaagtatcacatcatagcctttcagcacaagccaaaaataggttttaatagaatcataatccactctttgtaaagcaaatgccatatggaattgacaaaacaaaaagaaagaacaaggcctttcccctccccccactatctatctctcttcttttctaatataatgctgtagccctggtcattttctgtctttcaaagaaaacctgagactttcaggctatactggagaaaagtttaccacgtctgatgctatggcctcatcctttatgccctgctgctctttgaactcagaaaattaggaaattcaaagcaatattttttttatttcatttgagaagctcagatagcgaaaattataggaatttttttttcttttaaagggggtgagtgataatcatggatatggtacttacattgaaaggaatgtggcttttaaaatacaaatagttaggcattgcctcttttaaaagaagtgtactttgggtcaagatatagttccatggtagattactttgcacagccagtgcaagactctaagttcattcaatacaacatgagaaagaaaaacaattgtttgaaatacatgctattaattgcggtctggaggattgcaaaattaaattaggacattaacagaaagaaaggtatacataatcaaattcaaaatggcagtaaatagtaatgataataatcatcaaagaaaactagagccaaataaaagttacagaagcaaaatttgttcatttaaagtattacactagtagaaatgggacatgagcatgcagttgagctgcatgtacacaaaggcatatatatatatatatatatacaaaaacatatgtgtatccatatttatactatatatactgtgtattaaatacataatgtactgtattttatatatatgtgtgtgtgtgtgtgtgtgtgtgtgtgtgagagagagagagagagagagagagagagtttggtatcctgataaaatgattcatactaagagctggacatgtagacagttgagtgactgtctatcatgcatgaggccctaagtctcttcctagtgcagcacaaattaacatgcctgacttggaagtaggaagatcagaagctcagttaccctcaactacagagtaacttctgagttgatctgagctagttgagatcctatctgaattaacatgagaacatgactgctcatagtatggttaatcagaaggttttattttacatatgaaggagatatgagccaggagtatcctgaagagtccagaccaggccatgagaagaaagagcaaagaggaagagagaggaagggagagtccaagagagctcgtggaaagtgatatatgaaagagaagctaagagaaaggaagcaaggcttagatgctaaagaggtttagggtagagttgggggtgaaaagtacttaggagcctgaactctgtcactggtactaaaagaaactagaggtcattacaatgttaaatagaccactcagccattttttctgggtttctctgagacactacactgtccttataaagaaatacaaataacaaatagatataaaagaaatggttgacactccatgtgcttaaagttttacaatactttgaatatttggaaatgtttgtatatgtaaataataacatatcctgtgacatgggacccaagtctaaatgagaagttcagtttggtttctgtttgacaatatgcctaaggtaaagtcacacaatatatttaatatccctgcatttggactgtcgtatatcccacgaaattgggtatagaattttctgctgttgcatcatgtcagtgttcaaaatgattctgactctagagcacttcttatttcagatttttagattagtactgcccctttctccatcctttttttcctctccccctgttacacaattttgtcagccttacacaatctccaaggcaaatcctatttgttgagttaggtactatgacttggttcattttaattaaactcatttaaatgtgagaagactagaaagaatcatccatgtgattaaatcatataagtgataaaatacagttattgaggatttcaatccaaattttggtctttcagactcatgttcctaaccatgatattacaccatgcttgagttcagagaggatcataaatctaagatgaattccacatgtgtttcctatgaaacttttattgccttcttacaatgtctctcaagtgggaaaaaaatgttcgttttgaaaggattgtaaactaatttaaaaattagctgctcacttacaccatcgactccagaaagctttacttaatcatagcaatcaaaattaatttccttgtcccttgtgttctcataatattttaatactttgatgatcatacttgctcatttgcctgtactgcttatgtacatttctgttttgcacaccaacttataaacacttttaaaatacggattctttctcatctttaaatattaggcaagaagtgtggcatgatcgttttagaaagttaagtgcttagtgaatttttgtttgtttgtttgtttgtttgttttaaatacactagagtttactatataattatatgaaacttaacactctggcaaggaaatggagaatattaactttttattctggggtggcctctgtttgcccaaagaaggaccctaatacctacataatgttagtcttttactatgttttgattttaaagtgcctgtattaaaaattaagactttgccaagtcttctgtagaaattgcctagttctaaggaactctttgaatggagcctatgctttggggaatctgtgtgcacaaaacttctctgtttgatgagccttgctcatttgaaattcagtctaaaattacactgagcatgaacttcatttttcaaacattgtccagggaatttgatagacatttggagcgtgatggtaatggtgagaaaataatatattgctggttaaagggtgcataaacccgttcaagccacaggagacttgtctgggaaatcatctttttcagaacatgaaacaagacttaatttgtctgaaagagttaatgttccctcatcctgacaatttttccgtttttgccactagaagctacattttgagagattaaaatcctttccatggaattcattcatattaagtggaagtaacagaaaaaaatacttgaaaaatacactgtccaccttagttatgtgtatagttcccatatactataatacataagtatctattcatagacacaaagatgaaccatttttttttatttacaggatcataaattgtgactatggatccaggaatttgttagtattatgttaatttatatgtgtcccaaatattatcaattttttatagcatttgtattgttaaaaagctcagattttataggaaagaatagtaatatcagtatgtctctgtaaatatactcttagaggaaactctcaagcatacactattttcttaatgtagaaaggcaaatcagtattttttcataaggtagatgactctttatttatcagtttccaatataccttaggtatatgcttctattaaacaccccttgtattttcttccatttgaaactttatggtacaggcagtgaattcattttattaggtaatgagtaaaaaacaaatgacattaaaccaaacctgaaagcagttagttgtcccaataacatttgtgccactattatacccatggccatatcttgccatgtttgtcattatttcaatttactggttttttatccagcctattagactattgatggcccccaccactgccccagcagcttgaatagcacctctcaggactatgagagctaactagcaggaagatagcttcctgagcagtagcaacttgatgtctatatgtcctttgcccaatgtatctgctatcctcagcaattgggtctttctatcaagttctgatgggcaagcaaaagcagttgaaatagcctgccttgtttgagatgatgtccgttgggatacccctaaccagtaacatgagggtagatattccatacctgtaactggacttttaatttggtagtctacgacttctatgggggaaaaaatcccctgtatcaagtaaatctttgtgtctgttgactcttatatgattgttggttttcttaaattttaaacagagaagacatgaagttgtggataagaaagtaagggtgaatatgggaagagttaagaggaagagttggtcatgaatatgatcaagatacattgtataaaaccctcatgtaattaataaaaaatgcttagttaaattaattttcactaaggagatagagtttagtaggtaagtagtcttgctgtaccatcatgatgacctgagttgaaatcccagcacctgtgtaaaaaccaggtatagccatgttaacctataaccctaacatagagtgagatggagacagcagaatcactggggctttatgcccagcatcctagcttacaattcagttagagtgtctttctcaatggaataaggtggagagtaatagaacaggacactactgtattacaaaaatgggataaattattacattatgcaaatgcatttgggagctaactatggaaatatatgatttatcattgcttatcctcttaaattttgatggtaaatatatgtctatgtgtatgtctgaagacaaatataaataaacgtgtgtgtgtgtgtgtgagtgtatttgtccaaattttaaaaatggaggatggaagcaatattcaggtagtattcataatttcaatcttaaaggaatcttgacccttttagtagaagagtcaattaagtgaatttgaatagtcttggtctatcgaaaatataatatactaaattttatattaactgtaaagtgaaaattttcacttctttcaagaaattgtacagtatggaaggtataattggtagcaaaaaagaaaaacatgcagctgttccagttattttttgtgtgacaaaatatgtgatagtcacaaattaaggacagaaggggtccttttggctcacactttttaggttgaatttcatcatggctggaaatttcaaggcaggtgttcatgtcaaacctctacacaaaaagcagagaagaagaaggatcatcatgcacacctctccatctctttgttgtttcgtccaggactctgacccatgtgatagtgcctcccacatctgtggtgggtctttccacatcagttaacctgatattgatagtctgtaactaggatgcctagaggtttgcctcctggatgtttctaaatcccatcaagtttacagtcaatattaaccatcaaaataagataattattttaattgctaagtgactgtagtgtagtctaaaactacaatagatgttttaaatattctgtaccatgtttttgcttgattatgcagcattccagctatgagcatagctgagaattaatattccaacttctttatattgttggaaatcaacagagagactaaaatgagcatctcagtatggaaatgcattccaaaaacaaatgaaaatgaatattatcttttgttgcgaattaactatctcctttgtcacacataattaagaatttggtgtactaacaattctctaggttcagaagtgtgttccttcccgtgtttctactagtcatacagcatatatttattaagtagctacagcagtttcttgcaatatgctaggtgctatagaattggagcagacaaatcaagtacaaagtactcggcaggctgtgacagggcttaacactcaggtaagagcaaataagaatgaaaaaaatagtgtttgagtttaattgtatggcattgttataagtgataaagtgttaacaagccagaggataatgtgcttttcaacagcttcattgaggaaataaaattcaaaggttattgtcacattgtctagctgaaaataaatgtttagtatatttacttttgtgtgatcaccttctggaatctcagaccaggcacatagttggacactcgatatttctaataaataaaccaatcaatacatgatttttgctctactgtcatatcaaggtcatagattaaattatgttgtaatgtctactcatagatcacctaatatatggatgaaatttacttttcaattcaattaatatttatcattagtagaataaaccaaagtttgtgacaactcccaaattaatgactatcaaaatgatttgaaagtatgagattatatcccaatcatagaacacttgcctaatgtatgtgcatctatggggtttattcatcactatttgctaggtgcattcttaactgaattatattaacgaactcaaaatttaatatattaagtgaacaatcgacttagaactatagctacaactttgttgcattttgtaatttccattttataggatttaatagtttaaactcagaatgtgttaaaaaagatgaattggctaagcatgaaaataccgtatgatgaggcatatgttaggtcatctaacaaatctgcataaacattcatagattagcacataattgacacatagattttgccttctgctctgtttcatttcccttataatgcctaaatacatctcatggataacgcattggaaatataagttaaacatagatatgacatgaatatttcctttcagcattgtatgttagaaagcaaaatcaacaatatacaggataaaggtatattaaatgcaaatagattatatgcaattcattctatttagtactgaaacctcttagatccacagatattttcagtctacatagtatctataaacatgattttactaatgggtcagagcagggaaagatccattttgagatgacatggaagaaagataaggaaaggtatagtctaaacatgatcaaaggctctgtcaataaaagaagaaaaaaaagattttcaaaaacaagttgaccatttggctatgaggagcacttggctggttttcattgctgttcttccctgctttcatctactggacagggttactgcctgccacagcttgatagcttattctatcaagtctagtctgatatgttctgtgataaaacctaccatatgaactgtgcattagaaaccaaataattgccacagtttcttcagctctcataaaaaatcaacacagaatacttctgtgcttcttaaaatttacacagggaattattcatcctagacagatatcaattctacatcacctgacatgtattagtgaacaacaacaaaagtataacctgtatgctggagtcaggaactggttaaaaataaacattaggaaataaatatgcatatgtggcatatgtagaatagattcatacagccacctccatcaaccaaggttctcctccaagggctaatgtttgaattggcaggtgaaatacaaataattaactcaccctagcagactgatacaaccctgtcatgtaaatgactagggagacagaagcaggtgggattgatatgcctgccaggagtataacagtacatatttagcttaacatttcttggtttcatgtccagcacctaggtgtggatgaagtgatcttcactgaacaggtaaagattaattgtttgcagatacttaagtgtttggcactttggtgagtcagcagttagaagttaagttccatttccaatatatatggtgtgttgctagattaatatttctatgggattttaaagttggagttagaaatctctcaaattgagtcaaatactgagaatatttatatttgagaaactctgttatcacactccactcacacacacaccaaagttgcttttagtatcacctaggggttgagtgggtattttcgtaaagctatgtcagattcactggaaaacctgatgctctgctaaccctgtgggagctggaattcttcagctaaagaggttcgaatagatttaggtatttatacaaaccgaactctgaaaccacatgagatttgctgagtactagtttacatagagcttaactacaatggcttcctctttcttttttttttttttttttttttttttttttttttttccattttttattaggtatttagctcatttacatttccaatgctatagcaaaagtcccccttacccacccacccccactcccctacccacccactcccccccctttggccctggcgttcccctgtaccggggcacacaaagtctgcgtgtccaatgggcctctctttccagtgatggccgactaggccatcttttgatacatatgcagctagagtcaagagctcaggggtactggttagttcataatgttgttccacctatagggttgaagatccctttagctccttgggtactttctctagctcctccattgggagccctgtgatccatccattagctgactgtgagcatccacttctgtgtttgctaggccccggcatagtctcacaagagacagctacatctgggtcctttcgataaaatcttgctagtatatgcaatggtgtcagcgtttggatgctgattatggggtggatccctggatatggcagtctctacatggtccatcctttcatctcagctccaaactttgtttctgtaactccttccatgggtgttttgttcccacttctaaggaggggcatagtgtccacacttcagtcttcatttttcttgagtttcatgtgtttaggaaattgtatcttatatcgtgggtatcctaggttttgggctagtatccacttatcagtgagtacatattgtgtgagttcctttgtgattgtgttacctcactcaggatgatgctctccaggtccatccatttggctaggaatttcataaattcattctttttaatagctgagtagtactccattgtgtagatgtaccacattttctgtatccattcctctgttgaggggcatctgggttctttccagtttctggctattataaataaggctgctatgaacatagtggagcatgtgtccttcttaccagttggggcttcttctggatatatgcccaggagaggtattgctggatcctccggtagtactatgtccaattttctgaggaaccgccagactgatttccagagtggttgtacaagcctgcaatcccaccaacaatggaggagtgttcctctttctccacatccacgccagcatctgctgtcacctgaatttttgatcttagccattctgactggtgtgaagtggaatctcagggttgttttgatttgcatttccctgatgattaaggatgttgaacattttttcaggtgcttctctgccattcggtattcctcaggtgagaattctttgttcagttctgagccccattttttaagggggttatttgattttctgaggtccaccttcttgagttctttatatatgttggatattagtcccctatctgatttaggataggtaaagatcctttcccagtctgttggtggtctttttgtcttatagacagtgtcttttgccttgcagaaactttggagtttcattaggtcccatttgtcaattctcgatcttacagcacaagccattgctgttctgttcaggaatttttcccctgtgcccatatcttcaaggcttttccccactttctcctctataagtttcagtgtctctggttttatgtgaagttccttgatccacttagatttgaccttagtacaaggagataagtatggatcgattcgcattcttctacatgataacaaccagttgtgccagcaccaattgttgaaaatgctgtctttcttccactggatggttttggctcccttgtcgaagatcaagtgaccataggtgtgtgggttcatttctgggtcttcaattctattccattggtccacttgtctgtctctataccagtaccatgcagtttttatcacaattgctctgtagtaaagctttaggtcaggcatggtgattccaccagaggttcttttatccttgagaagagtttttgctatcctcggttttttgttattccagatgaatttgcaaattgctccttctaattcgttgaagaattgagttggaattttaatggggattgcattgaatctgtagattgcttttggcaagatagccatttttacaatgttggtcctgccaatccatgagcatgggagatctttccatcttctgagatcttctttaatttctttcttcagggacttgaagtttttatcatacagatctttcacttccttcgttagagtcacgccgagatattttatattatttgtggctattgagaagggtgttgtttccctaatttctttctcagcctgtttattctttgtgtagagaaaggccattgacttgtttgagttaattttatatccagctacttcaccgaagctgtttatcaggtttaggagttctctgttggaatttttagggtcacttatatatactatcatatcatctgcaaaaagtgatattttgacttcctcttttccaatttgtatccccttgatctccttttgttgtcgaattgctctggctaatacttcaagtactatgttgaaaaggtagggagaaagtgggcagccttgtctagtccctgattttagtgggattgcttccagcttctctccatttactttgatgttggctactggtttgctgtagattgcttttatcatgtttaggtattggccttgaattcctgatctttccagaacttttatcatgaatgggtgttggatcttgtcaaatgctttttctgcatctaacgagatgatcatgtggtttttgtctttgagtttgtttatataatggattacattgatggattttcgtatattaaaccatccctgcatccctggaataaaacctacttggtcaggatggatgattgctttaatgtgttcttggattcggttagcgagaattttattaaggatttttgcatcgatgttcataagagaaattggtctgaagttctctatctttgttggatctttctgtggtttaggtatcagagtaatagtggcttcataaaatgagttgggtagaataccttctacttctatcttgtgaaaaagtttgtgcagaactggagttagatcttctttgaaggtctgatagaactctgcactaaacccgtctggtcctgggctttttttggctgggagactattaataactgcttctatttctttaggggatatgggactgtttagaaggtcatcttgatcctgattcaactttggtacctggtatctgtccagaaatttgtccatttcgtccaggttttccagttttgttgagtatagccttttgtagaaggatctgatggtgttttggatttcttcaggatctgttgttatgtctcccttttcatttctgattttgttaattaggattttgtccctgtgccctttagtgagtctagctaagggtttatctatcttgttgattttctcaaagaaccaactcctcgtttggttaattctttgaatagttcttcttgtttccacttggttgatttcacccctgagtttgattatttcctgccgtctactcctcttgggtgaatttgcttcctttttttctagagcttttagatgtgttgtcaagctgctagtatgtgctctctcccgttttttcttgaaggcactcatagctatgagtttccctcttagaaatgctttcattgtgtcccaaaggtttgggtacgttgtggcttcattttcattaaactctaaaaagtctttaatttctttctttattccttccttgaccaaggtatcattgagaagagtgttgttcagtttccatgtgaatgttggctttctgttatttattttgttattgaagatcagccttagtgcatggtgatctgataggatacatgggacaatttcaatatttttgaatctgttgaggcctgatttgtgacctattatgtggtcaattttggagaaggtaccatgaggtgctgagaagaaggtatatccttttgttttagggtaaaatgttctgtagatatctgtcagatccatttgtttcatcacttctgttagtttcagtgtgtccctgtttagtttctgtttccatgatctgtccattggtgaaagtggtgtgttgaagtctcccactattattgtgtgaggcgcaatgtgtgctttgagctttactaaagtttctttagtgaatgtggctgctcttgtatttggagcatagatattcagaattgagagttcctcttggaggattttacctttgatgagaatgaagtgtccctccttgtcttttttgatgactttgggttggaagtcaatcttatcagatattaggatggctactcctgcttgtttcttcataccatttgcttggaaaattgttttccagcctttcattctgaggtagtgtctatctttttctctgagatgagtttcctgtaagcagcaaaatgttgggtcttgtttgtgtagccagtttgttagtctatgtctttttattggcgagttgagaccattgatgttaagagatattaaggaaaagtaattgttgcttcctgttattttagttgttaaaggtggcattctgttcttgtggctgtcttcttttaggtttgttgagggattaccttcttgttttttctagggcgttgttcccgttcttgtattggtttttttctgttattatcctttgaagggctggattcgtggagagataatgcgtgaatttggttttgtcgtggaatactttggtttctccctctatgataattgagagtttggctgggtatagtagcctgggctgcagtttgtgttctcttagtgtctgtataacatctgtccaggctcttctggctttcatagtctctggtgaaaaatctggtgtaattctgataggcttgcctttatatgttacttgacctttttcccttactgcttttagtattctatctttatttagtgcatttgatgttctgattattatgtgtcgggaggaatttcttttctggtccagtctatttggagttctgtaggcttcttgtatgttcatatgcatctcattctttagatttgggaagttttcttcaataattttgttgaagatgtttgctggacctttgagttgaaaatcttcattctcatccactcctattatccgtacgtttggtcttcttattgtgtcctggatttcctggatattttgagttaggatctttttgcattttccattttctttgattgttgtgccgatgttctctatggaatcttctgcacctgagattctctcttccatctcttgtattctgttgctgatgctcaaatctatggttccagatttctttcctagggtttctatctctagtgttgcctcgctttgagttttctttattgtgtctacttccctttttaggtccagtatggttttgttcatttccatcacctgtttgtatgttttttcctctttttctgtaaggacttctacctgtttgattgtgttttcctgtttttctttaaggacttgtaactctttagcagtgttctcctgtatttctttaagtgatttattaaagtccttcttgatgtcctctaccatcatcatgagatatgcttttaaatctaggtctaggttctcaggtgtgttggggttccctggactgggcgaagtgggtgtgctgggttctggtgatggtgagtggtcttggttcctgttagtaagattcctccgtttacctttcgccatctggtaatctctggagttagtagttatagttgactctgtttagagattgttcttctggtgattctgttaccgtctatcagcagacctgggagacagattctctcctctgagtttcagtgctcagagcactctctgctggcaagctctcttacagggaaggtgcgcagatatcttgtatttggacctcctcctggccgaagaagaaggcccaaaacaggacctttctcagacactgtgttgctttggcagttcccaggtggtacagactctcacctaagcagactaaattcctaagttccttggagtcccgggaccaagatggcgaccgctgctgctgtggcttaggtcgcctccccagccgggcgggcacctgtcctctggtccggaaggtggtcggctgtccccggcccacacagggtgctgcctcagcgcctctgtgcttctgcctgttccagaagctgtcaggttctctggcgcaccctctcacctgttcagactaatttcctaagttcggcgggtcccggaccaagatggcgaccgctgctgctgtggcttaggtcgcctccccagccgggcgggcacctgtcctccggtccggaaggtggccggctgtccccggcccacacagggtgctgcctcagcccctctgtgcttccgcctgttccagaggctgtcaggttctctggcgcaccctctcacctgttcagactaatttcctaagttcggcgggtctcggaccaagatggcgaccgctgctgctgtcggcttcctctttcaacatttactttttttatttaaacagcttaattgagggctataaaaacactggatcagtctttccaaataaaaatgaaatgcacctgccatgggttagttttactgtagaaaccaatcctgctacctgtaggcagtttaggtgttcaaatgatctttttttttttttttttaaatgccaaaagatttgatttggtattacagggttatagctttgagttgtgaatttgtaaaagtgtgacgattcttttgcttactgggtttgaaataccaaaacagttatgagatttgaattgttggtactttttcaaatgatttattttaattaggatgtaaatatacgcgtgtgggatgtattacatgcatgaaggtcaaggaaaggagtaggactctagctgaaaaacttcaaatcatcaggatttatgaataagccaaacagcatcactctctttgactcagcttgcttctcaatgctttcatggtgttactgtttccatccataccaaaacaaaaacaaaaaattggatacagagtaaacctagttgttttttttcaaagaacacttgtttcaataatataacagattgagatctctctcctcctcttagtctccctctctccctctttctccccctcccccttcactcgccccttcccctctccctctccctccctctttccttcaacctccccctcaaactccccccttcccttctctctctttgtgctttgtgtgtggatgtgggggtctgttttggcatatgagggtcattgctttaatcactggtattgtaatttcctaggttcccctctcatctctctctctctctctctctctctctctctctctctcacacacacacacacacacactgaagaagatttggttcatttccaatgacttttgttcatttaacaaacactattatttggttacttatgagccaaacatcatgctccatgcttgaggcctaatatggaatatggtaaagcatttgtcctaaggcgtttagagtacaaatactatcttgttttgccaggtttttatacacaaatttcattgaattttactcatattaacttctcacttccttgtatctcttttctaatattttcctgcttgtctgtttgacccatatatcctgtagattaacaaatctttccactatttagaaagaacaaatactggctgttttcttcttttctcgtccagattatgatctctggttagtatctgttgccagcatttattttgataatggatttttaaagcgtgagtttcattcactctcagtttggacagtattatctttatgtgcagttcctgagaattagtgaaatgactgtcatcatctttgttggaagatttccaggacatctggcaaaatttctaatatataaagcaagctgtctccatctgaacaaatgactctttggatgctagatatcctgtaacatctacacttatgtaattctcagccaggatcaattttttttttaagtggagtaagaggaaaataaaatttataaagaaagacagagctcaccctttatcttgataaagcatctcacattttggtgaagtataaaaatgtaattataaatatagtcttttatgttttcctgttggtaggcattttctttcaccagcataagcttttaattgcctaatcaattttggctttacctttaaagaaaaattactgcagtttgctgcatctgtcaaaggtgacaggctaattctttgagccaaaacagtatacatgaaatgtgatttctgttgctttcctgaaatatagcacagcttatttcttgacacatcctttactgtagttaagattccatggcagagaacagactgcttactttgaggtttcaaagtatagctaatttacaagaataagctttccaatatttgctatcaatccaagaatttatgtgtttcatcagaaccatgcacgtacaaaaggaattgattctcttacacaggatactgccacttcgacagaacagagaattgatttgtattataaattaactcaccaattatcgatggttccatctgacttatacacattaagaatctgcagtttcccagttatcaataataagaatactgtgtataaaatgtaatggggtgcgccagctgaatccgagttaaatattgcagtaaatgttgctcagctttaacatctgtcacacacactttctgcataatattttaattcattaaacctgtctctttttttttctttaagaataaatcataacttactctgtctacagggaaagacctgtaagaacaagtctctggccaccaacctttacagtatccttagtttattacaacattttgggacttagtgtcctcattaaaatgcacagtaacagtccttagaaataagaagatgcctgtctccaagtgtcactgctaagaagacccattaacttctcagactagaaataaattcggccctgaaataacatttctgaaacttctttttctcagaagcaatgattgaataaaataaggaatagaaagctcacaattactgaatttcctaatacaaccttgaattaggaaaaaaagtaaaataaaaagaaagaaagaaagctcacaatgtttcaattcccgcttagaggggaagatagtccctggtgcatatactggaaactctatatgtataacatcgaacttaaaacatcaaaaccctgttactttacttgtgtaagataatgtccatggggcttacaagacttaagtgcaaacacagtacctgaagttgacctccatgaagtttctttgcctaggaagatttacttcaacccccaacccacctccatccctggttggttactgcccaataagagagtaagctctttgcccccttagggcttgtaactctaataaagctactgaatgaaagaacttgggtgtcatttagagccatttgaaaaataaactattgtgtcctgaaaaagttaagcactattaggcctggtaatttaccataattgaagagttacagcagaaaatatgcaagttctgatttctggccaatttgagtttttacagtgttgttcttggcagctccctatgttgtgagtagcccactcttctacttcaccccttgttattaatttgtaaaatgaaacaaattactgacccttgaattgtgctattatacatgcttgagtaatttcatttacaaaggatttcatttattttatttattatttacgctctacctacttccaaaacaatgtgctctggcttagttttaactcattctaattcatatcaaatgtacattttgccaagccctgttcatactcacacagtgcttcccatttgctgggctacggtactgtgatgactgttatgccatttatcagccacctgaaaatgactaaattagcaacacatcaagtcagggtttcagcagtgctacggtccattgggaaagaacacacagttaacagttatgtatctagttatctcaaatatgtgatcttgggacagtggtatgccatttcattctcaggtttactcagatttaaatgtagggattaaagccaggtgttgggtctcaagcctataatcttagcacccaggaagccccagaaggggaaggatttgactttcagctaacttgatttgaggcatggtgggccctgaagtgagactgcttcaaaacttaaattccgtaaaaatgtagaagtttacatttattttctgtagtcatacagggtgataataaatacttataaagtgtcatgaaatgtcatctccccccccccccatattgtcaattcggcaggtggaaattgtcaagcaacacttatgtttttgagccctatcagacaaatgaccaacagtgatgacaaaataaaatgcctagtttgtggaagtcagtgttactatgatggaagatcatgtatacaatgatggggaaagtaattcaagtgaaatatatatatatatatatatatatatatatatatatatatatatatacagaagtaagaggaagtgttaaactgatgctgaagttggagaatatttggtaaatagaataaagcaaaacacaaaattatttaatgggcacttatataatatttctatatgctaggcttcttcttaaccacttttcaagagtaaattctttatttctattcctggctacactatacatgataattatatttcttttacatgatgtgaaagctgtcatccaaaagagcttagctactcacagttgttcaacagagtggtagaattgggatttgacctagggtaatctagaattaatgccttgaccaaagtgtttcaccactatccattgactcagaagttcattcctttgcttgaatctgctgctagaatccctcagcatcctgacatgtagctatgactttagactactgggagaaccaaaaatgtcctaactacttgtctcttgaacaaccaggtacatttactagagttccacatggtaattataagagtattattataaaacatctcccatgttctatgattgaattctgcattctcttttctgctggtttacataacctgataaaaaaataaaatggcatttgagaataattggaaggcagggctagagagatggctaagagtttaagagtactagttgttcttccagtggatctttgctggtttaatttccagaacccacatggtggctcacaattctctgtaattctacttccagcatatctgaaaatatgacattttttctgtctttgattggcttgcacccagacatgaatacaggcaaaatgctcatagaaagaagacctaaaaaaggattagaaaattccattatttcattgaatatatctaatgtgtaaaatgtaacaggttgtaactgtgctatatatgtaactgtgctataatttggagagtgtgaatcacaccagatacatacacacacacacacacacacacacacacacacacacacataatcatgcatgtgttctgttattttagtgttacctaagatattgtgtatctttgatataaaattgatgtgtagatctattgcctatactatttaattcatatattaaataagcaccagtttaatagatacaccacaggattataaactctgtgcagaggctgccgagaacccttgtatttatctgagtgtctaacaccagtctttttgcagcataaagagtagtggaaaattttgactgtatgaatgattgagcaagttgctaagtgatggaaagatagaactataatatccattaattgtgtgcctcaggtcattgttcatgtggtatctgcataagttctgttcagtaagaaagacagttctactatacatttgaatttctttaaagttttgtttggcaagtaaataaagagagagaactagcaatttccccccataaatatctgaatgaagtatttgaaagacagcaaagtaattcatcaatgagaaatgagtctttatagtattgatcagtcccagctctctttgaaaagacttgctgttatcatctgagaagctgtctgccaccacaagagcccagtagaattttctaggttatcaccatggggtgctcctgtggtgccaattattctgactgatgtcattatcctagttggaaatgcagtaaaacttctgaatctctaccctgaccattcaattggcttttgtataaagcatcacacaaccacacagtcaagttcagatcagattttaactctgatgcattactatttcctagactttgtggtgtatgagtcggatagttttatgtttatgtgtgtacatgcctgtgtgtaccgtaccttacatctgaaaaaatacatttttattcattatatataaataactaataaaataacctgctcacatttgaaaacttccaatgtctatatgtgaatacataattatcatctctgctctctcattagtaaagtctttaaatcctgcacttactgaaattaactttgatagaaaaccttttgtagcataaagtttaagtcattttaaaaacaagttaatattgcattagataataaccttgatgaatttactttagaatgcaacctaagaaataatgggatggtagagggtctttcattgtgttagagatttttatagtagtaggcatataattaattaacatttcattaatgatctgtaaggagtatcagtaaacaacactttaattaagttcatgggtaataaattaatgagtttagaaaataccagtgaagacaggaaaataattaaaaagaccagaaatattagaaaataggactgtaacatcaattgactacatgtaacttgtattccatcaagatttattctttgcatttttagatttataaaagaagtaaacatggaaaacaaagaaatacctatcttgtcaaccattgatgatagaatagttgtttaagtgatgggattctgaataaatttttcacataagtatttcagtttagaaaggaaatgactcattatgtcatctaaatgacctgtttgtaaagaaagtaagttgtgttgaatataaactactagccagtcctattaaatgattctctggtttcctatgctcagatacaattagaaaaatgcccatgttttcataaccatttaatggtagagatgaatttgaaccctgataattctatgatatgtctaataatagtaattaagctgcttgtgaactagcatatttttgtgttgtactgaaccagtactggtttcccatgttattctactttaggccttctaatgaatacctgacccttagactatgttacctgctataccaaaaacatgtacatacttacttttggtcttgacatcatggccagctagaactacttctagtcatcatcagttttacttgtatttaaaccagatggaatattgacactcaaactgtgaatataactatggatggggggagtgtgtgtgtgtgtgtgtgtgtgtgtgtgtgtgtgtatggagagagaaacttccgttttttggtttaaaccatgtaaatgacactaagtagatgtgaaatatatatatgtgtgtgtacacacacatatatatatatatattcattagtgcatcaaacacagcttaaaacctaaaactgaatatttacaacttaaagctacctaagggaaactacaggttatcctgttgttaatgtatcactagagttatttcagtgtctcaataccaatgatttattttcttttcagtaatattctcagcactaatttttaaactacttcatttacttttcctttttctgtaaacttgttcgtcctaaaagcttatatgctaggcaacttggtgacaaaggcagacctcaccttgctaatcactacagtgaagcccttccacaactacactgcatatatactgattagtcatataaaattctagccatgtgtagggttttagtgtaaagtgatgaaatatccaacatgacacttagggcaaaaaagaaaaaaaaacagtttagatttctgaactgtctaccttagcatccttagcactcctctgctaagaggagtctcaagaggcttaaaacttcatttaagatatgcaatttttgctagttgctgtatatcatcatacaaaatgaaatacagtggttatcacttccacagtccattgcttaattctccccgcgaatgagaaatgctgttgatcataattcagtatgatattaagtagtttggatatgaatgggttaattacacttataataaccattattgagaatatattcctggaaaatgtaaggtgtcccttgtgtgttccatagaaaaagagcagtttagatgagcagatgttgaaaggattaaaggtagaaaacagattgaaatgaaataacaagtacttaaattacagtctttgatagcctaggaccattgctttgagttaatgttagtttttattgtgtgtggctctgttcttcattttaaattttccagagagttaaggattcaaattctgacctcacaaaaacctagatggtcaattttaaaacccatttgtcctcctttttctgattcctcagctataaaaatgaagttgaactacacgatgctctcagttccgtcaagctctgttctcttcccaggaaatctaaatattgtttcctctttcaatgtcaatgttatatgaaagttgcatgaaagaccataaaagaaaacttgacaagtaaaactagcatccttagaatgaatgaatacatggtgtgacctccatgggtcacttccctttttttttttcagtagatgaacacagtaatgtaatatttttaactaaagtctatagtttacgttacagtccattccttacattgtgcattcagtcgattgctgtggtggtccctggagtctttggtagcagtgaacttttattttgtttagaggtgctttatcagagtctgatgaacaaatttcatcttgagcatgctacatctgctttctacaactaagctccactaccgattattataaatgtgtccatagtttgtctttttcagaaggccatacagttgaaatcatacaatatggaaccttttccaattcacttgcccttgtttgctctctatttgcattgataaaacactgaccccccccacccccgccttcaataaccactgaccaaaaccaacttggagaggaaaacggttatttcctattacagctcatcttatcagaaagggaagccaaagcagaagcttgaagcagaaaccacaaaggagtgatgcttaacggcttgttttctatcttctgcttagatggctttcttacaccattcagaaatggcactggccacagtgggctgggctctcttatatcagttaccaatgaagtaaatgcctcactgatatgctcatatatcactccgatctaggcaaacactgcacttggcattctttcagataactctgtgtctaattgttagctgaaactaactaggagatttgccagtaacttttcccccaaatcttttttgaggcttagtggcttttttttttctttcccatgatgttattaatttctgggggcattcaaaattctctgtattattttcttttttttttgtttgtttgtttgtttgtttttgttttttttccattttttattaggtatttagctcatttacatttccaatgctataccaaaagtcccccatagccacccacccccactcccctacccacccactccctttttttggccctggcgttcccctgtattggggcatataaagtttgcgtgtccaatgggcctctctttccagtgatggccggttaggccatcttttgatacatatgcagctagagtcaagagctccggggtactggttagttcataatgttgttccacctatagggttgcagatccctttagcttcttgggtactttctctagctcctccattgggagccctgtgatccatcaattagctgactgtgagcatccacttctatgtttgctaggcccaggcatactctgacaagtgacagctatatcagggtcctttcagcttaatcttgctagtgtatgcaatggtgtcagcatttggaagctgattatgggatggattccggatatggcagtctctacatggtccatctttttatcccagctccaaactttgtctctgtacctccttccaagggtgttttgttcccacttctaaggaggggcatagtgtccacacttcagtcttcatttttcttgagtttcatgtgtttaggaaattgtatcttatatcttggatatcctaggttttgggctaatatccacttatcagtgagtacatattgtgtgagttcctttgtgaatgtgttacctcactcaggatgatgccctccaggtccatccatttggctaggaatttcataaattcattctttttaatagctgagtagtactccattgtgtagatgtaccacattttctgtatccattcctctgttgaggggcatctgggttattttcaaatacctgatttgatatatccttttggctaggtcacagccctcatttattcaaacactaaaaattctattacttgttcttttgaagatgtaataaaaccttatcaattaacatccctccctcaaggactggtgttccaataccaggtaccacatggactatgcaagtactctactaaactacattgctaagggtctcatttcccctattggatttaccacgttgtttaggcttggcttcctgccttatccctctcaataactaatgatgcaggcttgtgtcacagtctggctgccttcaatgtttcaataaacagataatcaccataccagtgtgccacagattatatttatgcaacagcaagcccaggtcacttttttttgaatccctgctattacagatctgaccctgtcatttcacttcacaagtcgtgcaccttcactatcatacaacagctccctatctggggtgaaaacaaaagacagcggacattttcctcaataattacatgccatgtctacaaggcactcactgcacaactgagttcatggttcttccagacctactctacttcaagtgtttcagtatattaaaaagatacctggcccatctccccaaaattaggttctaacaaggctctagccatgttacttatttctttttataaatgtaggatagactcttaagcatatgaagttcccatctaagctccatagtttactaagtgacttgattctctcttgattttggtctcttcctctgtaaggtgaggggagttatgaggtggcttgcattgtgtctctgaaatgggatcccctggcttgtcaggacagaaaagaaaacaaggtagaaatgaactgctctaaaggaaatcatgcagctatttttcatattacttgtactaggagtctagtttctattgttagtcttttactccatatcctttttcatcctgtgactttgttttttaacgtaaaaacctgcctttcttacgtgccattgatacattatgtaatgtaagctgacaaacaagaaatatagagtgagaggaactacattttctggcttattttaaccttgcattgtaaattcccactcagccttatttttaaaatacctcattctgtgaagttctaaatactaataatttataacatttttccttattattgatggggttagcctcagataatataccagattcaaaaggatagtgagtccttttttctgtccagcacagcacatgaagaatgggtctactgaaagtaggtaaaagaaataagcctttcaagctattcccagtatttttagttaggtaacagacttactacaaggaaatcacttagggcttaagtctccagtaagaaaaagatcagtgagtctgccttccccttgacttggatgtatttacaggagcttccagtacctctttgcctacattataattgtgttcaaagagacataggcacgggtatatattgcttcctctcatactgatacttaactaagtataagttcctggaatacatgttttcacttaaatatcacattaaaaaaggaagaagaagaaaagtagctcaggcctttttagtgcttaacctctgagatctgacaggggaagaagtccatacaaaattataattatattacagtagctataattatggagtgacacagaaacattttaacagaccagctaaatctaaagttttaaatgaacagctttagtaatcaatcaaggttaacaatttttttaaacatgagagtcatattttttaatctaaataaatgtctggtgatagaaatattttatgtcttctaagtgttggagaagctggagagacactagatttccaccagttctccttgcaatcatatagttttgatttaattaacagagaaaatctgcatatgcaatagggtatagagtgtggattttacttctttaatagtttgacaagcagattgcaacaaacaaggcatttggaagcctgttaaggtcccagaggccttataaatatgcagcacacttctctgtatctccccaggtccctgagctagagatatgatgaataaaattaaaaccaccagatctctttgtatagctttcagcggccactaatctaagatgagtaaagactattttgcaggtgtgcattcagtaatagaaaaagcaacgtgccgtacaaaaatatgttttgactttgtaaaagttcttcctaaactgaatttttttctgtctctttaatgatgcattctcttagacctaattctgagagtaaaactccttatatctccttgggtttgttttatacttaatacatgtgggacaacacatgtagagaaattatttcttgaaaggtgttatacttttatttgtaaatacatctttggaatagcataatccatccagagcaagttcttctttagaatttgattttaatagattagtacttttcttattactgtgtttatcaccattcatgactgagcagatctccatggtccttttttcaaggatttcttcaaatttatggaaattcattcatttgccttgaagccttctgatccctttagtatattatctagaaagggtgggatctattagaagacatatgagaatggctaatgtaaaccgcagttcatggtattgacatttgcatcagagttcatcatagactgtaggaaaagggtataatgcaaagctgtttcctgtaatctataaatccacaaaatgtaagtactgcattaatattaactatgccaagcaatcgtgtacaatagctgaaaaaggctgccattttctactgttaactccgagaaaagggaaagtcttttgatttaaagcccacattggggtgttgcttttaagaaagccaacaaaatgatggggtatgaaaattttatttactgattaagaactcagttgtaaagcttagggaatgggaaaactaatttgtcaaattatcccctcagagttcaacaataaactagaactctctggggtttttatgtaatagaagacacctgtattttgtcttaatgtgcctgtgccttcagaactgcgactgaatcacacccagaagtgctaaaatggaattcccagcaaccgttttcagaatgggtttgaaagaatatatccaaataacagaccaattgaattaagaaccgtgtatttgtactcttttactggcgacattgctgattcctgttattgccctcttgaaagctgtactgtacattcttgggttttatcaatttcagacacaggcacggtgtgatgtcaagtgcggtaagaaataatttgaatattatagaagtagttctctgaattaacttatgctgatagttttggctgtgatgtgtgtatgtgtgtgtgtgtgtgttgtatcttaacaataatggtcttttcaaaaatatagaacaaaaaaggcatgacttggatcacaaagaatacagcagatttccggtactatcgtgttttattttcctatcatatttcttaaatgtgtaactactgagatactagaatgttagaacttaactgaatgtcatacttaggcttcaaaatgaaaggtatttgtagactcaagttgatacatgctttcctgacccagtattttattccacaaccagttatgcaattatgtggcctaagtgtataactcactagcacctatctccctctctctctaattctggaaaaggaagtatttatttttaagtgttaatcacaaataaaacaatttatagatagcctctacctgcctggtggaaattattaatctataagatagacgtgattcttacacttttgaaacagcagtttataaaacctcggtatgttcccaagtgaacataggaaatgaatatttttggagctagtaatcttactgagttatacatactgagtttgaaaagcaaacctcttacaatttttcaagtagttaataagtgtcttatcaatgataaactgttccctagagaggactattttacaactcttattcccagttccatacatttatgtttaaatgcaagcctggtcccagttggccaattttgacattttcttctacagcagttctttactaactcacatgaaagtatgttaatgaccactatggcctttccaatatacggtgactaaatttcaggatgatatgttttccatctgtaaacacgatctcggtgcagacaccagaatgctaaactttccctgctacttgtgtacttaaaatagaaaatacagggctggtggctcagcagttttaagaacatgtgttgctcttccagaggacccagctctgatttcaagatgctacatgacagctcacaaatgtctgaaacaccagacccaggggctctaattctctcttttctgaccttcactttgagagcttttcttcacagcccccttatgataatggctccccttggtttgtacctttctgcttgtcttcctctgagattcctaggtggaatagccacaacctatcagatgtttctttttgataggacaaaactatgggcaccagatcacactgccatgaagtgggatttagagcttaaattttcagaggagggataaacatttatttgtcatccaggcaatgacaaagtgccagagcaaaagacaggcctgcttaagtcatgcagagtgattttaagtaggattagctgtgaaatcagtctttgagccatgtgtcagaactgtaatagtggagcatggtcggaatgtctataatcttcatcagtcctctagtagtggcatattgttgccattgaacagcatgcttataaggggaagggtggaaacaaagagggaaaggaatagagtttatgtaaaaatgactaatgtttaaggtttcccaggaattaaatcttcatttttgttaataattgtcaccctaacctatcctgatataaattattttcatcctgttatcatgtaagatactgaatatgcactgcaccagagaatatgttaaatacctgtgtatgcttttttaaaatgagactcaaatagtgaaggagtttgcccagtttatcagatggttacagactgcaagtattattagttacatagcaagccatgcattccatttaaaattttatcatgagcagcacttcattttaaatacctttattctttattcttctttgttaattaatgtactttattataagctcctctatagataatttgaaaatatgccagtctttttaagatgctactacatattttacaaataaacacactaagtttttattagaagataggagggaaatctgagcagccatcaagggtggaaaatcttgcttgctatactcatgtaaaaacaaatctgtatgtaacatcttttctataacatcaggtgttcaaatggcaatttcacactctttgtcttttagtatatatggatgttttttagtcttcccaagaatgttcaaaataaatcacaaatatagtatatattataatgcctaaacttcattctatttaatttgccttaacaatagtttcttatctcttcatttacatggtctgtttcatagtattccccagcagtcttcccctgctccttagttgccttatttataccttcacaccttgaatggctacatctcttttaacttaatgttctttaaagttcttgtaacttgacccgagaaacaagctggcatcacctggggaacttttaaagcatactgatgcctaggtaatattccagacccattaagtctgacggttgcaattcagagaaccatagcagtgttgctaagctttgctaagttttgatctgattcttttccaaacactatttgcttgtatatatatatatatatatacacacacatgtatacatatatatgtatacacatactttgtacctatatttgttaatgacataaaatcaatatcacattcataattatatcttagtaatttttctgtacttgtcttagggtttccattgttatgaagagacaccatgagcaagcaaactcttataaaggctaacatttaactgggctgacttacagaatcagatgtttagtttattatcatggcaggaagcatggcggcattcaagcaaccctgacgctggagaaggagttgagagctctggatcttgatctgaaggcagttaggagaagactggcatcctcagcagctagaagaaatctctcaatgtccacctctacagtaacatacatcctccaacaagaccatacctactctaacaaggccccacctcctaacagtgccattccctggtccaagcatatgcaaggttaccatatcctactaatttttacatgcttcaaatgccacaacatgcatcaagactatagagatgacactataattgaagttacttttcaatgattcatttgcattagttaatataaagcaaagaatgtggaagactgtgaaccaaggcaaaggagactgagcaaacatagaacaaatatatataaggagctctcattttagccttatagatccttagaagaggcccaggagtgacagagatgttaagtaggtaaggaagaaccatatgctgaagaattttggatttttcgtcaagggctttcatccagattagagatatatttgtgatgccaatgtatgtgtggttcttgtttaaaggtccttaagaatttaaagacaacagtgctggtgcataacctgtaaaaccagcacttggaaaaataaggcttgggaatcatgtatttgatgctagcccaggtgacacagaaagaccttatgtcaaagggtagaaggcaggataatggcaacaacaacaaaaatgctacatcaagcaggaagtatgggcctttatgttaatatgcagctcatatatatcgtcttgggttttaactatatctcaaacatgttcagaaccttgaaagacctacacaagagagagttaaatattattgctttatatcttgatcacaacgtagaaaattatatttgtgtgtatagaggcaaggacctattaattgattttgggaaacatggtttaccaataatcttgatacttatatattttattgaaatttggtgacatcatttcttccttcaagcatttgctctctccagcaccttcttgctctcatattcatagcttatcttttaattattttcacacatgcatatgcacgcacacacactcgttgctgtttgtatgtgtgtacatatgtatatatgtatacatatatattcttaaacacataaatacaatcttcccagtccatataacattacctctatgtgtagggtcatcaacatgactgtttaaacaatacctgaacaatgagaacaccaatggtaatgttataacatgaaagggttagcatgctaagagcaggaaaaatggatattccccaagaaacaaacatacaatcccatttgtttttatactgtcacagtgatagtggtaacaataataatagaaatagcgactaatggcctggtggcatttaaagaccttcagaagtaagcaaattatatattttgatcttggtttatagaaggggacagttaagtaacttcccagaagttacagagataatgataactacaggactttcatacttatatgaaagatataagtatatgtctgcttcactaacacttcttggcttatcattagcaactacttatggaaacaatttcaaaatcaacaagttgtgcaacattaaaagagacttgactaaattgtagttgaatcattatctattgtattcttaaaaccacttgactaagattcatatgcatgttttttaaagtaggtgccagaaatgtcttatgtttatgttcttctgagcaagctctaaaaatacgttatatgaatcactcatttgcttatctactaaagaatttgaaatcaaacaagtactcaccagactttttttctaaatttaatgtttgttgtggttattttcttttgggtgggttctgaacataaattagaatggagtgaactattgattaaattatttgatctgagaacaaatgaacaaacaaacaaacaaataaataaataaatttaaaaaatatacccatttaagtttattaaagcagaaagtagctaacagataaatctctaaatgaaagagaagattggatgacaagaaaaacattaaagacatgtgtgaacatgtgaaggatttagccaagaagtataattttaggcattatataatgccaactataaataaacttggtaaatagtacctttgtgttgactcaatctctatcatactgtagaaacattctttcctggtcagctctaataatttttgttttatttcttttttgtttttgttgttcaaattctttttttttaattaattaattaattattttttacactccatattttctgccccacctacacacccaagccaccttccaactgttccacatcccatacctcctccctacctcctgtcttcaggtggatgtccccaaccccatcccacctgacaattcttattcctttgtatctactagaactttagatatctgaagatttatcttcttatagttgatataacaagtaaatttggggaatgtttatcttataaataattgattattttcatagaatcactatgtttgagttgatttaggtgtttattttctgttgtaatttaagcaattggcttaattatactccaagggaaaacaacattcttttaataatggttttgtgttttcttgattctcttgtctttctgagtttgtttgtaattggtacataaatggtgattacagttctgagtggctaatggttgaaatattatttgaatttcaaagctgcattactcttataataatattatgttcaagctatataagtaaaattgtcaccaaaagaacaagtagaatataagctgcattgtacagaggagactatatgaacagattgaagggagttatttaccaaacacattggctagattcaatccacagtcctctacctgcatgggttccctttcttatcccgagtaggttcacaatttgtcatctgccacccctcattgtcaatagcaaactttacctcttaagtcatataaaagtgctgggttttacccataagtatttttattatggcttgattttttgttttgttttgtttccttcggggaacaatgtcagactaagttagatatttttgtaaaaaataaaaataaactttgtaaaattttatttttatttgtaaaaataaaaataaaaataaaaataaaaatttatgagtacctgaaaataatgcagaaatattctagcatgtgcatcttaattaatgtatggaaaactttaggcatacaaagaagtgaataacactttctaatatatttattgtattggaagatttttctcctggactttgtaaagcattttaagaaattgtcattttcttttgagttatttattatatttgtacatattagttaccaaaggccgactagtttttttttcttattttcttttccatagataattacagaaatatcaagcaaccacattttaaaaaaattgatagtacttaacataacagttgagatatatcctactctattgaaccttgaaagtatttcttattcattattatcattatactgtttttacaaaaataggtaggtcatacagttgaattgtaaaactgagagtagatttgataatttagcaacttttcaatttgtgtttatagagttccaagtgcataacattagacttttatttattctattaatgttcctcttgctcttgtctttggatatgaatcacttcatctagttttcacatttccttctttattttttcatttttattattatttatttatttatttatttttgcttatttcccttggccttctttaccaatctaataacctcaatcagtctttcaacccagagggttgttatgtttatatcgctctggttgctatttcgctcctcacaaaccacatcttgcaaccactagttgtatgtttcctcacacgcacatatacacacatacatacacacacacacacacacacacacacacacacacacacacactcattccccccaacacttatccaggtctgaaaacactgttttactaaacaaatcattcatcttcttctaaaacctagttctttgaatgttaccactactcttctgaattgtctactttcattcagtggtgaatatttgatgctgctttgtattgacacgttcagtgaaaactgttattatgttaatatctctgctctaaattaattaattaatttttatttctataatcgatttgcacctttattgtcactgcttagttttatacaagctgtgtgtactttttttaaaatagggatctctctgtgcagtcctggctgtactagaactcacaatgtagagcaagctggcctctaactcacagagaacctcctgcctctccttccctactactaaatgcttagattaaagctatgtgccagcatgccaggctctctttacttcttacaagacatcatctaagcaatttctccagactcttcttccccccaagtccattgctatactttcctcagatgaatcactgcatttatgattcctctgaacaaaaacaaaaaacaaaatgcaaacaaacaaacaaagaacacttaaagtcaaaatggagtagcttcagactcattagggctacataggaatttccctattaaaactcacttagcctgtgctctaagtaaaactaattatctgctgaaatattattgttgttataccttgatccaactatccccgaaattgatagattttttgcacttttgtttaagattttataacaatcagcattatacactatcttgtgtgcatatataattgtagtatgtaattgccacaatatgcatatgttacttcttttccctctggaagcagcaaagttctaacacatgtaaacatgtgttattaatatattataaaaatactttaatgtataatttgcatgatcgtgatgttccactctaatctcctaatttgttgtgtgaactcattagaaacagtcctctccttctgaccatgaaaaagaattcctttctagtaagaatttgttgctatcaagacaagtgtttttaggtatttttccagagccccttttgtggtttttattcttgcgaaggacataaatttttatcctgtctgcctgcagttgcagttcctggctttacgagctatcaaatatacttctttttctttgtacaaaactaactggcttatataagaatcagactcatgaccttgccctcattagcaccatgagctaaccaattctgacatatagaaattacaaaagcaacaaataataagagaaaacaaaatggtaagaacgtctagtgggaaataattttcataaagaacatatcaaatttgtgacctgcgtttagcagattatataaaattcttgattgtggaattgctccattttacaggggaaatacaatatagcaacagttgtagagattaaaatcagagatgtcgcactaacacactattttccttcttatataatgtagatttatatagaacaaggcttcaaaccatctgtgggtaattcgtatttgtcaactttcctgtaaatttttattcatgaaaataccactggtggccaaagtaagccagtgagtgaaagtagccaatcccccaaacagctctgccagtttatttcagtgtggatttctagtttgctgttttttctttctttctgtctctgtgttgtactgaagcggagaataaggggagattgctgctgctacagtgatttggataaataaatgatcaatataagcattactataatgataggatttgatgtagattctattgtgaaaattaagacccattcctgattcttaattgacttgaatgcttcctgactttaggaaaaagttttagtttgaataaaaagtgtacattttataactgaatttgggttttgttctgtttattttgatgggagggagattcttcaagacagcatttgaaatcaatatatcttacattaatactatatttagtaataataaggaactatcacagagtcctattatgctttcattatatctaaatggatatactatgtgataaatatacccacctaactcaatttacaattttgttgttaaaagaatatgaaaatatctaaaaagccatgtttttataacttacttgagtgctcgcaagtttaaaattttgccatgacgcaaatcagcagaaagttgtactttgtcaaagtatatgttggaggctctttgtcacatttactataaagaaagcatcacatgtgctctccttttgtagattcgttcctgtatcacaaatttggaaggatatttgtttgctggcctaattcccaggaagtgttttgcatatttttaagggagaatcagagagaagtaaagcttaattaattgtaataaacttaaaaatgccttctagcccagcaaagaagaaattatatataaatagaaaaatagtggaaactagatgggtacactaagatagaatgtaaatgtctagtatattatctgatacatagttaagcaaggctgtagtccttgacatacttttataatagtaataaaaatggtaaaattgctactgttggtgatattttactttaatggaagaaatcatatacttgaaaatataaattaggctaccatatgataaaggaacccagtgaggattaccttcaacacatagtaaaatgtttcattttggagggtattggtaaaatattttggaaatagtcctggattatagattacatagtttgaattttattttgtgtgactcaatcaacagaaagtatactctaagaacgcttaaaggtttttttgccatttcaatgttctgaccaacatatgtagacaatgatatattgtatgtgtatatacatttttatacatttacatatattcattatatatatgaataacatacatacatggtaatatagaatgaattaggaagtgatccttccatttctattttgtggaataatttgaagagtattgatattagttgttttttgaaagtctggtagaattctcatgaaaaccatttggtaatgggctttttttggttgggaggttgtcagtgactacttctatttccttaggggttatagaaatctttagatagttgatctgatcttgatttaattttgccacatgatatctgtctagaaaatcatccaattcatctagattttccagttttgcggagtacaggcttttgaagtatgacctaatgattttttaaatttactcactttctattcttatgtctcccttttcatttctgaatttttttttgccctgtggagtagagggacaggcatgctaatatgccactagtgcaggtggagctatggagccagctaactgtttctcaattgtgtctacttttctaactgcatctaaacactacaacactagatgacctggtttttctacaaacaactatagttttgtacagtgggctttgtacatatactctttttggtagtacaatactactcgtaacagtcttgataaatttgctttctcaaaaaaaggttatgttatcttgctgttataaaatgttgaaattatattaaattatccataggagacattatttagttattgggtttagtgctttttgccaaactctgtatattgttgtacctgtgatgttaagataactttaaaaaataagagagaccatgtggcagtactcagaggaatacctccagcaaataaattgtggatgtgctaaattaaacacagacacagaatcctatttattgcagagtttctggctactttttttgttaatttctaatagtagctaggttattgaacactgacctaaattatttaccatgtcttatgtccaccaccactcccccttcctgtgggtgtgggggaatgtagtcaaggcatttatttagctttgagacaggatcttatatgcctctagccatgttagaacgctttctgtcacctaggcgatctcaaacttgaagaaatcctcctgcatctgctggcttagtactgggattacagatatgtgtcaccatgcctaatttcaagctgtttgtttttatctatagaatttgtaggtgaaaggaatgcttgtcagaaataaaaataatgcttttttcaaggtacttatagctgttattagcagagcttcttgcttataggaaatcctctttgaaatgttctgggggaaataataattaaacaggattgctttagaaattgcactggtagtagtacccataatgttcagtataagaaaaaatagaatgcttttaacttctacatcaataaaaaaatatgcactaatttatactaaggatttggtatagtataaagttttgcattaatattctgccaagttagttaatgttgatgaatcaatagcatatggctttcagatcctgtgagctagttacaatggaccataaatactgtccaaacactgtcagtgtgaaaacattattttgttgcataagttgcataacattctaaaagtatttcataagcaaattacttaatatgaaaataactgggtgatcttgcataactacagtagcacccttaaggtgtgacttcatgaaggcatgatcatgaaagaacttcatgttactacatgaaaaagcctctgtgaaccattactgaaaacggcctggatagatatattgctagaaatggttgcctatttctgtaatttcaaaacgaagtagcagagaatcccataatgggaaaagtacttttacatatccttgtgatggtgttcttctcatgatgtttgattccattttgatgggtttgctgatagtatgattcctgctgtcactctaatttgtgattattatagctgtttcctttttgataaaggatgctgttgcataaaaacactgacatgaagctatcctttcagaaattgcattctgtatgctgctatagtcattgccatgttgtaaagtgactgttttgctatccacaaggtaggattatatgtttaatatatcaatttgtatgattcatcatttcaatagaaaaagggggcccatagctgtatgtattttgaacttaaaaggtaatgcacactgtcaaggtgaaatagaaatataggatttaactgactatgcagtcattggaaagtgaatttgggatgatggtggtctaattcacaatttctccgagacacatgggaaaaggccgtccaaaggcattagaaatacagtgccctatgaacgccaatttcaaagcctcccatgtcatagccaagggtaggacctgagagatcccagtctaaaaactctggcaaaaatgaaaggaaagtgtgtgtgtggggggaggatgcagtaaacctcttgaaatttatgtagaatgttctaacatagtatcattgaagccataatatcttcccctctcctccctttccctctctctgtgaagaagcaaggaagctatggtagaagtaaaaacaccagaacttagcatagctccttttgtcccttacattgcttcagtggtcagaggtgttgttggattagggaatgagatatgggagtggtagagatggtgtcctgtcagatgtcatttgacaacttcaagccttctcatgcaactgttctttattacaccaaaactgtttacccattcaggatgaaatcttacctttaagaataaaatgttaataaataactagtgttctcagcactactagtacctgagaactagaagggagtatcagctatcctgcaagtatataatatttgctatttcccaatagtatatttactggccctctcctcctccacatgaagaaacattctattttccttttccatgggtagctgtgattctgccatgtttctgaagatccacagtctgaaatccattttccccatgagcctttcatttttaatatttatccaccttagcctcacggaagctatagataaacacttgctttggaagtttatcctctacctcaaaggaactggcttcagctttgtatctgaagtaaggacagagataagaaagactttctataccaaagaggcatttaagaggataagaagtgtgaaaatcataaagctaaggaacagtgaatggttacatttaattggatttagggtaggtaataaattgtgaatggagttgtacaaggtaaattcaggatgtttccattgagaccctgtccctcagggtctcaagtgtttaaagaattccctcttattaggtgtaaaaacaagggttggggatagcatcacacagtaaggggttgacttgaaaaaaacactgtctaattaccaaggtgatcttgtcatgtgatactaaagtcttactcccataacatagaaatagttatacttcactgaatatttatgctgaatttgattcagagatgtcatatgcccaggttttataaatgttccatttaataaaatgtatacacgctgtggcatttcttcctgagttggtaatgaatagatctatgtatgaataacacttgcataaggggaatttacagtttctaaatatggtgacatcttataagagcagggcagctggcctatatctataacctctagacattgcttctttaccctacactaacactaggtctgacacttgaaacaactctattggccaaaggaagacatgctaattttggctgtctttctataacatatcaccaatctctttcttatctatacacaaacagacagacagacagacagatagacagacaggtgacagagagagagagagagaaagagagagaatgagagaatgagagaatgactctggtgagactatgccagggcctagcaaacacagaagtggatgctcacagtcagctattggatggatcacaggtcccccaatggaggagctagagaaaatacccaaggagatgaagggatctgcaaccctataggtggaacattatgagctaaccagtaccccggagctcttgactctagctgcatatgtatcaaaagatggcctaaccggccatcactggaaagagaggcccattggacttgcaaactttatatgccccagtacaggggaacgcctgggccaaaaagtgggagtgggtgggtaggggagtggggggggggttgggggacttttgggatagcattggaaatgtaaatgaggaaaatacctaataaaaaatcaataaaaaaaaagaatgagagaatgtgagaatagccatttgtggaagagcttagagcatttatgggccttttaagtttaacccttttgtctcacttgacaaacaaattctcttgtataagataactataactctatatcataaagggaaatattttctgttaggaggtagtatgatcaggtgtttaagaagatgatggttaaatgtgatatacaaatactatgatttgtgtgagttgtttctaaaatcctttgggctattatttttttatttgcaaagctttgctcagctttcctcccttttagattcagtgtaactctaacagtggtcctcaagcttcctaacgttgtaatgctttaatacagttgctcatagtatagtaacctccagctataaaattatttttattgctaattcataactataattttgctgctgttataaattataatgtaaatatctgatatccaggatatctgataagagactcctgtgaaaaaaatatcattcgacctgcaaaggtatctaaacccagaagttgggaactgctggactaatacgtaatgtaagtgctccttgtatttatttcattagcacatacctttaactggcagaaagtgtaaatcccttggttagcatgactacatgttcttcacagaggattgtttctcctgagcttggtttgcttttgtttgcttttggccttgtttgtggaactcacaaccttgtgcatgctagccaactgttcttccattgagctataaccccaatctctagtatttttatgcttacattttgataccctggctatattaatatttgcaacctaagtagtttaaaatgtagctccaaatgtattcacaacaccatttaccttttcagttaatcattgatattacaaaagaatcaaaaccatcaagatggttcagtaggtcatgtaaaagagtatttcactgcatcttaacgtactctcaacctatatgcccttggcctcctcatagatcaaaagtcttcctacactgtgcttttacaccctctggtattgaaagtgacaaagtagttctaatcctcaaattccatcactccactttgcttgctgtgctccatttcccattcatttctgtacagcccagaagcctcatgtattaacaagtgtataccagcagagtttcatttagtgattttcttttatcactggcttccctaagtttggtctttttcatattcagttttcattgatacattcttaatacttaaatgaagtacttcccagatgtagtatctttagatgctccaatgattagcatcaactttttcctggcagaatctaaaagatctacaattacattttgaaaatggtttgtggcagagctgaggacacaatataagtaatggtagagcctttgcttatcatgacatgagccctggatttaatccccagtactacccctccaatcatttttaaccactattacagaaaatattttaggcaaaataatttctctgtagctatagctgccaaatatttcatagcaactttcttctaatgtctatgaagaaagtggcactcttagatggtgttcctttgtcagccattttcaaaaatggcaacattcaatatcagttgtacaaagtagtagatgttatgtcctcaactgaaagatgcaatcaagtccttgagagatggaatcattgaattgagaaaacatatgagacatttttagtatctaaggtagtataaagtgttcaacctatttttcctctgcccattctaatctatataataagaaaagtcattctgtaagcagccatgaccttactggggagaaaggaaaaaggaaaggaaaagataaaggttagctatgtattctgttcctaaagaataacctagagaatttaaaagaacttcttgctatactgctttcccaggacccctctgagaataatagaataaggtcagaaaaatccattggaataatccaagctacagataataatggttgacatcacaatagtgttagtacaaatggcaaaaatgtagccggttacctaactgcataattttaaactatatgaaattctcaatatttagccaccatcagtcagcgaaaggtgaaatttctaatatttctggttttgaaagtagaaagtatagtttcgttaaaagagtagaatagatatgtagaacatgaaagaaatctaatcaaaaaaatttgccagactactgacctaagcaattggaaatagagttgacattatttcaaatcatggtgactccaaggctataaagtggacacctttggaagcagtcaacttttcctcagccttaattttggcttagtatttctttggcaacctatcaatagcaacaatcaaacctagataataacatatatatgtataactaattccctcttgatatatattatgtatattatataatatataatatataatatatatggtatgtgtacacatatatgtccatattgatgacaaaaataattaagcttctctattaacactgattgataggtctggctatcttcccatatgaaggatagcatgttacttctatatatggtttgaaaaatgtgattttgatgctttcttgacactatgccacttttctttcaacatttattctctaaacttactttctttctgctttattatattcttttatgacttcctgtcactctaaatcaggtgagattcagctagggtatatgttattacatgcaatttggaaagattatgttttgtttgctggttgctgttatttttctttaaaatggtgttttactctgtaaccaaggctattctgaaacttagaatcactgccacccccaccacccccagcacctctaagtgctaggatctcagtcacgaaccactttgcttgacttcaagaactgcctttatgttctgtgatcctgtaacatgggagcatgaaataaacataaagtgaagcttcctgttttgccaggttgttttcaggaagtaataaatacacacaatacaagccccagttcaacagcatttctacttacttacctgcatggcagagatacaaatcgtaagtgtatccacagaaatggatgtaaaggatttaacaatgtatcttctttgatggcattcaggtctgaggcaactttatcatggcaaagtacaaaaatgtgaagaaatgccatgttgagtgaggatcagatcagaaattagcagttttatgagttttgataagaaacttttaatacaggtcacattatttgtgtaccctgagttaaagatgaacatatatccttctgtgattttgactctttgcctcactcactaatacagatatctgtatatctgtgatatacaggtagatagatagatagatagatagatagatagatagatagatagatagatagatagatagatagacagatacaatggggggtgatttcttctgtgattgagtttatgaaggaagaaatagtatgggagtgaaaaggtgttagaggatttaaaagaaaatagtacatgagttatttagtttgtccaaatttaaaagacatcaaagctgtttgctcaggctcttgttttcaagatgataacttgtgtaatcacataaatgatgttctgtgtcactgaaaggaaggcctcattattgttgctgtgaaatgtttgtgttaaacaatcattaaaaacagacttgctctacatttttagcattttcctcagacatgtgataaagcacgaaagggatggttatgagaaacaaaactgtaccctgtttatatgaaaatgctttacatatatgattaactacaatttgatttctcatgatcattttgggatgcttcttatccttaatttgaagacatttaaggagagataacatgagtaaaatcagtaatgtaaggcaagatatgatgggagagaagtgcccctgtgtttcctgtcagtttaacagaaattatcacatgagtatgcatgaaatgtgaagtttcatgatggaacacagcccttcccccaagtatgcttcaagattcccaaggatttccatcaagaagcatgagaggtggatgatgaaatgtaaaactccccatctattttcatcccactaaccatgtgttcagtctcacatcccagctctcttttcatgttttgtaaacttggtccttttgtaagatagtgaaaagaaatgattctactgaacttaggtggttctcatcttattcatccccacaaactgaatgcattgctctatttcccccatcacatacagcagaggactgtcacgtctgggttcagtcaaagatgatgcacctaaccttcaagagactggggtacctagggagtttagaggtctggttgggtgagggtggggggtgggaacatcctcatggagacagggaatggggaggaggtatgggatgtggaacagttggagggtggaccagggtggggggcagggaataaaatctgtagtgtaaaaaatttaaataaaagacaaaaaataaaatataaaattataaaaaagtcacatgaaacatgcacaaaatgagtatagcagttgctcattaaagattcccattggatcagaagagtttctaatcaaaaatttctccaccatagatattattatgaaaaaatacgtttattttattaagattatatttattaagctagtgatgagtgcttcttagcatgtcttccctactttattcacacaaatacccaataaatgacatctaaatagggcttagggtatggggtaaaaaggaactaggttgtcttcctttatcaaattgccaaattcatctgatctccacaagaaaaagtaatgagcaattcaattatatttgattctgtctgtgttttcttcttcctcttcttcttcctctctagatgacctaaaattaatgatttagagctgattctcaaaattttattctcttagtgtggagaaaataagccccttatttctttggatagccaatgctctctagctggctatatcagcaagcttaagcaattttgtctatttaccctgatgagtcacaaaattatcaacttgtatatgtaccaggaacacatcaatttaaaacctcagtgatgtgcctacccaacccctttttttcttttctattctttttctctttcttttctttctattcctttctttttcttctcttttcttcctttcttatttgaggcagggtcttctatagcttaagatgtccttgagtttgctaagtaacaaagtattgaccaacaatctattgatcctcctgtcttgacccatgaactttagattctcctgtcctaacctcccaaactgctagaattacagtaaagttccaccatgccttgtttatagagtgttggaaatcaaactcaggatttttcaaattctagacaaatattttatcaattatgttacttccattatttcattttctccctcttcctccctttctgttttttctctttttactttgtctcctgacacactaatttacaaagaccaaataaagaaacaaacaaaaagcaacaagagaatacttggcataagaatatggcaatttagccgggcatggtggcacaggcctttaatcccagcacttgggaggcagaggcaggcggatttctgagttcgaggccggcctggtcttctcgttaaaaaaaaaaaaaaaaaaacgaatatggcaatttgataaaggaagacagccttgttcaaatccataatccaaaccctatttagatagtctatttttacattataggaaaaatatattttgacaagttgactagtttccctctgggtttccatttgccttgagcagaatcttcagccatcttgtatggacggagcaaatgtgtttatataatggggtccgtgctaaatgaaaaagttcgatgtgcactagcttccataatacgaacagcacgaactgaaactaaaggataatagaaccagtgcagggtgtctaggcaagatgcgaaagcaaattgcttggaataggaattgcatgatgactattgtaatactcctattattttctgaaaaatcagaatggcttatattgaacctgaaccagaaggatttctgtgtccattttaggtacaaactgtataaaatgaactaaagcaggtgaacactgaaaacagtaaaatgtcaccatttgttttattgcccaatgaccactttttttctgatttcaaaattactcttgcctgccatttgttagtatttcttctgattaacttactgaagccctaataaccctatatgaatgatttcaaataaacatcatgttagggatacaagggtatttttcgaaggccttactctctgctgcctagagaacacagagcaaaattgagacttgaaatatatatttttttcttttgggtaattgttcatgtattttagttgattataagcagacatttcttttgtacttattattacctggtgataattcaagttaaattcgtgagatgttgcaattcctacagtgatttgaatgggaaaatgtcagcaaaccacagtgaacgtgatcttagagatgtgagcccttctcatgtatattttttacacattaatactcaatagaattgtgaaatatggcactttgcatttacaaaagaatgcgatggcagtacccctcttcatatgcatgaatgtctctgaagggaatagtaattatctgcatttctttccactttaagaacactgtatcctgaccttgtctgtgattgtaatcactgtaacttgattacagtttttaaggtgtcgagctatcactgctgtcttcaatatcacctcaaaatgaagaaaggatagtggcaatattaaagaaacattaaacttcggtaaagcttctcagttgtatcattattaaaatcacaatgatgaaattctatctcagaaatacatgtgtagaagaatctttaagaagcacgtgtaggtggatttttgctttctaaagcaaatagcagggtagaattattgtaggttcttcaagatgccctctttcagtttaattcttttttttttaaattggatattttattttttaacatttcaaatgttattccctttcccagttacccctccagtgtccccctatcccaccctcccctccccccatcttctatgagagagctctcccacctacacacccactcccttctctcaggcctggcactcccctacactggggcatcaagccttcccaggactgagggggctcccgtcccatccatgctagataaggccatcctctgttaattctgcagctttagttggcagtttagactctgggatctctggggggtctggttggttgatatcgttgttcctcctataggactgcaaaccccttcagatccctcagtcctgactctaactccacaaattaattctttaaatctacaagttgaatctgaatattttcaattcatgactctccagaattttcttaaaaaagaagaaataaaatttaaaagtaggttacacagttaaaataaaaaaggatccaagatcaagcaatgtggaattctctttctgctgctttccttgcagtttcaaatctgttttcttcgtcttattcggggtgttgcagggatgttaaggtggtaagcctagttttgaaaatgatctttttctccacttttttataggacaccagaacttcaaagtatctctactataaaagtctcataatattatttcaaataagatttaatacctagccatgcctggtgacacacacctttaatcctaccacacaggagtcagaaccaggtacatctctgtgtgcctgaggccaggtttgcctacagagtgagttccaggacatccagcgctacataagactgtctcaggaaaggaaaaaaaaaataactaaaaaatacaccaaacgaaaccaaagaacaacaacaaaaaacaaacaaaaaaaaacccaaaaaacccagtccttaaaatgatagatggcaccaggtacaacggaggtatgcaaaaaatattttataataaaatctgatggggaacattacaaacttatttggtaatattttgtaaagaattacttattttatgtatatgagtaaactgtagcttttttcagagacaccagagagggtacttcactgtgtttctgtttagtttctgtttcgatggcctgtccgttggtgagagcagagtgttgaagtctctcactactattttgtgaggttcaatgtgtgttttgagttttactaatatttctcttataaatgtgagggcctttgcatatgggacatagatattcagaattgagagttcatcttggtgggtttttcctttgataagtatgaagtgtccttccccatctcttttgataactttttggtgaatgtctattttattggatattagaatggctactccagattgtttcttgggagcatttgcttggaaaactttttctctgacttttattctgaagtagtactgtctttgtcactgagttgtatttcttatatacagcaaactgctgggtcctgttcctgtatccagcctgctagccagtgattgttggttcctgttattttgatgttagaggtggaattatgtttgtatgggtttgttgaaagaagattattttcttcctttttctaaggtgtagtttccctccttgtgttggtgttttccatatattatcctttgtatggctggatttgtggaaagatgttgtataaatttggttttgttatggaatatcttggtttctccatctatgatgattgtgttttgctggttatagtagcctaggataatagcacctgtgttctcttagggtctgtatgacatctgttcaggatcttctggctttcatcatctctggtgagaagtctgctgtaattctgataggcctgctttatatgttactaggccttcttcctttaccacttttaatattttattaaaatctctgttctatgcatttagtgtttttattatcatgtgactggaaaattttcttttctggtataatctatttggtgctctataggctttttgtgggaatgggtgggtaagtggtgaagcaccctctcagaagcaaaggggataatgaacatttgtagtgtaaataaataaaataataaaataataaaataaaaatgttaattgtttggcagctagacatatttcaatgaaaaatccctacatatttgtgtttatgaaatagccaaaccctaagtggacagacagccttaaaggactgtatgtctgactattacctctagattaatcaattctgaatgttttgcaagaaactaaagagtttctcccccaagagcttctttactaaacccaggaatatgcgaggctaagtaatagcaacaaactcatcaccttgaccaatgtctcttaagattgcactgcatgtctgtaaatatttctgaatcacttcttgtattataccattgtacaattgcttttattaaatcccgagtcacagaatgatcctttcttttacttgaattacataacatagtattcaaatggcaaaaagaaaagtataaaaaattattttcattaaaaggctatgtttttatttcaggtggtattagtagctattttattactaattcatttaatattcatgagttcactgtggatgtcagttctcctttatgatatcatttataaaatgactgaatatgagcacattttcttagatgaagcatttaaataacattatacaattctttaatcactagggatttgatggaagtattagaacttaacctctgaattgtgtattaggaagttaaggttacatttgcagtggtttggagacagatttaagaatatagtctgtagtagcagttcataacatgactcatttggaatatgctaaaggtcatgtatatcatatgaactatagcattactattcagaaaacatgaaattttcctagcgatacatcacacagacattaccatagtcttttgtgggcattaaaagtatagaacattaaaatagacttgctttctttaatatttattagttttcaaacacttaacattgcaagaaaaaggaccattaagaggaaatgctttctgtccaaattcacatacatatatacatgttaacatgttcatgtacattcacatgatatatttttaaatggctactagtcatatcttgaaagttgcctaacagtgtgcatgttgaaaataatatagaacagtttgatttctgccatatagatttaaaattataattataactgaattataattcattcatcaaggacgtgtcttattctgtttaatgaaaatatagtctttatatttctcactttgaagagccctctgaaaacaaagatcatgctttcatgaccaaacatggtctctgtatactttgagaattgattaatgttaattcattttaaaaatggccttagaagcctagtactctcattcctggcacatttctctatggttaagcataggattctacaggaaagagtacaaagagcaatccgatttgttttctgagttagaaaggaaactgaacataagatatcgaatggggcaatgcctaaagggaaagaaatgaatacagggtagggccatatttttaattacttccaaagggcactggtgtgtgttttataaccattcgtctctgtttttatgaagcactaactccttgaagcacaaaattacatgtgtgtgcctgaggcatatggaaagtaaacaccagagaccatagctgagtcttaggcactgggttaatatgtacagtttggaagagttttgggagtccattggaatgtaatcagtttgattagtttcttaagaagaaaaggaaatactctcaaatgaaaacttatattcacagtgtaaattatattagcgattttaaatttttcttcctgattaaaaagtatggtgttgctaacaaaatgtttccctgcatttctctaaactattttaatatctttacaaattgatatcctctaatatttattctgacctcaagttttggttgctttattggagttttgttattgtttttgaaacatagtctccctataactcccaggctgtcctagcatttgagactgccctgcctcctcatccctgcagtgttgagattactggcatgtgcaaattgttttcttcggtccttaaaaagagtcctcagaaataagatgctctgacaatagtgggctcaaacaagtaaattgttgaacctaattctgcaatctcactctgaccttttgtactcagtacttagtagaatttggctctactaataaccaactctgagagggatgctccagttcctacacatgaatctgcttttagtgaaacaaattaagcaaatttcactggtaattcaaagacttaaatatattcactttctctaatggaaaaccactttctctaatagttctggtaaatttcctacaggtgatgatgtgacgcttgtaacaattagtgtgttctgtttacttctatacaaggccatataattagaggagcatataaatggctcacatagctacaagtcaaatgtaccacataatatgttccgatggcaactgtactgtcatttcatctaaagttcctttcatagacaatgaaaaacaattcctgcctgccaggtgtttagaaatcatcacaggaacagtgaaatagcaaaacagtcaaacctacattcacaagggatacaatgaactaatcaaataatacagctttgaaacccatcttttaaagaatttgttgtttgcttttcatctccttttttaatgatgacatcttaatttttaatcctgccattcattctttctaatgtaacagacagattatgatcatctgcactcaaacacagaagtttgagagataggaaagaaatcacatctagtacagtagacaaaaaggaaaagcccatatagttttaagattgtgttaatgcacaagaaaaatatgccacagactgcctctttctatatgctccatgaaggcaatggtaacttataccatctttgtgaaactggtacaatttacataaccactttttttgttacacaaatattgttcatcttagagcttaaatgactctagtggtgaaaattattatttgttcacatggcagtggattcaaaaggaaatgagcagcctacagtgtccactgcatgaatgacctatgcctactgagagtgaaatgtgtatctgagtggtagtatatactatatagcatcattcaaggaaagaaaatacctatatacatctttaggaatacagacttacttagttaaaaatttatttaatagctacattgagcatttgtaattattaactgtaaaatgttttacacaacttgatatatttaaacactgaagctttagaaggcaggaactagctagctgtctgatgtagccagatagttgctgaaccagaatattgcaggctgacatccctgcttcctgtctgctgcctcaacaaactcctgcaatcacaagctgctgaacatgtttgctctgccatgaggtattgtgttgctctgaattgtgagccaaaataaacccctccttccttcagttgcatttttgtcagtttttggtcatagcaacaaggaaagtgactaatacaattattaatataaaaatcaagaatggaataaaacccaataatattccaatctgagcattaattgaaatgtcctgtgtaagaatgaaatccatagtgtacagtttttcttcctaatgacattttatgtatttttagatggggtattctcatatttttaatttttgctgtacattctttcttgagaaaagagatagcaatgtaatccaggttggctgggaactcaaagcaatcctgttgcctctgtctcctaagtgcagggaatttggcatggaccatcacacaggactcctgctaaatatttcttaactcatggttctcagaggcttcattttaaggtattcagagcattgtttctataatgtagtcaatggaatgtaaacaattatactctctggaacggaaagtctttgtgaatttaaatatatgttctatagaattctaaaaaacaaatacttctttttaaattgtgggcaaagataaattgatatcaactaccatctgtagaaaatttctcataaaaacatcactgaataaaggaacaaaagcatgttattttatatatcaacctttcctgatgcgttatccactaaaatgacattttaaaagattcacagtgggtagcatatggaatactccataaacactgattagatttaataatgtttgtatcactgtttgggaacatgtactagaaatgcagcagccatatatcattagcatcaaaataactcaaaagaaaagctaattaaggcaagactgttttagaaactttgtaaaattgaagtcagaaataacaacctctccacctggccaggactttggacttgcttgttgtatgcatacaaaacagatttgattcttagagcttagaggtggcttctataaaaattacaatgggctgttatagtctcattttcagactgtccatactgcccaaaatcctcatcgtaatgaaagaaaggactattgctgaaggtgaggtttcagcctagtcctatcaaagaagagcaacactgttgtctgctgttctgttgagctacattcattgactgtctttgattgatgaattagcttttgctttgcaagtgcagatatattaagttgagcagtgcagtagcagagattcactcatgacctgccatggtatttgatgcatgcatgtccgggtaaaatatatatggttccattgtattttacaggagttactagttcgtcattaattggtcatttctaaggtgtttagacaacaaattaaaagtaagcaggatgaagaataggtagagatttttttgtttttgttttgggggttttggggagttgttaatttgtttggttttttggagagattaaaatatatttggcaaaatatgcccattataaataaaaggaaattatcatatatgtaatctttttaagtctgacatttctttaatacctacatgtcttgttaaataccatttttcgtgtgttttctttaacccatttaatcaagtctttctaattcatataaaaataaatgtatctttaaaaatcatttttcttctgttttgttgttagcttggggcatatgttttcttgttttatactgttacaaaaacatcaagctaaataatattttggagtctagtttaatcatgtactcttttcttagtaaaacacattaattagctctttgagtcataagttatcttattattttctcaagaaccatcactttgagtatcaaattcttattttaaaagtgtcattgttttctctagctctagcatctgtcattgctcctgtttagcttctgcatctcagtttcagtgtaatttagatcagatgttactttcattagcagaagtttcatagcacttcttagtaaatgcacacattttaacgattcattttctctttttctttttaatgctgatttttatttgtctttgaaacagtaatttataagcaagataaaatctacaatatataagatataaaaacaaaatgaaatggacaaatcagcacaatttttttcaatacttggcgcttgtttcttattgaatcttaaaactaacttatacataaggtattaataaaaatataatatgcctcttcctaaattcaagatactttttacaaatacaagaataagcttggttatgcgacatatacatctaattgtagtacttgagacaagatgatccctggctctttaatgagttcaaggccagcctaggctacatgagattctgtctcaaaaaaagagaaaaaaaagaaagaatgaaaaaaagaaaggaaggaaggaaggaaggaaggatctgtttataaagagaggataaatgaaaagctttaaatatgaaaaagacatataaaacattccatttgcttatgcaatatggtatcttttatgctcaggtttccatctttacggaatttatttagtatatttcacccacacaagaatcttaactttttcttttctctaccatctgctattcagttaatatgtgtttggattgttttatgcaaaagaactaacagcttaacattttggcactctttgctctcatgtcttgacaatgcctaggcatttgtagataaaagaaacatattcttttttgtatgtgtaagtgaaaaattgtttccccttacctgccctgctgaatgagaatgtattcaaaaatgagatggtggtagagggaggaggagagggagaggagaaagactctcagcctaaattggtgcttcttgcctatattccaagtagtcaggaagccaagacacgaggaccaacacaggctccaagccagcctcagctacatagtgatttccatgccagcctgtactgcagtgtgagaacatgtctcaaaaacaaaaacaaaacaaaaagaataggaagaatacaaagcatgtgaattttggtgttctccccttcccactgcaccaaacacaatagttttagttgcttaaaattcatctttatatctgaatgtacttagactagtcagataatactgtcacaattctaggtacagtgagatgcagcagatctctagaatattttaatttatagactgaagttctatgcctactgaacagcaacccctctcttcctcctccactcagcctctggaaataaccatgtctattaatttaactactttagatacttccaaaggaccactgctttacaaaggaatgaaaacctggaaggaaactcgaaagatcttccactaatgacaggctgagcagaatttttctgttgtagcaagaaggctcaactccatttctgttctcaggataattctgtagaatactcaaagaccttcttctagcatagttgcagagtgggtctacattgtggtgtccaaatctataccctgtaaatctgtttcttaatgcatagaaacacacacatgcacgtacacacgctcacacacacacacacacacacacacacacacacacacacacttcctgtgggaaccaaagcaaagtctgtgtatattgtcaatgtggtagaaactgaatttgaacttgcatgtaatcatgtgactatttttaagtattacttaaaatatctaaaccaaatcttgtctttctctgtttctatgtatttttaggttaaatatggtctttgcttattgtagaggaaaccatatcaaaatcagtccttccttaaatgtgaaatacaattattattaactagagttctttgttatttagcaactctttagaactgttgaaccttgtagaactgaaattgctgtaaagcctagggaaaggactgttttgtctttctatgattttgaccagttttgatacttaatatcagtgaaattatatatctgttctcctgtaactggcttgtttatttactataatattctcatcatccatctatgctgttacatatggcaagtaccttctttttcaaaaataatagcatttttcctatatttatttgtcaaatgccccacttggggcttgggatttgaaatgttgaattgtagataggtttctattcatgtccttcctattttactagtagcttcaaactcagatatgcaaatagccatctctcatccttcctcaactagaatgccaaccaggtaagtaagaaggaaaaggcaagtgtatacactgattggaatatgttccaatcatcagtgtgtactccaatgccttcatgcttttattgtctcacagacacctaggtggaggtgtgattactgcttcagtgaacataaaagagcaaatgccacctcaatgttcttccttttcctactttttttaaaagtccaagatctgtctttcagtaactcattgacaataaatacatatatgattcctaagatcacctatttttttaagatctcagaaatacttagagagaacaaacatattgatctgcagtcccaaacaacactaccgaagtaattttgttattgtttattttatttaaggaggaaattttcacagctacatttttatttctccagcaaaccaaaagaaacataacctttgagagtaataccttggcaattgaatagattcttctatgaacaaaaatcataaaaatgtcttcagaattaattaatttgacttcatattaagacatattaaattgatatcagaaaaatctaaaattcacaaatcactcagaaaacaattgacttttccatatatacatgtagatatacaggtgtaaatatacatatcttataagccttataaaacagagctttactgaagtatgttaggaatatgttacaagaaaataactttttagaaaagtaaattggaaatacaaataaaatttgcctagtgaaaactcaggcccctagttggaccagaataagttatttatatggaataaatttaggaaatcattctgaaatgtttgactgccatgaaagatattattagttaagctctttatatcttgaaatgtacttattgtcaactatacaaaaagttatactagctgaggaaggcatcaaagttagggcaaaggcctccttagatttgggaacaaaacacccatggaaggagttacagagacggagtttggagctgagatgaaaggatggaccatgtagagactgccatagccagggatccaccccataatcagcatccaaacgctgacaccattgcatacactagcaagattttattgaaaggacgcagatgtagctgtctcttgtgagactatgccggggcccagcaaacacagaagtggatgctcacagtcagctaatggatggatcatagggctcccaatggaggagctagagaaagtagccaaggagctaaagggatctgcaaccctataggtggaacaacattatgagctaaccagtaccccggagctcttgactctagctgcatatatatcaaaagatggcctagtcggccatcactggaaagagaggcccattggacttgcaaactttatatgccccagtacaggggaattccagggccaaaaagggggagtgggtgggcaggggagtgggggtgggtggatatgggggacttttggtatagcattggaaatgtaaatgagttaaatacctaataaaaaatggaaaaaaaaaaaaagttagggcaaagggtataattggatcacctataatttagataaagatatagcattatagattctgataaatgaacttaggttcccaaggcttaaggacctagaagttggaagtttaagggcaagggtgacaaacagcctatattgaaaacaaataagagttctcaataggccattattatcaaatatgaaattgtcctttagtgagtgtcattattatattttacaggagcatatctgtctttaaagaggcagaaggtcctcaaggctgtttgggctatcacctacttttaatctagaatggaatgattacatacattaagcaaccattttaattaaaacattctagtatttccaattgaacaaaatcagtgtacctactagaaatgtagttcagtgggtaatctgtttgactggcctgtaggaagccccaagtgaactacagtacaagtaatattaggtatgatggagtatacatcaaattccagcagttgggaagtagaaggtagaggattgagaaattcaaggtcgctttccaccagaactcagcctgggctacttgagtctctacattgtgtgtttgtgagtgtgtgtgtgtgtgtgtgtgtgtgtgtgtgtgtgtgtgcatgcgtgtgcgtgcgcatgcacgtgtgtgttgtatctatatcatatatttgcctccagaacattttgctctgtttatttctcttctgagtaaaacctttcaccgtactcaccttttctaaaatggctgtgtctgttttacctagatatttatgcagtctggtgtttttaagctagagtgaaccatacagaatttctatggtaatttctttgttttgtaactgaactgtgggcaatgagtcccacagattgatctgcccatgtcaaagggacaagggaaggatctagatctgtcacaattgttaaagctttacaatgcatattgatatatttttccacctgtttactttgatggtagttttagttatataaataaacaacaatggtgacttcaaacctgaatttgaaggtactagctagataaagcaatattatggaagtatttacaatttctaaacccaaaacatggcatttgacaaaaattataaggaaaagtactcataaaatcgggggatggaatataatgcctaagagtcaaagaatcatgttaaagggcacaataactcaaatagctatatgttcaatccatattatatcagaattacctaagtgtcatgagtataagaacatacagaaaccgacaaataaaaacaaggagtgatttttctatacttggtttcatgattcctaattaatttcaaaattataaatagttatgtttgagtctgtaacatttcttaaatttgaggctaacctggtctacagagtgagttccagaacagccagggctacacagagaaaccctgtctccaaacaaacaaacaaaagaacaactcttaaagtcatataaaatctggcccctactttcttcatgaaccgtttcatcttttccccttgttttataggtttagtattgtagacattattccttcttgtgttcctaacatgtttaatactcttccttcatttctctcaccctcttctggtgatccttcaactgacaattcatatttatctctcaccttaaattcctttcttaaagatattgtgaaccccactcctgtctctttcaaggttgagttttattctaaacaaatgtgcatttatttgacaacttacgacttttaatcactttctttgattttcaattttcaacataatttgtaattatgaaacaaaataaattgttttgtacaagaaagtaataccttttaaaattgataacattttttttcatcctctaaaagatgcttggtgcatgctaggcatttaatcaatctgtttgagtaatggtgtgaagaagtgactatggagtatctaactgaacagagatagattgtcatcaggtatggtggcatacagctttagtcccagcactctgttgtcataggcagggggaatccctgtgagttctagaccagcctgagctacaccgtgagaccctgtttcaaaacaaataaccaaaaaaagcaacgcaaaatagacctacaaacataagagtgtcttcaaaagaatgttgaaagaaacataaagacaaaatggagtgaataaacaatagagaaaaggaagaatacatagcaggcttctctttgtatagaagctgattctaaaacatttcttaagtactagatggttcggtctatctgtggaaaggtctggttattataaaatatttatatcagtatagttctataaaagcattctacatttttaaaagttggaacttgagctcaacatcattaatagacaatcttctgttattcaaatgccctctgccttcattttgcaataagagccttaaagaaaatgtattctatatctagagctatcatagaggattaccgtaaaccccaatgcagtccatattattcttattaatgtttcatatttttcgagatatattcactggcaatatatagtttttaaatgattttcagctagtttttacttaataatattttaatgttaatcctttgaaatacaaatttctgtatagatattattcaagttacatagaaaattcacaattttaacatttagagaacttttgatgttatgaaaatgagaaaatctgcctatttttcaatagtctacatttatgatatccttttatttaaatgggcaattataccatgttgctaactaaagattgtgtgaaggttaagtggatctcaagttgatttttccatgttctccaacaattgccagtaatgatatttaatttttcaagcttttattaaaattgtgagtaactaatgtactgcctataaagatgaaaattttaagaagtgatttgactcaattatctacatgatatataaactctgtcacccccagtgctctggtaatgttcattccatttacaataaaacaatttttctctagtaataactactctgtccatcaaacttaagtaaaatgagaaacatttttttctacttcatctgatgaagtagctctatatttctggttggagagcatccagggattggcaggtaggcataactacttttaaacataaaatatacatagaagtataaggaaaataatttttctgtccatatgggcactatggaggaaaaatagatttttcagatttcattttaaccctgtagtgtttattatactgtgaaggtatatcacacacacacacacacatacacatatatattcactgtttcaagaagttaatatgaaaatgctttgtggatttatgttgcatattttataagttaacttttagattcatgattgagacccatttagttttttagattaataatacaccaaaatggttagcatctcgactgttttcaaattctgcacacatttaaatccttcaaggaacacttctctgcagaagagctcagagagtttcagtgctcaccttacattccatgatgaataattcagaaggcgtatggggtttttgcttgtttgtttttgttgtttgtttgttctctttataccagaacttggaaaggtgactgctgaaaagaaaggtgttcggaatcagttttgaccctctcttacttgattactttatattttggatctgccccacctcactaccttataagtatatttaatgtgccatttaaaatgccatgaatcaactttgtatgccccagtacaggggaacgccagggccaaaaagggggagtgggtgggtaggggagtgggggtgggtgggtatgggggacttttggtatagcattggaaatgtaaatgagctaaatacctaataaaaaatggaaaaaaaaaataaaatgccatgaattaactccatcatagaaaagttcggtccttttcagggtacttctcttaatagtctagaatttctgaatggatgaaaatgaacagtctaacttttgagcgcaaaagaattaaaaccttacagaaccctactctttaatgttgttagagctatgctcacttttcagtggcatccaagccaatgaatctaggcattcaggaacaggagccccttggtgctatcactcttcattagtacctgagagatctatggtagactttgtagtttagctacacagtgtacccatcgccagccttccatctgttctctgaacagggccatctgctcctctttgggtgttctcaaaacccagcttagaacagactttctggcctagtcaaatccttcacaggattctacagcatattttctaaaatctgttatccttaatcttaaataataatatgtaagaggaacagtttatatctctactaatgaaatacgtttctgacgttctctaggcatatctgttaaggagatactttatattacaaataaattgaaactgacaaagttgctccagttggccttggggtctctgatccccctgccacaggctttgctattagctaggattatgtgagccacccatcacattcatcaaaaatgtatttttattatattttattcatttagtaaagagtgcacaacataatatgtgtggaagacatctgggaacgagttggaagcgtttgttctctcctcccaagtatctactggagcaatataaacattcagatccaatatgtaaccttaataaactcccaacaatcaaatttaacttttatttctaatatacaaaaatagctatcactcacatcagaagctattactatattctatactattctatactatactatattagaactatcttagcggaatttcattgcctttgagaaaaaaagttgttttgaaaaaaaattaatactagggaacataataggaattaagatagattgtaggtgtttagtgatatataactgtcaattgaggagagcataattatttgcactattaggttgttaccttctttgtggtagaaatgaaggatttagtcattattgtgtcactaacatgtactaaacaatagcttacataactgtgaaatcaacaactaaatttcataagtaatataaaatcatgattgtacagaaagagctgtatagtttctttcctctttctctttgtctattttggttttagttttggttttcgttctctggtttttttttttttaattgggtttattgttgttgtttttgttcttgagacatagattcaccgtgtagccatgactagcttggaattatcttgtagaccaggctggccctcaagagatctagcttcttcaagcatgtgccaccttgtctaacgtattcagttttgtcttattttcttgtttggtggtggtggtggtggtggtggtggtggtggcagctgctgctgctgctgcttttaatgtgaatcccatggaatttgtttttcctgcataggtttatttatggttgtttttatattttttaaattaggtattttcttcatttacatttcaaatgctatcccaaaagtcccccatactctcccacacacacactcccctcccccactcccacttcttggccctggtattcccctgtactggggcatataaagtttgcaataccaagaatcccatggaatttgatggcataattgagattgtaaactgtttcaaggctgaacactctctctctctctttctttctctctttctctctctctctctctctctctctctctctctctctctctctctttctctctctctctctctctcagaatcaaaactgtagaggtaaataaaagactcagactgggttgcttgctatttattgttacaaagataaactattcaccgacttatggatcttctcactttggaacacagaactttggaaatgagttttggcctgtaaaaacaaatttgtaaaattgtatatcactacacaaacatgtttttttttcctcaaaaaaagtatgttaggataaatgaggcatgtaagagctttgccttttttgttagctttgactttttcactggttttacagatgttatacatcctgaaatatatattttactaatttgcattgtaaatatattgcacataagagtgaccgttgcaaagtgcctctgcatagtatttctggtataagtctgtattttttttctttgtgaagagattaggaaacaaaactatcattttaattctgtgctgagaaataaagactagtgttatatttctgctccactgaaatgggatgtttaatatctgaacatagtcttaaaagtaaaaattatatggtgataaaaaccaaaatgtatatgaagcacgtgtattttatggaaaaaacagaaaagtgttcattctttcaggtctgttaatgtcaaaatagatttgagggttgaatgatttaatgacacttgttagcagaggtttaagtagcattaaaaagaccagagataaatgacagctcattttcaaaatcatggtatgcactataggtgtcagctacagagtaattttccacaaatggcctgatttctgcattgttttcattagaaaaacaaaagttgtgttccaattgaagatatatttagacccatgttatagttttgctttggtgatcactggtcctttgtaaggaacttaactctaatttttcaatgtaaattttgctttctactttcttcataattattcctgtaattttttctaaatcagtcttatgaagtagcatataagaattacctagccaaagagaacaaagcagaagcaagtactctaacttatacctcctgcttggatttgttgttgttgttgttgttgttgttgttttatttttcaagacagggtttctctgtatagtcctggctgtcctggaactcactttgtagaccaggctggcctcaaactcagaaatgtgcctgcctctgccttccaagtgctgggcgccaccacgcccggcatacctcgaaattttagccagctgctacatccactccagtagtggcccacacttaacaggcctagaaacctgaacatagtcccaaggcgactatgttgtggcatcctgtaataatgaatgctccaaatctgtccttgttttagtcggtgaacagatctttattatctttattattgttttattataagtgcctctaaggattgattttgacttatagctaagttagatttctcaccagtccttggcagtccatgagctgaccctggacatggatagcagagtcactgccctacacaggaatttacatttatttaggaaggaaggttgtggtctagggaggaactagagtagatacttagaactgtagatagctgagccactccatacacaggaatttacaatggcctagggagaaggtggattatacagtagactagaattggaaacagagcaaatgcatgaagcccttgcccttgtcttttaagattaagctgaccttaggtggggctgcttttgatcccaattgttaattgattttatcccagttgcttcctgttagcttttaaattcgcattcctctgtttttttgtagtaaaactaattttgcataagataacttcaatgtaccttgaatggcggtaatatatcacttagtttctttgtttcctataatataaaagactgatgctccctttgacaacattacattcagatacacactctctctgtgtccctatctgtttgtcacccccttttcaccaactccttgctctcctgtaactggaacccccaatttcttccagagattgagggaggccgatgggggctggtccatggcagccagcatatttatggttttatatttattagtcttaaatggttcatttttcaatttatcttcaattgttctataacagaatttggatttggtagagatatatagatggatagatagatggatagtagagaggtaagatagttagatggatacatacatacatacatacatacatacatacacacatagatacatagaatattacatgtagttttagttttagaccaatgcttggacttccatgcatgattacaagcatgagccatcacaactgctatttacatttcgtatgacatgacatatgacagaaatgaaaatgccaagggtggatcagtatatatttaatcttaggtttgatgaagaatgcatagttacagagaatcatgagtgagggaaaaaaaaggtgtaaaatgggaggaatttaacgagacatatttgtaaacttttgtataatgttctttagaggcaatgacatctttttcctacacatagagagtgtctctggattgaaggtcttaggacctgttcaaggtaactcaatgaattattttcctggatgctatagaggaaaaaaggcaaaaggaaggtcagagagacatttttcctcctgttttttcccttttaatattggctgcatatgttttgtatgtatttctgtatatatatatatatatatatatatatatatatatatatatatacacatatatatacatatatgtgtgtgtgtgtgtgtgtgtgtgtatacatgtaataaattcatgctatagcaaaagaggtacttttctgataataagcattttctaacaaacatattctatatggttgtacattaaatatttctaattgaaaaattttcaaactttgtaagcaatatgacagtaggaacttttgcaacaaattgtgtgaactgccttccattgttcatacttcacatattgaaagctggacagagcccggtgtggtggaacacacctttaatcccagcatttgggaggcagaggcaggcggatttctgagttcaaggccagcctggtctacagagtgagttccaggactgccaggccatacagagaaaccctgtctcggaaaaaaaaaaacaaaaaacaaaaaacaaacaaacaaacaaaaaaaaaaacagaaaaagaaaaagaaaaagaaagaaaaaaaaaagctggacagtcaactttctcagaattagaagaccttcaaaatggctatatttgaagaaaggttcttgaaggaggtaattcatataaaaattattaaagtatatcttaatagtatgtgacaattggccttcttagaaagggttgttcgaacacacaaggcaaaacctgtgaacaattatatgaggacacgacaagaaggcagcaatcggcaagccaaggaaagaggctgcataagaaactaattattcctatacctttcaatcaaaattcaagctcctgaatgtgtgaagaaactaagtttgtatcggtaaaacccagtgtgtggcactttataatggcagctctaacaagcaaatatacttacatatatagtggttttaataagtcttgctatctagtggctgtttctaaaatattattggatcgcattccttaatgcaaagttacagctttacccagaatgccagagaacagtatgacaaactgtccaccatgcacagcaatatgttgaagctctatgagagtctgggagaatacttcatttttgacccgaacacagtaaacatggaagaattttttggtgatctcaacaccttcagaaccctatttttggtgagtaacatagtttaaaacatggtgagttctgttgtttgtttctctctttttaaatttgtactgaaatctttatgtatctaataaatctactgatttcatggtatagatctttagctgcagcagaaaagtcagttaaaacataatttgtcatttgaggagtatttctgtcaccaacttatttgttaaatgggactctataatcagtgagattggccataaaatggttcaattggtgtaggacttagacaatttgggaggtgagaaaagtcttcaaggaactactttctactagttcttgagatacaaatcaaggtatatcctaacagttaaaccagcaactctagaaatagtacaaactactctaaactcttttaaataccataattgcctttcatctctttcatgagaataaatgctgaagttgctctttgacccttaatgaagttatatatttaattttcaggtcacttataattagtatgtgatttgctaacaataagagctcagaaaaattagtcaaaccattttcaaaatttaaaagttataagtctaatatggatacataaacacacaagcaacactcttatctgtggattaattttctacagttccggccaattatagatcttaataattaaatgaaaagtttcggaggtaaacaactcaaaagttttaaataacttttatttttataagacatggttaaaatttattacagtgttattgttaatcttttattgtggctaacttaactgacatgcagactggtgtgcaacatattggtagtcttgaacttggatttttcgtgaaacctctttgagaattaattgcctgtaacctataatgtgtaggtgaacagacagtaacatttttcactctctaaccattctttcagttatttattgagaatcctcttgatttgatgtgcagagccagaaataaagggaaggaagtaaattttccctattccaagaacacggacggtataagcattagaatttactgtgtctggtcacagtaacaggttaggatacagttataatacacacgagaacgtgcctaatattgtctacagtggccaaagaagccttcatgaggacgttgacatttgagcatagtctaggaaaaaaaataggagtttgacaagcagattttgataagcatgtttaagggttttatacctgacctataattcaaagacttataaatcaacatcactagcttcagtcaatcactaatgctcaccatgtttctggttcatggtgagcttaaagtgatttcactccctcaggagacagaagaatcctgaaagagagacaaaaattggaattgctagaatttcccattttcttagtgtttgtgtgtttggcctcagggttcttagcactaaaagcatattggactagagagggaagcaatcaaataccagtagtgctgagaagaaaataagagttctgattcatgtgctaccaaaaatgacttccaaatgagctcagagcttcatcttaggagatatatttggcaatgtatagcataaacaagatgcagaagcaaacaaaaaaaaatattcctcagaaagagctatcttctgaaagatagaaaattcagaaataaagaaaaagagctgacattacagattaagtccttttcaaaattatcacattcaaatgatggaaaaagaagttccgtagtatctatgggatagtgctctctctgttcattataaatatcatttatatagaaaactgtcactcagctactgagtatgttgaaggtgttcaagattatagataaatagttagatagatagatctccaaattcataatgtagactgtccttttagttcttttccctgagatgtcatctgtttttaaaatggcaaaaaggaaagattaattaacaacccctgaattcaaattgaatgttttatggaagaaactcagttccatatttatgcactgtctaaacatcttttttgtttatcctcctttatgcttcagtcactctactagttcaaatagttgactgcacaaatacttgttctttcttttgagatattttgaatagaatatgcaaaaccagtgagctttatatgtgtcaccgccatacaatatacaaattaatttcagctgttggaaaagtgtttgaggcaagcattttacttcaataactttcatagctccaaatgaattatagaaaatacttttctcttttaaacctgtcacattcctactgcttctgtctgtgtgtgtacttttttaataaacactatgttactcgggtactcaataaatatttgttttgtttatcctcattctatacctcatatactaaaaatataggaataaagctttgaaaagttgttaaatgcattggcataagttaaaaagatgttttcacaactattaatcattccagcagatttttctctcaacaaaacatgagcagtagtttgtttgataaataaaccttggagccagttttacatgatcattaaaattgtgaagtattaataggctaaatagcctcaggcaatcatggggtatgttcttgcacaataatgctacttctgaaatggttttgtcttagtcaattttttttctaaccttttgaacactattttactttggggtcccttctatctcagctgaactataatggttctattctttctacattaggaagacccaaatctggaaggtaaatgaaaaaacgacaacagtgggttcctaagagatgctagagctttggagaacaaagagaacctttggtaatccaggatcatgtataactgacaggctaaagtataattgttacgataccttagttgttcctatagggaattataacagccaaggccgaatgtatgtaattttcagatatagtcttccatctctgttaaaaatgattcttttaaagtttagacttgttctgagacatgctttcatgtattctagttggccttaattttatagtcgagactgaccttgaacttctgatcctcctgcctccatttccatagtactgtagaatgcatacaccacgatgccaggctccccattaattttacagaacataacaaaatatggaatgttatagggaagaacattaaaaagtctaagctcttcgttagagatctctgtgttaccatgttcatttatggagatacttaaaatttaatgcaatgcttttatcttttataattgaaaagacttatattttatgtgtataaatgcttggttatacaacacttgtttatctggtgccctcagaggcccaggactggagttacagaggtttatgatctacttggaggatctagcctgtgtccttaagcaaagcagccagtcgacatatacaccgagtcatttctccagccatagaaacacttacttttaagaagtcaccacctgtttcatgccatcatccctttgacaaggtcttcatcttctctgagtctaaactgcaactggaaatccaaaatgagcatcttcatttaggaatactcaaaagactaaattgataatattcaaaaatattcattcttcattataggcaatttgaatttaaagaggctaaggtgaacttttacattaaaaaaattgagtgtataattcctgatctaaagctctaacttgttttgactcatcttaaaaccttgatttcccaagttcttaaaggtgtcattggtgttgtatcattttaaaaagaacaacaataaaaatggtggacttaagttaagaaaccaagtatgttgtttaaccaagtagtcttaacaagtaataaaaaccattgcctagaatcttattacccccaagtctctactagatgcctaatatgtttatttctctttgctttgcaagtaaaatgctaattgataaagtaaaaatgaccttgagaaactgcaagatcctgatatgcctcttgaataattactttactttgtaagctataggtctctaagccctatctcttaggaattcagaggcaggttgccttagtaacaataatccaagctttccaaatagtctctctcccccaccttcaaactgaactcacactcctacagcctctatcccccagctggtacctctggaattaccacacatatgcatacatgctgacagcatgttatctatggttgccctttgatatttcctcacatgccagctaggacttacatcctagaatgagaataaaacattggaaacaaacaaaagtctcgaattctcccaacttgttttgtattgttccagttctcaactacacaaggttgggaggagggtgatggtagtggtagtagtgcttgttgttgttgttttattttgttttgttttactaataaagctgtttggagttgcctaccatgaaaatgcatacatgtagacttaaggtccgagggtgcagtctgtattggaccagttcttgccattaactcgtaactgtataaatagttgtgattcataggacacttcacaaaaacagttcctttcccttctttcccgatccccttctccttagaggctttaaagaatgtcttagccagggtgtggtggcacacacctgtaatcccagcagcactcaggaggcagaggcaggtggatttctgagttcgaggccagcctggtctacaaagtgatttccaggacagccagggctatacagagaaaccctgtcccaaggggggaaaaaaaaagaatgtcttaagtcctaaatccctgaagaactatctaataccataaaccctttcactgtcctccttcctcacttttgttcagtcacctaagcttatagcttttttttttccctaggagccaggaacaaataaaatgccagcataaatcctgccatgcacatagagccctaagggcctaccaactccctctagttaatcacatacacccagataattccctttgcgctcagctgggaccaccctagctacatagccttcggatgattttgatctattgcaactctttgaaaataggagatccatgtaaaatatatggtaactctattaagcagaatatttaaccagaattcctcattccccagtcatgtcagaaagactatagtgttttatataagttatcactggcttctccctttacaggaagatgtcaactatcaactgttgtattctgtttgactcttcactttgggctagaaatggatgtcctatttttttttctgatatgattgttccttgtatagaaaaactaaccattttgtcataaataactaaaggatatgtaataaaagtatacatagtttaaaaagttctccaatatcataaagctgtctactggttggaaaggttcctaaatatatgtatatacttttcattaatattatttagaagtgtcataaatatttctaaaaaactgtcagaattgtatttgacaagcgaaattttaccctttaaacaccaaaagccatagtttcattaaatgtaaaaatattagcaaaatcaatttaatgttttcttttcctattaaagtctaataagtattagaagccctatacaaaatgcagtatctttagtttgggcaacatgtcatgtagaaattttcatagaagtgttccagtataaataagttattttttagttatgtccaagaagtaagagagttataagttatgtaatacaagatgtaagttgacctttcttaggagtcctgagactggacaaagataccttaaggccttttggaggtatctgtcaaaatatgccttctataacctgaagcagaaaatccttgaccttcatacaagccatgctacctctcaacttgctcaggttttttattattattcattctgcttcatctttgtttattcactaatcaatctttaatcagaaaagcctccctagccactgtataagccagttcaaagccatcctgcttagaatcaaacccactgagcaatttttatcttcctcatttccttttcccctgcctcctacctcctccagttgctgatcaagttgttcaaatcacttcctccaaacagatttccctgacactcatcaatctgtctagccctagtgtgtagtcttataatttcccttgtatgggtcaagtacattgctaataactaaggatatttacggatgaggtaatgaattaagaaaacaatgaatgaacgcaaactgtcaaagataagttgaaaatgcttgccctccagaactccattccagtgagtgggaagaaatagtgaacttggatgcatgcataggaaaaccatgttagcacagaagggagatgtgttcgttctttgggatataaggaaggctctgagcaggaggcatatacaaagagaatatggtcagttgttgctcctttatgaccaaagatgttcttcttttgttctcctcagcctccttttgatgttgaagtttagtggtaaatatatattatttcctagagctccatgctgagttcaaagtggaaaaacaacaattttattaccagagaagtagttatcagctaattattatgatctagaggttttccaccatatgcttagatgagcagtaaccaagcttcaattaattcttacagactggcagctgtactgaacaatagagcaattgaggcagattatctagcaaaaacattcccaagagtctgatttgtatggtattaatttaggtcagtggatctcatccaagagtgattttctcttccaaggaacatttggcaagatctagatagttttttggttctcacaactaaggagtaggtactaatggcatctggtgattaaagccactgcatgacaaacaccaataatatgcataatggttgccctcaacaaagaaatattcctatggctgagtcagaaaacaaaataacaaaatcaataaacaaacaaacaaaagagaaaacaaaaaaactgcttcagggttatctgataaggattattattttatttatttattattcagaaaatccaaattcacaggcaaaatctgtactagataaattcaggtcttttgtacaagatgctttaggtattagtatcattcaaaatatcctggctccagttttttttttttaaacacttttactatcagcttcgcatgcaatggaaagaaaataataacataattatgacatagagataaaatcaaaagaaacttggtgtttcattccaaaatataattactattaataccttgccatatatcttttcggcatgcatatatgcctgaagtgtgagtttgtcctaaaataaacagaatgaattataaaaacttaaattccaaacaaaatttaacttgtaaaaattactatacctgtgtggaaatatccatcagaattcagtggatgttgccattggtgacatcttcagttgaggtaaaaaatgttaattagctcatttgataatatctttttaccaacacctgctgataatcagggccattgtaagccacgtgtaaatggactactggaatcctgctttctctttttgttttctacacaatacaaccatcatacttcctaaagacaaggacccttaaatcaataattggtgcctggctacctgggcctattcagactagcatttactcagcactctgttatcaatacctgctgtgcccgttgatttaaaactattactaaggacagtgtctgtctgtttataaatgaaaactataatataaaaacttgtaattacaaaatgccttcctaacaaaagtaatgctgtgatttaaaatgagaacgagtgtcctgaaaatatctatatgactatatctatatttttctcttgtttcccccaatattcttcttgattcaaattccaacaggattcttagactttttattgctttaaatgtttgaaccatattatatcttaataatgaaataactactatttgtattgacatatgtcctttgatttgcttttcacaagaactcttttatgacattcagacttctctagtattcttgatgaggctgtaggggggaactaaggaatggatggcattccacaaaagcttgaaaagagccagccagccatttcagtgtttgcattaaaatggaagttgttggaatcttttctgtgaggaagcttcctccttcttgttctgcctgagggaggactcaatctgatgggactgaatttgacttttcaagttcaacatgtagtgcacaaatgacctaaacttactgacactagggtgagtataatttgaaatggtatgtttatttcccctccattgcctatatatcatataaattggagatgtataaaaactacaatattatgtaaatgtggatgtaactataaacataattgcagtcgtgagcaatgtgaatccctagatagaacaaattgatgcccccaacaatcgtgaaactttaatttgaatgttcattacctttagtgttctaaatcattctcattgattatataacggctaccagaaaatatttggacagatacttactcttgagtttaaaatacaagacttataaataaaactttaagatgaattctttttaatatatattacccatttgggtgttttttgatactatattttgacttttgaacatactatcatgtttggtgttttagctttttttcataacatttccggatgctttgggcagccaaatgagaacaaaatgataaaaatttttaaaaaatgataaaaattttaaaaaaatgataagaattggctgaagaatatagttttgctatgttatatcactagaaatatagaaggaaggcagatgattaggtagttcgttgatatctataaaccaagatttttcaaaaaagtctgttttgtcactgtgggaagtttgagccacatttacaaagtagttatccacttaatccaagcatcacatggacataccctaatattttataacaggatgttatacactgtgaagacttttttctctctaaattgggtgagaaattcttctagaagcttctatgaaggtttttcaaattgctgttgagaattattataagttttgaatttccaaaatataagtaagtggtagaaatgagtgtattatattgtaaaacaaacaaacaaacaaacaaacaaacaaataaaaacccacattactgcttgtttaaatcgggaaagaagtcatgttggcaaatatgccaatagaaagcatcagaaatttgcattcccattacccctccctattcatcttcaagagaaggtatttctgttttattaacttgcttgttcgctttttctcattcacttaagtattgttattgtgctctaacttgtaaagacacttgtctggacccaaatattgcagatttaattttctttagtatattaaagtaaaacaataacaacaacaacaataacaaaaacaaaaaacaaaaagccctgttctcatggagtgtgatttaatatgccaaacagaatgcccagctaataatagatgaacaatttctgcatcagttagttacatagtcccattgtataatcagcagtttaaatgaagattttaattttcatgttataaattttcccttaaatgcagttatcactaggtatccctgtttaggagactttattcattacaattagataactttcctaaacactctatagcattgggtatgtatcctatgtggcatagatatacttatgaagcctatcaactgagaaaaggagtccttcaaagagttctgtcctttgggttaagtaactctaattttctgacatgtagatgatacgtaaatcataacttaacctacttacttggtacagtgtctgcttttagacaagggctaaggttaacaatggaggaaaaacatgagaatacacctatacttttcctaatgccatttccaaacctattgctttcatcaattacatatttaacccttttctttcttatagaaaacaaaacaaaaacagtgatttgctagtacaagtagtaagttaaaaacactgtttcattctctgcatatgtgtcttcatcaaggtagcacgggtttagaaggttagatattaacatctccgaatggatttctaaacaagaaactgacaaaaagtgagatgtattgcaaagcatgtactggtgtaaaagcatattttagtgccaaaaggatgaaaaattataagtaacttacaaagacattcctttcccctggtctctgttcgctgttagtgagttgataggtaaactattgcagtaggaaggtgtcactcattctgcattacatccatgccctttaaattcaggacagtgctttaatccagtagaacaattctgtcaagaacttttagcactacagccagctactaccacaagaaatacttgaagcagcctctcttgtacttttgaaagaacaccttatacatggttgccttgtctttctcggtctagaattctctttccaaaaatgattaacctctcgtggtctggcaattcagctttctgatcttcccttttcaagttgacatccttcttggaatggcctccattttaatatagatcagaaactgggaaatgaagatccttagagaaattttggctcctctgtttttataaataaatttgaagtggtgcacagctatgctcatttccttgtattttgtccatgtctaccctcccagtagaaaggcagggctgtagagttgagacaaaacctgcctgataaacaaagctaaaattagtaagtacccctctaattccatttaaaagtatgtaagagttggagtgagctcgtgctagagtgtaaggaacagtgaaaaaaataagttaaaaacctaaaagtaagggcgcaaggagaaattctcatgaggagttcatagaaaccctgtagtatcttgagttttacctttcaagtacagtccctctcaagaatggggatcacttttaaggagatgggtacttccaattatcttgccagagaaaagatcagtctatctattgagtttgcatttgtttcaggtgatttttattttatatagtgccccttaagcagaaatgttgcatatgtgttgcatggtaaaagaatggctatagatttgacccagggcttaccatgtgagactacagtcttgctcatcctatagttctcataccatatattcttccatagagagaaaagatacttgcagcctttagcataacgggtacacagtaaatggtgcatactctattttgccccaattttgcattatagcatagtatacatatattgttaaccaccagaacaatcagtttccacaatgaatataatgcttcttagtcttgactttgagtagaaatatttcccctggagatagagagaggtgattaggtatgacatgataaagatacattttgataagatgatgataatatcaccacatgtaagggagactgtactctccattcttcaatcttaaatatgtcttactatgggtgtaataatattaacatttttaatgaaatactgcgtaatgtttccaggtagcacatgcccctctgatttctatgtgtttctcgtcacaatgttattcttcaattctagactcaaatttattttctgcctgataccttaagctagaatcactacaactaccacacactcagtatattacaaatgtaattttttacagcttttcctaattacttcctttaatatctttggtgaagactcaacctggtatgttatttttcctcactattgacatctcttcagtctccagtatgtattgtttatgttttaaaatatttctcaaatctatcctatatttatgctcattttaagtaccttagtttcagtattcctcatttctcccatggatttctgcaatattttttaatgtgtcctgagtttactgttaacactctccaaactgacttcatgctgctttaagatagtgtctccaaagatgtcgatatatgtaagatacttgttttttcaaaaaatttccgtgcctgcccatacatagataaagcctagagtagcatttagaagcctttagaaatctaaagttgcccaagcagtgttctgggtatagagtggcatctgttctatttgctatttctgtggtagaggctgtgatcatctgtccaggggtggtactacctacactgggcaggaccctctcccatcaattatttatccagaaaatgcctaccagcatacctacaggccagtttgatggaagtagttcctcaattgtgtgtgtgtgtgttttttttattttgcgcaggtattttagttttatatcaacttgacaaaaactaaccagcacatcattgttcttaccaacctttcttccacctggggaggggaaacattgttcttcaagattctattcaatggctactttcactgtcatgtctttcttactacctttgtgaaactttgttcttcaagattcaatggctactttcactgtcatgtctttcttactacctttgtgaaactttgtgcaacagggagaattaatttcccactgttttgtgtgttgatatttccttatgaatatagcagtcctaaaagcctacacataattattggtaggatatggactttgtgtgtgtgtgttgtgacagagtctccctctatagcccaggctatcctggaacccactctatttgtatcctagggagaccttcaactcatggtaatctccttcctgagcttgccaagtgctgagattagaggagagaaccatcaaactctgcctatccttctttatcatttgagctccacatctttctggtgctatacctctttcccttctctaagacacttcaaaggaaacaaccacaccccttatctctacttcacttaaaaggagtggaatgataataaggtaaacatgataaaaatctagttattttttattacttaattataaaaagttccaattttaccttcagcatgctttaatataaacacaaaatggagaaagtaacactgatatatcattgtacgagaatatccaggatattttgttcagaagttcacattgaaagaagtcaagtctaaaatatgacatttattattgcaaaattttgtacaggatataaaaaccagtgtgtctgtaaactccctaaatcctcatgcaagttatttgtccaatatgtcaagcctaatggtgaaaatccctctctaccaataaataaggcaacttaaaaagtagattcatagtgaggccagaaaattcccctataaataatgatatattaccttgggagaaggaaggtaaaggagaggacattagatcattagcataataagcaaaagatagtccaatcactaagtaagcaatgttcttcagccagacctaagtcatgatcaaagacaaaatcataagtgagatgtgttgtggaatgtagctacagtttgcacatacatatggaatggcttgcttcccagaatgcaatcactagtatatatatcagtacccttattatttctactttgagagagatgattttgaaacaaactgtttcttgttctgacctgtttcccattcaaaatcattttgaaaatgatctatagtgtattgtttgcagatatttttatgagtgatagattagttcccaagatgtcaaaaggagacaagaaattgtaaattcactttacttatttttttctattttattaagtggtgaatgagacatatataccaatggaaacaaaatattgtagactagaaatagaaagattctctaagggtttatcttataacttggtgtagcatgctttctatacctctttacaattaaccagctaatcttcttaatcattttcagtagaaagcactttcttgacttggttctgttgctttacaatctgtacagtagtgttgtttttaaagtctcttcttaaaatacaactgcagagcatagtgctctgagttctgaaagcactctaataaacttaccatttaattaagtagccatgtcatgtccatggataaagttctgttccttgaaccagttgtccttgagattacccatcttcttttgaggtttgtcacttccaaactttgacatcttttttttaattctaccttcagatttattttcatatttgtatatgttccttccatagtgagaccatagtctaaatatgaatatgcctctgcacaggaaattattcagcctatgatttaaactcataaaaaatggccaaactaccaataagtaaaccaatgtaagaataatgtttgtaaattatgtcctatactagtatttacactgaattcattttctggtttttattaattaagaaagagttatttcgggctggtgagatggctcagtgggtaagagcacctgactgctcttccaaaggtccagagttcaaatcccagcaaccacatggtggctcacaaccatctgtaacaagatctgactccctcttctggtgtgtctgaagacagctacagtgtacttacatataataaataaatattttaaaaaaattaaataaaaaaaaagaaagagttatttcatggcataagtgttctgtgcacttatgaagtctgcttatatgagtcaagtgtgttgactcatgcctataatgccagcactccgaaagctgaaataggagggtttctatgagtttaatgcaaacctaggctatatactgagcccagcctgagccagagtataagaccatgactcaaaaatacatgaataagtatataagtaagtgatgtccatcaaaaaagaatatcacacttgcagtggactgaactaaccatgagcctatcctcccagaatctgcagaagtcagcaacactgaagtaaacatgcatataagaaatatattgacagacatttaaattcatgtgaaatatgtaacctgtatttcaacattatatataagaaaagattagttcatttttttagtggtcattagtgaaacagcccctgcagtctctggtttaagaaaggactgaagttataagtattcctgtttccttctgtcttatttaggttttattgctgtgaagagacatcgtggccacagcaactcttataaggaaaaacatttaattggggatagcttgcagtttcaaaggtttagtcgattatcatcatggtggggagcatggcagcctgtaggcagacatggagctagagaaggagatgatagttctacatcttcattctcagggagaaggatactgtgtatttcactgagtgtaacttgagcagagtatctccaagccagcccacacagtgacatatttccccaacaaagccacatctactccaacaagaccacatttcctaatagtgctacttcatatgggcctatgggggccaattacattcaaagtaccacatttcatttcctggcccccatagccttgtaactatataataatgcaaaatgcatttatatcaatttcaaaatacttatagtctataaaagtttcaaactcgttgaaattccaaagttcaaagtctcttctatgactcatgcgatatcttaattgtaatgttctataaaataaaaatcaagaagcatatagcatatttccaacaaataatggtatggggtatacattactgtttcaaaattgtggaaatggagcatagtaaggaaatactgaactagagcaaaacaaaaaaccagctggacaaactccaactgtatctctatgcatgtcaaatgtcaaaatgttcttcggatctccaacccatttcagctctgttgactgtaacacacttctttaccttgtgctgtttcttctccctgttatcagctttccatgctgatacagatactttttttttctagaaagtatcccatggtcctggcatttctaacctcttggggtctggaagtcaattcaagcttcacctttccatgcttcacacaatggcctctctgaatctccatgcagggatatccctgccacattcctggcttaaacaatttttcttagtcacagtgagagattccatagccccccctctttttttctatccctgtccctaaaacaagaaccatgtagccaaagatgctaagttatgctgcttgtcagggctgtaacatggccccctttttcaattacatcttcaccagctttctgttttcaatcatttccttcattgactaagctttgctgctgtcccggatctcactctatagactaggctgaccatgaactcagggatctgtgtgcttctatctcctgagtgctgggattgaaatcatgtaccaccatacctgaatctaaactactctttaatttcttttttcacaggatggaagtttagcttagctgggtagaatcttgccctgatgataccactccctgtagtcaatttaacacctttaatctatttatcttctcaaacatgggacttagctccattccacttcctgctgccccttttctccttgaaccttacattttgtatttttctttgctcagcttgctccttttcatcaaaatgttctccataatagttaacattaatagctacacaatagaatctatagtagggtggtttgagatttcctttgccaatgtaattaaaatacttcactatagacttgggtaagtaaacaagggcaaaaagttgccacattatttgccaacgtatcacaagaatagtctctaggccacaaacaaacattcttctctgaaacctctagagccaggcccccatatatcaagtcaccctcagcaacttgtcttcccgctcctactagtatggccaattaagccttgcttaaagcattctactacttgcttaattcaaagtccccaaatacacatcatttcaaaacaacaacaacaaacaaataaaaacatgccccagcctatcacagcaatacctcagtccctggtaccaaattctgtcttagtttgggttttattgctatgaagagacaccatgaccaaagcaactcttataaaggaaaacattaaattgagactggcttatagtttcagagtccattatcatcatgtcagggagcatggtagcatgcagacagaaatagtgctggagaaggagctaagagttctacatcttgattcataggcaacaggatactgtatgtcactctttatctctgctcataggagacttccaagccagcctgaaaattaacatacttcctccaacaaggctacacccacttccacaatgctacttcctatggggctacaggggccattttcattcaaactgtttcattcaaactgccataccttctggttttttttttttttttcctgagacagggtgcctctgtgtagtcctggccatcctggaactcactctgtagaccaggctggcctcaaactcagaaattcgtctgcctctgcctcccaagtgctgggattaaaggcatgcaccaccatgcccggctggaatttcatttttttaaacaacaatctaactggtactggcttgttttatggaccactgtgatccataagtatcaccatactttcccatgcttcatcaggactctgtttttaaattttctgttgcttggtttccattcattatctgttagtggtgtgtgtgtgtgtgtgtgtgtgtgtgtgtgtgtgtgtgtgtgtgtgaaaatcagacacatcaataaagggaaaggtacaacccgataattacttgaaggacatcttgctgtcaataatttggaagatagcacaacaaatcagcaaacaatcactttgtacttagaaaagcacggagttgtgactggtaatcaagatagctttgtgaaaagaaaattgagctcaaccattttaatttacttctatggaagaatcagttccctatattccaagagagagaaatatctgctaattccctaagatttgtattccttcctgagtgacattcattatcaataatgattaaagagaagtaaactgtaaatttcaggataccagtacatctgacattaaggcagtaccccacctgagtctaggagatagagccacagaaaattaacatttctaggacttctttctgtcacaacacagtgccgtgagtgactaagtttcatgggtgattctttttgttgattatccagggactaaaactctctgtgataaacataataaagaatgtatgtatgtatgtatgtatgtatgtatgtatgtctatttcctacataccattgaaggcaaaaatacctagatagtaaccagagtatttgtgtcttatcttccttgccccttctaccttttcctgtctttcctatcacccaaaggagagataaatgattgtatatatctagagagatttcaaacatttcattcaaaataagataagattggagaaaaagcttttattagatatatatgttgaatcaaaatagaatcaaataaagttagatagatttaaaatatgaataaaaacatcaaaccaataatatagaaacaaggcaaagcacaaatatatcataaaataaatactcttaaagtttagtgaaacagtatttatcatgcattaggcattgagtgaagtgtgatgatttttttttaaagaacacaccacaaatgtatatagtcaaatgagcctaacttttttattatcattattaaaagataatgcccttattagcagaggatggctttgtcatgtatcaatgggaagagaggcccttggtcctgtgaagaatctatgccccagtatagaggaatgccaggatgggaaagtaggagtggttgggtgggggagcaccctcatagaagcaggaggaggggcgatgggacaggggggttctggaagggaaactgggaaaggagataacatttgaaatgtaaataaataaagtatccaataaaaaaagataatccccttgtcatagaattttgaagaaatcctgttttagaattctccaagtgttctatggtatgcgttttagatctattcaggtgcacttaatctttgaaatttaggttgctgtcatttcaggaaatagccaaaaatgatattaaaccaagttttatagtaaaatagatgatggaactgggtaacaaaatttctgcttaaaaataatgtgaatctgaaataatgaaactgatttcagtaaaatcagagttcagttcagaatgagaaatttcaaacacagattaatgcccttaccaaaataagtttatggcttcccaaggtggttgtttaaaaagatgattgatggtttcaacagacatattggaagcgatcttttacctttgcagttgcactttaaaatagtagaaaacagatactttattttagaagaatttgagcatcaaaaactggtagaaatgaaatgtcatacctcttaaagtatcgttgcaatctttgttttcttattttcagggaaggcatagcaggatagagaaacctataattgaaaaataatgtccaacaggtagaaaagacccaggaggatactcaagtgttattaaactaatggaaaaagatatctatgaggaactttttattctagaaactgatactgaactgtgtagctgctgcattcaaagaatctgagacaggaggattgagtctgtgagagagataaagacacagagacagaggcaaagagagacagagagagacaaagagacagagacagagagacagagaccacacaggttttttttttcccccaaaggctgcaaagacccactcctccttatccatcaatctataactgaaaagaaaatcctgtattgcatttgagggttaacttttgtgaaacttgggcactccagtgagtcctgaagacaagtcacaccactaggaaaatattttaaaggaagattttgactcttttcttttaaacagaggtcgataaacaagacacgggcttacaaactgacagcttttgctgagacataaggaaggttttgtttggttggttggtttttgggtttttttttccaatttacaagtagtacagtatcaaaataggttcctagggtaagtcatggaactctctatacagttagagaactcaggctcatgtttcgtgaagactgtccctactcatcaagtctaaatcttacttgtcaaggtaatttgatatatttatccaagtcttaacatgcttctcactatacctcaattgatcacattagaaccttactgagatgccagagctgttgcgcaatagttcataagttttgtttttttttttttttttgagtcatgcatttaatcctcagcattgaaaagcaaaacaagaaaaccttattgattgcactgcctcttctagcttcgtagagatactattatagcaataaacacaggctttagaacaaaaacttaacactgctttattttcctccacttcgactttcctgagatgtttttctattaaaacattgtatcagtcacttaagaatttcattttcttcctttagctcaaaaaagttatagattagttttctatagtcactcaaagcggttcatagattttaatcaaatagtggtccatagagacatgttgaactcaatttgtttttctttcccagatgcaaagatggatgctcacatttctataacaaaaatgtctgctgaaacctccagcatttgaaaagcttttctatgctacagattgcagattaacttctagctaatcatagttcagaactctaatggactgtgacgagagagacagtttttcctccaacttcatatcacatgtttctgcagttgtaaggcaaattttaaaagaaggccttggggatcacagccagccatcattattggcgcatgaccgcttgtaaccaactgcaagtttaatatccaaggagatttgcacataacagtcttttttcttcttgtttttaataatttacctttgagattctcttcacgaccatgctggtgtgcaaagatctgtttgtctgtcaaacctccagatatgtactgcaagcgaaatacacattaattttttatttgtttcctagggagtatgagcagtgagctggttgtgcagaataaaagagggcttcttcgctgagcacttacttgtattcacttcagcttccttcctcacctgtagcaaattagtttcctccatgattctatcccctgccagaagggaatcatttacaaaaatcaattcacagaactttttatataaaccatccacccaaatctgaaaacattttgtcttaaaacaaaggatactgaaaagctgtatgtgtggtactaatgcttgaggaacctgtaagtgtctcctggcaagcaaagacctcacttttaaaatcagcatgcttcttttcacttaaccttgaaggctatctgtaagtgctaatctatgtccaaagcaattttctggacaggaacttgagctacaactacatgacaagtcacaaattgaagcctcagaaatactaagcattggcatttctaaggaaactgatataaatgtcaatgacccaaagccaatagatgattagaaatcaagccaccgttccaaagtaccttagtggtttttaagaggctgccatgatttttcacaataaagaaatatgaggcatatgaggaaccatgtgtggaggtattctttgtaatttaatgttttgagaacttccaggctgaaatcggttattatggaaatcaaccatctccagctgctaattttcagaaactgaagagtatagaaatttaaagtagattttgaccctttatttatgttctggatttgacattaggaaagagggagacacaaacagtttaggggtttctgttgtataatttggtgaggtagaaagtagtgagaggggagacattaacagagagactggatgggctggagagatggcttggcagttaagaacactgacctgatcttccagaggaagttcaattcccagcaaccacatagtggctcataaccatctgtaatgggatctgataccctcttctggtgtctcaagatagctacaggacactcatatgagagagagagagagagagagagagagagagagagagagagagagagagagagagactggatggaggtatgtgagagcctagaggtaatataggtgtgaaagttcaaggtaagctatagagctaatgagactggttgtcaatggacaaatagtagacaaagtcaaagaatttatacagggtaatagtatataagccttgtagactattggaagcatactgaatagtatagtaagtaataaatggattttctgccagacaaacaaatgcagcagagtttcagttgaagggggaaaatgtgggagaggaaattacagtccagaaagaaaatgggcaaagaccaacattttctgtagaaagcaaggaatataggaatcaaagagaaaggttctatttggtttctgccttatgtgtggcacaagatacatctgtgattcataccatatttgcataggttaaagagcaagactctaagcactatctagctatgctatcagtatatttgttcagtgtctgttactgagtcacctaagtacttgaggaagctaatcaaggtttcaattacgcctgtaagtaagaaagttatacctctgttgcaattgtagctgattggttgatgaagtattcatgagatatttcataagaggaactttaaaggtcacttgtaccataataagtggaaatctcacggaaagaaaaagtttagcagtattatagtgcttatgaagtcttaagaggctctgattctccaagactggttgctgctgttgaaaactcattgcccccagcatttgtcatgacttcttcaatctaatatgctctttatgcacatcgaaactatagaaaaagactatctaatgttgtttgatattaattaaagaataggatttctttctttccttaatgtaaagctttaatttgacctggatctctgctgaaaattctaataaatgacttcagtggtttcctcaccccagtctcctgcagtcatatgattcttcaggttttttttttcaaccaaaagctgagaaggtcacattaacattctcatttggaaagtggtgttatctaaaatggtagaggaaaacctggacaaatgtggatcttgctttactacctcctcaaatattgaggattttcacccacatgtatcaaactaacaaattacacagccaagttaatttgcacattatattgtgatatgacacactgagatgtgtatcttcacaactgtttaatatagatttcctggaaatttttccatagacaattacagaagtcccactagcagccaggacagttgaagctaaactgaaagtagagtaaaatggtaggtaggagaattttttaaacagaataaagaggacatttccagacaaaattaactaaatgggcaagagaagccctatacattgttggtaccatgccatagattgaccatgtagtctgatactctgacttcttctgtaaatctttagttataccaagtgaatcacttattctgagataaatagaagtaaatggtgcaaactccctacttgcagtttctgcattagagattatctgctgtaccatgaaactactctggtgagttcagagggctacactaattaatatatgattataaaggtacaaatttagtgagagtttgatactgcagtcttgtgaactccccaacaatgaattcttggatagatttacagtaccagacatcatgcatttcctcttgtaatgtaagccttacagccaatcataaaatggttggttacccccataccatatgccattattgcaccaaaagtttaacttgatgttctagtcattattgtcctttacagagtaagactgttagttttttcccccagctgccgacgatgcagtactatgaaagctatgcagcaggaaagaatagtcctagtcagtaccaacttgattcctccatattctgtggccaatatatgtgctgccttcagcaataggattttaccctcacattactgtgagcaaccaagaacaatttcaatagcctgtactatttaggaagtctccaagacttccaacaacccaaggataggtatcccagctttttatttattaactatggcttttgggaggagtagaagattctatgttttatagatagatagatagatagatagatagagttatagtggtacaaattcagtgatactttgatactatgggtcatgtgaactccacaaacatggaatattagttgaattcacagaaacagacatccttcattttacccggtggactaggctttacagccaatcataaagtggttggttacctcattataaatagatagacagatagatagatagatagatagatagatagatagatagatagatatagacagtcagatagatagatagatagatagatagatagatagaatatagctttctatatggcttttaaatttttttgctttaatagtttttcttaaatctttatgtaataactagaaaattgttgcatttgcatgagctatgtatttgtatatgccatctttacttattaggactccactggtcattatgatcagtaagggagttaagatgattcattcattttcagcaaagcaatatagattttattgacaggtataaatttaagttggtgactatttcatagtaaattttagacatagtatctattatattttctcctttcattctttatactgattcttaaaagacagttgcactaataaaacgaagatctctttctgtgaacatatttcttaccttgtaggaagttactataaaaacattttttaattagcatccttaaacaaagcatgttcctaatttcctcctcctgtttttgctcatttttttttttttggttttgtaataatgaaggtgataaggacgcatccctctgtagagttttctcccttattatcagctcctgcgtttttagaagttaaacagatcttgaaatttcttacttttcactctactgtaattaaaggcaattgatatgaaaccattgttatgaggattgatggacttaatagttaattctcttgaatattttgctacatattcatttaagcctccatttcatccagaaatgtaatctatttgcatagctgccaaattgcatttttaagagtccccgatattagtgattacctaattgtctaccatcttcaattatataagttatgttttatatgaattcattgttttgaattgtattcattataaaatatatattttagagaaatatgtgaggaatgttgcagaagtaccatgattcaaagcattaaaaaacatacggcccatctctatcagcatttatcttatctcaaaacagttcagatttgggcatattaatatagtaatttctatatacttcattaaatagactagtaaatcaaaagattcatagaaaaattagcaaaggcttgagaaaaggactgacagatttatctaatgaaaatgtaagatgtaggccaggcattgtgccacatgcctgtaatcctgacactttgggagctgaatcctgaggatcataggatcaaacttagtataggctatacagtgaattctagcctgagcaatatatcaaaacttttgtcaaaaataaagagaagaaaaataagaaatacacacacacacacacacacacacacacacacacacacttatatatatacccataagatacaagctatccagtgaaacttgaattttagataaataataacttagtatcagggtgtgctggggattgtatctttcctttggtaaaaatatgtcccaaatattgtacagaatatacatagatttataaagttatttgaaatatagccaagtattctgtaattttcttttttttctttttttctttcttttgttttgttttgttttgttttgtttttttagagacaaggtttctctgtctgactgtcctagaactcactttgtagaccaggctggcctcgaactcagaaatccgcctgcctctgcctcccgagtgctgggattgaaggcgtgcgccatcaccacccggctataattttcttaagtttctcttgggtatagtgtacatcaacatagttgaggatgccaagcaactataagtggttctagtagttaagcatttgtgtggctttgaacatggcacccttattagtgtgagctaaagcttcatgttttgtaaatgaggttgaataacccttaaatgagctcttctatttatagagatgagatactatgtcttgaaaacatctggcacaaagtatattgcaattattatgagagtaagcctatctatatatacacatatatgtgtgtatatatgcacatgtttatatacatatatgtgtgtatgtatacacacacacacatataggaaaaatccaaaaaaaaaaacccaaaatatatttctatactataacaatcattgaatcattgcagaagacgtttctgacctcaaaagatagggcaatttctcagtgagtacaatgtatcctgccactgtggacaatacctgggtgtgctataatctgaactctgacactacgcacttggagatagtagcagatcccaaagtatatgggcttaccccccaggcctgcttccctccccatttcagaagccaggtccagcctttagtttgtgtcgctgaactcatccatccttaggctagagtaatttcctaaagcagctcatggtactgtggaaacattatttacaaacttactgataacaatactttacaaataaacatgcaggtgaagtaacacatagagggaatcggcctagctcaagtgcaggaacttctgtgaaaggagctactaccctctatttgcagatccattgacattccaagtacactatctgttttgacatcccaaggattttaggatgctagaagaggaccaaggatgtagctgagtaggtagagggcttcatgaaagaaactctgggtgcagtcccaagcactactaacttaaactagtgggatagtaggctgtctgtgcctgcaatcccaacatttagtgctcagctcaggaggtagctacagaatgatcagaagttcaaagtcttctgccattacatacaaagttcaaggccagcctatacaggtctctctctctctctctctctttctctctctctctctctctctctctctctctctctctcacacacacacacacacactaaagagaaaagaagtaaaggaaggaagaagttacaagaagaataacaaaaaagtaaacaggctatttctccattttagtaagtttgttgtgaagccttccagttgcaatagcacattcaattgacaatatcagagcccacatggatctaggtgactgttcagagtggggcactgggctatgcacagacagtctcgtttccagtcgagttgagaggtgaaccccaggacccagtggtgataattcaccaacatgggactgtaggcgttccctcaagtctcctggactcaaggcttcttttgaagttagcaccccctcagcccccacaggagaagcgtggctagtagtcacgtagacaatgtcccaagcttctgaccttcagactagactcctcccatttacctagcaaggacaagataacaacccaccataagagggtctgtttggccccacctttctctcctcgttctctcttcactctcttactctctctctccttgctctctctaacctcttactctagccttttttctctctctccttttcacctttctctcttcttggccatattctctctctctctctctctctctctctctctctctctttctctctctctctctctcccttctctcttccccctgcctttctacaaaaaagctctaaaaccatagactgtctctgttcatcaaggcccactgtagctgtttctagccttcctgtgctccaaccacagatgaacacaggactctcgcctgcgtgtgaacctctctccctcagccctctctcccataaccctggtgctgagggtgttgaccccgggcccctggtatggggggctgccctctgtccacctcacctgctcctgtcgagttggggttagtggcttagatgcccacccggggccaagtggacagcatctggcagccctcccgcgaactcctgcccagagcacagaccacaggaggaactctggccggatgcaggcattccttccctccccctttttttccctcacgcccccttaattcccaacagttcattcagcacatgaaatattgggccaataacaaaataacaatattaacaataacaaggccaatatacataaatgctgacctgcttctctcttctgctgcttacctccttttatgtaacttaccagaaatcatacaacttcttcatcttgagaccaaattacataatgccttttgtactgttatcttctttttttgaaaagccaatttacactttctggactttatcaaatgtatagatttttatatattcatttgtactgaggtataacttgacagatcctaaaatattttaccatcttttttgggtgatattttttacttcagtgctttaatactgttatccgatacattgttttcatgtattttctcccattctcagaacttctcttcattttcttgtgccattttcttattaactaattaattgttaattattttattatctgtgtaccaacagtgccatttgatgatttttttaagtttgattaagttctattttatttatgtttcctgtgctcttggtgacatgttgacattgtcctctccctcatcctttaagaaaaaaataaacactcaacatggaatgaaaggataagtattatctacttacctttcaaattacataaattcctgaccttgggtaaatactttaaaatcatttagaagtttacacatttagaaatggcaatctgattctgagctagcactgagtagtttttaattattattcatcttttcacaatttcatacatgattgtactacatccttagtcacactaattcctttgtcttctcttggcctccttatccccaccagcttccacacctctcaccaagaccttcttacagtttatggttttgctttcctttttgccccataacacattgggattaagcagggctgcttgtgaggggatggaagtaaagctgttcactggtgtctgagtaacccactaatggtggcatccctggaaacccataagacaaggcttcacagcccttcttcatatcttcaagcacttaaggtctttcttccattctgatattgccataaagatattcctttagtcttagaagaggttttatgtgtgcccatctaaggattaatactttctggtcacatgttttcagaattttctttctgaaacctcaatctgggtatttttgcccttcaggtgacatttggtagactcaagagacttatttggttgccacattgtaagagatgctaattgcatctagtggctggagggaaaagatgccatcaaacaccctccaatgcataggacccctacatcaccatcatcctctatctggccaaaatgatagtagaaggaatccttgaatctctctacagtagccagaaagttgtgtgctcatagcctaattcaaagaggattttgcctaaccagagtattaggtatcacagatgtaaaatcagttggattttatagtaagaaaccaatcctttcaagccaagaaatttgtttagaggggtttacaggaggattttgccctactataccctttaacgtgaagaaaaaatatttcagtatagactgagactctcaagacgaaagtatcataaatgtattcttattcttggggttttctttattttcttatttttttatagttttagggaaagtttatgcccatgctatgtagtatatccatcaatcataatcaggagaaacagagcatgaaggaatgaaggaatgaaggtagttgatgtgtctttaaaatagtgacttctctgaactctgaagaggctgacattatttcatctgatcactttgcttcacatttctcagctatcgtgtacaggattcactggaattccataaatgtcaaagatctggaaatctgtttcatcatttccaacaatttcagcatataaaaagctctaaaacttgcaggtgattgtttcacgtcctgaatcattagatgtaatcattcctccaacaacacaaccacctccacatcatagacgagaataccttgattagaatgtattaagttctgcaggaagcactttaagtacacaactcatttctcttcacaaatatcctaggagggaggtttttttttttaactcatttttcagataacaggaaaacattcaataagtgatgaaatacttagtttgcttgtatatcaaaagtagctcattttaacaataaagcaggtatttttattgttatacccataacatagataaccctgttttcctgccacaacacataataactgaaaaaatatttcaaatatttcttttccagaagagatgtcttaagtggaattatttgtctctgtcaacaaacagtatatgcccacattctgaggctgctgtgaaaatttcttctcacagctaaattatagaagttttaaagtgtgtaccttctctattatatactatgtaggaaaaaaccataattttttgaattttatttttgtctttaggaagcactgaaagaaaaccacaagagaaaggaaatggaagagaagagcaggagagcaaagcttgcaaaagagaaagcggaacaagagaagctggaacgccagaagaagaagaagcaactcattgacataaacaaaggtacaaaaccactcccaatgctttgcataagctgtggccgcatgggcttgtgagtcacgaagatttctgtatctggaccatttggtacagcttagttactctctatcttaaaattaatatgtattgtaatatattgatgaatatcaacggtctctgagcatattgctgaatggaggagcatgggcatttccataggttctacttccatccctcctataactacaattgaattttatattgatggttaaagtataaagtgatttaatttttaaaatttgtttaattataatgtaattttgttcctggtagaaaactcgtggtataattactcttttttttttccagctagattttgctcaagttactatttttatttctaatcactctacactaaacactgtaaattatgggtaatcagtacgagatgttgtatggttgacaccttttttttatttgttatgctagcatgttctagagaaggccatcatagaggaagaacagagtgagatgagaagtgaaaagctggtctgaggggatgagggtcagaccttaacttcactttgttggcatatatctattgtcagtgctgtaacaacagtcctccttgggggcttgaacattccaagtcctaatagatattgacagcactattaccagttggaaaaacaaggactgccaagcatctttctcagctgggaggctaagtaggcattcctggtgcattcgcagcagtatccactaaacgttctttcagctaacaagaacgttagaggtagatttttctcttcattagatgttgaagaagagaggccaaaatactcagaatggtggtgtaaatctatattgacaacacaaaggaagtagaaacagggagatcacaaatgtaaggccacattcaattacagaatgaattattctttatctcaaaacaaatggggatgatgagcggacagatgcaaagaagcaaaagtgattagtacacaggtgtctgcacttaaaggttaggaatggaaggcatagtagttttccttaagtaactttcacagcagggagaaaagatataccttctctcctctcttcagcactaagaggtccagagggttaaagtaaaacacaagcaaacccaaatctgatcaagatacacagtagtatgcttgatatttattggagtacttcctgccatatttagagataataaaaattccaagcacttttaaaatattgatcagatagcaaggaccattctaagatgtactgcattccaagacaagcatgaaatcagtccttcaatctctatgctgtgaacactaattatttcattgtttggaaaagaatcagaaggtcatacaatttaagaagtttggcaaatagggtacacaaacagatatttagcactgagatagaatggaagtcatgtaactccggaatttttacacttatctttgcctctatcaatcaacattaatagcaaatgttcagtagtattttctgtgttccaagacagacttattttaaggtattagcccatgtgcttattgaaactggcaagtccataatttacaaggaaggtccacaggctaaaacccaggggacagccacgtttgagtctgcttttcctcctgcttgagtaaaattagtctttttgtattagtagagtcttcagctgatgagtgagatacattttcaaaagaaatgcaatctgctttattcaagtccgtcagtttgaaagttagcatcttccaaaaatagcctcacagcaacaaggataatatttgaccaaatttctaggcaatgttgttcagtcaagttgacatataaaattaagcatcacaagaaaagtgtcaaaaacttgagttgacagtttctggtgattgcttacatgtaggaattgagggtgagcgctctgcagaagggaatatattcattcacagagaaagaaaatgtatctgtaaagcagatttgcttgtgagagttacaatgggtaactatcatgtgaaaacattcagtttgcaaatgccttggagagaagtcttaagggcatccttaaggaaaatctttgggaagccactctaacacgagaatgaaacctaggaaggacgtcttttttttttttccattttttattaggtatttagctcatttacatttccaatgctatatcaaaagtcccccatacccacccacccccactcccctacccgcccactccccctttttggccctggcgttcccctgttctggggcatataaagtttgtgtgtccaatgggcctctctttccagtgatggccgactaggccatcttttgatacatatgcagctagagtcaagagctccggggtactggttagttcataatgttgatccacctatagggttgcagatccctttagcaacttgggtactttctctagctcctccattgggagccctgtgatccatccattagctgactgtgggcatccacatctgtgtttgctaggccccggcatagtctcacaagagacagctacatctgggtcctttcgataaaatcttgctagtgtatgcaatggtgtcagcgtttggatgctgattatggggtggatccctggataaggcagtctctacatggtccatcctttcatctcagctccaaactttgtctctgtaactccttccaagggtgttttgttcccacttctaaggaggggtatagtgttcacacttcagtcttcatttttcttgagtttcatgtgtttaggaaattgtatcttatatcttgggtatcctaggttttgggctaatatccacttatcagtgagtacatattgtgtgagttcctttgtgaatgtgttacctcactcaggatgatgccctccaggtccatccatttggctaagaatttcataaattcattctttttaatagctgagtagtactccattgtgtagatgtaccacattttctgtatccattcctctgttgagggacatctgggttctttccagcttctggctattataaataaggctgctatgaacatagtggagcatgtgtccaggaaggacgtcttaatgttcagggttttgtttgaagattaaagtagtgaagattactagaaatggtggatactgagagattaaaacaacagatgtattatctcatatttctgggggctcggagttcaagaagaataacaacaaggctccattcctttggaagaaactaaataccacctttacctaagtatttaccagtttttcactatttttctgaaaatctacccaagacatggctaattgtctcttttagttatcattgatgctcatttgatgagcttgagggacatgagaattagggatacattttcatatgacatttttcagtgccagatggatggctcagcgaagaataatgaatattgttctttcagaagatctaagttcaattcatagcacccacatcaagcagctcacaaacatttagaattacagttccaatgagatgccttcttctcatctccctggggactgcaccaacccacacatgtaattttgaaaagaaaatgaatagtatttttctcctaagggctgttactacatgtagatcaagcaaatggtaggcttcaatattagcaacttaacttgtagctatgtataaaaaatgtgttattgctgttgttattgttgttatacatttcaatagtattttacatgaagactgtgttcgtacttcaaaataagttacaaaaagacatctctgaaagattatgcagtacattttaagttttaagaatgaaaggtagggggagtgggtgggtaggggattgggggggtgggtatggggtacttttgggatagcattgaaaatgtaaacgaggaaaatacctaataaaaataaatttaaaaaaaaaagaatgaaaggtacaagactggagagatggctcagccattaaaggctaggctcacaaccaaaaatataagaatgaaaggtacagaagaggaagaagaatatagtcatatgtcaaggtagagctcagtgtaccatatatacataaaattttatccattaatcaaaacttgtaaaactgcttatgcaattactctgatcatatcattatgatatatatatatatatatatcactgtgccctataaatgtatacagttaaaataataactgaggaataagggatatagccaaatccttgtttcccacatgcaagacctatgttctatttccagttccacaaaattttaaaaaactaaaaatctttttaaaatttaactaacactacatgtactttttaacagtttctagtttgtttaagaaaatgtcaaactattacagaaaaaccttccatgaactcataaaactactagatcaaaaaaaaacataattatctgcctggaaaaattatatacccttatgatagagaaacatattgtgatttaattattcaaaaaaagaacatagtaattatacaagattttatctgaaatctagatataatcaactgagttcagaaataaagatataaatgctaacattcaagataaaaccattaaaatgtcatgtatcaaatctcagttttaagaaacctatggatgagaaggcaaaagtgaaaacaggaaactatatttttactgtaaatgagaaaaataggtatttcatgctaaggaggccataatttgtgagtgtgattaaaaagcaattgctctgttaaagaaggtgttcattttagctctctcacctaggtttatacactggtcctttccctgtgtctattcatgcttcagttccttcagctgtaatgtagggcagtgacatttatcctgtgtagatttcaagaaagattaaaggagataattaagcatagtaacactcttgataccgttgagtcatttaatactcgttgaagaatactgaaaatgctcaagaaattgttctcaccttcaagacggtttcagttttgtcaaagagatttaataaagctgaaccagcaactagtaaattgtgtgccagtacatgatagagattatttgctctgtaggcctatccaaagggaaaaatcaatttagcttggcaaaatgtcaactcttcatggcgaaggctaagagtattttctgtgcatattatttgagctaccccttgaaaaatgggtagaattttgatgaataatatcaccagagctacacatcagcacatctagtaacaggcctcaggtaagctatgtttaatggaccatgagaaaaaataacaaaataatgaagaggatgaagtcctaaattcaagttctgcctccattctttcctaggctataatctctgtcagtgtattgaggctttctgtatctgactttcttctataatatgaataattattcatataatatgaaaaatatcattatttttctctattgtgagtactaactgtaaggtgggaactctttgtactcgagcatgcacacctagtacatagtgatgtcttttgatatattctcaatctcggtgctttcatgctgagccaatattttctgcggttaccgtcgttaggaagaaagttgggtttggagacctgagggaaagagaacatacagccaacgcaagtccatggaagtgagtcacaagagttatggcatgatgagggaggagagcccaggctattgaaggaattctttcagggatttctgaggtagtaaacctgaagcacaagaaagaagaggtgactacaacaaggacatagctgggaaagaacagtgaaaggtgaagaaaaaggagttagctggcagctcattctttcttcaaaggcttttaaaccagtggcagtttaagaaggtactaggagggaggaaaaatttcatgaaggaatgaagagagacagtgtgagttgcaagccagagatttaccagacagaagaggattatttttttctgaactgcacacttttaccaatagataattatatattgatgtattttagcatattaggtgatttctttcatccaactaacatttattgcaccatttcctaaataatcataattagtgcatgcacagtaatatagtatttatttgaatgtaaaatggagaaagctaatttacatgcagcaaaaattatgctaaatcaataaatgtgctcgaagttgtgtgtgcacagtatatgaactacataaagtgctgggagtaatctacattctacaacctgtgcttacgttgatatagacgataattaacttaggaaccattaaaaccattcattagttatgtggggagagaaagaaagcttaccaaatatttgtaaataaatctctttctttttctgtttatgggagtgagcaaattacctacaattgcataaagcaataggaaaagattacattaaaaacttgatgtttttaaattgcaaactacagctgtgattctgatcagatattatttaatcaggaatgattttgctattccttatataatatcaaatggaaattagaattatctgtttcttctagtacaatgataaagaatgagaataaatcagtcttcatagtgtagaatagcaagttttgatgcatatctcttagcatgttaatgctatgcacaggcacactctctaggaagtctgccctaacctagatcatatacttctttcctttgtagatgttggggccctttcttccttccagccccatgctcccagaaataaaactcactcaaaatatatttacaaataccttggccaaatagctatgctattctcttactagactcataactgaagataacctatttattttaatctacattttgccatgtggctggtttcctgtgctcaggtaccatgtgcccatctcttctagtcttcctgggtgtattttcctctctggctctattccagaattctctctgtctccgagatgcccaccttctatttcctgcctaagccataggctatcagactttttattgataggtgccacattcatacagatatacaatattctctctacagttctttcttgttcttcccatctccatccacctctctaaatgccggttcttagatttgtatgaaacctttttcataataaacttcaactctacttaacaaagtagttattcctagaaaaacatttgatagcaatctataagattcaagataattatttcttgacttgggccaggtataacccacctgaaatcatagaatttgtgaggcagaggcaaagaagatcccaagtttaaggtagcctgaactagaaagagttacctaactcagaaaacaaaactttcacccaagtgaataaatatattttatcatatatttttcttaaatgaggataggttaatactttttttcctgctgtcagagtccatatcttaaatgataataacccaaattatagatgcaaaatatcacaagtggtggaactgattcaagtagtatttaagcaactctgataatattagtttttgaagtaatacataccaccccttttgcatattttacatatgctaatgaatgagtcatagatgttaatgcaatgttaagtgagtttgtatacttggtatagccttctcgataaagacatgaggaaaatctggatgatgccctactcatttaaactactttgttccctatattgccaaacatgtaaggcaatctgtatttgttcaaaatcagatcattttcgctttgatctctaggttggaatttttcaatggatacttaggggttgttttcttaaagtaattcaatacagtaaattgtgcacaggtttggagtttttagcacagtaagttatgtgtaccatgagcacatccatgaccaagtggagtccagtggagaacggtgactatacttctgtcaccctccaccttcttcccttaagacagggaatcctaaacctggagctaggtttgcagccctccgtccccagcaattgtactgtctccccctaacacagcataggggttacagttgcatgccagccatgcctggctttttcattttcaatatgggtgctggggatttgatctctgttcctcatgcttatacaggaagcactcttacctactaagccatttccttggcattggattgtatgtttttaatgtaaaatattagagtacattttaaaaaaaacaccatgcatgccatattgttataattcacttgataaacagttttttgagattttaaattaaaacactgttaacatgttgaaatgcaaaaagctattcccactgaagtaatcactaataacctggtaattaaccttttaatgacatgggatttcagacagatgtctcgtcattgacttaaccagcaatttaaatgaatttatttccctattgttgaagccagacaaacctgaatgttccgtataccgtgcatccttgagagttcccctaaccttcctgatcctcagcttcctcatccaaaagacagtgaaagtaatgacatctatttcatgggattttcatatgaagtaaatgcaaatctctgagcacttgcctagaatacaattggcattaaataatgatttaataataaatgaataataaaattaaattcagtgaatagatgaaggtgactattgacaacacttaaatggctggcctagaatgcaagaagttttccatgtacacacaagtctttatcatgcattgtctttctaaactcttatcaatacacaatcctcatctcactccccagatctacttacacaaataaaaatgtacactatatcataggcacatataatttgaggcaaataacacatgatatgcacttaatgatagataactgggtttttattatagtctctagtgagccattgttaagaatattagtgaacatgtaagtgtatgagagtatacgtaatataaagtacttccaagatatactctagattataagattctaaatatttcttcctgtagtacattttagccacttatcattcgtaatttttttttgaccttgtaccacagtaattgcaggcatggtgtcagttcagtggaaataagcactaaacctcattctatcagttccagcagaaaacacgtttctacatctactaaaaatattcctttaaatgggaagacaaaaataaatatgtgaaacaagataggtaatttacttaggtctcattaagctttcttagattctaaatgcagaatctcagattcataaaaactctaagagctgtcttccatgtggtgagcatttagcaagattttatcagtcctatgtaggagatgcgttaagttggcaattacaaatttggcttttctttacagtatatatatgtgtgttgctgtgttgtcttatgtgtctttactaggaagaaaactataagaatattgaagcatttgggtaaaaacaataaaatttgctacataagaaatggccaaaacatattgtaggtggcctaatcgtttattagagatatatgtttgctccatattttaatagtttcattcttattatagaaaagcattaaatgaacaataacagctgtttatataccctcattgtggttaatttggctctcttctcagtcaagtgcatttggattcatgtcaataataaataacacctaacagattcagagaacaagcaaactgcactgaacccattcgagtctctaataatgctttaaaaaagaatacatttgtttcatgcaactctgtccttgaggccttggtcttcagaaaggacaaaatctattgttgtattaaatatccaaaaacattattccagatgaaaacttctcagtgtgttctttaatttaattccacaagtttttattgagttcccagagtatattgagcagagtgatgcaccttaatcatagtcattgtcttacaaatcagaatcattatcccagtagaagagttagtaactaccagccattctgtatgcatttctgctataaaaagtaatgacttaggcatgtgggcctaaatgtatattgatatgtatattctcatagatcgtatagaatatttaccatgtaaatttaatgtcttttcacatatatagtgtatatgtttaaaattttctgtttcttcttctcaaatgcccaatcctcaatcaccagttattcccttcacatatggagcatcaataaaatagaaaatatcttaactagttactgggaaattttgcgaataaaagcaagttatagttttacaatgatattaaaaagacattaaaacctaagcttagtggcgcacacctttaatcccagcactcaagaggcagaggcaggtggatttctgagttcgaggccagcctggtctacaaagtgagtgccaggatagccagggctatacagagaaaccctgtctcaaccccgcccccccccaaaaaaaaacaatatctgactgtcatcctaatcaattgtaggtttcatatgctacttagtaaaaagcctagaagaagataatataattcatttgggaattaaaaaataattatacttttaaatgtgtaattcattatggatgatagaatacttttatttgttagaaccagttctgaaatctattttaagtgtacattgctttaaaaatgaccctctcttcatcagaatgattacttgagagcagctgaattttatttagcctgttctgtttcctgagccctggatacttgtaggtctaaaataagccatgttaatgattggatgggatccagggcagtttatttcagatttgtgtacttctgtggattaagaaaattacattttcaaaaaaaatgctggattaggctatgctatgaggtgttaggtaaaacatgtggctttttttttttttgactgtctagcccattattattataacatgatccttacctgaatgtttcagggaaaaatcctatgcagctgtaggcctgaaactgttcatcttccttgttcctttcagcagtgtcttagacattcttggttgacttgctaccttgtctgattttctagaacagtatttccgtgaaaggaaaatgtgttccctctagtcctcttttgtcaaaaaccctttgcacttgctttcgtttgccaattgaaccttttttgaaatgcatcagtagggagagcttgcctcgcctttgctagacaggagtagctgtaggtgcatttaaacaattcaacttgaaaagggaatttctctctttttatttgaaaacaattgaaaatgaaaggtgtatgtctcaggacatagtacttaaccgacctctttctgctgaactgaggcatggtgtatgaaactgcttcccctgtgtgttccctagtgttttaaaaacatgctttgcttatttgaggcaactggtttctaggcagaaatctctccattggaagcagaatccattatgttattaggtcttggtattctgttctcgcatctctttttctttgttcttagtcaacatagctatgctttaaaagctatatgattatatttcaaggggaaattgacacagtgtattaatctttaagtgtaaccacagtctatccgcccacagtccatggaccctgtacttttaaggaatcctctaagctcctctgactaaagcatgttgaaaatatccattttcacttgagtaaccctaaccataaatgaaagccccagaggcatgtgtctctcctaacttttggaaataggagtaggacaggctgtctttgaaatgtccagcctagctatcttcatcccatctcttatttgaacacatgagaaaaaaatgaagttaacatttatatgtaagaagtatatatagccttatgaaaagatattgggtactctgaacttcagtgatcaatagcataattgaaggctgtagaaaccagcctgatgtggtgaaacatgcctttaaacccagtacttaggaggcagaaggaggtggatctctgaggttgaggccagcctggtctacagagtgaaatcttatctctaaaaaatcccctttttaaaaagaaacaaaaaggaactaacaaccaaagcaggcattgtgctttacacctgtaaccccagacaggcctggaagacaagagagctgataatcagtagtcatggacttcctaagctgggtagtgacttcaaggccagccctggttacataaaaccttatttcaaagaattaattacacagacactaaaggctaattggttatataggtaccaatgtaaaactggaagctacataccttacggtggcaccatccatgtcaggaggtagtaggtcatatatatcatttaaatggaaaaaaatgagaccataccccaattgcgttttgtggactttactttgttgttgttgttgttgttgttgttgttgttgttgttgttatctcacaaatgtggtagggaaaggattcctgactttagaagctgaccatctgtaaattaaatctttgatattcaagaagtgccaacctttaatttaccaactttaaggcctttgttttgaactttacttctcagtggtagggagtttctaaggcgagttcctgattttcatgtaattcttttatgtaatatttatctgtaaagccgagcagattttatgacttgatgatgccttttcatcattctgctctgtggctctccctctgtcttcagcattgttacactgtcacacacctgctgatgcattgctgcctggtaggtgacatcatgatttgtgagcaatccgatatataaataaggtggtgagaactgcctcagcaattctgtttctatttgagatgaattaaataatctctttgtgttctcttacatttccctccgctctgtgttttcacaattatattagacactgtaggggaagcttctctctctctctctctctctctctctctctctctctctctctctccatttctaaagaatattcagttaatccaaaaatttcctagaaatgtaataccccatatgtcataatataactctagttctttagtatatttaggtcatgcccaaatgtggaattcagcaataaactaataactactaatttcctaggaggttcctagaaatatgcttggagtagagtcaggagaataccactgtgtagccaatctgtgaggtccacacttagtgagggagcctgtctccaaaataagatagagaactatagaggaagacagcaaacatttgcctctggatttcacacagacgcacagtctctctctctctctctctctctctctctctctctctctctctctctctctctctctctctctttctctctttgtgtgtgtgtgtgtgtgtgtgtgtgtgtgtgtgtgtgtgtgtgtgagagagagagagagagagagagagagagagagagacgcacacgattctttaggactttagaagcatttctcattctcagtaacctcatagtaacaatgattctctccatttgttcatttcataatgcattctgtcactgtagaaattagcactttgaaatcttgtcttataattatgctaagaagctagttcagaaagtacagtccctagatcagtagtttgaacataacttgagaatttgttagaaatataaagtttctggatgaatgctaaactgctgaataagaaaccagaaatgaagatagcaaggcatcatttagcaagctcttttggtgattctgatgcatctcaaatttcagaacacaaggatccaatgacacatgatccattgtatagcttgacaactgtgctgaagtaacatcacagtcaaggccatggagcacttgctttttaatgttgaaaaatagaggagagaggaacatttatctcttttttatcctagattgctaattctatcctagattgctaatgcctgaaattgtttttaattatgtttttgtatcaagtcatgatttcattatgcgtttgaaagagacccttattccccctgctttgtgattctgtattttttaatctactggctgtgacaggatcaatcagaatcaaaaagcttactgcaacaaaatgaaaagatactcttgatacagggcatgtttcagggaacccagacgtctttgtgttattcaatgtgtctgtcactgatacatatagtcatgtttttaaaaccacaacatgccaaatgaagcaagtcaactgatttacattttttatgtatgtataggggtttattgagtttgaaaaaaaatgaattgcagaggaatttcttaagtagcacttcccattgtatattgaaatagattttattcataatgattaggaggtagataatgaattttacaactgttcagaagtgcatctagtgaagaagtttaccttatactggttataaccatgatttttctatgattatgtatgtgcactttcatgttttttcactcttaattggacactttcatatatatttttaacaagcaagtatttcttttcagtgacaaggaatagggtcactgagaccattttcttactgaatcacacttgattgcattaagaaagttatatagcctctcagagaagtgacttaactaggaggacattcttccttgatatgattttataaatgtaaaagaaaagaaaatatcattaaattatcagcaatcataagtactacatcatctggaaggctttatagtcctttgaaaatgtaaaaggaaatttgtggaaaatggacaatcatgacaaatgcttatgctgcaaattgttttgtcataattgcctccataatttgtttaaaaatttcaagtatctcaagatagcctcagcaaagtactatgttcagagctgtcaggggcatgggtctctgtgtgattacacaaatggccattgtcattgatatgcagtttgcaggcacacaaagcataagtaatagaataacctaaagaagcaagatccgcacactttgctcataaaacaaaatgaatactttgacttgaataaaagtaagaatctttaaaaaaaaaaaactcacttcttaaaaaagctcttcctgtaagtgacccttttattattttaaaagtctctatctttttctatcaattctagcatgatctctgtagcaaataaagagagagagctttacccatgagatcttctgtcaaaaaataatcttcttcagccctctttggatatattaagaaatagtttccatctctcttaaagtaggtttgaacattttactctgatgaatactttacatgctcacaacaaatgacttcaaattctcatatatttcaccaatgagagtcccctttcttttttactccttcgtggcttaaggtactatatcagcacattctctataaataatttcttcatctgttttctgtttctaataaaataataacccaaactgggtaagatttaatgaaagggggtttatttagttaggcttttgtttccagaggttcaaagtgggtagcacttggtgattgcctggtcactgagagagtcctgaggtggagcaaggtgtcttatagctagagatggagtgaatgtatgtttgtctgtactgatctgtatagtttgttttttttttgttttgtttttattttttgttgttgttgtttgtttgtttgtttgtttgttttacaaagccatgaagaatccatggtgcagttctattctggtggccttatttattaagctttaatgcttccctaacactgcttctaaacattacagttggtttaagcttgtagcctcagtacctcacaattccaatacatgaattcttgaagacacaatcaaagcacatccaaaccatcgggtcaatgacatttgtttctgctatttcatgtctctccatctgtgcctgatatggagctcacacttaacaatatcgattcgttggatttattttctgcggtatgttttttgtaaaacattaggaaacgcttcagatgatctagtcatataattctgtaagacagagagaatgattctaaatgtcccaggaggacaacaacgtaaaacacaattaaactgtacttgctatatttcattttcttacaagttctgtttttctagaatttagtcattattctcttctttttattgtaatcattccatgcatctcactcctttccttcagccaatatgttttatttttaaacccaactgtaattatactcttcctgagaaaacagaaagcagacatttttttattctctcatacaatacattccatctgcagtttccattccctccactcatccagttttctcacacatcccatcttctccagattcactccttttttcctttcagaaaggaatagccctcccagggatatcaacctaacatatcataacaaaattaagtaatgctaggcactagccctcatatcaaggctggaacaggcaatcctgctgtaggaaaaggttcccaagaacaggtgaaagagtcagagatacatccatctctactgttagaagtctcaataaaacaccaagctaacaaacattgtatatctgtagaggacctaccatgaacccatgtagacccatgcaggctccatgattcctgctacagtctctgtgagcccctataggcccttcttagttgattctatggaccatgttctcctagagtccttgactgctctggttcctacaatttttcctccttctcttacacagtgtttccagagctcaaagacgaagggcccaatgggtatctccactttggggtttctcccagcctgatatttggctgtgggtctctgcatttactcccatcagctaaagcagacttttgtaactagtatatttcactgtgtcaaacttgaaaagtttttcatcatgtttgccaaccctctctgatacataaacagagcttgactaatcattattattgtctacaatttttcctttttataaaaaaaactattgaattattcagtgtttcttaaaagttcaatgatttttatatttcaaatgcacttttgttttcaatatattcacagcatgcacaggatctcactcactggtccactggttctaatatttattagaataattttatttaccatatgtttgtgtcattggaaatgttaggagaaaaaattgaattctgaatgtgaaaggtcttttcttcttctttcaaaaggaaaaaatgcattctctgacattaataaaagtcatgctgacgttcttttacaagagactcgccaaaatgacaaaagagcatgaaaaatgtaattaggtgtttggttgaactgagttggttggtttgttctcctatctgataaattcaagtgcacaaaaataaaattacaattaataagaaagtagaaatgtggcagacatattgatatgcttgggaatattaaagtagttgtcattattttacatgcttatggtggaaaaataaatttcactctttttttttttttgcaaatgttgctgaattttcctctgaaagccactataataattggatttatttattcaattctcactgaagtactagctgaattaagtttcagaaaaataaacaagtattctctatctctaaatatattaactaatctataaaggtttgacattcattaatgcttgctgagggaaaaatgagttctgcagattgtgtttttctcagcactgcattaacttacttccacaaaccctgcttaagctttgatttctaaatctctccccagtgaaatcatacctcaaagatgtttcattaaaatgacaagataagctgtcttgtatccctatgctggcttgcggaaaaggggccaaatctgggagatcttgcgaaactgttcctaaattttagggaaagaaacaaagtagtaacctcaacaaaaatagtcaacatctgcatcgtcaaaataataatccaaagagaaagctgctgatgttccaagccttggatttctgtgtgatcctattgtcattgtgtttacattaataacttgtgcagactgacaatatggagtttatgttgtggactgtaagaactgttagaagtctagttttctagtgatctgttttagaattgctttttatgttgtgctgtatcctacatgtctttgcctacctctctcttgtttgcatatattttcttgcagggttaatagtagcttaaattgctcaactttgcttctaaatcttattccaaaccatacgaaattgctgcagtttgaccacttttgacctataaaaatgccaacttcatatagttcaagctaataaaaatcctaattctccagtagaggaggaacatcctactattccataatcattttcagttatggatgaagctaaaaatctaccctaccccggttgatcatttataagctatttgacatttaaaagaattccactgcagatttttggcatttaaaaggaacttttaagtaagaagactttctccttgttactgcaccctgggaaacagacctttgaaaaagacacctaacaggataccagtctcccatggctaaatttcttctgtttacatagtatttcttcatagacatatttgatatgttgattaatataacattgttttttctttattccaaatgaatatgctacgatcattctaattagatcaaacaatgtttgaataacttgagtaccagtatctaaatgataccttatgagtgagtgaatgattaatcaatccactgcatcttaattattccaggattaattctgatgtaggagttacctttttttcactgtgctctcagttcaaggtaaactttaaaatatcaccaaatctcaaaaattaaaagattccctaaggacattctctctctttttgaaggcactgttagtatgaatgattacttgctaaaacagacacagtgatacttttaaagcttcatgggttgagtaattccttcaaagaaattgtaatctatcgtttggcttcttttccctaacatagaatggcatagtactgtaaaataccccagaataccatatgtcataagaccacacatagtgtatttctttgaaaggatggggataaatttcccctatactaaaaatcactagctgccatggacgctctgaatgaaaaatggtccttatcatttctttgtgggctgcaatttccctctgtttatataggctataaataggacacaaagcatcctgaatgagatcagatagtatgcaaagattttagagatgagtttagatgaacaaatcataaaaagaacacagtattaccttgacctaaatctttgccagagagcttttggtatcctctcctataccctttggcatatgccgctttttatttggagaggaaaaataattatgaatagtaaaaaaaaaatattactgttcagtggataagccagataaagtcttgaataccttatttaataaaatcactagtgttctcctttatgatagatttgtctgaggcaatctatcagcatatggaccttactaaaacaactgccttactagatagacccttgactcctacgagtatttgatccatgcctaaagcataacgtgaaagttggctagtattaattattaatatgcaacatttttctcctttgccatattatgtatcaaataagcagagattttttcgaagaagattttatttcttctctgcttaagcagcaaagctctttattaagtgcaaattctcttccaatctgacctgcatcaagggaacaagcatatgttaccttaggagggtctcctgctagttccttctgcatttgatcggggatcatgcactgaataagtgcccagtggttctacactgataccttggacgagttcatgagcaactgcatgaagaataggctgagagactgatggctacggcagtgcttccttatcacactctccagagccggctgttttaagaaccagagccatagccgcatatcagtttgaaatcataaatcttttctacttagtcacaaccacacacacacacacacacacacacacacacacacacacacacacacactgctcattcacattgggcattatgacatacgtctgtaatccaggcactaggaattcatgtaggagaatcaggagttcaaggccagtctggcctacatagagtttaaagcctgcctaaataaataatagttcccctcaaaactctctctgactagagacctatccattttaattcagtataaaaatatttatgggactggtacagcagaagtctgataagatagcatagttgttttatagcatagtatatgagagaagccatgggagttcttgaattaaaatcaaagcaatacaaaggtcaaatatacatctcaacctaaagcaattgtgatgttgacttctaagcaatgatgagctctaaatgccaacatttcctcggttttgctagcgtttagtggggtgtttagtagggtacttagtggggtataaatattatctatgacttcattttaaaggatgcacaaataaagaatttaacacgattatatctctaaggtatttgatgtcttttttgtaattctgtgccatttccttttacccaatcaaccaacataattcaatggaacccatagtttttgctcactaaactgttaagtataggtgttcgtgaacattcggaagggtttaattttagaaaccttgaagttggaaaagctttgcaccaagtaaaaattttaaaatattaagtgacttaattattattgccttgattttttttcttgaaagtaggaatggaagaaaggaagggagatagggaggaaggaagggggaaaaggtgggttaggttaattcttctgacttttataccaagacttgcaaatcttgcagcaaatctttcctttttccatattgctccactgatgtaaattgcaatgttaagagtggtgtttatatactacaagtgttgatcctcagctcttttcccgaggcaagaatcccaggtagccctttatgctttgcagtgcaggctttgtattcctctactggtttcaaatcggatggattgttttgtaatctgaagacatccatccataagatagtatgcctgcaaatggtagctttaattagtttttcacacaaactctctccacccctctttcaatcagttcgtctttactttagatggcataggtagctattggactcaaagacacttcaatagttagttggcaagtcacagaagagaaaataaaagtaaatgttagcagtaggtacacatgtgtagagtatatgggtatataacaatggacataaaaggactggagatgtagctcattagaaatatgaaaggccacagttttgatagccaacactgcagaaaggatgaaaatattatttgtttagcttaagatgatggtagctgcctgtaattcttgcactcaggaggctgatgcagaagaatcgtgaattccaggccagactgggatgcctgtatagcctctgtcttaatgcaacagtaatgacaatagaacattgagatgataacagtagtgaattgataggactattgtacattcaaggatagcgtcttggccgcagattggaatcgtgtatcaattctctgtgtagcttgatcacagagctgctttgaactctttcctgctcttccttattcctgcaccgatccttacaatgactgaatcatttatcaaaaccatttaacatctgtcacaaactgttaaatcagtagtttttttttttttttaatggtagacattcccggttttctttatcttccttctgagcttctaagtcactgaaggatctcaattcgtcagaagtcaaaagagagcagtgagagtggtagcacagattgtcaccatcttgctccttcaatagcctatatccaaaaaaaaaaaaccttaacagtagtgagtgaagactctttggaatacatattagattgatatggaaactacaaccagaaacctctgggaaagggcctttggtgtcccgtgtctagaaacagtggtaacaaaaaccaaccaaccaaccaacaaaccaacaaacaaacaaaacaattttggatttatacctcttcttaggtgagaagtctgaaactacctatttgttttgtttgcctcttacccaaactgattttgccttttaaaagagaaacattgttgtcttgtctaaaaatgtctgtagtgggtattggggttggagagatggctcagcagttaagcttttgcagaagcccttagttcaatacctagcagccatggcaggtttcttactaccagagtttctgacacctctaagcatgcacattcttttggggaacatacattcatatgcacaaaccggtgcaggcatgcacacacacacacacacacacacacacacatttaaaaataataaaaagtaaattttacaaaatgttcattatattactgaatatgaagtggctatttatacagtatgcatcagtgtgcactctccaattaaaatgctcagaaaaatacaggggtgcgggagatgttaaagtgttcaaattgctcttaaaagtaaagaaaatatcatatgctacacacaacagtgtcaaaaattcaatcaatttttaatcctacctccatgtaagcaaagtgtgatccccagaaccaacttaaagatccagggtcagatagctagagtatgcgctagagaagcagaaataccagagaccctgcctaaacaaggtggaatgtgagaagctattctggaatactgtcctgtgacctctctacaagtgtgctgtgtcaagtgcatgacaaccctaccccactgctgcacacacttatttatttaaaaaaaatagaaaatttcatatactcatgaactccctgcatctaaaagataaatatcaagtaagttgctatgcaaaactatggagtgagaaggaatatatgctaataaaaacagtgaagttattaattgcctttctgcagttgcacaggaacttggtgggaaaggtgattcattatagaatctgaaaagcaagagaagaacagtacaatttgaaagttagattgacagctgatgaattgtccacttactccttgcatgtcaaccatcagcaattaagagttgcagtcccttcctttacaacatgtttatatacctggcggtggactacctttactgttggatttgggacatttgttacaactgcctgggtctattctcataatggcaggctttgtaaagtcatttctactccacactgtacctgtgctagacacaaaggaacatgcaaagaagctttttggataactattaaattcaagcaatcacttccaggtatactatcttgtagatggctgtcttcagattacaaatgattcatatcttaccctatttgaaactagcaaaggaacacaaaacctgcataacaaagcataaaggactgcctatggactcttgcctcaatgaaggagctgaagcaagcacttctagtatatatgagcacaatttgatattgtagtttacatcagtggataaagatagggaaaggaagaatctgcatatatatatatatatatatatatatatatatatatatatatatatatatatatatatagctgtttcatacctgtctcacccttggctctgcactgaaatgggaagcatctcaattgaaagtaaccttatattgaatgctgatgttctcactcactttccatgatggtgaagcctgatttatttgactggctcttgcagagagaggtccttcaatgcctcagaagcaaatctgaagatccatatagtgtttccattggcagcatgtactctagagcagggatgaacaacctttctctataaagagctgactggtaaatactttatgttcccctagacctaaagtctatgtcataactaaattctgttcatatagtacaaaagctgccgtaaatgcattatatatgccagaaagattttgctgaaagcaccctgatatagctgtctcatatgaggctatgccagtgcctagcaaacacagaagtggatgctcacagtcatctataagatggaacacagggcccctaatggaggagctaaagaaaatacccaaggagctgaaggggtctgcaaccctataggtggaacaacaatatgaactaatcagtacccccagagatcgtatctctatctgcatatgtagcagaagatggcctagtcggccatcaccaggaagagaggcctcttggtattgcaaactttatatgccccattacaggggaatgccagggccaagaagtgggagtgggtgggtagggaagaagggctggggggggggggggttaatagggaactttcgggatagcatttgaattgtatataaagaaaatatctaataaaaaataaaaataaataaatgatgcattatgaatgaaagtggctgtgtatggaaccaagatggtggggattgaaagttgaatttctgacattgttgtgtagcatatgatattcttctttacttttaataagccattcaagaaatgaaaactatcgttggcatagaggttataacaaaatggagacaagttgctagtaactatcagagctagggttcatccttactcaaggcatttgtgttcttttgttggttctctgtctggccattctcagttccatgaaccagagaaattcatttatctctttgctttggtttctttgcctggaaaacaaaatgggatctaattttaattgggtttatattgtgtggtgtatattaggctctcagtaaatgctagatgttatcaatattcctacctccaaaaaatctttgccttatcttatctgaaagacttgctttccttacttttattttcactagtgttcatgcccttagtaaatgattgattctgataaaacacacaaagtatttcaaaggtctctttgaaatattaattattggatgtgagatattttaccagcagcatcaacaatgtttttcctggaaaaaattaacattcaggtttattgggtgcttgtttattaatagaacacataattttcaactacaaatatttctagcatataggtaactgaagagaaatgagtaagcataaacattattttttaactaccatttcctattaagctctctttcctcaggcaagctgccagaaatgtgcctctggccaaaaagttcctacatagaaagtctaccattagaaatctattcatttgtgttaacaagcttctctttaagatgcaaatatatcaggcacccttatttctccaactcaatttccctgataaactcttacatagcacacatgtaagtaattggggcaaaattaactaagggttcctcattgatgggtttagaatgaaatttccaaataccttatgacattatccatccccccaatgtatatcccatgactctacatacctaaaacagttaccttaagttgaaatcatctcaaaagattgctatgcactttgatgtttatgtggactctgttgttcacttcattggtgaaaatgcattgattatctgttctgacaatgagataaggtaacaaaatgagtgtaagtatactttgtggaacattctgtccccccttccccatacctgtaattttaattacaggagtttaattctgtaaacgtccagaacctgggaatgcagtgtttttctattttctctagcaaatgtcattcactgtatagtataatcatcgaactgacccagcttagctcagggtttctagtggtttcttctaagctccaatgattgcaagtttttcaaatcctttggaacaggagcatctacctttgttgcttctcttagaacaccaggctttctatttatccctgcttttaatcgctttggaataatatcttgattctttttaccacagtttctgtctgtaaatcacttcataaaccattatcgtagggaccatctgctgggttttccaaatcaccattaacttctttaaaattaaaacacaaataagaaaaaaacctggcatcagttagtggctttctaggtgctgtggactacaatgcatatcgttcaggattcttttacatctgtgaagtcagtttgatttctcttatttctgactcacttgtggcgctactcttaggcttagccagatagaataatgtttgcagcatggtgtactgttttcaccatattgcaggggcatttcttggtctttattgcctcctgttattccaagttaaactgtgagagctatttatcagcccagggccttcattttttttgtggattcctgagaaaagattttgtttgcttcttctttgaaaagtgagcaatcttctagttctgtgtcctgtgcaaatccatacataatgcacatgttcttaatctggagcatgatagattatgtgagatgtgagaaagattgactctaacactgcttcttcttgcgccccacttgtcactaccttttttttttttcagggaccaaataaataaccatttattcagtagagtaaatacattagactagatttcagagtgtttgaggaactcagtttggggtcccttacactactgaacatcaacactatgaaagacactctatcaaatcacatcatttggggctggaaagagggctcagtggttaaaaacattgctcttgcagagaaccaaggttcagttcagagcagcatgacagctcacaactatctgtaactctaaatctagctcagagtcgtctgtaactccaattcctggtatcatcttctggcctccacaggcactgtatctttgtgttacacatgtatacatgcaggcaaaacaccatacacataaactaaaactaaaaaaaaaagtgatggcaaataagtgcattgtagtgtcttagacttatgtgagtactttccaagtcaggtccttttcctgagccttgataatcttcttgggaggacttgagttatagaaaattgaataatgtaaagaaaatttttaatgatatcttcttatttttttgggtattttcttcatttacatttccaatgctatcccaaaagtcccccgtaccccccccccaactcccctacccacccactctcacttcttggccctggtattcccctgtactgaggcatataaagtttgcatggccaatggtcctctctttccattgatggccaactaggccatcttctgatacatatgcagctagagtcaagagctccggggtactggttagttcacattgtttttccacctatagggttgcagatccctttagctacttgggtactttctccagctcctccattgggggccctgtgttccatccactagctgactgtgagcatccacttatgtgtttgctaggtcccggcatagcctcgcaagagacagttatatcagggtcctttcagcaaaatcttgctagtgtatgcaatgttgtcagggtttggaggctgattatgggatggatccccggatgtggcagtctctagatggcccatccttatgtctcagctccaaactttgtctctgtaactccttccatgggtgattgtttccaattctaagaaggggcaaagtgtccacactttggtctttgttcttcttcagtttcatgtgttttgcaaattgtatcttatatctcgggtatactaagtttctgggctaatatccacttatcagtgagtacatatcatttgagttcttttgtgattatgctacttcactcaggatgatgccctccaggtccaatcatttgcctaggaatttcataaattcattctttttaatagctgagtagtactccattatgtaaatgtaccacattttctgtatccattcctctgttgaggggcatctggcttctttccagcttcttgctattataaataaggcatctatgaacatagtggagcatgtgtccttcttaccggttggaacatcttctggatatatgaccaggagaggtattgtgggatcctctggtagtactatgtccaattttctgaggaaccaccaggctgatttccagagtggttgtacaagctttcaatcccaacaacaatggaggagtgttcctctttctccacatcctcgccagcatctgctgtcacctgaatttttgaacttagccattctgactggtgtgaagtagaatctcagggttgttttgatttgcatttccctgatgattaaggatggtgaacattttttcaggtgcttctcagccattcggtattcctcaggtgagaattctttgtttagctctaagccccatttttaatggggttatcttcttgagttctttatatatattggatattagtcccctatcagattcttgagttctttatatatattggatattagtcccctatcagatttaggataggtaaagatcctttcccaatctcttggtggtctttttatcttattgaaagtgtcttttgccttacagaagctttgcaattttatgagttcccatttgtcgattctcaatcttacatcacaagccattgctgttccattcaggaattgttcccctgtgcccaaatcttcgaagcttttctccactttctcctctataagtttcagtgtctctggttttatgtggagttccttggtccacttagaattgagctttgtataaggagataagaatggatcaattcgcatttttctacatgttaaccgccagttgtgccagcaccatttgttgaaaatgctgtcttttttccactggatggttttagctcccttgtcaaagatcatgtgaccataggtgtgtgggttcatttctgggtcttcaattctattccattggtctacttgtctgtaccagtaccatgcagttttgatcacaattgctctgtagacagctttaggtcaggcatggtgattccaccagaggttcttttatccttgagaatagtttttgctatcctaggttttttcttattccagatgaatttgcagattgccctttctaatttgttgaagaattgagtttgaattttgatgtggattgcattgaatctgtacattgcttttgtcaagatagccatttttattatattgatcctgccaatccatgagcatgggagatctttctgtcttctgagatattttttaatttctttcttcagagacttgaagttattatcacacagattcctgatctttccaagacttttatcatgaatgggtgttggattttgtcaaatgctttctccacatctaacgagatgatcatgtggtttttgtctttgagtttgtttatatactggattacattgatggatttccgtatattcaaccacccctgcatccctggaatgaaacctacttggtcaggatggatgattgttttgatgtgttcttggattcggttagcaagaattttattgaggatttttgcatctatattcataagggaaattggtctgaagttctctatctttgttgggtctttttgtggtttaggtatcggagtaattgtggcttcatagaatgagttgggtagagtaccttctgtttctattttgtggaatagtttgtgcagaaatggaattagatcttctttgaatgtctgagagaactctgcactaaacccatatctggtcctggactttttttggttgggagtcgattaatgcctgcttttatttctttaggggatataggactgtttagatcattaacctgatcctgatttaactttggtacctggtatctgtctagaaatttgtccatttcatccaggttcttcagttttgttgagtatagccttttgcagaaggatctgatggtgtttcggatttcttcaggacctgttgttatgtctcccttttcatttctgattttgttaattaggatgctgtccctgtgccctctagtgagtctggctaagggtttatctatcctttctcaaagaaccagctccttgtttggttgattctttgaatatttcttcttgtttccccttagttgatttagcccctgagtttgattatttcctgccttctactcctcttgggtgaatttgtttccttttgttctagagcttttaggtgtgttgtcaagctgctagtgtgcgctctccctggtttctttttggaggcactcagatctatgagttttcctcttagaaatgctttcattgtgtcccataagtttggttatgttgtggcttcatttcattaatctctaaaacgtctttaatttctttatttattccctccttgaccaaagtatcattgagaagagtgttgttcagtttccacgtggatgttggctctgtattatttatattgttattgaagatcagccttagtccatggtgatctgatgagatgcatgggactatttcagtatttttgtatcttttgaggcctgttttgtgaccaagtaaatggtcaattttggagtaggtaccatgatgtgcagagaacgaggtatatcctgtatttctttaagtgagttattaaaatccttcttgatatcctctaccatcatcatgagatatgcttttatatctgggtctaggttttcgggtgtgttggggtgcccaggactgggtgaggtgggagtcctgtgttctgatgatggtgagtggtcttttttctgttagtaagattcttacatttgcttttcaccatctggtaatctctagagttagttgttatagttgtctctggttaatgcttgttcctcccgtgattctgttagcctctatcagcagacctgggagactagctctctccttagtttcagtggtctgagcactgtctctaggcaagctctcctcttgcagggaagatggacagatatctggcgttcggtcctgcctcctggcagaagaagaaggcctgaaacacagcctgtctaagaagctgttagcttttgtagtccgcactctcacctgtgcagactagtctcagagggattcgggaaccaagatggcttccccaggtgctccagcaaagccttcccgggtggggaggactgctgtctctggcagggaaggtgcccagatgtctggagcctgaaacggggtctgcctcagaagttgtcctctagggaccttgggtgtgtctgtggactctctgcccaaggtgatccggtgctggcgcagactggaagggacttgtcactgccttcttatgcagtcagcttcctgtctactgccgatgcccttgctcaccaaaacaatttgacttttttacataggcttttaccaaatgggtccaaatggaccagctaagttggcccatgcctttatgcagaacaatatgtgccactgtggactaaatactattcttttttcacaattgatttctctcccatgatggtcttttttgtagactgctatgaggctggtcttgaatgtcaccttcaggcacactatcttcctcagaagatctaagcatggatttttttagagttgcttgaagccctttggatctgcttcctttgatagtctaaacccatttatatctgttccctgatcatttctatctcatcataaatgtgggtctttcgaaaggtctttctctcctcatggcttatcatgctggacatacctactctctcaagtgactatgctgattcaaaaatacctccactcctttccttattgagaactgtttgagctgtgagtaggggtggagttcaatggtagagttcttgctcaataagcacaaagtccgggttttaaaacccacaccataaaaatatgtaagaagaaagaaaaggcttgagatggctcagcaggtaagaacactgacaggttttccagaggacctgtgtttgatcactagcacccacatggtgattcacaaccatctgtaattccaggtccacgggatccaataacctctttttttctctacggtcaccaggcacacagatgatacacagacatgcatacaggcaaaacacccatactaaaaccctcatagtaaaaataaatactaaaatcaaccttcaaagcatataataacaacagtcaaaactaatatcaggtgatagaaataagtagtttccctgggttttagagataagaaagagagggtggttctgtccttggatggtggtggttacatgggtatatatctaatctgttgaaacacctcaaattggacacctgagatctctaagttgtaagtttgtatacttggatcatgtacaagaagagaatggccacacacaaatatgcattgagttacatctaaatctgactgtccttaaaccagttataattgttgatggcttctatttctctttcatttacatgtaactacaatacctaaattactaccgaaatttaattattttggaggctttattttagccttactgattcatatcttctatccatgtttgtctagttcatagaaagcgtagttgaaattttataattaatatatacaagtactatctcatatagaagggtcctagcctcaataagaaactttttttctttgtggtcacttactactagttggtattgactttcttccgttttgacagagatcttcatttgtaaatgttcagagttttaggattttaggaaattacatccataatctgaacctctcccaaattggaaacttatgaaaatacttgggttttagattaggtatgctcaactgataaaacatacacaaatattataaaatccaacaaactgtgaaaactaaatcatctatccccaggcatttaagataaaggacattgaactcatattatgtttagactagtaattctcaagcctagtgaactagagtgccatcttcaataatagaagtgcccattacactgtttagttaatagataaagtatatttggattaacagtatgtgatactagatgaaagcaaagagttgtaaacagtaaagctacaatatttatggaagacgcataactcctaggtcagacattcaactgttacacatagtatagtaagcaatataagttatatgttctcattttcttataattttctttgctattcaacttccatagaagggtacaaaggtattgcaagatggatggtacaaatacaatggctttgtagcactccagaggagccctaagattaggtatccctaatctattataatgaactcagtgcaaacctacatttgccccggagaaccatataacttatttttaaagcagacaaacctatcattcaccttaggtagaagctttgtgtcatgtaagactattgccataaaaatagacttttaaaacatttagaaattgtgagaagccaatagagaattctctcacatcagtatgtgctagtcatcagggaatagttttgcacaaaagcatagcagagaatattaatttacctagtgtttattttaatccgtagcatctccaaatacttttggggaaataagtcaataccatgtcggttaactttaatgctaaaatcggagcttcaccatctactgaatgataaatcccatgggaaacatgaggcagaaggtgtcacccacaactttcctttcatcagatgagaaactgctcacagaggcccgagactgtatgcagcaggcctagctcctcagtgttcttggtgactaattgtgtaaggagagattataaagtgaactgtggattgttacttctcagccatacccacatataatcatttcagtggctaaaaagcattacaaaattacctcgtgatatttctttacttggcaaaataagtacttttcatttttttaaaaagcagcttttctgtgtttaatattcttcttttatgatagaaaatgaacacattttcccattgagttaactttgtacacaataaaaagtcgctcactactaattacatataaatatgaattcatagttatacaaacttggaaattttaagtgaactgtcattctcacacaattcaatcacaaaccaaacttcacttaaattcactcaaaatgaaaagtaacatttttccagtagccatagtggttttcattttcttttggaagaaataaagattggtcctgtgattatatttgtaaaacttacatctgtgaaggttggacattctatgagaatcactcagcttcttttaacgttagcatgaagcagatgaaaatggaatggactgaagaaatgtcattcttctctttgataagtgtaagatgtttataaaaatctgctcttactgttcctgttgtgttttttgaagcactatatagtatatgtgttgacaacagcaacagtatcacccccagggtgtgagtgctgtgtaatgagaaaaaattttttgatggttataatggttaatggcatagttaaatataacataaacagagaagcagtagttccatgattttaaatcttcttgttgctgctgctgatatttttctttctttctttcttccttccttccttccttcctttctttctttctttcttttctttcttttctttcttttctttcttttctttctttctttctttccttcgtctttctttctaagatagggattctctgtgtaaccctggcttgctggctttctttctttctttccttctttcctttctttctttctttctttctttctttctttctttcttttctttcttttctttctttctttccttcgtctttctttctaagatagggattctctgtgtaaccctggcttgctggctttctttctttctttccttctttcctttctttctttctttctttctttctttctttctttctttcttttctttcttttctttctttctttccttcgtctttctttctaagatagggattctctgtgtaaccctggcttgctggctttctttctttctttccttctttcctttctttctttctttctttctttctttctttctttctttctttctgtctttctttctttctttctttctctcactctcgctctcactctctcttctctctttctaagatatggattctctgtgtaaccctggctgttctggaactcactctgtagaccagtttagcctcaaattcagagatccacctgcctctacttccatagtgctggggctaaggccatgcaccattaccaccggccatgactctaaatcttaagaatggtaaacgtctgggaaaatatggaaatatgtctaagtgaggaaaggaatgatgatgagaaatgtgttatatcataatagttcaaaaaacactagtgaacaggatggatctttgccttcttttttttttttttttttgtattccacatttttactctaaccaaagtagactatcattaaagatttttagtgaaacactatccatcatgctatattataaaatttcatattttcatctaacttatagaaactgtaaatatatgccatttggcacactgttctgtgcacttgtttgcacatgctcatttatgcagtctttagaattgccattttcacaagaccacatgagatccacttgcattgttaccctctcactgttctttagctgggtaaatttcttctccatgatttcttctccagcattccatacttcttttcatgacttctggttaaatattgcagttaagagactgaagagcacacttaggagatacaagtgcttgctgtgaaagtgaaagcaaaaggacccaaatttgaatccccagaactcatctcaaagccatccataataaattaagtgcccagaattccaacatttctatagtgaggtgggaggcagaggtaagcaaattgcctgaagctctattactggcaagcctggtgttaagtaggcccaatggagacacacacaagaaagagaatttgtctccagcaagggagaaagtgaagaaagacactctgaggttcttatctggcttcaatataggctttgttcttagacatttctccacctcatgttttaccacagtgctttttggcgaacctctctaaaatttcagtttgatcaaataacatggcttcctactgcttttaattgtcctgatcaatatggtgaccacaaggcacatgtgctgttgaattccagctaatcagaactaaagtgtacaaaagaaaatatgcactagatctaagaccttggtcttataaaatatgtcaagtatctcattatttccaaatatattttctttaatctgaattacttaagatttatactttagtccctttacatatcatttgatgtctaagtttccttttatttttgtcttttttttattacgtattttcctcaattacatttccaatgctatcccaaaagtcccccacaccaccccccactcccctacccacccattcccattttttggccctggtgttcccctgtactggggcatataaagtttgcctgtccaatgggcctctctttccagtgatggctgactaggccatcttttgatacatatgcagctagagtcaagagctccggggtactggttagttcataatgttgttccacctatagggttgcagacccctttagctccttgggtactttctctagctcctccattgggggccctgtgatccatccaatagttgactgtgagcatccacttctgtgtttgctaggcccggcctagtctcacaagagacagctatatcagggtcctttcagcaaaatcttgctagtgtatgcaatggtgtcagcgtttggaggctaatcatacctgtaaaaaacaatctgacaaatttcaaatttaaaccatttaatacatagaatttaattattccatctatactattactttgttattctttttttgtagctattgactgatgatttaaatatgtcactgatcttaatatttaaaaagcacagtcactttttttctaatggctgggagtccgctctctgtttcattttcaccagacagtggtttggagaatctctgtgtttcctttccatttgtattaagtattctgccttagataacttatgttaaaaggataaataattacaacattgaagaagtttcaaatcaaatgaagagcatagtaattttagcttgttctcatggtataggagaaaatttcatgtaatatgatagtgcctcttaaagcaaaataggatttgaatttaatcttagactggaatgggagatcatatcttcttccttaacttccattcttttcttatcttccctacttgcaaatatcccatactccagacccgtagagttacttcataggagctacctaggtagggttcttttcatcagctagacaataaggcatgagaagactcaggtccctgtgggttatatacagcacagtaacttccctgtcaacagacactctattataaatactgttagaaatatcagaaatgtgcttgatggccagagttgtcaaaggtaagagtacagtgtaatgtttcctgttaggaaattccatcaacattctttgagtattctccattcttgtttctaacaattctttcctataagaaaagtctttaggcatgaaccagcattctaaaaagcaaatgagatttttttttttttttggctgatgtctctcaatataaaatatggcctttcaggtgttatggtcaccttttctttatagaatgtcagcaattcaaaatgagtaaaggatatggattaggtaagaattgaatgcaaatgcgttttgcaaatagtgctttttgagataatcgcagatgatggttcaatgctgacggtattaatacaatcagtatttaaccttgtataactctgcttcatcaagtctcgccctgcacattgattgcattaagccaggtcagtggtttcttgcttaggaatatcttagcagaatcttaacaggaaggcagcagtagctgatcagctactgtttatttgcatactgagtgtgtcatcaataatagaaaagacaaggtctttaagttgaaagaacagtgggattggcatgaattttgcttaatggtgcgtaataagcaaagaagcctgtgatgctagaaactgacaggagccattacgttaaaacagatatatgtctttaatttaagggtattatgtaaatctgacaggagtttttccctttattttcctgtagtttaactttaattgctgtaagattaattctgatttctctcatcctccagagggtgatgagacgggagtgatggataatcttctggaagccctacagtcaggtgcagcattcagagaccgcagaaagcgaattccaagaaatccaggtaagacccactgtagcttacatagtctggtgatatgtgaatattctatatcaaatccctcttccataaaaggaaagtgtactttctcagaaacatatttcagttgatctctggttatatgtggaatctgagtaggcccctacaactaacaagtttgcaagttttaaccctgtaaatatatcttatacactgtgtactttaaaaaaatcagaaattaggaatcccactgtgtttaatattaaatattttaattgttattttatgagcatggggcttaggtagaaggtgattaaaaaccataaacgtaattaaatcattaaaaataattgactcaagagtgttatattagctcttctccggtaaggaaactaagtcagtgtttgtttctgtagttgagttttggttttcactatagtgtgatgcccggtattgttaatagtgggagaatcgccatgatcctcaaaactca

SEQ ID NO: 733 - DNA, 578707 bp, mus musculus; identical to SEQ ID NO: 732

SEQ ID NO: 734 - DNA, 342 bp, mus musculus
tccctgtcccagcgaaccccctccctgcctgcaccggctcccaggcctcgcgggagtcggccgccgccgcctcgccctccagggaggcggccgcctttaccgccccagggcttggggtgggtgacgggagtgaggacaggagcggtagctaagcgagcaggcctggagtggggggacagaggcggcgactaggggaaggtgaaactgccgctgcaggaggaggagcaggaggaggtgacgcaggagaaacgcaccgcccggagcttgtctgagctcagcgcccgagcctgaggggagaagggggaagagggctgcggccggccgagagggaggcggcggccg

SEQ ID NO: 735 - DNA, 260 bp, mus musculus
atcaggcccgcggacgagttggcctcctcgccgccctcccgcgataacccgcagtcgctcagcggcccagtgccctgagaaggccgagccggttatcgctcccccacacctccctcgccccctccggctgctcacggtgggccaaaggcccggaaggatgttttgatgccgaaatcgcttccaagcgacagtagaccgaccacctttgtatttttagctgttcctgaaggaggaggaaaaaacgaagacgaagaaaggaa

SEQ ID NO: 736 - DNA, 330 bp, mus musculus
aactcactttgcagaccaggctggccttgaactcagaaatccacctgcttctgcttcccaagcgctgggattaaaggcgtgcgccaccactgcccggccaagagcaagtactcttaactgctgagccttgatagttcctttacgatgaattctgcaatgaatctagtcttttgtttattttttgtttttcaagacaaaagagtttctctgtgtaacaatcctggctgtcataaagcttgctttgtagtccagtctccgagatctgcctgcctctgctttcccaatattgggtttaaaggtgtgcatcaccactgtactgctaaacctagt

SEQ ID NO: 737 - DNA, 106131 bp, mus musculus
gtggccagtagtttgcggcatcgggaggaggagcagcaacagcagcagtagcggcagcggctggctgagaggggagacgggcgagcgggtgcagacggcagcaccagctaccgctcaccatgcccggcttgcccagagggcactggcattcacttccctagcccctcgcgggctgcggcgcagtgtcctccctggctttccagctgagccgattcatctgagacccgaacctctcgccccaaacccattccttcctgctctccccctctctctcatactccacattcgcacttcccatccacacattcactcttcctctctttcgaacatccacgaacagacctcccctgcgcgcgagcgccggggagggaggaagccctaagcagggctgatagcgcttctcctggaggatgggatccagaagctcccgcaagtaaactttggagccgacagaagccctcgaccctggcagctgcccaggcggaccccaacaacatgcggctgaactaaggagggctttctttggcggcggcggcggcggcggcggcggcagcggcagcggcggcagcggcggcggcagcggcggctgctgcggtccttgaagctacaccccagcccaaacccaggaaggcaaagaagccccgggtacccgcgactgcagccccgcctcttctggccggtactgtagtagcttcctttcttcaccttcccattccccgtgtcccctcccccttccccggggcaattggaaagagcaggactttgattttcttggacaaattgccatcttcccgtttttagaaacttaaggcggaggcctgggctgcgttggcaactttgatttccgagatataaacgcccgcagacccgcaactgctctgtgggaggaaccctgcgcccacctcggatcctgggcagacgcaccccccaccccacgccctcggacaccaacctcagcgcccgggagagtgctctcgcatctctcccctcccccttcctctgcccgccccgggacagccctccagctctgccaaatccctgggagcccacggatcttgccaggaactcagacttctgcctgcgatcccccctttccctctaacaggccttgaagaggccagagggccccccccccccggatcccggagggtgcgtaccaggcgggagctccctccgcagtgagctgggcgcgctggggggaggtccttgcgcatgccaggtgcacagactgcgcgctcgcctgccccagtgccggtgcgctgcggcgggtccggcagtgcctgagaggctgcgcccccacagccttccacgtccgcgccccgagtccactaccgactctgctgcttgtggccctctggggcgtgcgagcgccgctcgaaccgcagccctgcgctgctgcggccagtcccgcctggctaactttgaaaggggaaaactgagtagccgggctggagggagggggctcggggctgcgcggcgctccctgggcaccccggagcccccggccccccagacagtctctgctgagaccactgcaatctcagcattggagcctgcgcgggttcctcccgcgcgcctccgggccgccctgggcgggactcctcccgcggcctccggggccacggggcgcgcgcaacaggcggcccgagccggcgggaagctggagcgccggcggcgtcggtctcggaggggtgtggagaggcgaggcaaggcagagccccgcgcagccatggagtctctcctgctgccggtgctattgctgctggctgtactgtggacgcaggcggctgccctgattaaccttaaatactcggtcgaagaggagcagcgcgccgggacggtgatcgctaacgtggccaaggacgcgcgggaggccggcttcgcgctggacccccgacaggcttctgctttccgcgtggtgtccaactcggctccgcacctggtggacatcaaccccagctcgggcctcttggtcaccaagcagaagattgaccgagacctgctgtgccgccagagccccaagtgtatcatctcgctcgaggtcatgtccagctcaatggagatctgtgtgattaaggtggagatcaaagacctgaacgacaatgctcccagttttccggccgcacagatagagctggagatctctgaggcagccagccccggcacccgcatcccactggacagtgcatatgacccggactccggcagctttggtgtgcagacctacgagctcacgcccaacgagctgtttggcctggaaataaagacgcggggtgacggttcgcgctttgctgaactggtggtggagaagagcctggaccgtgagacacagtcacattacagctttcgcattacggctctcgacggaggcgacccaccacacatgggcacagttggcctcagcatcaaggtgaccgattcgaatgacaacaacccagtgtttggcgagtccacctactcagtgagcgtgcctgaaaattcacctcccaatacacccgtcatccgcctcaatgccagcgatccagatgagggcaccaatggccaagtggtctattccttctatggttatgtcaatgaccgtacgcgtgaactcttccaaattgacccacacagcggcctggtcaccgtcaccggtgcgctagactatgaagagggccatgtgtacgaactggatgtgcaagccaaagacctggggcccaactctatccctgcacactgcaaagtcacagtcagcgtacttgatactaatgacaacccgccaattatcaacctcctgtcggtcaatagcgagcttgtggaggtgagcgagagcgcccccccgggctatgtgattgccctggttcgggtgtctgatcgcgactccgggctcaatggacgtgtgcagtgccgcttgctgggcaatgtcccctttcgactgcaggagtatgagagcttctccactattcttgtggatgggaggctggaccgagagcagcatgaccagtacaatctcactattcaggctcgagacagcggtgtgcctatgctgcagagtgccaagtcgttcactgtgcgtatcacagatgagaatgacaaccacccacacttctccaagccttactaccaagtcattgtacaggagaacaacactcctggtgcctatctgctctcagtgtctgcccgcgaccctgacatgggtcttaatggcagtgtctcctatcaaattgtgccatcacaggtgcgagacatgccagtcttcacctatgtctcaatcaatcccaactctggtgacatctatgcgctccgttcctttaaccatgagcagaccaaggcgtttgaattcaaggtcctggccaaggatggcggcttgccctccctgcaaagcaatgccactgtgagggtcattatcctcgacgtcaatgacaatacaccggtcatcactgccccacctctgatcaatggcactgctgaggtctacattcctcgaaactctggcataggctatttggtgactgtagttaaggcagacgattatgatgagggcgaaaatggccgagtcacctatgacatgacagaaggtgaccgaggtttcttcgaaatagaccaggtcaatggagaagtcagaaccactcgtacctttaatgagaactccaagccttcctatgagcttatagtggtggcccatgaccatggcaagacatctctctctgcttctgcccttgtcctaatatacctgtccccagctcttgatgcccaagagtcaatgggctctgtgaacttatccctgattttcattattgctctgggctccattgcgggcattctctttgtcactatgatcttcgtggcaatcaaatgcaagcgtgacaacaaagagatccggacctacaattgcaggtagagccaagttttctttcttttcttctgtgttttgagtgagtaagatatgtgtatttgtgtcggtcggtctaaaaaccccagtgcttttgtttcctatttaaatgcatgcagcatacccacaatgcttctttgtggagggtgagaagtttgtgacagtccaagttgatcaattcttttgatctgacaatttgctggaagacaatcatttactgtttgaatggattttgtcacataatgatgatgagcagaaaagcaattatcatttaaaattttcacagctgtctccaatgaagttaaggtagaaaaaaatgagggggaaggagggagaatcaaggagtgagagaggagggagggagggagggagaggaaggagagctcaagagagacggattttcctatttgtagcaaaagttctatggggtcatggttgggagggcttgctttcctggaacccagtgttttgcagaggagagctgaaaggggatggtgtactggcagctgtcttgtcctgctgtagggttatagttcacagagagagagctctgagagtttatgataagaaacggagaggaggaagagagagagagagagagagagagagagagagagagagagagagagagagagagagagagagagagagagagagagaaagagccctgtgcaggggaagcaggtcattagtggttttgagtgtattcttggcttgttttgtatctagtccccagacatatggctatacaaagtaaaattctattaggcatctgtatgttttcaaatatcggcttggttggtgtgtgaagaccaaacatcccaatgagaaacaagactttgcatccagatgtttcagtaaaaatagcaatcttctggagttggctatgctttcctttaatgtggaactgtgctgtggcattaagatctggtccctaccagtggatgtcactatgggctattgtgttacagtttctctgaagtgtgtgtaggatgtgcgtgggggtggggaaacaagaggagaggaaaaagaagtagaaacttgaatagcatgtaatgtagcatttttaaagtcttgattaacacattagaggttcttgctgaagacttccttgcgatttgattgaagaaataagtctaagaatttctagaatcctatttaggataatgcacatattttttttccagcagtgtctcatcgaaacagttgaaaaaagttatttttatttatttttttactttgctgaaaatgaatgatgctgctatttccagccaaggtgtgtgtgtgcttgtgtgtactttcaacacacctacacatactgtatctcgtaccatctgtgcttgcatgttaatcagtcaaaatatgttcctgtaggtccgatttgtatctgacaccatctgaaatacacacgtctgtgaatcagagctccctgaatatgtaacagccatgcaattattgtttcccttttactattctctgcattacacaagttagtagacaaatgctaaccacacatgaatatcaatcaggtgccataaaagagcagctgcaatgcctcataaatgctttaatcctgttactactgaaatggccatgacttttctttccttcagtaccaagtcacttcagatgggagaaatggaaattaatattgctcttacctttgaaacctgtgacagccactggcgatttttataggagaaaaatgcaggctcaataaaatttttatttatatggagataatgacagaggggactctttttaagccattttctcagcataaagtaaatgcataagacccttaccatgatgaaaaagaaatcagcttgaagtagagatattgaaggctttgccacttcttggtgatatatgactagaagtaagaactctttctgagagcttgccaaggagatcattaaacaaggaagaacatttgaattgagaaaaaaagtgcaaatctcagtgctctccaacttcacccaaatgtgtattttataaagcactcttccttgtgatggcttgcgattagtgaagtacagtttaattaaataattggtcaataccgaatgggccatgcattgaatgcctctgctgaataattggatggggcattgccaaacttacccatcatgggtaaacaaaatgactagaacttcccattgattcagtaaacagattagaaaagaaatgtaatcctagtcctgaagtttggggaattttatctgtcccttggcctctgtatcaccaatttgccatcatttcaaggcagactggacagagagtaaaagggtgaggtaaagtgattgcttatgtctaggtagatcctggggacagagcaataatttgccttggtagatatgggtaggtaggcaaactccccatctgctcagccttcttagaatcacaaagttcaggagaagcctatgcgtctatgtgattaggcagggttttctagttctgaaatgcattcatttatgagacttgtgagttgatctgcaattgctgcttgtattgggctcctctttttgtattctgacaattagctttgtcaagtgagagaatacagacacattctttcacttgtaaagtccaacctgtattctttattatccttattgttttgctgattattactcagagattgaattctcagacaataagctgaaatcattatgtgcaaagtaatacatgacattgaaaatctgactaccttttaacgtatttcttttgacaagtctcttaatgcttggtgtctttggtgcacgttcctgggtctgtgtcagtgttaattaaattgagctttttatgttccagttgcagcacagctgcttgtaggtacacctgaatggagaaggatgctgaatgcactaacctttaaattcctttgcagtaattgtttaaccatcacttgtctcctcggctgttttataaaaggacaaaacagcaagtgtctgcattgcatctcggtttctcccaatagtgaggagcaagacaaaaaggcagaggagaaagtgagcctaaggggaaagaggtaaaaaggcattttcccctcattcaaatgggtttggctatcagatttctctaggagaggagggggaagggtggaaagtagaagggagctgggctagggcagggaggagggtgtgggtgagcagagttaggtgctcttagaggacagggtgtgaacctctactctagtctaaaagtgatcagtttaatgacagaggaagctgattcatggtatttgccacattgcaaattcctggaggcattggcaagggtttttcttaatcccctccatctccttttctgttaaattggcacttactttgtaccttacccagtactccctttaggttccagggcagcatcagatttgagcattttcatgctctcccccataggctcaactttccccaccctcacccctgcttactggccactcataaggaaaaatttcaaattgaaatatgaaattttctttgggaagggttggtgggaggcgggaggttagtatgtttaatatgcaaacttcatggccctcagcttgttttcgcatgcaaaaggcacagggagaaacacgatgatgtaatgcgccagaataaggagctggagcagagatggggtgcaaccctctggggtacttaatgtttattcgtcagtacatggtctgggaaggtgttatctattcgtgctgccttttctgtcacatagaatcgctgagtactcctatgggcatcaaaagaaatcaagtaagaagaaaaaaattagtaagaatgacatccgccttgtacctcgggacgtggaggagacagacaagatgaatgttgtcagttgctcctcccttacttcgtccctcaactatttcgactaccaccagcagacactgcccctgggctgtcgtcgctctgagagcactttcctgaatgtggagaaccagaatacccgtaacaccactgccagccacatctaccatcactccttcaacagccagggcccacagcagccagacctgatcatcaatggtgtgcccctgcctgaggtgagtgcagctaagtggttcggtgggggtcttcccagatcttctagagctgcttactatcccatgggacactctggaggcacatcccttgtctaagtccattttcacactcagcatttgctaatagccctttttgggacgaagaatagttattcaacatagagggcgtttgtgtaaggagtgatgttgggaatctgaactcaaatgatttgagccttgatgtgccttcataatgtcccaacatagtaaaagattacttcacctgttgctgatacgcatgctcaaaagccagtactgccagcttggagactaaagcagtttaggtttgccaagcagtattgaaaatgaatgaattcctttttcatttcattttcctcctgtggttcggaatcctaaaggcactccaagtttggctcttttgttctctaccatctatcctgctgagactatggtcagtaggatacaagcaataaagttttaaaagtcacattgctggtttttagccattctggtaatgtttgacagttgagggggttgaaactgttactaacatgaatattgtatgaagcagccatgcatttgaattaactgtttcccttcagtttgggtgttttcctggaggtttttttttttttttccaaacacaatatggccaaatgtttgttggttattgaaataatctgggagactagggtgatgtgccagtgatggtgatgaggttgggggaagaggaagctataaacaagtccttaagttggtttcattttctatgaagtgcttaagtccctctttggttggaaatttgttaatactgggagacatgctctctttctagtcactctgaaagctattattcctgtagatttcaagtggacttcaacagtttttcagggtatttgtataggtatcatctcattagaaactggcaattgtttatcttgatagagtcctccctggtgagagataaaacaaagatttagagatgctgaggaacttgctcagacccagaaagcagatcacaccgaacgggaggagtagatcaccttgctctgtacttcctaagtgtttgagtagtacttcctgcctttgcaaatgattcagactgatatagctaggcaatcatgggaacataaaatgaactcattgtttgtatcagttttgtagggcaaaaggtgcttaggtccatttacattgtttcattgcatctcttatttcctcgaaaataattcctactagaattaaaagcatggaaaatgaagttttcttttcttttttttaactgagcagctcagccaaagcaccagcattttgagtacataactctataaacaaagagttattgaaagtctagtgttatgtcaagtaaattcagttctaagtattaaagacccttatcaaggctagggcctcataaactacttagagagatactgtggacctctaatagttcagcaatggagatggagaggtaaggctttgtagtggattcaaatagatcatgattttgaattaaggtatcaccttttaccatggaaacctgttggatcctctgtttcttcatctaaaacaatgggtaaattattatgggaacttttcaaggaaaaataaaacattacgaattgtaaagagtgtgtgatttacaactgtccctaaaaaggtagaattttgttttaattgaaaattgaagaattaccattggcaatggactattcacttgagcatgtctctccagtctctatgaccaaagaggaatttaggctggttctatgtagataataactacacaatgctgtaaccagactattgatttatagtaatccttgaacaatgaagttgaaaatgctaacattgtgtatttggttgctggtttgttattgttcaggaaggtggacaaaagtattgaattctaaagatttcatgatcattttacaatcaattcaagttcctgagaaaagagagccatgctatctattgagtatgtgagagaaaagggagatagtaactatgatttcttggttcacctaataccttggtgtcatttctgagtttctctaagggcaggaaaacacggaatttcaggaagctggtcttagttttgatgctttccctgacattcaaagccagataccctctttgtccaacaaaagtgcactgatctggtgtataaggttaggctgagattttatgtgtattacccagtccatcatcctagaaagttcatagtcacgcatccgccaagatgtttaacctgtatccatcatgaagttctacatagggaaaacagtacttctctttttctttcgtattagaaacccctgagcttttattcaactgacatttgttcagtgtgtgttccttataagatacttctctatgttctgtagctccagagacaaataaaaataataaaaaaataaaaccacaatgaatgcagagtctaaagaggtcaacatgtaaacaggtagccttcatgtgggatgttaagtgttactcttccgtgccatggaattcctagaataataatgctctgatgtatttcctacctttataattttcccatttattaactaatccatccaagaaacaattcacttatgaagcaattatagtacagaatgatacatgctctgatgtagaaagtagatgattctatggaaatttctcttaagtcatattatgacgttaaagttatcctttatattatttcatgaaactatttctatttgttatttaactcaacacactagcatttattgcatgtatagaacatgccaaatattgcatctgctgtttgttagtgatgcaaagataaaacacttgatccttgacatcagaaagcttaaaagaaaaagacaattcaattctaattctgaatggtgtccctttcctaagcatatgatgtgtgacattctttctcttcagattgggaccattagattcttctgctgtgttaccttttatgacacacactctttattatttgaacagtgataaagcttatttgaaatagcaattagacaagtacaactcagaaccactgtgcttgccccttgctccttccaactccacttcactttgaaatggatcaccactgtattaaatcaaattactaagtacttttataatgttcaatgtccgcagctgtgtagcagatagcttgtagattccaaatatgtgtaagaggacagaaacttctgctttcagagtgttcacagtgtagctggggagccaagatcattcaaaggattcaactgctaaggaggcaacacaaagatagccttaatcacctgttcctttgtatgctacttagtatttctccttccaaggcaaccctgatatcatttttatgtaaatttgctgctgagctatctaggcttggagctgaattgaataaaggtggcttttgtttaggtggtgtggctcaaaccaagagctaagtgcttgctagtcaagtgctctaccactaattacccttatccttgagggtgacttctttttttaagtctgcaaacctagttacctttgaatggtgtcaggtataaggacctggaaatgtggtgttgaatgtgcttaggtggggttaggtaaagggattggagcactggtctagaaaattggaatttcttgtactgcagagatagcctcctatagaacgagaaatgaatattttcctgtcttctgctgttgcttgggatgtcagccacagcaattttaagattttgtatacaaatgtgaggaggtaaagtggaaggtgtctttactgtttgcagaaggcttttgtagaattagtgatgccttgtaccttttaaatattttaacttcaaaggtgaggttcacattctttggcatcctagtttatatagcttagagagtttatttgtaaatgagattgtgtgtgtagctgtgtgtgtgtgtgtgtgtgtgtgtgtgtgagagagagagagagagagagagagagagacagacagagacagagacagagacagagagatatacacagagacagagagatcacacacagagacagagagaacagaagaaaaaagaaaggaatttgaaaagaagaaatatattaggttttcttagtttggtaatattttttctgaatttttttctgagaatcccttaatgtgccaggtttttttattccgtctgatattatgtaaatggaagcaggaatagtgggtgcttctgggtgctaaagtatgtttgttacttatttgtacattagtattcttgtattgcccttttgctcagtaggggctctggtcattagaaggagcaaatagagctcgtgtttttcctataaagaattgagatttgggtagtctgtctcttttcacattcaggatggttgaatagtccaaatacatttaatgttttgtgagacattttcaaattttagttttagatgctgaatggtttgaggctgacaattctgcatgagggaaatgtccataatgtctatagagatgcaagggatttctgttttggcttaccctcaatcttgaattttcttttcctttttcttttttcttttcttttttcacttgaaaccatttggtggcaaactatagcatctttgatgtgaaacgtgtgtgtgtgtgtgtgtgtgtgtgtgtgtgtgcgcgtgtgcacacacacatgcatgcttgcttgttttactccagttgtttgtgaaacaaatttttaagttgtaatgtagcagaggaagaatctgcgaacaggggtatttgtggcaggaagcaaaatgactgcttccagttgtcctacaaaatgtctgaattcatggccatgttatggcagataaagcaaaaaaaaaaaaaaaaaaaaaaaaaaaaaaaaaaaaaaaaaaaaaaaaagaaagaaaaagaaagaaagaaacccaccatcaattaggtcttgaagaaaagttaaaaaatgaatgaaatatctcagcattctttgttccttaaagcaaagaagttaggaatttgcaatgacttgagaaaaattttggatatggataaccacaagccaatcagacagacaacagatccagaaagggatagaaacctagtaactatgatgaaggttgcttggctagtatggataccacacagtgccacttgcagttttagatcactaaattctaaatttacatcactaatgctaaaaccaataaacatttccttcagtgaacttagtttaaaaaaaaagacgtttccttgttattatgggatcttggactcattgaagtcatatctataaaggtcaaaagaaatcccgaggctgcaggatgaagtaccagaaaagaatgcattccggtaccacctttggctttcttcaaaactcaagggctctacttctactagtgggtattcttgggccacccattgcctgctgtatgtttactgggcccatttgtttcacatctagctgaggtagtgcgtctcccagcgggcatcagctagcaagatgtgttccagaataaactattcctctgtcgtctccacgcaactgctgcagaactgagttagtttacattagtatttgctaatttattattatcattccttattggcaattaactggttacctgagagatcatctctctccctgtacaccttcactaaagttgagcttagccacagtgcttgctaatgatcctgagttttttctcctcagggatctggaggcaggacattttccagagaaagctctggggctttggaatgcctcttatcacaggaccattgtggtcgaatctgcttttcttttgttagtcagatttaccaagtgaaagggcagtcccctttcctccttaacttgctctgctttactgttgaatccacatactgggcccaggttgatgtgaaacttgacgtgtagcagatagcttatcaggagttaaagggatgaaaaaagtggagtttcctcctggggaaaaaaaaggacagagacagagagactgaaagagagagagagagagggagagagagagagagagggagagagagagagagagagagagggagagagagagagagagggagagagagagagagagagagggagagagagagagagtctttcatttatggccctgcagtatacctgcaggtacctgcttggactttcagatgttgacacctctgcttctgagtcttactttccgtggcttagggagaccgagcctggctggatagtgtctcagatgtagataaatcaaggcatcggtctaagagtgctgtatctgagaggtgggaggcttgtgctggagcagccatttctccccactgagaggagactggatatcttgatgtgtgactggctggcctttaatgtgtgcttcatttacttcaaacaattgagaggtttgaagtgaaagtcccagagggtcagttgtttgcagagggaaatgctcttcaagtttcatttcctgttgagtatgaggagtgatttttgtgtgggctgcttagtggggtcaccagcttccagtttactaatgcctgcttgtgtctcccagtggaatgatgagcaacaggctggtcaccggcttcccgagaagaagctgttttggctttcatttagtgttttgcttaaaacattggctgtgaccacaaagcgccatagaattcttgacgtagttcttagaagggactctatggtggtgaaaatgtggttacagcaaagcaaatgtcctggacttggtgggtagctgtgtcatcatggctccagggagcctgatgaagaagagtcccaaattttagcccagcctggcccagagtgtgaattaaataccatcctaagcaactgaactgaattctcatctcaaaatacaaagtaaaactacgtatgttttactgagtttgtagtccacgggaatacgggagaccatctcttcattgcacagtacctcccaccccaaagcaatttgcccatgttcatagatttgtggccatagtagacgcccaggtagctcttcagcatccaagtgcattctcctttagaatagaaaaacacccatcagtcctctctgggaggatctacagataaacctttgttgggaggggcattcctgaaaagctgatagaaggtgagtgtttgttttgcaaattagaccctttgttagctaaccctggtggcctctgtgtttaaagaagcccgtggtggattccttctaaaggaaaggatcctaaccgaatatgaacatcaactcttaaatgatttcctttggaagtctggaattttacctattttgtttgttcaaagtggggctcatgaccctggtaaggtttacatgagcattaaaagctggggtgaatatccctgattcccttgggaggtaagtgaccctagacttctcactggctaatttctggttgagtttcgcttaattaaaaatccagttgtgtaaaagggtaaactatatagagtccggaccagaccgattcatgccatttacatttaacaaatgttaatatttatttgctatggatctaacccactgaaataaaaatggattgcttccccaaatacagacctgtcttttccctcccactacactctttctaagcctatggtacaaaactgccaggaatgcttttagttctagaagagacagtatctcttctagagttagccccccccccctttttgatgtaggatgtaaaagcttcttaggtcaatggggatttcctgcattgagtacagcctagaaattactttgaaatatgaaagaattccttcataatttttgtttaaattgagtatttgggaagggagagaatggattttcagatgaaaggagactggcgggcggacagataagtgttaggagcagccacatgagacttgtgcatatttgagacttaaacagacaagaagtttggtgtcaggcctgtgtgcttcgtgagcctggcattagtggactagaccagagtttcttgatgtcagatgcttaagcaatgtcttcatgtgcatagtcttctgatgctccattaagcctctgagtgccagggtggccagttttcagcttctcccactgggccccatctggttgttgttctgtggcaagctgctctccttcagcaccaccagtaactagccttggcggcctcacattttaagattgtttgctcctaaatctgatttccagagcatgaagggcacctttttacggattgtactgtgttcttctggacaaaatggaatccttgtgtaagctgggagggagaaaattttaatagaaatgttagatccttctttaccctgtgtgtgtgtgtgtgtgtgtgtgtgtgtgtgtgtgtatgtgtgtgtgtgtgcacacgtgtgcatgcacgtgtgcccgtgcatgtgcttgcttgtgtgcctgtgctaagagacacatatatgatttttaggtcatcagagctctctcttcatcattctcttatcctctgctaattgcctatgtgagaaagtcaatgctattgccataatgtgaggccaagggaaaacctttctgggataacttttaattcagaattttgaatgagaaactgtcaaataatcactgttgcatgcagatgtgaagctcagctaaagtatatcctagagtgactgtgtttaattctttggaaattatttcccgaggactgttgttcattttgtcgtttttttggagtttatctttgtttaaagccttcctctctctcattaattcccatggtttgatttgaagaagtctgactggtttagcctgctaatattcataggtaatttgttataaaaccatttctgatgaggatgcgtgagtatagggagactgcctgcagtcagagggattggtttaacccttgagcaatttttttaataagtaaaaatctctgtgctataacattaatatttgaaatgtgacacctgggagagtgtggatgcatttggctacaggtaccacttaatgacttattggaagactccttcttggtgttaccaaccacagagactgaggtgaagacatgtgcactctatgcttataagactggcattgcttgtaattttttggtactgatcacgtcttcaatcagagctttttcattttctcaaggatagatttttcaagtgaccgagtatgttgatggtcacatttgttcctaagagcttaggaacgagaacatgttgacatcagtattaaataatgatgtttccttttcatagtgggattttacatgtttttttttttaaaaaaaacgatttaaagtagctactgtgttttttgaaacaaatatcaaattttacagaagaaacatcaattttcttgcttgctattgggatgtgtgttcttatacccctagatcactcttttgaatttcacctctactggtatttcctcagaaatggaaagggggagggtgtgcttcattgaataacagtgcaatatggggatgctcgaagtggaaagaaaatgaaattgctttttcacaaactatgcatcgtgtggtgacatgctagagaaaagttgttagaagctggcacgctatcaaggatgtgatgttggtaattattgcttggcatctagatctgatcatcaggtaccctcaaggccagatggtggtaagtggagaaaaatctggaactgcaaaggtttgtgactatacactctcatagttgggggcacctgatacaaatgtattggaaactgacaatactttgccctcctaactctgtgagcctggaaaactccatcagtatacttctttctagaatgtgactgaccctgagccactgtatccccaatgatgatgccctgcaatagggactagtttctctagtaaaacaggtgaaaacaaaattcaaatcctcacaaaaacaacttgcttttttgaaacttcttattagtaaggaattaagaatctaagatacagagccgggtgtggtggcgcacgcctttgatcccagcactcgggaggcagaggcaggcggatctctcagttgaaggccagcctggtctacagagtgagttccagggcagccagggctacacagagaaaccctgtctcaaaaaaaacaaaaaaaacaaaaaaaacaaaaaacaaaaaaaatacaaaaaacaaaaaaaacaaaaacccaaccccccaaaaaacaaaacaaaacaaaaaaaccccccaaaaaactccaaaccaaaaaacaaaaagaatctaaaatataaagaattttgaagaatccaaacaaataccaacttataccaaacctgaactaatatgaaaagggactggactggtgaatccccagtcttcccttaactcgtctcagggcaattgtatggagttctgcagcaatggtttaaagacctatataaagctgattgcaccaaggttggagtaatgttacttttgttggttgtattgaggacaaggggctcagctatggccagtgacagtgtaggcatggctctgtagcatttaaatgaagatagcatattctatatgatcgttgatgagtgcatcatttaagtatgtctttcagtctaattcctatttttccataaaggcagaaatgagtgcccccatctccttttacttagcatgtacttgtttgttctaggatgaatcagagatggactcctcttgcctgatcaaataggactttgcagaaagggcagattcctgtatctataaattctgttgatgattatcaccctacctaaaaattcataagctgaaagccagcaagcttttcttctagagccagctattcctgagaaagctttattttttgtaaactgataaaatatctaaccttttataccaacaaaaaccaacagtatggaaataagcaacttttattccattctaaggacaatttaactaaattatacaacttctaatacaattgtttgaagcttccacttgggaagttttctcattttaataccttgcagctgagataaatattttagctacgtggtgtgcatttaacaatatgtctccccaattgtcattcttcctgggatttgttggcatgatcggtagttcagcttggctttgctcattttgttgtttgctatagatgatcaacaaagagccagaattcaataaaaatgtttttttttttttgtggtgttatttttaatttcagtccctaggaggaggctaacttagccttgcagaatcaatacggggcacttggggtttacttgagagccaaaatattaggtagatttttctttcaaactggatattattccagaattattaaaaccaatacatgtaggaggctggtagattgcattcagcaggacttgggccattgtttgcagtaacacaacctatttcagagagtcagtgactacttcaggggttagggaagttagtggataacaatgtggaaagtggtgttctactgaaaacctcgaaagaatcattttcagtagtcttttgagagacaggtcagttgtatatcattccttttgtacaatgtcagctgtttattgactatcttttgctccagatgagtttagctctttagtggttaaagatccctacttttacaggatattcacttgttttagataaaatgtggcctgctatgatgatttgcttgtatagtttagtgaatggaagtactgtttagtagtcaagatttttttcaatttgtcttgaaagcatgtatccattcaccaggcactaaatatttgcaaacgttttttcttacccttcttctactcaacctggagaaatagagagaaaggataggaagtgcttacccccatagcttagatgatcagatgttactagatagtgctatgtagttggttgacaattagaaaaatatttttaaaaatacacatgctgagaaaagattttatatttatatagcaattaaataaaatatatttattaactttgttttagagctttattggagttatttggtaaatggaaatcttacatatgtgagggccagaagttggtattgtggtgtctatacatgctgtgaaatgatttccataatcaatctaatatttccaccatctcatatatttgtcactttaaaaatagtgagaacacttaagttcctggcaattgttaagagtacaatacagcattgtcagctacagtgactcttctgtatagcagacacttcgagaacatttttatagtcaaagcttggtacttcttggttaatttcttcctacgtttgctaatcccaacctcaagcaactaccattctgttttgcttctatgaattaaaaggctctattttattaatccattaacccttcaaatatttgtggaatgcatactacatgctggtcactactcaaagcactggagctataaacgtgagcaaaagacacttccagctcccactgaatttgcatttttatgagtggaagcaaacaaacaaacaaacaaacaaataaataaaaatttgatggtcatgcctaaaattaagaaagtataagtcatatgtcctagaagcaggactattttaggaaggtaagagaagatatctcagataaagggacattgcaaaatacccatatataaaaataactgttacaaatcaatagaaaggcaaacatcaagatataaatataagatggacacaaatagggaattcatagagaatctataagatgtcaatagatgtgaaaatatttcaattttagcaatcagataatagccatggcatatgaaaatatttcagttaagttaatcaggtaatagaaatggaatgacactttaatttttaattgcaaaaatgatgcatgcttcttacttaagagatcaaacaatacagaagtgtaaaaaatataagctaaagtcttcacaactgtatccccacaaacttatcactttaaacagttgcagagagtaatttgataagcaagatttcggattttaatcgttacattaacaaaatgtataaaaacaatactcaagggtgctaagggtgtgataggatatactgcaacatagagtataatcagtgaaatgcatggctttcttgagggtagtttggcaatgtacattaatagccctattgtgtctatttctacttttggaatttatcataaggagagaattttagatttgcattagaatctgtggtgttacagtgttaatctcagtataacttaatagaactgagacattggaaatatccaagtatcatcttacatgaatgattaaatgtatacacatatgttagaatagtgtgaagatataaaatagttttctgaagaatattagtgatagaggaaaatgttcatgatgtatattaactaggaaaaaaagacgtcagcacatgcacattggttccatttgttttgaagctgagagacattgagagagaaaagcaaaggttgctaccacatattataatttatctgaatatacaggtgtatattgtaggattccccaaatcatgttttatatacacaagctctccctctctctctctctctctctctctctctctctctctctctctctctctctccctctctctctctctctcctgattttctagattttctatatttatttgaatatgcaattttttggggaaaaaccaattacttaaaaaacataactgctagactgtacagtgagtataaaggcccacagagatgacatagacagattgcataagttattttgaggaggcctagaacaaatacattttttattttccttttcaatcaaattttggcagttttcctattatattccttgtcttggagttttcttccaattaataacaagcatcaagtattacatttaaaactaacactttcctttaacgttcacctttaaaatgtgagaaatagtgttaggaaaaatattgttcttcgtctgtacattcttgtaaaagtagattgctctcatcagcttgagatatctgctttaaaagctttaagtcttatttttagggtaaggagctttaaaatagtaactgctaactgcaacctgtacacgcttctaataccatagagtttgcactttaggcaaagagtttgtcagcaatctttttagtactgagtggacagtttgtggattttaaaacaaattttgtattctgtattgtttgttttcatgcccctgctccttaagtctgagactaacacattactttggtatatcttggtagccgaacattttcatacaagaaggagggggttattaaattagttgtcattaaagatggtgaaaattatgaactcaactatttttcaggaaggtaaaatggattcaacccttttaagaaaagtaaaatcatttgagtgcttccttcactaacagtgcagttttgaacaccagaaattcaaagcacggctttcttttgaacacttgttttgttttctcacatggcaagcactgcatgtaaatgtaaactctttatttcagtggatctgtatagatgaacatcaaaatgtggagatattgtgaaaaaattgtcttggaacaaagaaagcacatacagatcctgcacccattacatcatagctagaagagaagcctgcaagggagcgctctgattatgaatggagtatttcctttttttacaatttaaactggaaaacacctgcagcctaaagctgtagattgcccactacataagtgggtactagagccttcattagggctgtatttcttttatgtgcatccatttaagtaaatgactttagatttgaattttaagtttgttcttgtcatgacaacatgcattttatagaaatagtgatctattattgcatgttcatatgtgatagcacagaaggaactataaattgaaggccaacccttccctgtttggaagtttcttaatgtaaaattattcttcattggaagaaatattgagaatgtttaaagttgattcttaaagattgttttaaagaaaagattaacattttttttctttgtgatgaggtgatgaaagattttggattagaagaagagaatttccaggaaattaaaatatttaattgcctttaagcctggatttggaagaatttaatatagcaaagcagcagctaaaacctgtaatattatgcaaattagtattaccactaaagtcaatatgaagctctagacagtgatgacaaaaataagaggattttattaatttagattctatttacacttgttacttacatgttaatgactatatagtgttgatgaaggctcacttctaaacttgtttatggctcctggataggtccaaaagccttgccataccatcatctacctgccaccttccatggctactgttgcccaagaacagatgtgtttgcatgttctatctgagagagttttgttcactagcactaacataagggagatggaagcatgcaagaaattgtgaatccacaagagcctctttcaaaaaatgatgttttttaatgtgttgacatctttgaagacacatctgttaatatcatgagggagggaatacattatagtttctagttttcacttaacaattattaaggaatgtgttgttctcttgggggaaagtgggttagagcctagtgtcttttatgattgtttttattggttcttcaatgtgaaatcaattcatgtcaactgtgaaataaaaggaaaaattcagtaatatttggtgaccttgttaagtcatctacacttttgctattccagaatagccacacttacattctgttcatttccagagacaaaacaaatgttcagcaaatgtttgtttaattagtaagaaaacttcaatggttttaatgttgacattgtttccttttatcattgccttagaacataaactctttttggagggtagattatattaatttactgaagtttttacataaaatcattaaacatctgttttatttgttgagaaatcattttatacagagttgtaaattcttttaaatacacatatggtttttagaaatgcagattacaagagtaggggaaagttactttgccaagatatggaaaccaagaattcatgctcatcctttccaaaggacaaaccagaaatgtaaattctgtagtgtacattgtgtatacttttgtatttaactagaaaatctctgtcaataaattttatatatttaaacttgaggagatttagcttttaaaaaatgtgtactacataaataaatccatgataaaaatccttatacctaaatcatgtttcacactgtagttgtttccttagactaaatcccatagaaggcaagttgtttggatctgaaggtttaaagagttatggttattccccaagaaatatctatgatctgattttattgtagtcataaagcattactaccatctttatttttcagtgtgggggatcaagcccagagcatagggcatgcaaaacaaacattctagcacatatctacacgctcccctagtcacatcattatattttaagtagtgctgccagtatgggaagatgggaaacaggcagcttcacacattcttggtgcgagttaaattggtatgagttccagtggaaagaaatttgtcaatttcactcaaaattgcaaacacacataccctttaacctatatactttatgtttagagaaatttttaaacaaacatgcttgactatgtgtagcataatatgtacataatatataatatatgtatatatataaactatatatatttgaaataaaaaaatagaaactgtgtctggaagtaggagaaaaccagtgtatcacatattgatatacaaagctttctaaatataaagactaaaagattaagaagtgtacagtatagttaaatttatgtaaaaatgaggggaaggaatagatgtatattttacttgtttgcatatctatgaaaatatatgtaatggtaaatgggcaattaattagagtaggtacctgttgaaagagtaacaatggagagaataggagatagagtaggagggagaaagattaaattcatagatcaaaatctataaataacatcagagagacttcttccttcctgctgaaaatgagaacagaggcagagactcacagctaaaaattatgtgtgcacacgtgatacacacacacacacacacacacacagagagagagagagagagagagagagagagagagagagagagagagtctaaattggaggtctatatcaaattgctccctttaaagctcagggaatctagggaagaggaggcagaaagattgtaagagtggaggacaccaggcaggagaacagagccctctgaatcaactaagcaaacctcatacaggctcacagagactgaagcagcaaccacagggcatacatgagtctacatcagatcctctgtgtacatattatagctattacctcagtatttttatgggactcctgactgtgagaataagtgggtctctggatcttttgcttgctctcgagactctttttcctcctgttagtttgctgtgtccaacttggatatgacaattattgcttcatcttattattctgttttgtcatgtttggttgttatctcttagaatcttcttcctttctgatgagagacagacagggagtggatccagaggggagaggaggcagggagaaattaggaggaatggagggaggagaaactacaacaaggatatagtgtatgaaaaaataatctaatttcaatatgagaagtaaaaacaagcaatgcatctcatttaattttaagttggattttttttgcttaaaatttttgctttgttgtttgctgtttctaataacacaccaatggagaataacttatatatacacatatacatatatttagggtaaatcctttgatttgtttaatacaaaaacttttatgtgactttttattatgagttaaacccagagtacagaccataataataacatagttacacatttttaattttttttttctgagacaggatttttctatgtagccctggctgtcctgaaactctctttgtagaccaggctggcctcaaattcacagagatccacctacctctgcctcctaccccagtaattgctggaattaaagttgggagctaccactctgagagctaaaccattttagaatgaatatatagagaacattttatcttttaatctgtggtttcttctgttgcttttatgccacaaactcactcccaataatgtgtttctttgagtacttttatgaactttattgttcacagatatagagttaacagttacagctgtttgtgacttatcactgggttgattcactttgatttattatactttaccctctgttttctgatgcttcttaaaaccattataatttaagctactatatatgctataggcattctaaagctatccatatgctttgtatggatccattatgtagccatgtattgccaccatattgtttaattattaatgcctcataaagaattctaataagtcatatggaaaaattctcattgtcttttaaaatatattttagtttttctgtttaattatttcaggtagaatttgatataatgttaaattttacaaattattgtattaatgactaaataatgtctgacaaatgaataattggggacataagatcgttttttaatcatgtccagatctattggcattggtatatttatatggttctatttgtgtttttgttagttttgttttcttttgtctgttgagcagcccctttcccctttcatgttttcatcagatggaagtggtagagtctataggaggagtcttgagttacgcacctacatttttgtcttaagcagttcttgtttttagacatggcttgcaaccttaggtgttcatgtaatagttattgtagtttattgcatgtctgtttttagaagttaaaatcagtagctgagtgacaacacaggaactatgttctctctgcctgagcttcctcatttacaaaataagaacaatagtcgctaccttgcagattcaaagattttttttttttttttttttttgtgagcattcagtgtaagtgctgaagcaatatactttctgtaactcttcaataagtacctggtcttaaaacatctcttttttccttaagagggtttataattctaagtctgaaatgaagtaatgtgttcatatatcccctagcaatatagagtagtggggtgacaccatctgcttgtgaaatacttccatttcccccctttttaatactgtagatttatcccatcccatacctttatgtattaggtagattaatttcttttgaaataacagtatttatggtgctcacactgactccttgatggcttctcattgttctttactatgatgctttttgataactcagttggagaaggtcctacatgaattagagttagctagatgggctgctgagagaaccaaaggcccttctttgatgttatccccccttgtattttctttccagagtcagtggatatcaatttaggccttaatatggcatttttcaacctttctcctatgtgactcggtgctgggcatctccattagctaggaagctctggagatggcaatttcatggaccactggcttggggttgtgacctgcactttaataaatactgcctccaaacctttcttctcctgtgacctgctgcttctgcagacctaggttctgtttcagggccagtggtttttcttcttgctttcatgcaagtgacttacaaatgaatattaaatagctagttcatggaaaaaaaaaccaaaccaaaaaccaaaaaaccaaagaaaaacaacaacaacaaaaaactttttagcttctgttcccagacacatctttcttcatcctaggaatgagctcctactagaaatatattttatatcatgttcttagtttcaggataaaatatggcagtggccaagaacacggactcaaattccagtaaggccatttggggaccaatttatgctttagggaaaggccaggaggcttggtgaagggagaagaggaaaatcttgactgtttcctataatgtctacattagatacatgtgtgaatcctgaagtaaaaacattcttactgtaagtggatcattgccaatgaaataacaggcagctgaataataatttgtcagtattgttcactagttataacacatgcacaatactgatggaaggtgttagtaacactaggcactacatacaaagagactctgtattttcttaattttttgataaatctaaatgtgtttgaagggcaaaaaggaaggtttttaatgtatcagagatactaaagtattttaaggcaaaatatatattttgatttgttttaaaatattctaggccaaaagagaattaaggaggctatagatttgaaaatgattcataaaacattaattatctaaaatgggtagtggtcaaattgagttttaggttagcttgctttagtattttttaaaggaaatataaacaatcaaaattgtttctaaaaataccttaaaagttagatagcttggtgcaaccattttttaatcaggttcttcctagtcctaatacaccaattttctcttttagatagctagatattttcctgctcagacccagctgctgagtaccaccaactactttctgttcatttaagtacaggcaccctttcccctcttgtctagcttacagagttgtaatccatgcacgtatgattaaaaagccatccaaatgcagctcccggtttcttttgcatttgtactggctttgttcactaggtacgttgttgctttgctgtaaaccacaggcccagagtaaacctcagctgtgctgtagctattttcgacgacaactttctagttgcttgtgtgtaattgcccatattacatcatcctaactattgtgaaatgtacaaaatgcaaagcttatctaatgattcacaccaggtggatagctccttttgcaagtccttttataatcagttccttacaataaacagatcactccacttgattcttgttttcttgttcaggacaaaggtaatttagtgattgataatgatgtaccaagagagaagtggatcgtatacattgtgtgctgtaacactgacagtctacctaaaatgttccataggctatgttttctcttagtgaaagcaaagagccaagggggagaaaaactccttttagagtaaatcaagttaacacaaacccaaatgaagtttaatattgctgtctcgaatactggagggggaaaaaaatctatttttagggactagaagaattttagtcttcctggtgtttcagagtttgtccttttttttttgtcttttatgatggtaggtgcatgccatacaaaagatttttaaatgtattcattgctgcagtgtggtagcccattttaaagaaagtcaggcatatacagcttagaccttttagttctgtcttatggtcgttaagcatttgcaggctgagtaatatcacatgtttactcgcctagaagatgaattttaaaatagtaatatttatctttggccttgagcttttagaaattgcacacagagcccagtgtgggcagttgtcttagagataagaattcaaatcaggaaaggaggagaagattccttaaaacctaaagatcagatatagatagattatataatgctgaaccttcttattgctgcaaaatagtctttataaatactgtatgtactcattagaccaaatgagagtacccagagctcaatattaattggttcagtatcagctgatagccagtttgcaggttacagtggaattgttatcaatataatgtttttatcaatttcttggtttgtgaaattaaataaacatagcataaacactcgcagtgataagttgttgcagagaaaagtgctttgatttggaatttggaaacaaaattagaggtgattgaagcagaaagcaggctgtggcataagatttctgctagcatgtcttagaacgactaagaatatatgggtctttgagaggaagaacacccagaaagcagaaactttgggggaaatgtttcacaaagctttcttaaaggttgaatcaatcccagtggatcttttatgttgattgggttatttttgctttgcatgggtatactcagattctaatcctatgcttctctttgtcattgttccttctattctcttagaatctagatactggttaaacagtggtaagcaaaactgatatggctctgacttcctggaataggcccctgaaacatcaccaataaaaacatctcagaatcctgagagaaaaagtataaattcttatgaatgggaaaaagtctagggaattaaggaagtaatatctgatctcgccacagaaagctgtggtggaatagtgttgtggttgctgaggtgtggatttggaatgaaatctttaactcaatctcaggaagctattctctcctcctgtaagatgatctcaatctgagtgcggatatcttgaatctaacacattggctatgaaagtggaaaggagctgaggcaggaaggttgtggtgctaatgccagagtctaccatgaattctgcaaaaagcaaatttattcctgaaaagcagccatgcaaagaaatctatttcaagacaaggaagcagcctgcagacagcttcagatggctgatctgtagctacaagccttccactctctgctcagttgtctttgctttggacacttcacctcaccccaacatgtttgtgggtgctgtatggatggacctccatggaaaggtatttgtgatgcatgcaaggcttagcaaggcacatttgtgatgtggaatcagaaaggggtaaggaagtgtttatgattctctattttccttggctagacttcaacaaactagttttcaatccacccccttccatccagacacaccagcatcaacagcatactctggagaagaaaggtgtctttgcttccctagttcttgtttccaggctcttttttttcctcccttaacttttttttttccctgtgaaattctgcctgaaagtcagcagagggcgcacagatgcacaaaaacccagcctctattccgctggccacagtgattttatcatctttatctcatctttacattccgcagagacaggaatgcataagagacaggaatgcatatccactgcccaccctcgctttctctttgtaatattttcatcaaggaaaagtagtttccacttgttttgtaagggtgggtaaaggttactgtatagataatcagaaaaaaatatctcttcctgagatctgtgatgaactctgtgtatgtgcttccccccgccccacacacacagggaggggcggggaaagagagagagagagagagagagagagagagagagagagagagagagagcgagcaatatcttgggagttgctagtaccatacgtgactggtttggaaaggacttttttttttttttgccagtagcaaagcagacagtctgggttcctctttgctttcccccggctgttgtcctgctagcagctgccctgcttcctgacatatcctaataatgaggatgatgtggccagggggagattcagtttcttcccagtatgacttcctcattgaatctgccccttgctgtagtccacagaggattgtctcctcttaacagtgtgccctcttcactctgcccaaggtcagagtatccagctgtggtctgtctgtacccaacatccctggccactagtacaatctgcatacatctttgctaagtctatggatgatatgtgagaagcagaggaaagctagtttaagcctgtacaaggatgtcttggcatagcagtactgatgaaagcagagacttgtgtcaatgacataatcagagaagacacccagagcccagcttcagagagcagggaggaatgaagctcagtgcactgttctgacaaaagcccccacacttcaaatctgtctgccccaagtgccaatctccttctgatgtcttaacctgacttttgttcgagtttgctcaaatggttctggtgccacaaagaattgcctagctgcctggttgctatactgtctagcacattaatacaaatgcagggtgcttaataactagttgtttcataatgatagttatatatgatgaagaggtaagtgtgtgtgtgtgtatcaaggatagttgtggcttctcctaaataatggtcatgtcatctaaagccattttttttcatgtaaattttcttactgtgaccaagcttggaaaagagtcgtattgaagagcaagctatatatatatatataaaatctgaattatttcccactatgccttttgacttttccctttgggactttaaggtatctgttcctttttctcagagatctacttgggcagaccacatgttaaattctgcacccagcagaaacactatcaccgtgtgtgccagcaaaacgctaatgctgtaaacacaacgggcatttaccaagtaactgtttgtgatggagtaagtggtgctgctggcttgctcacttctggatggcttctccacgatgggagcagcattgggagttgggcccagtctgctccttggtctaaatgaacaacttcagaaagtgtttgtatagttaggtcatttctcaaaagtctgcagtcctgtgctgaatacttatccggcttggttttctgcttttggaacaaaggaaacttccactggccagtctgcttaatcagcaaagctttttccttcttcactactagtctgtattgggtttgcttctactccagtacattgcatttccaatcacatcaagccctattaggctgtcttccattcatagtagattagattcccttacacctcactgcctagcaggatttttctctccataatgtgtagagtattaggttcccttacatggcttactgcttgttaagttgtgtttggtgccgcatagtatcggcttctttatctcatcaacagtcgccgggttgctaattacacacttgcacattcacttctcttgcacattctctggtgtgcagctctccacacgctctgacctcacacttcagtgcctcgggcagttctgtctgctcccagattctgtttacttcagctgtgtggagtcatgcatctgtgcgtgaatcatgcatctgtgcaccagggtccatgctgagtactgcagcatttacaaaggaatgcagactaaactccacgaggagtgcaatctcctggagtgggtccagggcagagcagtgcataagatgaaggactcctacatgaagggtaagcgggtaagcgttagccttattcctttgctagaacccatttggtatttggcataaagctcgtgaaaaggcagcttgtttattataatgacaacactttgtcttgtaatgaaaaaaaagttaagtgaaaaaaaaaaaacatataggagagtccactgaagttactgacagagttgcgataaacctcttgggtcttttaaaatactctcctaacagtcttactttctcaaggactttataccccttaaggactctagaagagagttatctggcagagagaaataattcatgtatgcgctcttctctaacatgcctctacatggtttgacataaaatactgtgcagttttattcatctctggaagttaaggatccaaaactaatacaaagcagagtgagtcatggtttcacacaggcaccccgaagtggaagaaacattagcagttgtaattttagcactcaagagtctcaacttgggggtaaattcacaatctcacctttcagagtagtgtgacgattgtctaattccttcctcatgttgcttcacattccttgacctctgggtcagatcttgttccaggtggtttagtgtagcattccggtaattaccataaatgaaacttccttttttatgcatttgccatagtctaaaaaacacccaagtttactggcaacaaagggacgtgttttgtgtctctttctgccaactcaactggagtacttcctgaatgccaaatttctaatttcatgtgaactgtactcatagcctagtctggagcttgaaataacaaataatcatttataaagcaacatagcaataattaaaattatttgacataggcattaaatgaaaacagatgctggttgaatatttgctgcatttatttaaaaaataatgatttatttatttttattttatgtgcattgatgttttgcctgcatgcatgtctgagtgagggtgtcagatttcctggatctggagttagagacaattgtgagctgccatgtggatggtagcaatttaacttagttccactggaagagcagtcagtgttcttaacatctgagctacctctccagcatctaatacacacacacacacacacatacacacacacacacacacacacacacacacacacacacacacacacatacacacacacatacacacacacacacacacacacacacacacacacacacacacacatacacatatgtatgttggtctggagctcttatgttgaccagactggcctcaagctcagatatttgcctgcctctgtctcttgagtgttgagatttaaggcactcatgaccacccagttttttttttttctgaaagatttaaaatgtttttctttattcttgagaactttatacatatatacaatggaatggaatcatagctactccctgcttttctcctatgattcttctgtattatccccaacaggactcttcccaagttcatctccttttcttttttgataacccactgagtccattgagtgccacccatatgcgtatttgtgtggggccatccagtctaatatgggcaacctaccagtggccacatcctcaaaagagaatgattctttttctcttccagcattttaaaattgccaatagctcttcattaatgtgtgtggcatggggagtacctccttcatctatgtaagaattctggctggtctgttcattgctgtatattcacaagtatgattgctatagaagttcagaagatagtaccccacagcactcctctccaggctcctgtgccatctttaaaaatccttggaaagaaaggcaccagaaaataccacaaaatagaaagcaatcgccttttcagtataggcagcttttacatctactctgattgagtcccatgtccaaaacacagagtataagattcatattttctaatctaatttgtttagcgtaaagagactttgctaggatgaaacatgacagcaatattcagaactcattttccaaaggtctgctactatttggagcatttggaccatatcactgtttcattagaataacatgtttatcttcaaatgaaatgtccttttatttaaccatatttatcaccagcaagatagggagcttttcttttctgatacttgctttattgtgtaggcttcacatgaacatctcaacatagactttatactttccctgaatctccatgagctccttttgtacaatgctggatcgtcctaacctctcaaatactcctgtcaagacatgtactctcataactcaaaatgtttcatgtttaattctcttttaaatccaaaacttgtgatcctaacacatggactatagattgaaagaattatttagttgcaagttacctccactgtttcttggacgtgccttctttaacagcagaattccccacttttcttctcctgctcatttttagctgtaaagaccatagagtcagtcactgcttcaaatccaaccacccctttcacattaatagcataatggtgaacattctgtacattgcctgtgactaacataatcaccatgcaaaatgcatcattcataaattgtttagtgcgaccttttgcacagtagcactaattattattatcacagaagcccagtaaactagactggtaattatcggggatttatttgaatggacagctaagctattcttggcaagttagtcaaagcagttgtcatgacagccatacaaatatgtcttttgaattgggttaattagggtaattaatatctgttatttggcccccttttcccaaggtattgcctaaatgttatcaaagggggggggacataaagtttgaacaaaagtttgaatcgttctatggaaggtacttttgaaatgaacgaaatctgctcacccttcagaagtggctcccctagagaaagccttattttgttggatctctttctacttgtggatgtttcagagtcagcaagcacaagccacactgaaaagggatggagttaagaagaggagctcagctgtcagtttcccaggctgctgctttcctttcaatcacctttgagggctctcatgggaccatccctctggcttccacttttatcatagccctattttgttctgggctcatctagaactgtcttgccttgctctgcagcctcgcctttgtatcaattctctctctctctctctctctctctctctctctctctctctctctctctctctgtctctccctttttttctcacaaggaagttgtgagtttttctcccctgggcttctgcccctctgaagctttcttaagttttaattttgttggaggccttttatatcttatgccttgggggatggataatccagtgttgcttgatggtggttttccaatattttttttcctcctaagaaacaaacaggatgtagctgtgaagagctttcttcttctgtttcctccacaccaagtagactataaagtcagtttcttctctgtacatctccgtatgatgttttccttctgttagtgcaaagactagaggaagggaaagattaaaaaggaaatcagtttcccttaatgaggtcatcctttcagaggatactattgttcataaaaggaattagagacttctggtaatggttttaaatagcaaatttatttcctatttcttgcctaaaataataagggctatgacaagcaaagagaacttaagacatttattttagttacctagcctgtgtcacttagtagatgtttgaagtttttttttctcatgtattatcaaaattaatccttacaacgacctgaagggcacagaaactactagtatcccagttttatatttaaagaaactaaagtatatataaattgtataatttttctgaggcctcacatgaacagaacttgcgtgcaagtctttgatccagagttctttgtctatacgagcttgaacacaactcacccaaagctttaagattttgcaaactccagatgacttgcttgtgaaatgaacttccattgcatggactctctctctctctctctctctctctctctctctctctctctctctctctctctctctctctccctgcctccctccctccctccctcccttcatccctccctcccactcactcctcacttatcctcttctactccttctgcctcctctccccattttttccctaccttactttggcagttgagacttctaggtcagaaaatggtgttctggctgacccataaaaatcaagtttaggggaaattctactaaacagctttttatcaagtactcctggttaatgccttagaaatgagccagtgcactttctcccagtgtcatgttaaagtctcatgaacaggaaaagtcagtcctcctttctattttagatataggtgccctgttggaaaagacaagataaagtgttgcaaagagtgtcttgatgggactcaaagactatacaggatataaagaatgtggaggtggttagattctgtctgcatttccctgtcctagtaagtctggcgttaggtccatcttagatcttagaaagctgaaaacaagaaaaaatggggagggatttctaggcctatttctatgatgtattgtcatccaattaaaagtgggtggctgtatcgtgcatttaacatttaaaaatcaaacacaacaatttgcctagcgcataaagattattcattcatttgacaaatatttaccgaatgcttcatttgtgtgaggatcccttttcagggctctaagtgcaagaaataaatcgacaatgatttctatcatcatagtagaagcattgtagtagcaacacagggatagtataatcaataagagaaacattttggaagatgagtgctatggagaaaaatacagcaagtaagaaagtgatagcgaggagtggagaaattttgtcaatttaaatggacaggttaggttagtctttattaagtcttaattttgttacttatcactttacacagactctttccttcagttaggctgatgatttcctcccttgttagtgtctacatactcttgtacctcagtacgcctgtttaatgacaaaagagatccagagccttagtcaggaaatgttaaaaatgatcacacagatgataattgcttgcaatcatgctaagtgtgattacaaagccacacacagtgctatcatatagcatttattcatggaggccagcagaaggccacaggtagaccaccagacatttgagttcactggctccagtgggaggaccgtcacatggtgtgagtgcaaagcagcaagccccagccagataaggctgtgagggaagagctaggactttgttatttgagttgtctggttcccataattgcacatagttaccttagccctctaacctagctaatcattgacatttaattttaaacatatgaatctctatacaaacacgtagcctgtgtctgagcaaatcaaagacctttggatgtggtgaatgctggagttgctagaaaacagacttgggaggagggcacgcattaatgaaggtaatggctgattttcacagaagagtgactatttgttttttttcttgttctttcactgtgctccaaagcttcaaacccccctaaaactgaagaattacaggacaaaaatacaactttttttttaaaaaaatgtaaactgtggagagcaaaatattttaatgaggaaatatattattctcctacaaaccaagggctaatagtctggaactggtactttggctccctaaaaagtccaacaagacaagccaattatggactctgaaacatttttatttttagttccttgtaatagcaattcattctctgctatggtacattaactgggaaaccagttgaaatgagagttttggcacctttagaataattgactatatttactgaattcttaatagtgcagagaggtgagtgggcgagataaaagaacaaaaggcatggccaaaggacatgcatatggggaattttgactttcaataaaggccaacgacatgggtggctatggaatatagttcctctgccatttttttctttcaatttatttttaagtaggcaataaactagttttgctgatttttatttttattgtgatatggagtcacttttgtgagcaggagtaattaattgtgtataagtgaaaatttgtaagtctccaatagtctactatatctgggcatactgatgacatgtttcctgggctgttcactttcccctttggtagcatttcttttgcttgagagattggttacttcgctgtctggtgatctttggaattagcctctgataccaatttagagtggagatgataatgctttttagaaatgtatatatgccgtaagggaaggggcagctaagacaaatgcagccttaagtctcattaatgaaatatatacttgtgtttatggaagacatcagcccctttgaagtctttctccaacagaatgcatctagaggatgatgttcatttctggatgcttcctcttaagtagatcaccgatggactagaaagaactttaaataaggtcaagaaatgggtaaagggtctggaaatcttgtcaccggtcccttgggtaattggggggatttattcttctcttgtgaagtgctctatatcatactttctttattaaaaaaccaacgttctccactgagaatagaagagttccagtggaataaggctgatggttgttataccatcttccatcttcttgacacctggtataggttgaatatattcctcaaaattaatgtgctggaaacatgatcctcattgcagtcctatgaggtggggcatttgagaagtttttaaatcacgagggaagggtgaagctcttgtaagtagatccatgcctttttttgtgaaagtgggtttgttgccacaagaattattttcttacagaaggacttgccttacagaacttgccccatcttgctgtctgttctcatgtgatacctcccataatattatgatacagcaagaaaccataagcagatactgtccttctgttcttagatgtttctgctgtcagagttgcaaagaaataaattcttgttctttatacaatttcctcttctcaggtattcaggtatataaaacaaagtaagatagcacccttggcagactggtatcctttgggagctaggaatgatgtaatgacttaggacaactttagatgttggtttgttttccttctagagataaaaagagcataaacacatggagcccgtttttattaggttatattaactttataacatagcagttttcattttatgcatgaatatgatagtatttgatcatgttcagattattttaatactatttcttattttctctacccctttcccattcttttgccacctccctagtagctccatgggggaaatttgagatttcttagtgttataagtttctttccaaaaggcacttgtagttgtaatgttaataaatctgaatgacagaggacatcttaatctatgaaattaaaattttagacggcaaattttatgagctcgttaattgccacggagtccttattctttttagaaatcatagaacaatgcacagtcacacatatttttatttattccttcccagtcttctcgtgtctttgtaagcacaggataaaaacttgggggaaagaagaaacaaaagttacccatatttgcatagcaacatagtatgtatatatggcttgtaatggtcataaagagtctctttggaattttccagaccattcatacagaaaagatacaagatacccatctgagtagagattgtgtttgtcagtgagccacgatttctcttgcttcttgtgcctttcttttgctttaggatgaggtttgtagatgtgatacacacttcattgggcaggattaaggctccataaatgcatggaatgcatgagggtgactcaataacaccgggctttccttgggaggaaagacacagagctagccaatcaagagaagaatagaagaatagaaaaaaaaaagcaagcatagcattcacattcctaaaccatatataaggagaaaagaaactgctgcctctcaaaggagaaaaggagaaaagaaactttgctgactcctttgcaaaggagtcaaagtcacagctgtcttaactagtaggacctaagatccagtctgacctgctgaggaaactgaaggtctccacctactgacagaaagggctctatgcctctctatctatgacttatgggctagaggcagctttcaaagagattattcgagctagggtctacttgtctcaggaatcatccttatgcaaaggctgaaaaaagaatttgaaagtcatgaagattttgatcaccagagaaaacctttactggctcaaaaataaatctctgtggtttaattagctacccctttggacattgatttttttttcccaccaccagtataaaatttaacttgttctccaaactttagagaagagccaaccgaaatccagctggatttgtggctgtagagaggttgcttgattttgttaagcatggcttatggtctttctctctcctccatactgatatgaaactggcaaaaacaaggattagagcgagagcaatgtacacgcttctttcaaatcaaaggtcattcccagttcagtcctcccataggttgcacatatttgaagacagttcccatgacacatgcttcctaggggcaagggcttcttctctggtgcttgcttctctgcatatactgtaaactgtggatgaaacatttgtgttgctctgctccctactcacatgtatgtacctaagaccttatacaatagtatttacaagtggcccttttaggaggtacagtcatgagagattcatgcctttatgaatggaattagtgcacttataagaagacttaaaagattagctattccatcctgcctttctgctttccatggcaggaagacacagtagttatcttctttggaggatgcaacaaggtgccattagggaaagtagaaactagctctcaccagatgtgcttttctggcactttgcttttggattttctggactcaaaacctgtggaaaacaaattcctgctctttgcggccttttgttatagcaggacacacagattcagacgccacccacagaagcacccacagcattccactgccattgcttcttcatttcctctcagccatatgacatcaagtatgctcgctgagggcaggagtgggaaaggatgctccttagcactgactgtggagcctgcacctactatcaccaggatctatgaagttgtatagaattttccagcaatctgtcctagcaaccatttgttctgcaatagtcaagggcagccagagagcatgaagcaagcttttcagctgtgagatcttggaatgattgatctccttttgtttaccttccatctctgattgcttccatctaccccttttgtaccagtggatgcctttagtttgtacagatgaagatcttaaacacggtgaaggactgtctatgacttttatagctttggacttgggctggtggctttgtcattggactttgttttctatagcaccgtcaaatctgattaatcgagactaacttgggggaaggccagtaggaagtatagatagaaaacaaatgcaattttatttctctcaagttcagagtaataagaagtagactagcaaagtccttgccaggacgttttgccaagtagaagtccttggacctgtgttaatgaataaatgagagtgatgtgcaattaacatatttattatttgtaaattgcttctaaagtactttaatttattctcttaagtagtttaaacacttcccatgtaatcttgtttataccacaatttatccagcaaaccttctaaaaattgtataaggcagcctgtttctatctgaaggatcatcaaatatgaatgagtgaggacccagccacaaaggtgggactctcatatggtgagtcaaataagctgttaggaagtggacaaaagactcctatcctagatagctgttagtcatccaaagagttacccacccagttctattctgaaaagagaaagggcttcctggatgcaatccttaccaccagtccagacccttcagccatctaatgccagagaatttccactgaggcagtaaaaatgagaaaatttactttttggataatttccctctgatcaaacaacccccagtgggcaaaactaatagaagatactatattttgattgcagtttatctctagcaattatagatgagcaatttaagtggcaaccaagcaagtcatttgctagaatgaggctgtatttcagaggactttatcattctacatctcccaatcactaagctaaagacagtttgtttccttgggtggatcatatattctctttcttcagtttcccaaggcacaactagttttcttaaatgacagaaaattgacaaaatgtgatttataaatatcatttgcactacatttcacttttccccatgagaaatttagctgagagtatttttgaggattgggtttttattcttctgaggctcttttggagaactaacatgagagaaatagtgtggcaagtggaaagagatgagctatgacctccgtgttggaagagatgacttctgaactcatgcctaagttttctaataactaggtgtgctgcattggtatggctggaagatcctcgtaggcattattattattattaattattattattattattattattatgtgttcagaatgctgatggtgggagataaagtgagaagtatggagagggaaaaaagagatggaaggagggggataagataattgctaaagtcatactgaattttagtgctctttgaacatgtgatttttgtggtggttctgagaccaaaagggaatttttcaaagaccacactgtacagcatatcattgtaagggtacagtcatgattttaaaaccttttcaaatgaccacatttggcagtcaagcaactgaaggctccattgtgagatgaagaaataattaatattgcattaaggaatatatttctttaatttatgaaggataggtttcaaaagggactgtagaacggaaacaaaagcagtaaatccatcaaatgggcttctgttctctattctctacaaatttacagtccacaccccttatttgggaagcaggggggcttaggctcttgcctaagactctttcacttgatgactcttggctacttaagcatcaggtactcagaagctctgtgagtcccactttccccagcaatttaaaatggagaacagtcctttttgtccttcactgaggacttattctttgatgcaatattctgcaagaataattgccatatcattacagggtgtttattgagaaaatagttttaatccagtcaatgagatccatagtacaaatgatgctttaaattctgtaaagttgtaaaatgccctctgtgaggaaatattttgtatttaaagtcatttgttttgcatactggcatgttgatagaaataaatggagaacactcgttttttttttcttttttttttaaggtttataaatggtattttgaacaaatgaaaaggatggaaaagtaggaataaggatacataacatttatgctttgacgtaagccattcttctctactgtttttaaattcttgagtaatgttcacacacacacacacacacacacacacacatcagtctcagaaacaaaaaaaaatcagtctagaaagagcatataacacttggcattcctgattcaatattaggaagagacaggccagagagagagagagagtcctatccaagatggtgctcaatcatctgacaccagtctttgaatacctgctctgtacaagtaacagcgataagccatgaagatacagttctatctagccttgaaaagggtctggcccaatgtgtagtccataaataagcaatacaagctatcatgtgatatgagagaagtgagtatattcattgtttttgtatatgttactaaatgtgtcacatttcaatactggagaattctgagtcacaagccaatagctttccttcacattattgctgccactagaactttctgtggtgatataaatggtctagaaacagaactgtagccactggctgtgtgtgaccattgagcttttgaaacctggttactatgaccaaagaaagagaacaatgtaaacttaattgtgattttgataatttaaatgcaaattgctacatatgtctatgctattggataatgtgtcggggaagaagtgggcccagaattggttctgagtgggctctggtgacactgtccagttctttaatcctgttttcctactcacagactaaactagccttgcaatgatagctcatttccagctgacagctctgaattatgcatgctaatgtgctttgcttaaccctgagatgattttttttttaaagaaaagatattctgtgacagttcaatcataacaaaggaaggaaatggggcgaaagaaaactagtttataaaggcttttaaaacatctcaaatcttgccttgatttttgacagtgtgaggccatttctactctctaagagagttctctctctctttctcttcctctctctccctttctctctctccatgtatatgtgtatatacatataaatacatacacacataatcctctatgacagaagaaagattgtttaccctattttttgttgataaaacaaatagtaccagaataagattttatatatatatatatatatgtgtgtgtgtgtgtgtgtgtgtgtgtatcagcaggaaaatgtaggaataacatgtattcacaatgctcagtgagaatttagttagaagtcgaaataaatatgcaagggaaagcaagtttacaaactgatggtaagtaagacatggcacatgtctgtggagttaggtttagaaagtgtcgctacagacattattccatttgaccctagtaacaacttcgaggtggtgaggtaaggcattttcttttttcttttttttttttttttagcttatagatttgtaaatcaggaaattgagacctcggaaggtttcatgatgttaacaagcctaacatctagtaagaaccttgtctgcctttattttaaaagctttcttggaattaaaaatgttttatgattttttttgtaagcttagaaccatctgtgtaaagtgtctccagggtaccttttaccttaggtatagctggttataccaagaaaaagaaatttaaacatctaaacaaaacatatactattatttccctcatgaaaaatgtgtgtgtgtgtgtgtgtgtgtgtgaattaagaaataactgccacatctatttttactgatttaagcccagaccaaacgtctgtttttaagtggacacaagacctgagtacaatatagtgtatttgctatccaggcacttggaaggcaggaggaaaatgagtccaaagtaagccttgcttacatgagaccatgtctcaaacaaacaaagaaacaaagccaaccaaccaaccaaccaaccaacaaaacaaaatagaattaagtaggcacaaatgatgagctgttcagaatgaggagtgggtgtactagttatgaatgcatgaaatgggttgagctctacttaaaacacaggtcagggaagagctggggagtgctagtagaattgggggaaggaagggagatatatctgacccaggttgaagggctgtgctttctgacacagcatagtgttatgtttctgacagtaggggttattttattttgttttttatttattttattttaattttatttatttttttgacagttgagtttggaattcgtcctgggttctgctggactgggaatctgatggtagaaggagtgcgaggagttcccccttattatttcttaatcttccttcaggaggaaattgctgtcgttgtgctcattgcccttggacttgtcatgtttaagcaggctggggactttttttttccctctcccaagtagtatactcagtcagccagtcctaattacttccatttcattgcgttttccaggatcctaatgaggtgtggctttggtggtgtgagcatgggacctggtgtgaacagtctcaaattctagttgcaaatgcttgactcccctttctagtagaagataaatcccttcaccttctctgtcatgccattaggagagctaataatatttattctgttcataatggtaacaggaggattagctagttcatgttagctaaaaggctttctagaaaagaatggcaactttttgtgcagtgtgttcattttcaaatgctaattcttattaataggaggcacctgctctattactgtcattaagcacctcacagaagtcttgctggctgactgataagcaaaattcttcagttctgtgccacgagctctgtagaaaatgtagctactgtcagccgtagtttccaacttgggtatgtgttttctgcctgtctaaaaataattcctctcctccatggtttctgtaaggtttagtaattcccctctctccagcaaccctttatatttactgttactggttgcagaatgactattgtgtctcagctgtggggggaaatgatccctttctataagagcccattaaaccttctggaaatctcgtgataaaaggttccatataaatacaaggtactttagtaattgttgcactgttggttctttccataactgcattacagattgctaatgctttgacaatttcaagctgctgataacattagctattttgtgaggtgcaataatggccttctcattcatggctgccagtattctacggcagacagtagccttttgctttgaattgctgtcttctatatgtgtcaaattctatatgcccccctcttcatccctctaccatacagaatgagttaaggttttcatcacaacttttgaatgctcttattttgtctcacatatgactcataacatttctccccctaatactaatttcctgcaatgctttccttttgtcactagaaactggaggatacactactgtgggtttcattcagtacctaataattcctatagagggaagtactctttatttcaactacagtcataattaggaggttgccaatgttaagcaactgcagccccaattttgagaaatgtttattgtgcctcattagacctgaaactagtccttaaaaggtaaaaaaaaaaatctatgtacatgctggtgacagaaaatacatgtgaatgctatgtgtgcacatgcctctctcctttcatctcaggatactgagagcctactctatttgccatagcagaagtcagaatatctgcagtgaaagaggaccatggaggtcttattgacctcagacatggaaatgatctattgtattgtacctaattagaaaatatcaatattagaagctaatgcactctctatttctaagataggagactgctcctttgtcttttgccagcatgttcacatagtgcaggcttgagcaacaagctggtacaagggaaatggatttagagtgctatgccaaagacttactattattttttttactcttaaataagcttgtggaggcaattgggttttaagtgatgtataatctaaataatgggattggggttggaacagaatttaggggtgttgttttggcccacaggcacagggccacctgccacttaccctccaaatattttgaaagtcttttcagctgacaagactggctcaatagaaatcgtactctgcaggcagccagggctctatagctgctaaatagcaaggaattgaggaactggtaaagtataacttatggaaaagaatggaccaccacaggttctgagagtactgggccttctctgagccagaggagctcgaagatcagatggagccaaggtaactcgtactgcaggtcactgtctgtcagtgatgatgtcaggcctcatacggattttgttttctttgtgttttattgaggatcaaattgatatctcatatgttatcagtttcatcacaacatagcttctgaaatggaaaccactgcctaagttatcacaagttatcttacttcatgtactaaagatggtggccattgcctctaaatgacagttgaaatgctcaccaactttccagagaaggaagtcactcattccttgatcccttagctcacaggactgggtcctccagctacttctggggagctatctttagttggtgtgccaagttttcctttttcctttgtctaactgctagactacactctactcactccttcattataagcagccaagaaatgtcactctgagtaaaaacaagcatgaaagaggctaattacttcactgttgatgttatgagtcttatatttgttttccatttcagtagtaggtaatgccaggagcagtgttcctggtggttttcatgtggtccttgttgttaagccctgttccagctgagttagtatttaacctggctgtagtatttaactcctgtgtttgttttcttggctccagagaggatgaggggtaacagttggcacctgcttgtaaagttctttgatatttggagatgaaagcacgttgtgctagtgcctgcttgcaaaatagccttaatgtgttgtggcttcatatttggaatggagcttcgactcagggctttgctcacgtgtgtttgatagctacttaatccttgcattgagtttggtttatggggaatgaggtagtttgccttccatgacttcattttgtttactcttaacctgcattcactcctactgtggccttattgattttatatttttacaaacaacagaccttaaatggctccagagaatattctgtatcagagaatattatgtcccatcaaagacttagtgacaggtccaagtggtaccatgtttaacctgtgctttcagtacgacttttgcattagaaatgcacagattcctgtaaaaaactatgaggtttgttacggagacctttgatgaaaaaggacattttgagctaggaaggaagcactaagatcattttggtaaatctcactttgaagatggatgacttaaaattctttaggaataaaatgatcaatccaaggtcttctgggaaagagggacggccatggggagaaaattgaggtatttgtgtgcacgtgtgcctgcctgcttgaaaacatgtgcatttgtgtgtcagaactggagtgccagtgtacagaaagcatccgatttatagtgtgtggttagtgattgcctttcctagtggtaggaactctgggatggtaccttttattctgttgccagtaattcctattttatctgttgctgtgtggttggatgagtctttgaatatacattctagccagaggcagttttgctttactgctatgcagaacttacattttcatttttatgtgttaggcatagggagcaggaaaaagtcatttgtcaattcattaaaaaaaatcctgtgaaatgatggccttttgaatatcaaaaacagtattcagttttggaaaaggttctgtttttttttcatcattgaccaatggacacaattattattattattggacgttagctgttaagaaaataagcagcaattaaaaaatcacttcgttgtgtatctgatttggggtttcactctcgcagtttgtattgcaaagatgagttaagagttaaccatttaaaaagagtgaattgcagttggaatgctcttcagtttggtgggaattttaaagtgcaatttaaaagattgttcatttttcaaatacaaacctttaggtttgaaaaatctctgttttaatcccaggtctgaaacctttttatagcttgtgtagtggcctagggatttgtgccactgggcaaagagtctagtcctggatatttgcatttattgggcttctttctccttagggtttaagtctcttctagtgataaatgcggtgctgagagagctgcagtcagtcttgcagagactagggcacaactcagtgaactgtaaaagtaatacaaaatgacaattaaagtagggcatcctctgctaccttgagggcctgacaaagtggaagtatttgacttcagatgtgccagacttattaacatagaaacataacatatcacccaccctaaagtctcactccaaatttcatatatccagaaggatgctgaggatagaaagtagcaaacaaagaaggtgcctaagcagccgacattcaaaaaaaaaaattaaaaaaaccccacaaaccccaaaactctgcacaaactccatatattgaagacagtatattttctattttagaaccacatcttcacggtctctactcacaacgcattagctcattttctagactatgctcatacatataattttatagtttccaagaacacagtgaaataaaagcatctgatgtaaaatggcagaagggtcttgagagacaggaacatgtagggttcctctcaagttcaagctgtgaaccacccacaaggagtgctttgtggtcactgaagttacaggttaaattcacacgtctcagtgttttatgtatagaagggtactcacaaacaacaaaggaaaggtcaaattattattattttctactccaaagagggcagtttggtgatacatttcagaaataagtaagaaagcagtatggttgtttctgttataaaagggaaaaccctaacctctggacatcttagctgtccagagatagtcattctttacatactgtagaaaaaccaaggttttactaaatcaagaccaactaagatgtctgcttttgatacattcctaagggaaaaaaaggcttctggttagagaaataatttgtgaatgtattgggtgactttaaaagtgacatatttcccatcaagaccagagataaaagtttgctcttgacccatttttaatgtcaaaattacattttcagaaacaaatgctgttcttgtctctttgctacgtttccgtgttaacctggctgtctcattagagatggggacattttctagttaaattaatgtgacatttagagaaaaaatttctctctccaatgtttcatgttatttgccatttagaatacttagagatgggactggaataatgtcaaacaaattttgattaaataaggctaaccaggagctaatatattcacacaaaaaagaaatctctgttattatttcttgaagtgtttcttctgggcttctttgttctacattgagatcactttgactgataaacttacagaagtgctatcatatgaccagctgagcttgtattagcaaacatggccagagcctatagctagttccttgttcatgatctttggacttcaccatggaggtacattcagtttactggagaaactttaaaagtagtatgaattccagaccaattatctcagcatctttggtagttggtactttttaaaaaaagttcctgaggcaatgctgatgtgcactgggagccgagaaacactctttcagatgtgtaaggtgtttcagttcattaccacaagatggttctttctcaggttctttctatgtatcactctatactccaccagatgagtaaaaattgactgggtgtacaagaattagatttgagtatacacctggacccagtacttatttctttgtacacgtatatatatatagtatgttttcatgtgtgtgtagacctgacttcaatgtcagttgtcttcctcagttattctcttccacatagaggcatgctcctcactgaacataaagatcatggtttcagctagtctggctagttagcatgatctgggtattctctgtatccaacccccaaaggattacagataagctgcttggcccacttggcttttgggtgggctcaggacatatagactccagtcttcatgcttgtacagtaaatgctttacctgctaaggcatctcctcatgctgaactataattcttggtgcataaatatagaccaataataaaataagcctttgtgcctagttaactcagttgttctgaatgtagttctgaaaccagaatcatggattctgttctcatgtgaatgattctgctgtgttcttgcaattgcagcccagctactttagggattgagactgattgtaaaggttaaagacaatggctgaattggaatagccccattcattctgagaaagttggttctagaatttgttttattaggaggtagcacagtccgtctgctggtttggataatggaacacttacatttggagctcaggaatcacaagactgggatgtttactcattaagcgtaaagaagaaggaagacagagaaagatgatgaagtttaatggcatttctctatcttgagtagcatgtcatatctgttacatctgtcaatggctggccaatctgtgaaccttggtgagaagggagaattgtcaaagtcattataaccaggacttctagaattttctctactactaactcattgaccacaagagggatacctcatggtggtatagattattcccttcggaattaaaactagtactagtaatatttgcaagattattcttctcttctcaaacatgtggttcttgcatgatgcaggtcatcacaatgcaaacagacttgatgccttcatctttcaaaattttcttctggaaaatatatttttcttaacatgataatagtttgggatattgctcttgatttttcagcaaggccaatcaataccttctactttttttcctgtttacctgtaaagatttagtaaatttggacagaatttatttatgtatttattttactggaatgaagtaaaattcccagttctacttacagtgtcaagctccattgaaagcagtgttgttgtggaatctctttttgatctttttttttttttcttttctgtttcttgagacagggtttctctgtatagccctggctgtcctggaactcactctgtagaccaggctggtcttgaactcagaaatccgcctgcctctccctcccaagtgctggcattaaaggcatgtgccaccactgcccggcttgttgtagaatctcaccatgagtattgataagtgctgttaaattgctctttagaatttgtgctctcatggtgtgtatttctcatagtagaaaactgaagcacagagaaatgaagtcatttaaccaaggttgtacagtgaaacagagaagtaaaccacagagctcagtcagtcccctgttttcacaggatagcatgattttgaggagctgagaacttcttgttaaattgtatatttcactatcataaaacaaagtaaaacatacttaagcaacaccattttgcccattgtgttggtaaaatgaatttgctcaaatgtttcttaattaagtgactgatgaatgacttattgtagcaaacagtaagctcatattcccaacacagttttaagtttgcctgtcctctaccaatgacttttgtcacagtctcagtgttcacttaccaatcaataaagtagaaatgcgctgacaatttttatttttatttttgaaaaccatttcttccaatatcatcaaaacttgtgttcacgctaaagggtatctaaatatttagatgaaaatggtgtaagtagatgttgtacagtctgtcttcaagtgagagccgtatagggaacatagacacctgtgagtaactacaggacactggtgggtctttgtttcctttccaattctctctccccttttcccctcccaactattcagtatcaactatctacctactctagatatctaaggcccttgccctgacttttggctgtgtagtgtccatgtggtagctggctctgctgttacttgcctcattttctcctctatcaaactgtgagtctttgaatgcaaggactgcatctaacagcctagtgcaggcaatgtctgagaggtagtcatctgaaaagaatctgctattttgttctctagacagctattatatttccatttccaggcactttcagttgaagccattgcagaaggcctctgaagaatggtggggatggctaaatggcaggatgagggaagaaatgtgcttgagcatttggagttcatacaaaggttcaacaagtgctgagtttttaacgttgggtgtaagaccatgttttctaggatactgaattcagtttagatgcttccttgacttctacccattctcaggctgtccccctttaggataccaggattcctggtgctcaaaagctgatttcccatctctttcatctagcaggtgccctgcatttgcttttataaagccagctactgtaactggattaggcagtggtgttttaatgataggagccaagacagaggtttgcttacaaacttcatgtttcacatgaaaagctttgctaccccctgtggactgcctttcaccctgttttgggcataatacttgtttgcctttatacctgtgataaaagggaagccatcctgtgtaacggatgctgagcaaatgtcttaaaacaaagggaagttcagagtttaaatccacagtaggggattaccttgccgcatttccatatccttggaataaatattttaacatgttaattatctacttctaataaaaatacctttgaacttatagtcaatttgatgagcataaaatggtctccactggggaatgggaagcaattagtttctgtaatgattgtgagtcatactttctcttctctctaagtggttacatggtcagtagccagccatattctagagaatgtttatatcaattccaccccggcctccaagaataggttgcttcttttggagggaacttgaggacccccaaagaaggcgttcatcaaactgctgcccaactacggctttgctttgggtttattcattgtttttagcacaataaaaacaaaaaacaaaaaaacaacccttttaagaagaacacttggcctcttattatgagtcatttttaacctttttctttctcattgcagactgaaaactattcttttgactctaactacgtgaatagccgtgcccatttaatcaaaaggtaggttggtttgctttcacattcctacttcagagcttgattttatatatatatatatatatatatatatatatatacccaaaacattaattcttaagacctatgtccttttagatgttgtgacaaatgcctatgcactttgctaggaagtgtgcgaaatttagagaaaatagagaaagcaaggatcactgttagttatatcacacaaagagatggccttgcatcatatttatttccatcaaactatatgcaaaattaaaaatgaaattgggatgatgtgagatattttacttgtaattttggaattaatataagaaagatcagaaaactttcaaaatcaaactgatatttaaatttttgttgctacccagtttaaataataggtggcctcaactttttttctcctgtgaagtttgtagtatgctctgcaattgttattattttgacagttatgaaaatttaaaagatacttaaatgacagatgaaatattttttataatgctttttagatgagagaggaaaagaaaattttctaatttaatacttgtcaagacactttgaagtgttttagatgaaatctgaaaattgtatgattggttggttacaacttagctatattgtgagtacagagtagagttgaatactgagaagattccattgatataatgtgccctaaattcttaaaatggggagaaaaaaagagatcaggaaaccctctaaagaggcagaactaagcaaaggagagaatgccatgtctaaaagtagcacatcacttgaccattcagatgatgcctttattgctgtttcatgtaaatagccctttgaatggtccagtggatattctgcagctaaaattgaacattgagtttgtttgttaaaataatagcaataaagcagacaagcaaacagtatattagagctgcagtggagaagatcggaaaattctattattttgctggctgtaatcccataaatttctatcactgtaagaatgggattcaaatggaaaacaaaatcctttctcgtggtacaagaaactcaaactcaaatctaatttaatttatgatgtagcactaacccctataactatcgtagctatatctgtattggcttgggatagcttgtggccttcagtgatgatcattaggcatcttagaaatggttacacttgtattactgtcatagtatgattttgaaaatttgggcattgttgggaagaattccctgaacaaaaggtaaggcaaggaaaattgtctaagtagtttttttttttttttaggaagaacgaaaaagcctctttatatgtacttgttagaggggctctgcaggaagactgctttgttttctgcttcaggactgttattttcaaagcttcttttttgaactggtaaaaacagtggcttggttgatccttacaggtctctggagctagtcattctgggtacctggaaattctctgactaggttaaactgataatacaagcccgattttcatagcctactagaaagctaagactcctggggacctgcaaatcttagatcagcttcaaatatccaacttacaaggctgacttatgagataaagacttatgttaaagcatttagctttggagatacatggatttccacagcagctttgagtctcattggaaacctctgattttgattaattactttacatgtattttatacacacatgtgcacaaagactgcatcctggagctcaatgggctcctggaggatctatttctagatgtggccctaataaacagtagtttatttaccagtgaccacctgattaataggaaacacacacacacacacacacacacacacacacacacacacacacatttttgtcagtttctttttaatagaactgtgattgttttgggaaaccatgaaggtttttatggggtcagttgcatttaaacaaattccaatacccagaaagaaacaggatgttggtgtgctagcctttgctgcagaataactgctacaagtgtaaaattggtaggaaaccacagtggtgactaatagtaacactgatcccaagggaatcaagccatgggaaaagtcactaactgtccaccaagatgtttaagtcccatgtttgtttggaaaaaaatttcctggacaggaaattccaaatcctgtcctcagtcttaattttattaggaaatctcagaatttctaaaatgtcaagccaaggtcagcctagttcttacaatttgtttttctatacatctttctcatcttacattttctttcaagttatccaaagacatttcttgtaatgttgtcttgggctttcctggccagactctttatacataggtactttttattcttttgctcctgtctatatttgctagctgagcactggctttctctggtcctttttttttgtagaagtcatggttcctatatgaaataacaaaatagatggggcaagatgcatttcattcttctggtataaggacaaaggagttgaaaatactacagaaaagactcatttggagaaacatgggaggaggagtaataataccttctggtcagttgagggttttggtaaatagggtgattccataggacagttagaaccttaacagcaatcttctcccattgtcaaaatttctgttttagcatccatgagggcaatcccaatggaaatccaaagaggaaaatgtttcatagacacgacttaacattgaaaagccatgaagaataggttagaagggacaaagaaggtctatggcatattccccatagttttctgactctgtgctgctgaagcgagcactccccacagttttctaacattacatctccaaaacctcgttctaggggttttaagatgagcttgtccctctgctggccaccagagcagtaatagaaacattcgcacttacaatgctatccctgaagtttaatatttttctgaaacattatctgtaatctgaggatatacccaagttggtttctgagggaaacctagattagcaaactaagcgagttgcggttttttttttgtttgtttttttttttttttctggctggatcttagtaccactatgtttggatccctgctatctcctcaaagtaagacaggccagctgtgctacttttctccacagctgcaacgttctctcctcaagcctgttctccgaactgctggctaatatcaactcctggcgtgcttttggagccatagcaagtcaagcatgaggctgtagctcaaagaaaacacaacggtaattgagcaacacatcagaagcagtttagaaaagaaaatgaaccctggcttctaagctatgcgtggtggttttctttactaccaaaatagaaccggagttctgtagcatctgacgtggcaccatgtatgtggtcagtacttggtacatggttttcagataaataggagaaaggaacagaaggaaacattatttttttccactaaaatttttcttttaaagcagcaatttctgaacaatagtatgcatcagtaaaggcagtctgttgctccatctttagagaagttccaaatattaacatatatttaacaggtgattagtgacacctgttaaattagtcattagtagtctggaacactctctgaatcatacttcattaaagccagttacaatacactttttgactcttcttagtcataaatgacattctctaggtatgtgggatcacctattggagacttgacctgtatcctttcagattcttctgtcttttgcaaaagtaatattttaaaggacacatacaggatagtattagtataatgttctttcatcaaacacgtgtgtagaactctgctctaggggttttaagatgagcttgtccctctgctggccaccagagcagtaatagaaacatttgcatttacaataccattgaaaacagatgcctctaatttattgtcccacaaaagttgttttacaagtgtctcatctcccaagaggtacacaggtaataaagcaagtgaaatcagcatttttatgccagggcataaattgttatttgttttgggtgagtagccatttaccaggctgttttactgtttgcagcttcttgctcactggttcttaaactgccttacacaaatccattcattaagccactaaatgtccctacaagatcacagtaagcggtacttagtttgtcagatgggcaaactgatctttaaatgagttaactatcctgaggtttgaaggggtagtggctatacctttgtgatttttcttctgttgctcacatcagcagatccttagataatagtagctaatctttcccagtcttaatattttctatttttacctggaagcccccctcccgagaagccccgaggtacattgcagcattctgatgcatataaaatggatgacaaaattttaaaaaggcagatttaaaaccaattaggagacgtgagatagagatcaccagcttccagggcgataactcagtgcaattaaacattatgcttaccttgaagcttttgagaagccaagccaaattgaagtgcatcaggtcatatagtttttatcattcaataaagcaaagatatatatttgacaggagatatatttttctgtttctcaattttaggagaagtggcataatggacagtggctgacaagtgtttacagaagataggaatattcattaaataaatatataattcttataacaatcccatagaataccatggctatattatttaattgtaatgtgaatgaaacattataatacataatagtggtcatattaaataattttaatttctttggacatctatttctgtctggcttttcatgcaaagttatctgactgagtcttcaggatggtcttgggagggagattttatcaagtacatttatcaaggcaaggaagtcaaggattagatgtgccacaaagtgacagattacaggttatcacttgccctaatgacttcatctgtggtgctttttttctgcccgccatgttatatgcatactggtgaaagaacgtagaacagttgttctcaaccgagggtgatttgcagtgtctccctggagagatttttcattgttgaactttgtggtggtcatcactgataactaatgggcaaaggccaaaagacccattaaacatctcataatgcacaggatgtacacaacaaagaattatgtgacctaaaaattcaatagtaccaagattaagaagcactactctaagggatggccaattacatttgcctttagactatttcattcactatcatataactcaagcaaattttggcaactactgaaatgcattcaatttagccttgagttctttggcttaatatggcagcttttgtgctaaagatttaaagaacttttcattatgtttcacaaccagataatagaggttgaaagctaatatttatcataaaaatggaacagtctgtaataaaatgcaggccggtcattggttctctcttgaggtattatgagtgcctgtaggcagggtcaatttttatttctaaattataaactttgaatctatttaaattttggattagtatatatagcaaaccatagaatctgtgccatgaagctaggaatgataaaaaaaaaaatctttaagcaatgagtttccaattggtctttttgaccatgaaagaattataggattttcttaaatacttacatcctggtaggttgattggactgagctatctctgtgacttaatttggaggagctgagtaaactggcctgttgagtgatttggattttaatgactttgatgctcagatatattttctggaataattatgtaacaaggcagtgcattacatcaccagattcctcattttcttaaaacaatggcttcccagttacttctcccttgatctttcagtttttatgtttatgtcaccaagcatccaacacttaggttggtcatgtgttaattttataggcttcctctaggacaaatgtgcagagtgacagagtgtcattggtccatggcatagctctcaccacatgcagtgaactttttaatgtctctgagaggcaggcctgtgaatgttcaaagttcaaaacattgattcatgtagttgtggagttttcagaaattttgttcttggtcaccaataaactagaaggctagagcagccgatggtataatttgaaagcctgagaattagaaaaccagttgtagagattccagtctaagcctggaagcctgaaaatgaggagttctgaatatgggagaatattgatgtcccagttcaagtagtaaggatattcaaccttttgcttattgttcttttcaggacgtcttcaatggattggatgaatcctaccaacattggggaaagatacatgctttactcagttcttcaatctaaatgctaatctcttcagctaacacattcaaagacacattctgaaataaggcgtaactagctacctggatcgccctttgcccagtcaaatagacacataaaattagaccaaacccattctgtgcaccaatgatttcctcagctacagccagtcatccttttctttgaattggtccctccgccatttttactcaaaactgacaggggagccagatgtgatattttaggcttgtaataccaagatgcaggagaagcctgaagaagggacttaccacaacttcaaaggccaatgttgacttcatatcaaggtcctggtcaacctgtggtacagaatgagactctaagcaatcaaagaagcaggagactgacctggttttcttcaaccctgatcatccttttaattttaatcacactacctcagtttctgccatttttttgctttttatagttgatgattagtagttatctctagagaaacaattttaaccactgacatttcacaagccgagtttggtcttagatgtgctgcaattgttttgttttgttttgtttgtcatcagtgtgaccttgtgcaagttatttaacgtctaaaaaactgttgtctcatgtataaataagaatattattagcatcttttctttatacagccaatatgacttagaaagttaatgttgatttcttaaaacagtaactcatgaacagtaatttctcagaaaacattaactatttctatttgactttaattgtataagaatgggaaaaaaaaaccaaaattgtgatattctttagaaatgtttttagatttcaacctccagccaccttgcctgcggtgaagcactaaaaataagcaaatgaacatattagctgtatcagcatccaatattgagaactttttattgttaaattctattatcttctaacagaaatgtctcttcttcatatttctacccttttggacagtctagccactgctggccttcttacagagctgacatcatcctggctaggaaagattttaaaagccagatctatcacagttgtaaattaacatactttcttcaacccagcagctccaccttcaaggacctagagggcaacagcctgaaggatagtgggcatgaggagagtgaccagactgacagtgagcatgatgtccagaggagcctgtactgcgatactgctgtgaatgatgtcctgaacaccagtgtgacttccatgggatctcagatgcctgaccatggtaagggctggaccattttaagttgaaactatgtgctccaaggaacccagattctttctagattcgttgtcctactttactgcctagcatatgttattagtttgttcacctgttagcagcatctagagagttttgagatgtacaacatctacctccttgtataacgttggggcattttataagctgactgcatcctcattctctttaataatatctgcactgaacacataggaagtaagcagatgctttctcaccaggaataaatgactgtttatgctatagtgcatggattcagctgatcaattaaattgcatagaacatagctccaatgagaccagagaggtggggtttctttctttactagtctggttaacttcccctagagactgttctctgctcacagatcatgtagtcttttctgaggatacaaagcgctagactttacattttgcccacagggttgctattccaaagccacagagctactgcagaaatctatgtcactgcttacaggggaggctaagataatgtgcctgactcaatgcaaacccttccattattgtgaaacgagtctcaaagcacatgtaaggagccacatcctcatgtacgaagagagtctgtttttatgaacccatatacaagtacttttaggaagacatgctctttaaaactgtgctaggcagaaagcagggtattaaaacactagcagagtttagctgaggcagcttgttcatatcgacttgggcacaaaatgtcattttcaatattttaactgatgtaaacatggtatgcaaccagcctgtcttttccaattaagacgtatgaattcaatttggtgtttaggctgagtgaagcttcagaatgcttggctatgtcttgagaaaagctagtctcatgctcagctggaagccctactgctaaaagtcttaaagatgagaaaacaaaatctggtgattccgtgctgcttttcagctgtctcatttgactgtaaacatcattaaactcttttgttttggttttctaaatgaatccaaaaaatgcccgattcacaaaacaaaatgtttttcatggagaaaaattagccagtgtaaattctattaaattgtctaatccattcctcctcaggagattcacgtgtcaaagtctgtaatatagagaggtcacttccaattgtaccctgcttctttccttaattggcaagtggtgacatctgcagagataatatactttccgggaaaccttactatatgactaaggatgaaaaaaaattaaacatttatatagctgaaacagaggcaatttaattctcagaggatgcagacagatatgtatcatttcctactcatgtgtatctcaaagaaaggctttcttcatttagatatgaaaggttttctcttagatgctctctaaaatgaaattacttcaggaaagaaaatcaccgtaattgattctcactttatgcctggctagaccaacatctgttttaattttttgtcacatttctctaggaaaacactatcagtgggttgcagctagatgctctgagtgtttcttacaaatgtagactgaataatggcaagaatatgagaaaatgaacgtgacagcatccaaagaccctcttacatcaacattgatgatgtcacacacacacatgcatgtagtcacattttcctttgttatagcattttggcaacatctttatttttttgtatatttggtttacaagctgatagtttcattttttaggcatttttattagatattttcttcatttacatttcaaacgctatccccaaagccccttatacacttccccccaccctgctccccgacccacccactcccgcttcctggccctggcattcccatttactggggcatatgatcttcacaagaacaagggcctctcctcccaatgatagccgactaggccatcctctgctacctatgcagcagaagacacagctctggggggtactagttagttcatattgttgttcctcctatagggttgcagacccctttagctccttgggtactttctctagctccttcattaggggcataatttcattttttcattatttttattaattaggtattttcttcatttacatttccaatgctaccccataagtcctccaaaccctctccccctatctcctcccccccccccgttcccactcttggccctggcgttcccctgtattgaggcatataaagtttgcaagaccaatgggcctctctttccactgatagccgactaggtcatcttctgatacgtatggagctagagacacaagctcccaggggtactgattagttcataatgttgttccacctatagggttgcagatccctttagctccttgggtactttctctagctcctccattgggggccctgtgatccatccaatagctgactgtgagcatccacttctgtgtttgctaggccttgggggctttctgaacccaaacttgagttgatctttttgagtttgagtgacaaaagaaattgtactcctcttgtttaaatctcagtctttaccttatgataccaacaactacttatgattttatactaatacataactgtgtattctaagccaatctcaggctttctgtaagaactacagaaagctaacttgggttgattattagtactcaaaataatgtgagaaaaaaaaagtctaaaccaaaccccaaaccaaacaatgaaagaaaaacaacaacaagaaaacaatcagtgattccaaccatttacattttatggtatttattgtctcaaaactgcattcacataagtgtatattattttatgctaaggctcactagttgaaagtcactccctgggagaatttaccatataatcctgatcttgaactcttcagacaaaaccctgaatctgatacttctctttgtttgtgagaaccattgtaacaacacaccacatacaaccaacaaaggatataaagtcttataccattctattggaggagcttggctcatcttagataccataactgtgggtatttatgaaatgtctactttccacattagcactgtccctttctctgtacacgtgggaacacgtatttgatgggaaatcccaggaccgtcaaaatgaaaaggatttttatgtacccattatttttttcccttgagctggccgaagtggcttcttatataatctcattgtattgtcagtatttaagatggtgcagattatatttggtccgctcctttggagagacactggagccctaggcttcactgaattgcctcaaataccttcagtatttgttttgataattttgctgtagcatgtgaatgctcactgtgaatgacaaggggttttctgtcttgaattaaaggcccaatgtcttagttttcagtagcttttctgtgagagtcctcctaggcagagaaactctagaattcctatgttcagtgagggaaggagactatttaaaagactttcagagaaactctagaatccctatgttcagtgagggaaggagactatttaaaagactttcaaattcaaaggagaagacccagatgtttagtcactggagagtttggattgtatatttcttacttcagaaaaacatatgtgtgatgtgggtcagaatgccagggataaagacagtctctgctttctacatcactctaaaccatggcatctctcttaacaagtttgaaaccaggtcagtaggtgggtaaacttgttgagcttaattccctggttgccacagaactccagctttttatttgccatccatcatgcccataaattaatatggtttctgtaggcttctccccagtgctgtggatattgtgacttcctggaaaagaagatgttctttaacataagcttcctcttgacacactatatacagtttacaatattatctctcaattggtctcaaagcatcttgagaacaagtgttaccaacatttagcaagcttcttttctgacttggctactagagtgatgtaatgctgagcttagacatcacatctctctcttttttaaaatttttattaggtattttcctcatttacatttccaatgctagccaaaaagtccatacccacccacccccacttccctacccacccactccccctttttggccctggcgttcccctgtactggggcatataaagtttgcaagtccaatgggcctctctttccagtgatggtcgagtaggccatcttctgatacatatgcagctagagacaagagctcaggggtactggttagttgttgttccacctatagggttgcatttccctttagctccttgggtactttctctagctcctctcttaaccaatgcattccctacctgattttattcagtcagtttaccattttcctgagaagaatagtgactcctttaatgcctaaaattggcaatagggtagcaagcgatggctgaggctcctgattttgttgcataattgaggatgttagcagattgaatctctccttagccaattttttttctctgagacgagtagtgctggccttagtagatctcttgcttccctcttattttttttttatttttacttttgcaaagccatttatggtgatgtggatattgcattatgcttaaatgtataatatagatatgaaactaaagtttatggggaatcatatcttagaactacacactagttccaagtaatttgtttcaaatcacactcaatttacttatgattttaattattgattataaattcatctactcaaaagctgactctaattgctctaatatgcacctaatttgaagttcactccaacactgagttggtttccttcccatactaattggtatcaaatagaaacaatacacagaaacttacagtgatggttatcagtgatgttgatctgcctttctcatctaagaacacccaatagcagataatcattgcttcatttagggaagaaggtttgtattattattattattagatattttctttatttacatttcaaatggtatcccttttcctggtttcccctccgaaaacttccctcccctccccccttcctttgctcaccaacccacccactctcacttcctgtagggaagaagttttaacagcaaagtgttaagttctgcattttgcttaacttattttcaaagctcatcacctaaatattatttaacgtattttctgtgtaagatatggatcagaagaacttggtgtgcacctaatgtgaccgctgctgcaccactgccatgaaaatgtcccatagtcttcattctatacatagactagtgtcaaccacaagtatattaagatgtttatactcaacactctaccaacagcgtggaatttcattttctctagtcttttaatgaaattaggattcaatgactggacatctttctctttctccttttctatccccctgacttacctttcacctcactaaatttccaaacactcatttcaattaatctcttggcaaaacagggagttcccagtggaggatattttgtgacattgcaaagcagtatgctgctgggctccagaaattgtatctctgtccagatgttcatagagtaattgaaaattccattttatcagaatagcatttgctgtcaaaaagttttatctttacttcaacaaagaggttgattagatccccctggacctgaattagcatctttgaggctcgatatactgttttgcaattcatgtggttatttctttcctcgttttgctcatatagaaacttttaaaaatatcttcatcttatcacaaatatacacactaaaatgtttaattacttgaacatagaatcaggtttacaatgttgtcccaggtggtatatagtgttttagtattaaatattaagtaggcataagacatacataaaacacactaattcttcattcaaaaaattaaaaaataatacatttattaatttgtgtatacgtgtgtgggtgtgtgtctatctctctgtgtgtgtatgtgtgtgtgagagagagagaggggggagggagagagagagagagagagagagagagagagagagagagagagagagagaaagagagagaaagataaagagtaagttaaagcattgacaaacatgtttatatcagaggacaacttggggaaaattggttctctttttctaccatgtgggtcctggagattgaactgtaaaagcctatatactaactgacccatctgccactcctcattcaacaatatttttgagggttcatgtgtatggctctgaaaaatgaatgtgttaactctgatgttactgacctgctaaaataccatgattttactttgccttatttacggtctactgagatgactcaataataaaattattaatattatgccaatacaaaatactaaaagatattactttataaaaatatctcttgatgtaatttgcacaacaatatcagaaacatttttaaaaatacttgttctgaggttgaatttcctattcatcttatatttcaccataggatgataggttctttacttcaacttttttctgatgcccagaaatatttatttttctctgtgttaaaaagttatttttaactttgaagctagggagagaggtgaaaggtggagcttatctttttgtcaactacactgttgtattagataataggatttctatgaagcattctttatattttattaaggcagtcattgatttccttagaaagttgttgtaactagtaaaatatctttgacattagcagttattcacttttctgcagttattcatcagtttttcttcatgtaagacatttggagtaaaaccagctgattatcttctttcaaatagggaagtacacccccccccccgtgtgtgtgtgtgtgtgtgtgtgtgtgtgtgtgtgttacacacagtatttttgtaatccatttggaagttttagttgtttcttactcaaggtcatttggatttgcaaatttactattaataccacttaagataaaagattcattatttatccagagaatgccatgagctatcttgattagattaccctatgaatttcaatgtttttaagcgctcaaagagagaggagggagcacaatgaacaatttagagtttgagtctgtaggagtttatgaaccagtagcataaatggtccagtatggaatagatggccatatgatcagtgaagaaatcaattaagattatttgaactggaaagcaaaatgcattttaaaagatactttggtgaaatgggatcccattggagaaatagcaggaagcccaagattatatgctagataaaattatgctctttttgggtgatttgctaggtgaatcttttccagatgttgcatgcaaaaagtaagttctgtaggctaggattaatagatatactgccattagggtagcaggtaagagctaagtaaaaatgatggcttcttaattttttctactcttgactgatttctcctgtaaaaatgtttaaaggacttgaagtaaatatgtgtaccaaatacgtatataagtaaatcatttcctaataagaaatcatagcgaattttattttaaaaaatatatctttgtatatacatacttttaccatttattaaatatggaagaatattttcacgtgagtttacttatttatttttacataaagtgttaaatacggcatagatattttatactgcaggacatagaaacttatttttttttaaatttagtttacaaatactatgatttttataaccatcaatgaagagaacactgctttgtataaaaagcacagcacaaaatgacaaaagtatcagaattcttcagtatcatgttctaatcccaagccagaattcttttataattttttaaaatgaaacttaactcagaaactcaaacatcacattttaaaataaggcattccaagataatataattcaaaatatactaatttaatattcacagaggaattatggaagaaaaataataaaagcatttgttttgtgtgataaagtcctgttgttttctataacaacagcacaataaacgtggaattttctaccattcaatattctgaccaaggcttcaggtagtgttagttgatggtgtgtggtgccatggtatgcacaatgcaaagtacacatcttgtgccgtaagaatcagagctgcaatactattgcaggattcaacatgaactagcattgcccgaaacacctcagattggcatgcctctgattcaccttaatttgtggttgctctatgtccagagatatttaactggtgtcatttttttctacagtcacttgattctatatgggattgtgacccatagcctaagaggctatattactgactgcttcacatacttcaaagatgctctaaaattggatgatcattatccttttgaaaactctccttttatttaaacttatttctgtatacagtcatataactatgaaccattatcactcaccaggacagagaagcatgagtctaaacacagtgtttaaatagttgtattttttgattctttctcctttagtacatttactatgaaataaatatggggaattaagtatgctaacagtttaagaagcaatttaaagactatcagaattatacagcatcttttagtatgtgggcacttgcaagttggcttttcttttgccatacctttttttcagtcatcaagaattagttttttcccctggtgttttcaatcactgtcctcaccatgtgtctagtacacatcgagccagggaaagcctacttgatatagccacaccaaaaaggtacattttctacaaggaaatattttcactttttctttatgtaagacttcacaataaatctccagcttagaaaaaaagtaacagcaccaaataccaggtcagataatgtttaagttggcctctggggcaacgagaaatgttgcttgttaaggtactatctatcaacaggctcttacagagatgttttcagaggtcctaaatagtctagaagttggtcatacatgaccttctaaaactcaaggtgggtggaaatgacacttttttttgtaacttggaagaatagtatctcaaaaaacaattattctgctaagtgaatagaatataaaattgttcttcacagtgaggggccgggaagatgactcaacaggcaagaacactgggttcaagcatggtggcctgagtttaaatcgtcagaacctatttgacaatttgagtatgatttcccaaacctgtatcactgtcagtggtggaaggttgcagaaactcagaaaatggttgaagcttactggctaccagccaaactcaagatttacttggagactccgtctcaagggaacaatgcacagagcacctgaaacccttctcttgtctctgtgcttttatgcacatgtacacacacatccgttctcacacatgtgtgcaatacaccccccaagagagagaaattaaataaataaaacagaagatcgctaatgacatggtctctagagttatcaagcatatcttttgaggacagccacttatgtgttggtgacaaactcaaaaggacattgtgggagatttaaggttttgtgatgaactctggacatcatatagaaataggaaggtcagaaatctactgtgtgcctagaagtgcgttcaagctggcatgtagcagaggtgacttgaaaggcactggatccacgaggtgctaaaggagtttatcagaaatcgaactctgaattcacactgccacattggaaaggcttttagagagactgtctcttaagggttcctataatcagaaacaatacttctattttgttacccttcacaaggtttggtaataggcaggctgctaaataaaaaatatataatagacatgatttaattgtaagttttgttgtttttaatctaagtaaaacccacttcaaagcaaatgagactacttggattcctgtctcaacttaactggagaaatttccacctggttgaagttagagccctatacatagtttatgggctcttagtccaactggctaagccctagtggctttctgaactgtggcctagaatctagtctccaagtcttgtgggagtataattgaaatctggtttgactgaaaggataatttataatgctgtttcttttaagtgaaaatctgtaagcatacgttgctctaattacctgggaaaacttggtagccctaattgattatagcaaggcagcttcccaggcattagtttgcaaattctaattctgtgccagcaatctactttccaacttctctgtggccattctctcaatctctatacttctcttcccttcaatagatgttggacgacttgctttcctttctgctcttcagtctgtaaaattaccaacctgtgtgaacaacagaatctttccattttaatacatgggaaagagagagaaggggagagatgtaggttccaagatatttagactggtcaaactgttccaagctatcaccacctgctgtttttaatcattaatgaggctgtcagttagctttaatctgggagatgaaccaaaagaatggttttgattttaatttaatttaaaaatgagcttattgaaacaaaaaaaaaatgccttcagcttctaagagtcaggtcgtaccctggtgataaaccaaggtgagctagtgatagaaagagaactattactgatatgcaaaagtaaattattttaaactcaggcaacttttgttattgccatgactagccagaaaatttagttcttttaattcaagcattgattgcatcccacagacatgctgcatataaatatctgttccatttttttctttctgggagaaaaactgatgtacaaaacagttgaacagctgtattaatgtcagaatacaaattgatgacaaagtccagagtgcagcacaaagtacaaattatttctctggactcaatgctcatcaaactcttggtacatttcaaaacagttgtgtgattatctgtgagttttgtatagtgtgtgattttgcttagtggcaaaatgagaactcagaaatacaatgcctaagcaccaagtagatttcagagacctatatccaggcctctgtgaggactgtcagtgtagacagtttcattgtacctgtcttgagtttcaacaaacactttcaaatttataatttacttaagctaaaatttaatggaaaaacaaccttccatttgatttttttttaattgtagaaaacattaccattgggccctagttaactccagggtagttgcatcaaatcatactagtctgctaacacagcaagtgagcactttctgaactcagctgcttatcactctattcagctaatgagtctggaaacagcctgaactaccagagcaggcatcaagaaaccaacacttcaaaatcatcatctcctatttatcttttggtgtttgctttgtgatgccaagtagtaactcttaaaattgtctgtccagactttttaaaagaaacacagtttactctacggattgtgttagtatagtgtttcccattatgaaggataatgactggccatttgagtaacatttgagtgattgatctggatttttctggcaagtgaaatgccagaaaagttctgtagtcatataatttacaatgttttccagattatgatagtatggaagtggaccacgattgtttgcaccatgtctacatcttatattcacacatgtatctgttgatggtctgcaagtcctatcaccaggctgtagctgcagcaagcttgctagagtctgtctacctagtgttttggactgaattttgagtaaagttaaaattctgttttgcttcctgtgtgataatgagtcaaagatcagtgttgtagttttggaaggaggaaacatcttcaaacaagtgctccttaactcagaatgataggttgtcagatggtccagcccactattgaaaatgctgcatttccataaattagattggggaacagtagtctttttttttttttttccgagacagggtttctctgtgtagacctggctgtcctggaactcactttgtagaccaggctggtctcgaactcagaaatccgcctgcctctgcctccccagtgctgggattaaaggcgtgagccaccacaccctgttgaggaacagtagtctttatccctgttagttccccattccactctctgtttggtaagccaaacacttggggataactttatcattaaagaaatatcattgtgagcatttgaagctcgttgtactttgtccttttgcttatcctctagcaacttgtagtgttttttttttcttttgtattctaagaattatctaaaataaatgatttatagatcctgtgggactgaatctctaggtaagaaattagctgtctcttaaatgagatttacaaagtcagagagtatcttacataatttcgaaaaggagaacatttttgaagggaacaatattaatcaacatctaggatcctttagagcttaaaattctcataccagaaattcagctatggaaccaaatgttgaacctgtagcattattgagttgttctggcatcctaaatgtccattgtcattaatatagaaggattgaaacattggaatcttggaatccttgtgatatgcaatggatactatattatttatcctttacagcaattctaagtggtagacaagtatagaattaaaaacaaaaatccaaacaatgaaagccatttgaactgaggaataaagatagactctcagtagactgagaattgtacagaaaattagaatgaggtgatgagagagcaatgacataagctccacatatctgtggttgaaactaagataggcagggatataatgagatataatcaagacatcctttcatatgcctgatgtaagtaacccttataggtaagcctgggaattctgctcctcattggagtcttctaggtacacagtacattataaatatagggtgtagccattatgagctggctctaatgaaatacaaatactttaatactactccataatactcaagatcaacattaccagtcttgccacacagcataggataaaagaatacagactttggaaaaggacacgtctaagtcccatgttaacctttgataattgatgaccgaggacctcagtttagtcactcacttttttctcatttgcaaaatgaatgacagaaattacttgtcaaggtagttatgagatgactcactgtctattttctgccaaatagtaagcacccgaagcataaacagtagattgaggcagtgacctagcctttcctttctgtttaatctcagcatccctattatccaaaacgccatatctgtgatcctttgaacggaggccaaggcattgcatttcatgatgatagttcaaatttcaggcaccccactggagaacagtgactatatgtcttcaaattcatattaagttgtaaatgaattttactagatattgttccaaacgagattatggagagttgcagggaggatgactttctagatactgaatacagtcttagaggatgggaaatgcatagaaaagggaggccaagcaacctcacaagtttgcttagaggtatcagtgtcctaaagaacacttgatagttgttatttgatttacttactatgaaacgtgtagatgttcgaaagctccattccctatccagtcatttttgtgagtcatccctcttgtgatataaagagattataagatatccatgaatgatatgaagtgaagtctgggctaatgtaaataaaaattaaaataaaaatacatagattctggaacccttgtgaggtaagcaaatctctgttttgttttgttttgatttttttttttttttggtagtggtgattctccttagccttccctaggtcaaacaatgcacagctcagtccctaggatcttctgtattactcttgcctcattgctcttaaaaggctgataagtggcagatatcgctgtgattctgctattattgctgttcgtatatcatggtcagattttcacacacacacacaaaagaaataaaaagaaaatacatttttcatttctagttttcctctaaaaagtcaccctacaaataaagaatataaagaatcccttctgttctttttctattctgagaatgcactgaaaaatgcccagctcctacctgaaaggtcatatcttcttgccatatgaatgagctcacagcaggtctatggggatactgtcatctgagaaatgatagggatttatgtttctctggatttttttgcccctttttgtagtgttaaaaaatgtgaatttgttaatgattgaaaaaagaaaaccttcaaccacaggctcttaaaatcttaggggagagccactcatatcaatgaaacgataaatgaaaaaataattctacccttgcttttcttagagttgcttgtcatgtataactttcagttagctggctcacccttactggttccaagctactgaatctagctagcaggctgcagttttgcagcataaagtattttggcctgtgaagtaccttatgatgtattttcatttctcaatatgcaaatggaaggaggaacaaaagagaactgtgtacaattaaggatatgcacaaagaaaattaaaatgcaggggtcagcaccatggtttttaaaaaggctgattcattgtgaaaatcaagttccttttataatttgacatcctctaacaaatgtagctgaaagtgcataacttccctagacttaaaaatctaaatctatatgctatatggacaatattaaaaaatagtccttgaaataattttatagcatgtgactcagtgggagcaaggacttgaaaacactatagcatttgtttaccatgctgccttaaatggcctctcaaactttcagcttatatgttggtaaggtggggcgatgagcaggatgggtagaatcagtaaccatggtgacctttatatgtatctcacctcttgttggtacactataattgtgaatcagattgctaggttgtctccccctcttgtgcccttccctttcatgtcctgtgggcctgagtgctttcatctcttagtgtgatatcatttaccaaggagggcactggtcgacctaagagtcaggggggtcaggttctcattacattcccacagattaatagctgtgtaactataaacatattatttgtctgcctggattttacatctgtataatgcagggtattggtagaatttgccagggagctaggtggtgagaattgaatgagatggtagtgtatggcaaacatttaacccaatacctattctttagtagataaccaaaacagaattgccaaaataatcctcatgagtcattcctcttatccatgactacttcccactttataatatgggcaaaatagaagtgctatgagtagctttgttcgactagcagactgtgctgatttcttctttacctgatcctttctttcagtacctatgtgcatgattttttccacgctaattcatggcttgcctgtgtttttctaatgcaggaaaagagagggggttgataattgttaaagctcttccactgctgagctttcttttatctgattttgggttcagggcacaaccttttcagattcctgagcacatagccatttgccagtgggtctgtaatgagtgccatattcaagttaacagatggtatggtgtgcttgctttgaggggtaattgttctttcatcttaatttcctccctttggcattcatttgttggaagcagctcaatggcaatgtcataaagcttggggtaaaaattaaactgaagtagcaggttacttgtctatcaaaaaaatacagttaaactaaaaactaccgaaggtctaccaaagtggaggattttaaccctggtattagggagcaaataagtcttaagggtacaatggacttaattgccagttcattccctccttcctagttgttaactgcttctgttttccttaaagattaagacaactcctgcttgcctagcaggtctcacctcttacagttcatctgttcttctgaaactaatactccaagccttttcttctatggggccactgctgttttaactgaagtctctccctcccctctcctttgcacttttaccttgtcatttcttgtttagatcttcctccaagcatcctatctatagattagttttgttctatgttctttcctttgaagaacaactccatatactttacttttataggaaacagagatacagtcaatgagattgaaattttttgttcatttttttctgatttagttatactttatcctttattgaacatttttgtggctttcatcagatgatagagttcgcttccttactattgcttccagtttcccacataggtcaaaggtgttcccaaatgagcaagtatacatcaatccattctctaagtactactcaacaacataagtcatctatcaaggttcattccccagggaagttctcattcatacccttattctagatatgctagttgtgaaatgatttactggaagaaagaacacagattaaatgaaagtttctgcttcctacatatgtgacttcagggtattgttttgccacttgaattctcaaaggctcctagattggcaggaagttttcatctttggtacaaaggattgcctcctccagtttggaggacattttgcttcaggaatatacagcagaactttactgatgccagaaagatcagggcataagaactgttaccatgaaatgaaggaaagagtgggtgtgctttacgtaccccaaggggcatgtttgataggacaaggtgtatctacagctttagcatttgtatagttcctggcttttcactttcttatattttatgttgatttggcctgctgtgttatctgtgtctctggcaatctgattttccacagtatgccagttgaatcacagcttgtatcttcttgctttcctactctagctttgctggtttcttgctccctttgctatatacctaccctgactcctgccaaatgtctgataaaatcagtcttaagttcctgtttctccttgtttcctctgatttggactcgtttttggttaggccttctttctttctttctttctttctttctttctttctttctttctttctttctttctttctttctttctttctttctggcttattagagtacaggtttcctgaggaacagtcattctagatttgctttggttgataaaggttcttgttctatagctcaggatggttttgtatcagcctactttaagcaatgaatacaggcatgggctgccatgctgggctttatttgtgtgtgatagtgtatatattgttaactataaaatgactatttctcaatgatagtgtaaaattactttttcacattgttaatatatacaacggtcatcttgaatttgtaaatcgtcattattgcattctttctccttctatttgtgggtattttttttttgatttttaattgcttgtttttaatttttttgttttgctttgcttttttgctgctattgtagttgtggagatggtggtaaagtcctgttcaagcacatagattgaaatgcaggatctgcactaagtccctatatgatctccagcacctacttttctctctttgagcccacccccattctttatgtatattacagggtccagactgcagtgatttaaaggggctcactgttgctaaagttctatttagcatatagtagtttatctagcactaaaacattattggaggactctaaggctgagcttttgtctgtttctaaagaagacgatgtgtcaggaagtctgactcttagttctgaggctttagtatataaaaatccttccattatattgtgaggtacatggcgtaaaaattggtcagtttaagttgtgttaaacattgcgagattcttgctcctctttggcttttgtttgcatgcgtttagttgtcaaatgtgtgtatttttgtgtaagtggtcctctttcttctatacattccaattcatgttctcatcttccttcaccatttctgaatagttcgcaattttcaacttaattaggtctttcccctaagtgaagagcgcagctgtttcccctctgatgctttggcagctgcctttgcctttttcaaaatggaatgattagctcttgcctttgatttcttaactggccattggttcaggactcctagcccatttcctggatgttagacctatcaaaattccatggccagagttgctccaatttaccttgggggccttgcagtcttctgggcacttaatgcatatggtatctgggctttatcaatctttcagaactgcgtttatgttactgttcctagtgattatattgtttagccttttgagaaaatgatctatgtggagaacttagcctagtggagaaatagagggtaaaacatcataaatatattttgtccttgaattaaggtggcctcatttgtcataggctctctactttgattttaaagggcactcttgcctatccatctttttgttttagttatatgtgtcactatttaagaaagtgattgcattggtggcgcacgcctttaatcctagcacttgggaggcagtggcaggcagatttctgagtttgaggccagcctggtctacaaagtgagttccagggcagccagggctacacagagaaaccctgtctcaaaaaacaaaaaaacaaaacaaaaacaaaaacaaaaacaaaaaggatagtgattgctgtttttcgataggtgttttgactttagctatcttactggcctttaatttatgatttcactttcattattgggatttccgtttatcatgcctttctcttgcattcagaattataacgccaactttcctgttccttcccacctcccttctcacagtatgttctgggctaatcaacaggaaatcttgctgtatttccaacttagtactgcctttccaagcgcttgtgctgcagcctcttttgtttgcctgtcccaagtgcctcattcaatttaattctgcatacttagtatattaggcattttgtccatatttcctgtctgaagtgtagtttttgaatttgaacacattcttcgtgtatgtgtttccctcccttaaatgatgagatctgtaacaaagatattagctctgtgctcaggaagaaaagaaagcacaagtgaaagagcatcgctcgtggtctctgggggatgcaaggcccagcgtttgaaacagttgtgtgcacagtgtaactgtatctgtctgcctgcattatgactccatttggcagctcaagcatcaaatactgtttgtgctgcttaagttttcatagttcctcctaccactagcccttctactcagagcccaccctgtgttcatctcctttacttgcttctttcctattagccacataaaaacttattgtttaatgctctgtttccagggacttgttaaacaaactgctttcgcctttccaagtagcacttgcatcgtaatgtgaatacaacccaaacaaataacctgggaggcatttgggtcatcagtggagcctaatgtgatgctgtctttagacgtggtctttcttagcacacttttctttgtattccgccagtacttgggtacacagtaaaggatgggaccagcatgggctccgttgctgccaaagaggtcgagctttccctatatagttactcttcttcttctttttttttttcttttaattattctgcccaccccaaaagctcagtcttattagtcttttattccagattggaaaaaaataatgccaagaacccatagttattttaagtgactttcaggagagttccatgaagtttcggagcttggattgagaggcttgctcccaagtgcacgttcttagactcctttgctagactgcccttaggaggaaacatctgaccctttgttcaagtcactttgactgagaaaagcttccttctgatgttctatggaggtgtaaacttcctttaggtgtgaagcaggttaaatcatgagcggctccagtaaatatggttcgtggttcttgctctcttgagagaaacttgcctttggacaaagggttggagcagaaatgtttgcttttatttttttttcctaagcagtttgtaatcttcagtactttctgtggcttcaggctctcagtagacatactgtcaagctatgatcaaacttaccccttctcttttctttaccttagggatggatggggctggggaagggtgctccttgacattggtgagcgagaatatgacagatttcaggtaggggttctatgaaggggagaacaggctcatctatactctcatgtgtcaggttggcaagaaagcctgctttggtaaagccatttactctgccattttaaagataatgataaaatgaactctatcattagtgggtggtcgtgttttctggtacgactgctgttccatctggaggaagttatcactgactgctgcttatttagtagcagatagaaagcttcacacctttgggctgctgcaatcatgataatgaacattctgttcagaaggggagcattcaggctctttcccagtagcccttatcatgacactgggaatttaatacattcatttattcttctttcaagaaataggattaaatcccaaatggagcagggagcagtcttatccttctttgcatgattttcgagggctgtgcagttccagctgtgtaaacatgattgcagaacttaggtattgtctagtgggggaggactgcaatttgggtgaggcacgccatggctgggatggagccagacattcttccacccactttagtccacaccctgcggggtcggcttgctcagctcctagagtcagaagtgaagatggagcagctggagttaattatactgttttatagcttcatatcagtaggggatgaggactaggcaagggttagaaaaattttaaatcatatccttatgatgctgcacttacaacagtaggaaacaaagaaatggcagacattggacaaattaagaaaatgtaaaatattaaatgccacaagaaaatctaaaaatgactgttgaaacggcagctgaatttacactccatttgttctctatggtgactggaatgaaggctggataatatttaattgataggagaaatgtactgttgtacccagtatctggagtcagctatgttgtttaaattatgattcaatatataatcttacagacatctaatatctgggcattattgttgtgaaataaatgtgatttcttcaaaataaatgcaaatattatagggcatgcaatccttaatccaggcctctctccacaattgcttaggaagttggctctgctcacttcagtagtctaagttctagtaactggagggacacataggcatacgtattcctgaactttctgaggatgtgatagctttaatgacttcaattttccatcttattcttgggggaaggcaatcgccaggtaaagcaatgatagctggcttcctaatgggtgtagattttaagacacatttgtgatctgggaagaaggaaaacattactctttttagtacactcatgtagcatgagccagttggtgatcttcattcttgatacaactggtttttgaaggatttccttatgatttgatctgagcctgctccatgagaagaaacgaatggctggtgttacaaacttggtcaagagcccatgaaggaggagatcacgggcccagggttggtggtgctacatactactgatgctttgctaaatggacaaattctcattgaggtatttctatttatacccatagattactgatcctctcttagtcagagaagcttctttttgtagtgggtgatagctaagacagagacttattgctggtcaaaatcctgagaataagtcatgtggaacattcatctctaaacaggatatctgtaccacccctccaaaccccagggaatatcaacaaaaagggagagaagagattataaaaggcatagggtgaggagcatgctctcttgtgacatgatcaggctattacagttatgaacagccaataactgtgactacatgcacaagaccttcacataccaaaaatgtaagaaggcaaggagaaggtggttgggaagataagagtcagccgatgtgggaagggtgaataagacagtaatgtggatggatgtgaccacaattcattgtatgcacatatgtgcttgtcttctatttagataaaagtgtgataattttcctgagccattcactttaaatcactatctctcaaaatatttacaggattggaagctgtgaattgagggaaaaaaaggctgagttgatagagcaccaagtttgagtcattctacaagtattacaaagtagaaaagtgaagaaagtttagtaaattactgttgaagataaatattggaattttggggaaatcagagaatcaacacacacacacacacacacacacacacacacacacttttgttaatagctgtgggatcccagagagatgggaacatgtctgcagagtacccagcaggaaatgtatggatgcctccatcttccatcatattcaactggcatgggggaagtcttgtcaatattagccatgtgttgcctctgaaacttcaaactgggacacctattaacagtgtgctgcatgttgtaattgtagcatctgcagagcatcccataacatttagctggtggatgcctgtctgaatcattaattgtgagcattatgggtgccgtaacagcattggaattcctgcaactaaaagggaaacacatttggcttgtacttcatccacaatcacttacacttaagctattgatagttgattgggatctgtagcatgctgggtttgtgccatggacctctaaacatatttgatgggtggaacagacagggaggctgtgggttttggcaagctgtggctcccattagtcaggctgactgtgtctgacactaaagattccaattcactgagatgaaacttacttctctaggctttggctgatggcccaatgatcttaacgtgaagggcaagagagagccagtgttacattaagttgcaagtctccaatgagcaaatagttgagtcgtttactgaatagtctgttttttcccccttttggaaaaatataaaatttatagcacctttttagaaattgaagactcttcttagatttaaaatttttgttgtatagcaaatgctaaccattcattttccttatagggaaatgtgaactttttcaaaaggtatgtagactatgtaatttaatagttaatattcctgtccttaaagttttcatcttgtacatgttgctgctaacatatcctactaaaggcattccagacacagctgtttctaataataggaggggccccatagaaatgtcaggcatactctgagggggcttcagtggaaagaggaaatgtgttcagaaaatggacggtttccattatctgtggctttcctggcagacactcacccattgctattgtctatcattgcatccctgtagctaaccagggtatgaggtttttagtagaaagtcttgctatgatgaagaaaagccacaaagctggaggaaaagagagcctggaagatgagtggatattttggtcacagcagaaaggagctgaatagagctaaggaagacgagatgaggacaagcaatgggaattaatccatgaaagtacttaatatttagaggttggatgaagaggttcattgagcagcagaatctcctttcatgcaatgtctatgaatatgataaggttttgtaaaggcagttcagtcttaaatacactagaggagctggcagtgtatggttcacagggttgttctgtctactgcataatcagtctactattccacagccctgaataatctgtggaatgtggtcaaaagaaagtaaacagtacagatgggtgatttcctctcatgcaagttctagagctttcttaaacaaaggggagatgtgagcatcctttttaatgtctactgttagtttttgttttgtcttgataagagtctcaccgtgtagcctagatagctttaaacttgtcagcctccagcatcctcttactctggcgatatcattcattataggtatgcactaccacagccagtcacatttagtttctctggaatagaggctggccttgaaatcctgaccctcctgccgatacctctcaaatccttgatgatagatgtataccagcacaacaagtcccatctactttctgtgcagtctgcttgatagctctctttaaatttttattgcttcatcaaagctcctgggaaaccactgaggcatttagatgctgtgattatttttaattttaaatattagtcagtgttaacgttttttttttttctggatctcctttgtctagttgggtggtacagaaggaaggccagctctgtcttcattcctcttgtaaacagacatgcccaggagaggttgtttttaattgtcatgcagaccagaaaacaatctttatttcagtctgttgaacaacagcacaaaaatacttcacaagcactgggttcactggtgtctttttaaacagccattacataagaaattagcttcattccacaatgtttgtctatttttgtcttggtaaaatgattactcatttgttcaactaccatagatctcctatatcagaatggacaatagcatgttaaaaacgcaaacttttcagtttgtataagctctgttcaaaactttgtgctctgaagagtacaaaaattcccaagagaagaaaattacttgttagcacctttgttcgtgttctataagcatctttttttttttaaagatttactcatttatttattatatgtacactgtagctgtcctcagacactccagaagagggagtcagatctcgttacagatggttgtgagccaccatgtggttgctgggatttgaactcctgaccttcagaagagcagtcgggtgctcttacccactgagccatctcaccagccctataagcatcttatacataaagttatgccagcattacaacgctgtgtataacctacttgtaatgtgtatgtgtatgtgtgtgtgtgtgtgcatgcacacatattcagagtattttaatgtctcttgaagccttctgggtatcagttttcctgccccattctcttcttttctcagttctccagcccaatggattaattcatggccattaggatagagatggatagatagatggattaatacatggatggatggatgatgggttggtgcgtagatagagagatagatagaagacttgggacatgtcttaatatatatgagcaagtgatggtctttagccctttaactcactaccatttgcatttttcaaagctgattatttatctgcatttttaataataaggcagagtattttctgtcaactgacagaaataaataaaaaaaattcaaagttgaattaagggataagaaagctctagggccaaagaagctttttctgtaattaataatttcaatttactcttagagtatttatatgctaaagtccaacatttcatgttaaatacttctgtgcctcccatcttccagctgccagattggaatatcagagaatggaaatcacacgggtttcagtgactcttccaattctctactcccattgctatcttgttttctgcacagattgcttagggcttcttttaccagtgcatggtatttcctcattagccccgtgtctcacagatccagtcatgaaagatacagatttaacaaacaagggggaaatacagtaagattggagtttaggagcttcagtgtgtcagaaaaatgagattattccaagggtatctgcaattgggcacaggatttaaatttatggttctgttttttttccccagtaatcttttgatttgttctattgttttaatttgtgtatataagtaattgttaaggactagtagggatacaggtggtggtgtggagtgagtgccagggaagagaaacagagggggtagattttgtttctataatctaggcttactatgcatcagttcctaccaatatctttctagtactgtgttagtgtgggtacaggtgtgagttaactccagaaagactcgcattaacggtggctcaaatagatagcaaggcttctctaatgctctatggaacctccattttctgcatcagtgaggagttggcaaaggtgatgaggtcacagtgaagcatgtatacgttaaaggtataaggaccatttccttccagataagatcataggacagatttaagacaccctcacattttcaaacgtcttcaaagagtagattaattggtttctcttctgaatttgtataattgctttcgagacagcaccttataacatacagtctgctttcctctaccttgagtgattaagtggacaaccccaaaagaacaattctatgtagttttaaagagaagtgcaaaagaacaaaattgagcattgtccataagagatgggtaatggtaagtaaacagaaggtgacgtttgatcccttcaattttactattcattattcatagttattattcataaattccagcacaaatgttaggtctgcaccccagtgacacatttgcattttatttaaagttgacttctacatagttgtgcaaacaaggatttcatgagttgggtgctctttctttgttgcttatcattttcacatacctgcttctgtatcttttacattatcatctctaccatctatttcactattctacccaagattccccccaaaatgatttccaacacagaaaagtgatatttgaatatatttccctaaggcaatcaatttacttttaatttgtctggaactaagcttttctttgttgcaaaaaagaaggattgaaacggctataaaatttattagcttgcaggaagatatctgaaatgaatttttaaatgattttgctgttttctgtacccagaagcagtgtcatcagactatagcattccagatggtagctaaagtcacattaaaccatcaagataatgcgaacattttctataaggcttctgttggtaacagataatccacccttggtagctaacagacaccaatatcccaacatttctgcttcctttcagtgactatttccagtgacgtggcacactaaaggcgtggcacactagtcctttgaatcattgcaagagacaatgattggcttactgaacatttttattttcaaactcgaaggagtgattgggaaattactaatgcagtcttttaacttcccccgtcagtcctgagaactgtttggtattacaaaaaactctaaggaatctgaagttaaaattgcaatgtttattgactcatggccagtattgtactttccacaaaacgtgctgtcctgggacgtaactgaaggcagtgtcagttcctgttaaggggaacactgttgttggatattccccccaatgtccaacattaaattttcatttaaaaatggaagtttttttttaagtgctggaagtaaaactcagcatcttccctatgctaggcaagcactctcatcattaagctttatcccaaactgtgcaatgaggaatttttttttctcctagttaacatccctgtttttttttcttgctttagctgccaacacaacttatgctattcttactatgtgctttttgtctcacgcgtctaaagcctcaaatctatcacaatgcagcttttgcccaacttcataatatgctagtagtttttctatttattttttcctaatttttggaaatgaatgaaaccaaattacagccaagtttaggttcagagctcctggtgagcaggatgtaaagatttcactttgccaagagcataaccactttctgaatgtgtgaaatgatctggctgtgtttaatctacacaaaatcaaacaaatggattgaattcttcagagacctgactaggtgtaagattctcactggcaagggctacggggcttaattctgcgagaatcttacagcaaaacccttgaaaacagcctcatgtcattcagagttgcagcatctcagtgcttcacattgtagcggatcgttcagtgaccttctgtgtcatctcatattttatctgcaaagatgccttttaaaatggtgtctaggcacttagatgatggccagcactttgtcacataatttttttttcccgtcgcagaagacaaacacaaagatcccagtctacttcatctctgcttatctcagtcactgtcaccacttcttatttttctggctctgttttctgggtagccttttactcaagtttcttgctccctatgaatcagcacaaatgatttatacttatacacatctcaatatctgttctttatggacggaattgaattgagcaccagtacagaaatgaaaatgccaggaactattgtgactgccaaaattgcaacttagattgtatgaactgtgcatgccacactgtcatcaatcataaatattaaattctcaagcacttatccttcgatatgttttaactctgtctcttcaaccagctcagtactaaagattccatagaagatgattcaattgctttgcattttaaaaggttcatcttttaaatccatttccatgttctattggtgggaagtgaattccaggtgaacaaaccatgaatgaggagagagagcttatgtaccatttggcaccagaagttgtctgttgggtggtacttgataactaatgcagatctgtcaaattgtctggggcaaggttgggattcattcgtcttttcagctgccttccctgtgtcaagccaaaactaatctttatagaatgcccagtgattttttaccatcctgaaaaagctaggatagttaggactagctttttttttttctcattttgttcatttggggcagcatcactttgccatgctcaataattttggtttgataccctattcctaccctgacccttctccaccagaagctgtgtctattcttccttactccataaaatttgggtcccctttactgaatgctctgctaaattacaaaaggaaaagattgtctcagttggacagaagagcctcttatcaccctggcatttcttaatgtatatccttagataaatgaaaaatagtagggaatggcctcaatgtcataagaactggtttgtggggagcacattttgatatctattaaataacaacacaccagtattttcaaatgtcagagttctgccaccctactaattctgtctgatgtgtatctgagtatagtaaggagtgattggaagtaggaggctagggaagaggacaacaaaaattaatgatttaaggaaggaataaaggcagaagggggtaagatacaaatagctgttagcatcatcagaattagactggctgcaggatggcttagtactactggctcctaagtctggaaaactgtctcagccttcatacatatcccacacatgttgttcagaaggaatactgtctcgtgtggctaattttccactttatgaactgtttgcaattccactcccctatggctttgagttgtccttaagtcttcactgaatttttttttctagataattagaagaggtacttttctccttgtatcttgacatccaaggaaagccagttctcaaaatatcaagcaccgagtatctgagccccacacagtggttcctgctcttatccccttttcaccatccctgtcctggcttctttttccatggagctcattagtgctctgagtgctttgtcaagttatagacacagaatagttgtcctttctttggattctgaaggccttgaaagtgctttaggaattcttttttgaataaaccttccttttggtaattcccccacagaatagattggtaaaaggactttgttatgaaatcttgtaatattttttcagtaacatctaaattagttttgacagagtgaatcagtttctcctttagatatgaaaggcttatcttaggtcatatttgtctctattttatgggaatcaatgacattttctcttttgctttttaattaatcattttatttgtttacaattcaaatgttatcttccttccccatctctcctccatgaacttcccaccccattcccctaccctttgcctctaagagggtgctcctccacccacccacccactcctgcctcatccatctagcatcccccttctctggggcatcaagcctccacaggaccaagggcctttcctcccattgatgccagacaaggctacatatgcagctggagccatgggtccctccatgtgtactctttggttggtggtttagtccctgggagctctgcgggttctggttggttgatatttgttgttttttcctatggggttacaatcctcttcagctccttcagtccatatctatctcttccattgggattcccgggttcaatggttggctgtgagtaaggaaacagtgtttgatatttaaacaacacattcagttcagagataacacttttaagctaagttaaaatttttaatttatcataggtctggtccctgctaactattttcaggataggaagcttccatgttgaagcaattatattttcaattggatgtcaaatgcatattagatcgctttaaaactaccccaaagcacttgtaacttgactaatgcttctcaagttccattttttattgcctttgataaagtgacacagaatccttcataggtttctccaacgtttctattagctaggacatgtatttccaatttcaggagttgtgtcagtggcctgctgtcttgaggatcaatctagatttctttgttctttctgtatgttttaatcattccgttaagttaaactgttatctacaattgctctgttgtggcgttttttgctagttttagtaggtaccagaaaaaccagactacatagcttttgcttatccagagctttaaaaagcaagcagaatacacatgaattacataattacaagtaggatgaatgctatgacagagagcttctatggcccctatcttagtctactggatcattgagtgattccttaagaaagtaaaattctagttgggacttcaggaataatgttatccaccatgagttgtgttcatctattggaaatagggactccattgaagaaaatagataacctaactaaacgggagtttattttgcctcttacataaggagagttcagctctgatatggtggctatatacttttagctatatactaaggtccttatatctttctgttttgcaacccataggctcattattttcatccttagagttattgcattgttactaagatagatatcggagctgtagtcactatgattctgttccagataggacaaagaaggaaaaaataaggacacatagtctcacagataaaccaagttctcttttaagttttcataacattctgcctttataaggttggtttgatcctaggtatatgatcatgcctgtctagaaggaagtgcaataattttttaatgaagtaccttattcctaatgtaagtggggctctgtttctaatgataaaaaaatcagtaaagttatttgtaagcagcttttgaaaatctctgcaccagatgagtagaagttacttaagtggggataataatcaaaaagtgtgtttcatttaaagctactttttatttgggtgtatgtgaaggaatatatgccacatgtgccagggtcttttagagacagaagagggcatcagattaccatgtgctgaagttacagtcacttctaaacacctgccatgggtgctagcagccaaactccagtcctctggaagatcagtgaatacttttttttaccagtggtccatctcttcagcccactccaaattgtgcattctcaattaggcaaatgtgactaattttaatgacatttaccttctttataatctttgcaacaatattctccattatactttccagaaactgaccctgttttagttatagattgtcttgctcatgggctgatgaagagtaagttatgtaggtgtgtagtggtataatccaggaagcttttctgattaatagatcacttgctagtatgtcgaattaatgttgctagttagaacttgcagtaggtgggactcagttatgttttcctatttgaaaatcacttctaaagaggtaacacaaatgctcttgcaactatagccttaaactactttagtgttggagtctttgatcattaatatatttgagataatgcactcaaactttgaatcataataaagaactagtggtgttgttgaccacattcattgtgactagacacatagagaaatccaacagagcctctcagcttctctagtcttccaggactctgaaacttttagctaagcctgagttggcttttattactttggatgagaccatgcatagactctatttttgaagcacattgtttgcctttatctaaaaggacagctgttttatttctcaaagacaatagctattgctatacaaacttttactgtttgtataaaacaacatattctggtctttttctatttgaattacttatttacacatcacaatataattactgttgtctgttatgcctcctgcaactttgcaagactgatgtttggagatttatttattgtttatttatttgttgccagctgcttggaaattctctcatcaaagtcctgacaaaaataataaaacaattattgattactatctaaatatcaggagctttatctcctactttcctcttcctccttcttctcctcctcctttgcttaaaacaactatgttttcaagtgaagacgtctctgacatcatgatttgtgtccctcttaaaatttattcatccactttgattctttgtgtgtgtgtgtgtgtgtgtgtgtgtgtgtgtgtgtgtgtgatttgtaaggcccggggataacttcaggagtaggggagactagctgacaaacttaacagtcaactgtagtcatgtgtatgtctgaattaaaaccacttgccttagggctatagagatagctcagtggttaagagctgttgctccacgtttaactcgaagcacccacatggtaccttcaagtcatctgtaatgcaagttccacgggatagccatccctcttttggccttctcaggtttcaagcatgcactaattcacttacatacagagaagcaaaacattcaagcacataaacagaaatacatcttttaaaaaccaccacccactttcactaatttgtacatggcaatgtgtttgaatgatcacaaataggtgtagattttagaattttacatttttgcctatttttaggccaatactttcagataaagaaagaaaatatcaagtcacataaatgctttttaggggaaccctaatagggaattggtaagtcattagggtgtttaaacaagagtcagtgttctgcctatttgtggatgggtgatgcaaaatggctcctctctagtttcaaacctctgtctaacacccagctgttgtaacttttccaatattagcccttttttcttttcttttatttgttttcttctttttcttatgcaatctatctttgttgatatcaatgagaggcctttctgttgtgttgttctcatgtttgatattacagcgaatttctttttttttttttttccattttttattaggtatttagctcatttacatttccaatgctataccaaaagtcccccttacccacccacccccactcccctacccacccactccccccctttggccctggcattcccctgtaccggggcacacaaagtctgcgtgtccaatgggcctctctttccagtgatggccgactaggccatcttttgatacatatgcagctagagtcaagagctcaggggtactggttagttcataatgttgttccacctatagggttgaagatccctttagctccttgggtactttctctagctcctccattgggagccctgtgatccatccattagctgactgtgagcatccacttctgtgtttgctaggccccggcatagtctcacaagagacagctacgtctgggtcctttcagtaaaatcttgtacagcgaatttctttgctaaacttaaattatgatttatagtacatttaacctgtcagtataaatcatgatcttatatagaaaatagatataaatattttaagctatgttagactttattttaataatattgacacatttaataatattgatttaggaacaaaaataatacaatttccattgcattctggaattcttgtcctgatggcttctggagagtcttggtttgatttatacaaataaaagtcaattattgaactgtgttttcacttctttacccccaaatctgacagtcatttttataggtattacctgaagagttatgagataaagttttattattaggaaaactcagaagctataaatctggtagtactattacaatcctagggcctccaatagaaagcacgggatttaaatgaaactgacatgaggtatagccattctttcattcctgtatttgaggtttacacaaagttccttctttgcatgtacaagcctattttcattacttttttatatttttatgccccccccccatgaacatatgcatgttgcgctgtgatagggtattacatgacatcctttggaatttacaaggaagaggcagagaaaagggtttgacaaagtcttcaggttttcacatgcatggctattcatgcagttgggatagaaaactgggcttgcatttgaagacttgttctttctctggggcaggcacttttcttgttggtgatggtgctcttttgttattgtctttcaaatatgcaaaattctgagtgcttcattcttaagcactgaaatggttcattaaatacccatattaaagatgttggtgatgtttttatacaggtgtttttctttagtcagattttaaatagtacatggttgttcagtggtcaggcagatgttaatcccatgctttgccaaaacagtctttatagaaaactcctcttagagccaaatgaaagacttagccctcaatatacctgagctgaaaagataaaaatatgttattataataattgtgaatttgaactattgagatcttctatggtaggattaaagcagtcaacaaaatctttatttttggtagcataagatggactatacatatttttgagtgtgaactgtgatattttaatatctgtatgtaacatgtattatttaaatcaatataataagcattttgacctactcattccttagagtcttcaattcctctgtctcttctagatcctctcaaatatacaatatgttgttgcacattgtagttccacttgtcatgcttctttacctactcctctcattccttatccttgcctttcctggtttctaatggctacttttctccttttgtagtttccatatataaaggacagcatgtgacacttgattttccagtttcagctccatgtagctcttttgctcagtgtagcacttcaatttcatttactttgtctcaaaggatagaatttcatttttgttaatggctatgtaattccagtattccagtaagcatacatatcatgctttctttatccattcatctgttgatgggtagctacggtgattctgtatcttggctaatgccatactaaaataatatacttggttttgtagggaaccttattattttattttctctgaatatatgtccagaaatgagaggtagattagatagaggtttttttttctgttttaaatttatttcttaggaacattctattttgttctctctaatagctgttataatttgcattcctactagctatatatatatttcattaggaagcaggtccttaataaaagtgaagattaaagcaaatagggagaaatagcttatttgtggctaattaaatgaaccccaacatataagtcgtgtgtgtgtgtgtgtgtgtgtgtgtgtgtgtgtgtgtgtgtgtatgtttgtaattgaggctcgtgagttctctggaaatgaaggagtcatagtgtttctgttgggaaatctagtcatagagatgtcataatgaagtgactgagataactgctggtgagagagaaattatgtattaggttttcaaagagaatgcatagtaatctaaatggatacgccgtgtatcgtgtatcacttgataaggtggaaagtggttgatagtgttattaggaacaatgggcaagtttctttgattgagtgaacactgggtttcctccactgcttccagtcttgtgctgaatgcactttcaaacatgggtcaattttagcagtaggtgttgataaaattgctgactctccacaccttagcacttaggacatttaaaaatatttttttcttcataacttgtttctctttaggattttgtcttgtcaccagtaggaacagcaagcaaggacaaaaaaaaaaaaaaaggagtgtttagagaaggacctatagctttctaaaaatctattttttccacagttgtccccaaagataatgtaggactatccaaagtgctgtttcccaaaaggacctatggattttgagaaaccagaactgagttgtttcgtgattcctggaaaaagctgatgaaattgacatcttccttttcttcttacagaccagaatgaaggatttcattgcagggaagaatgccggattcttggccactctgatagatgctggatgcctcggaatcccatgcccacccgctccaagtcacctgagcacgtgaggaacatcatcgctctgtccattgaagctactgctgctgatgttgaggcttatgacgactgcggccccaccaagcggactttcgcgacctttggaaaagatgtcagtagccaccgggctgaggagcgtcccatcctgaaaggcaagcggactgtcgatgtgaccatctgcagccccaaagtcaacagcgctatccgggaggcaggcaatgggtgtgaagctattagccctgtcacctccccactccacctgaagagccctctgcccaccaagccttctatatcttacaccgtcgccctggctcctccagctcacgatctggagcaccatgccaacagtggcgcctctcgtccttctgaggctgagccccgtggagccgacaacgagaaagtgatgcatgaggtcaaccctattcggaaggatggtcgtgacaaggaatctcctagcgtgaagcgtctgaaggatatcgttctctaaagccatctgggttcgaggaagagagaacagaaaccacactggctagtgaagatgtagcagctgctcattttaattgctcaccaatggttggctcttgagtggctgcattgcagagctttccctaaatgtattgtgtataagtgactatcattctgtgacaatccctctcgtttcaacaggcagtaggggtgttcagttggagcaaattagctttggcttgagttgtacatgaggccttgatgttggggaaacagaggcaaattcagttgtgaaaaagtattatgtattaagtgtttgaatttatatatttttatatgtcaaaatgataatataaattaccattgtttgtgaagaattacatttaaaaaaagcaaaaagaaaaaaaaagaaaaaaaaaaacaacaacaaagctctggacacctttaagaagctcgccactgtttttttgtagtgtagacaagttactggtcatttattgtgtacaattcattgtttcagtgatgtgaaatcgagcccccaaaaggttgtttctgaagctcgagtactttccaatgccgctactttgctgtggatgcccctgctttaagaacccttttgctagctgtgctgttgttgtatttgatattgcaaattgctatgtgtgtggtgatggcaaaaggcttttaaaggttgatgttttcttttcttaaaaaaactaataaaaatacagataaaaaaaatatcaaacaaacaaaatgcgaacaatggaggcagcaaatgagtttagcgacaccatgcctagaggtcgaggacttggtggctgcacacatggtgtgattgctcaccacgttgaggaggatttctcccgcctttcagtcttctgcctcggtctgtcgctagatcattgtagaaagtcatttttggatttgctgctatctaatttgcagttgtcagaaatactgtgctgaaaattttatgagatacattatatattttttttctaattttcaggccctgcacaggaaagttactcccaaagttatcagttttcaggctgagaaattccctgtctccaatcatctaaaactcatgcaacatgactgagtctatttttgagatctaaattaccatctttttagatacacacttcctgattcagtgttttcccaatcatgattggacttagatggtaaagtgcatcatgggctggaatcaagggctccatattgctctttatcttacttataaataatgatagagtaagcagtatgaagtgtacacatacgtaaagacaggtgataacatcactaatctaattactgtgccttctaaatggagacactcagacacttgaacgcatctttttatgactaatacttttttgattaaaaatgtgaacaagaaattattaagacaaaacttctttagatttagctaactctttttattttctgtaggctaggaatatgccttttaacactaacaaaccggacattctttttgttgttattgttttaacactgcacaagtgcccctattttatcatgtctattaatattcactagccaacatagtattcttgcagcctaagagttcattatttaaaataaactaaacaaacatgtcacctttcctctgcctttgtcttaaaagaattgtttctaaagaacaagtttttttggttcttctctcttttgtaattcaagaatacttaaaaagaaaggctagaagttagagcgctagaattcaaaagagaatttattttcttaagtttagtagatacagtcagctttttgaaatgttttcattatttttatctgagttcctagctttatacattactaggaatactttcttttgtgggaggtgggagggtcttaagggagggggtgggtaaggcactggggatggggttaggtaagggagaagatttctggaaaaaaaagacacctataatgaagctacaaatccatcctcatttcctattctgtactgaatactacctcatgcaaaatattggcatggctgcaaatttccccctgacactgacagagatcagttgtccttccatcttcttcttgccttagttaattttctctcatatattttctcctattctgatttactttattttagtgtagtagattatgaattagctatttatttttgttcttccagatgactatttaatgaacacgttcagctttttacaagtgtcctttaagttaggaagactgcctatagaatttccactgctcttcaccatgatccatctgatagtatcttgttagctagcgcctcaaggtcactttgtagtcagactgtacagttttctacaggtgtatttcttactagagagtttgaaagattgtggaagatggaaatggaaggttggaatgtagagcagccactgcctgcaatagtcttaccagccacttaaaaacagtagcggtggcattgattttttttgccttttacctttttttaaaaaagcaactaaatttcttaaattttatccccagaatttactttcaagctttagattcatccttttaccctatctaaaacattgttctcagtgggcagtcagatgttttttttctgtttctaaactattatgttcagagaatttttctcattaaggaaattccccctgccccctccaaccctccaattgtctgatggaagtacaagtgcatcctaggagggcgggttctaagggcaggctgtgcttgcaaatcggacttttgcacaagggtcttaaatttcccaccaaattgggattcttcccctccccttttaatacatgtgatgaaaggctacctaggccaatggggcaattatcttttcctctttatttatttatttttctgcaaacatgttacacacaaatgggaacaattttagttcccaagtcctagggaattctactcattctgatgtcccttggtcatgaagtgtaacatgcttaaattttttctggccaggtaaacgtctttattcagtatagggaatctagtttgcattgattgattgctttctcacaaacataggaacatgctattcagtaagacatagggagaagtgatccacaatgccctgtggaaagttttcttttccctacgcagactagtaaatgaaactgttcagattgaaacttagagttccgttgatcctctgaagccagtagaaaaagtgaaggtttatcttggtactgaatagatagtgggctttggaattcagtacttcctgcagaacagtggttctcaaaatactgtctcagagcaacatcacttaggaacttgttagaaatgataattctctatccctgcctagaatgactgtataagaaatactaaggaactggcccagaaacccatataaatcagaggcccattcaagtttgagggcttgtaaaagcacaggtttgtagagcctaatccttagagtttattattcagttgttttgtggtaggaactcttttcctatctacagatgcctaggagatactgaggagacaatgctccagaggaaacttgcctcataggactaactgcatctaaagtggccatttatacagatttgttgatgtggtgaccacctgatcactaatgaaagatgtagttctgaactctgaaactggaaagtacccagagtaccttccagatgctgtcatctcagcatatggctggtagaggggaattcagatgacttttcctctacatctcccatttcactcaaaaggaaacacaaatggttcacttgacgtggcaaagacaaggagcagtttggggagaggcagggatggaaggaatagcttttttgggcattcaaggtggagaaaggattattactgtatataatccattttatggggatcattttgatgtcaaatgttcccccaagacactctcagcaagtctggtccacttggctcttttcacagggtaataaaacccttctgactttgacaaactggcataaatgagctgaagaagtccattgtatacagtcctagtgtttgccttcttggtaaaattacattttaaggatgtcatttcatgagtcaaattgtatctgctgacactaaagtgtattgagatgttgttctttagtttaagtatgtatcaaagtaatattcaaaggggatgttatgggggtgggactgggactgggtggctttatattgatattgaaatattccagagcaaaacacattgtcctaatgaagttgttacagctctctttgttttcttgtgaagctggaattggcctgtgggcctcttgttgtgcaaaagtgaattaatttcaaataggaatcacattgcttttgtaaaacaaagaaaatcaaccaccttgtctgaagtataagttgtaaggctctcttggtaaggaacaacccagaaacacctgaccttgattggaaagcattgtaggtcattagggaaatctgatgatgctgactggtgttccagctgtgttggcaattaaagatgaccttgttactaactgaatgttgctgtcaactttagcaaacaaaccagctaacacctttacagcaccagttaagaagatgtttactggcactggttggtattcagctgaggaaggctaagatacagactaaggaccaagagccagactaggtctagctagaaattcagcaacaaatacctccttgtgctatttgaatgctaaggtattagttgcaaaaggcttacgccttcgctcctctagtgaggggaatgagcctgatgacactattactgtttacctgtcaaaccagggtggcgatttagaaggatgcaagtacagtatgtctcattaagcagtctctgttgctgattatatgaagatgaaatggttgtatatgctgatctgtatgttatgtacattttcacagtgattgaatcattgtaaaaacaaaaaagacaaaaaagaatcaccactctgtctattttatgaagatgataaagcagctttattaaattattacagttctgttttaaatggtgttacctgccacattgtttccttttatctggtggttccctgttttcctcttaaatgtgttttctctgcttcaaaagtttaatgcattttagtattaaaggctattatggaaaaagtaatgaagttttggtg

SEQ ID NO: 738 - DNA, 106131 bp, mus musculus; identical to SEQ ID NO: 737

SEQ ID NO: 739 - DNA, 5115 bp, mus musculus
ctaagctcctgagttaggatctcagccagcagagatgtccaagaagccccggccagcagcggcaggtgagtcagaggaccaccaggccccgggagtgtgggaagtgtctccgcggcatcttgccatggccagggccaccaactggaaggtgtgaaggctctcatggctttgcgggggggggggggatatattttcagcgtaaatgagcaaaagcgggaggagcggaacttttccgttgggtttccccaagaaaaaaagatgggaccgggcagtctccaaagggtagcacatggttgtgcgctttaaaataatgcagaaccaagtttgtgttgcctggagcttttgggctccctgactacaccattccaattgtcccgctgaagggagataagccagatgtgagaggtggacattgattctgttcatttagttaggcatctgagagtgcctcgtggaattttcaaaaacaaattaagaaaaatgaatatttctaggggagggaagtggatttgtgttctttaacatatagttctttctggttttttaaactactaaaactcttctcagcgaggctcttttttccccttctctccctttaaacctttttgctggggctatcaacaaggagatactttaaaatcatttttaaagaattcatagtttaataaagtttttattctgtaaaagaggagttgccaaaaaggcattaagatgaacgaaaatccctaatcttagttcggctgagaagtctgaaagataggactgacctgataaaatcttgcttagctagctcctttattacattctgtgtttgcattcccagtcttaagtattttctgttttctctgctttagtggtatattcagccccaagggttatttcatttactgtatacttctaaattgtgcccaagtatgtattaattgtgcaaaagtttttcattgacattttcacatatgtatcagcaggggagctcttgagctagctgtgaactgtgcacgcatgcctgcaggtactgcaggcatgcaacctagaggctgtgcacatggcctagaggcttcgaacatggcctaaaggctttaaggctggagtttgactggcagcctcagagagtcatactgcttttgtttttcattgcttatatatatgcatatatatatgtatgtaagcaataaaaacaaataactatcaagaataatgcattctctagcctcttcctgggtgtctttctgcactctgtactttctaataacttctaaaattatatactaagggattgacttttaaaatatttttattaattgagcattccacataatgtattttgatcatattcatacacctccctcaacaactctgagatccttccttactttcttacagacctaaatttttgatctatttttctttgcataacagtaggtggtagtaatgaataaataaaatcagatttttaggttctattcataccactctttcaaggagtttatgccataaagctagtgtccgtggtctggatatggaaggatggaactcctttctcccaagggagggctgagccactgcagttgagccataaaaaagcttcttgctatcccaggatcagtctgattactactgttggtctatttgggtgacttaaatattgaaaattaaatctttgttcacttcaaatcagtatctacatataggttctgggttaatttcattctttagtttgcattcagccccacagaggtcatttagtttgctgaaatttactattttatttgatagttgtttcacaatagcttagttatttgttcatcaaataacatcgtgtaatttgggttgactttagaaatgataacacttagaagtcaggatggcaaataaagtatatgcacatttgttttccatgagaatcatgggtaagttcttatggagtattattagtaataccagagatgactatcagagtgagaaagagtttttaatgacttgtttgttttctttgtgttttttatgaactaaaaaacaagccatgagtgtaaggcttgaatgtcatgacgttgaggaacagtttatattgcgtctgcctccggtaagtaacttttatatcccagaatacatatcttcagtgcaaaagtatagttctgcatagataacatttgtatttcaggctataaaagatcagaatatttgctctccataaatcatcttctatcaagcagtcctattatagtgcatattcttctcacaatatttcttttttcctgtacataccgtcaatcatgtgggttaattccttgccaaaacaactatgacaattatggatcatccagtcacttactataaacattaacaagcaattttttgcacagccaaggtaagactgctctaaaactctttctgtcatctcagaagaggtggttggaggcattaccactatgtcacctgcaagttcatcaccaggccagcttatcacactcatttcagtattgtgctcgagtctctttccccactgataaccatggtccagcattatttcatttatgagattatgatagagatggccaggaagatattattcaattatagttaattaatatagctagtaaaccatagctaagcctttccaacagaaggatagcaggaagaagtgaaactgaaaagctaggagaaagaaagccccaactgtagttcctaaaagataatgtgcaacttcaattgactacatctaccttgacttatacaatgtatggtctttcatggtacacaacataattaatatttgggaagtgtaaggctttatttaagggaagacttgccttgaaatgtctgtcctattagctatcacttacacaatctttctgatttttaatttacctcccttttaggaacaagcttatgctgtcaggaaaattatacattctagaaatgctgcttggaaggataaactaaaaattgacttttctcgtaagtagttaatattaattcacaatatattaaacaataatttgctacagattgttatgcgccagacactgtactaggcattagagttctgaaaaaagaataaaatatgttatttttccaaaaggactaggtgcatcttctccttattgaggctagacaaggttttttgttttgttttgtttttttgtttttgttttttaaaggaatgtatttaaatgaacgaaatttacttttggtgatgacaagaaaacagttgctatcttattcacctttgctatcattagaaagaaatttactttttaactagtaacgtacaatatggaaaaacaagctatagatactcttctttttctagaagttgctaatcgaatattgatttgtagcctttaaagaaatagtaagtttcattgaagagattgcctgtctcacataagtcttcattattcaaattcttggagatcaaagagtccactgaaatgtcaatcttttctctcctttctcttagctgatggccaccatgcggttgttcaagtagacaacgtctcactgcctgctaaactggttaatctgccttgtgttatcggaagcctgaaaactattgacagaaagacattttataagaccgcggatgtttctcaggtatgattttgtgagatgtggtctcatctatcccaggttagccttaaactcagtatgtagttgactatgactttaaacttaaaatcattttgtcttcaactaccagatgctgggcttccatgcatgcctctctatactcttgggttgtactgaggatcaaagctagggctttgtgcatgctagacaagcactctaccgacggagtgatttcccgagatccacaaagccttgtttgctttgctttttagtgctcatgcatgctaggcaagtgttccacctgattttaagctatatcgccaccactgggtgtgatttttaaaaatcttttcgttcttatagcttttgtggaaatcttaagtctctgtcatgattcctactgcatggtaaatgctctggtttggtatctgttatttaacgtttcattcctttacttttacagactgatgctccccatttgccatttataatgactctcattaatttaaaaataggaatggctaagatccttttctgcactttctactaaagcagtatgttcactgaagaacagccggttcttactcatcatctctgatgctgctttctgatttgctctctaatcaaaatgcatcttatactataccttctgcagtggtaaactctaggtcaaagttgaatctacatatcatgctgcagggagagagggagagaagagggggcgggaaggaggagaggatgggcaagggatatagtacagagaatctgagtgcacagtgcttagaacttggctctgggaaatgcttggagagacttcggggctccagattgatggtggtatgatcgtgatttactactaacccatatttggacaataatcaaattctttgtctttgctcaatgtagatgcttgtatgcagtcctgaaggtgagcctcattctcctcctgaagaaccagttgtctctactggtcctactgtaattggaattagtgaagggaaggcagagagaaaaaaatataactggaagcatggcagtaagtcaccgttgctcattctggctgactacaatgacctcttgcattgcaattccctgttaaccagggaccttttacctggttcattaaactcttatttttaaagaaagaagtcattccacaaggaggacatagttctttgaggaatttgtataggtataggacagtgttcagttatatggtctgtttcatcatgtttttattttagttactccaccacttaagaatgtcagaaagaaaaggttccggaaaacaacaaaaaaggttagtctcatgccatttatgattctgtggggtggattagaggaggactgtgagagggaaagaaaggaagcgaatcgcttgggaactcatcaattcatttatatgttcagtaaacagttcctgccagatgaggtgcttcctacctttaatctctaatagcacctgggaggctaaaagaggagggttgtgagtttaaggcaatccttggctatagaatgagaccgtgtctcaaaactgtaaaa

SEQ ID NO: 740 - DNA, 7951 bp, mus musculus; identical to SEQ ID NO: 99

SEQ ID NO: 741 - DNA, 185 bp, mus musculus
aaagaggtcgcagctgctccctggagtgtgcgcggtgcccggagaccccagaccgtggtggggaggaggcgggaacccctgcggagccccaggcaccagggttgaatggagctgctgctgggtgtgatgatctgcagactagcacagcctactgaccgcctggcagttggctttctgagcgccca

SEQ ID NO: 742 - DNA, 74 bp, mus musculus
gggtgtgatgatctgcagactagcacagcctactgaccgcctggcagttggctttctgagcgcccatacccggc

SEQ ID NO: 743 - DNA, 133 bp, mus musculus
gagagatgacttagaggttaaaagcactggctgctcttggagaggacctgggttagattcctggcacccacgtggcagctcacaactatttgtaactccaattgcaagagatcccttgccctcttctggcctc

SEQ ID NO: 744 - DNA, 2853 bp, mus musculus
cgcagcagccagcgggagagcccaagagctactgagtgagctaagatttaaagacacccgtcccaatcagggaaaggccgggattgaaaagtgtagctggggtgttgatccagcccgccaagtattgtgactccattctgttttttcttgtctcaagaataattgcttgaagaaacttctcaacatggaaaacacgcgcagtgaaaatgaagagcaaccagagagcactctgaagatcgatgaagagcagcctgcagtggagcagtctcctgaaaatcagtgctctgaggaggatcaatcctcggaggatctgtcctccgaggagcagtcctccgaggaggagttctttcctgaagagctcctgcccgagctgctcccagagatgctgctgtctgaagatcgtcctccgcaggagtgcctctcacagaagaaccagttcgaagaccgtattcccatggagcaacctccctgcggggtgggcaaacacaagctagaggagggaagcttcaaagaaagactggcccgtatccgccctcaattcataggagacattcatggcagaaatttaagtaatgaagaaatgatacaggcagcggatgagttggaagagatgaagagagtacgaaacaaactgatgataatgcattggaaggcaaaacggagccgcccttaccctatttaatatgctccacttttcattgttttgcttgttaatagcatttgctacctggcccttgtgtttgcatcttcttatatgccctttcccatcttagttgtaacagttttattcaggttgtgcagttttatttcaagtgtttgacatgtaactggcacgggtctttgtttttgtttttgttttcagaccttctaaaatctgagtgtgatccatttgcatggaaagatatacattatatatgtgaggtgataaaagcaaaaggtatatgcatagcatcccatttttgtaaaaggaaaacacatttatatattaatatgcaaagaaaagctaaaaactatatacttaaagactaacattggttatctgtgtggtaaagataataagtgatttttatatttttttaaattttgctttatctaaagtttcatttttcatgatgaatacattttatttatgttgcacaacaaacaatataatgaaaaatgtgaagcaagcctaaaatcaaaaagtgttagtcagcttataaagaaaatgtgctccttaataaatatttatcagaacttaaaagttaatccaatgtttcttctgaatctcttttctaagatttatcttattttttaaatttgtatgagtgttttgcctataccaggtgtgtgaatagtgcctgcggaggtcagacgaaggtattggatgctctggaacagcagttacagatggtggtgaaaattgaacctaagtcctctagaggagcaacaagtgcttgtaaccactgagccatctctccagtccctcttctgaatctcttagaagaaatagaagcgggacgtttattatcagtaggaataacattttccaagttaaataggagtaagacatgcataccttacagtgttgctgtgaaagtaaacgagaaaagggtgctttgagctctgtttcttttttggtaggccctccccccaatctctatagacttggctgaagcatgaaaaattaatagctaaagaatgtctcacttgtgctcaccaacaatttctgtgagattccacgtgggtaccacatgctggtcctcttctgctgtactttgccttacctgccaggtacagctgccccttctcctagatcctgctgtttccactgtcccctatgctgccaatatgctcaaggttcaatgccatttgcaatctctaaggagccacagctgtagtgctagacacacggagaataggattcttccagctttacagttaaacatactcaagtatgtgtaggcacaatgctgttaagactttgatatagtaaaagagtgcacaaaattattttttaaatgctaagcaaaatggccttttccatgatttttatttgaaagcccttctttttttttttttttttcaattcttcctgaattcaaacatgaggtcactgagacctgggataggcagccaaatttctaagatggaattctaattatggaattgatgtccatcttacaaattgtgtagaaactctctttccacgtatgaagaaggggcttctcacagaattgtcttatctattcagttaactcatacaaaataaagaggaagataaaagtgaaatgtctatgtggtactaaatgaagccagcaatcccaactcttgggaagttgaggcaggagggttaccataagatggagtccagactgggctatacagtgagttctgggcagagctacatagtgagaccctgtctcaaaattgtgaattacaagcaatattaaatgatacatgaaaacctgcaataaaacattggaagcatgtgttacatatttacagatatatatttaaaacaaacaccttagcgtaaccactggaaagcagtcagttaagtcaatccatatgagaagaaatacaaattttatagacaaatatgcacacatacacacacatgtatacccatgggtggtaatctgtgtatatataacatacatacaacatataaatatacattcatagtctttaagtgatattgtataaaagatgccacctgctgtatattgaaatatttctaactcgtaccatgtcctgaaaatacacacattatctgcaagcctagattaaaggcaaatgatattcatgttgcatactctgaactttttgtagtttattccataataataaagatttaggtaatttctggta

SEQ ID NO: 745 - DNA, 935293 bp, mus musculus
gggcgagctgggtgggtgcaagctaggctgcctgcaccacagcccggctgagccggtggctccgctgctttctggagctcgcgagtcccgtgagcggtggtagcaccgccaactggggtgccccgcgtcccgcgtcccagcgtggcgcgcactgttcggcctgaaccaggtgcggctggaaggaggcagcaccaaagctaactcgctccaaagaatcttggaggcgggcacctttgagaatccattcactcagctgagaagtggtacctgccattctaactatagggtctaatgatttggaaacctcctgtaacctgtcccctctccagtacatcccgaagtccacagaagcggcactgaactccaggaatcttccgaacttcccaggtatcctcgctggcttaggactggaagtgtagtgaacctggtgggagactttgagtccgcggcgtgggagacaccttccaaaagccccctccatcccattcctctctgggcagctttactggccgccctggaagccaaaccctgcgctcttctgaactctgctcttcatcgcgccctgggcatggaactatacgcctgaaacctgctggaccttgctggttgttttgcaagactcaggtaaggcaaactccttgggacagatagttgcctcttgtgtataagcgctctcatgggcatctgggaagataaggccatagaagctctagcagtcctgcaccatggggtttccccacttggaaactaggcagtttcttttcttttctttttttctctttaacttctcattgaaagtttaggacgaggggcttcacgcctgtagaagcctgcttagtgtgttaggtaagggcgagcctgagctctgtatttctccagcaagatatttgtggtctgccagtgactcgcggctttgcagcctgaaacacattttcccactgggtgcttccgaattcttattattttggctatggccaggaaagcacgccaaggaggatggagttcagatgatggcccggtagagcagcaggggtttcccaatatgggctcctgtgtctgggaattcctgcggaacacaggactggagagagtgctggtgacccagagccatttctgtctttctgcgcttacaacccaaagattgcacaccttgagacattctgtcttcatcccgaggggtgtgggtgggtggtggtgatcatccctgcccctttgaacaggtgttttccaggttatatgaacctttcctttctgttccttggaggtaaagatggggatctcagaaagagggtttagatagagtaaccctcaagtggctcatcttgacttgagcctctggaactgaacaaacagcttgatgttactaccacacgcttaaagaaagatttttaaaaaggaagaagaggaagaagaaaggaaaactctttggcagagaggcttggaaaactgagtactcctctccaatggtttcttttggtccttgcccagtataagggaattaggagtagacattagtagacaaatatttaagactcatctctccctgctaaagttaccattggtataaagtacatctgggttgaaaggtaccctgggaaagggatctctttaaggttttttttttttttttttaatgatgatgaatgggaggcagcactggcccaccactgacatattcagctgcagattgtattgagtttcaaggagtaatgttactccttttctaatcagagaaagcatgaaaccaaggcagaccagacccaaagaaggcagagaggaaagacgtgttcttgaatatttgcaagtttcttgagcagtgttcacaggtcaggaagagtaccttttctaaacagtccctgggaaggaggaaattaagtgtccaggaaaggtgtgtgagattggggaccatttaaaccgctgaaactcctatatctccactccactgtggtagacatgggctgtccctgacaatttcagggttatgatagtgataatgctgtttactagctggctctgcttacagggtcatagacactttgctttctgctttccttcttgtcatgtgactccaaacacagtacttctcctctctgcccccaatggaaatcaggcaattaacaatggactcagggagttggaaattgccaggtgtctcagactctaggcttcagctggacttacccaccagccttttacgctgcctccaccaactctgctctttggctacatagctgtcacacagctcagtggttggacatgaagctgtgactacagctctgtgctgctggcttactgtaaaaactttgcaatctgcaggctgccctgggctaaacagcccgaatttaccaggctggaagcagatttaaatcgaaagcatttaaatgcaggttaaaaggctgctgcatcaaaggctcctggcttacaccctctagccacttgccctccctttctgcaggctgaggcactggagttgtcttagagatacctagctggggctggctatgcttttgctccacagactgaggccaggcaatagagcactatgcttggaatttgaataactttgtgagatagctgctctcagattgaacaatgggatattttcagtttctgagggctcttactgctattgagtacagaagctaaaacaattccgagggtggggttccagggaatctgggtgtatagacagtggcccttgaaggtgccttggtttaccaatttgtaaccaccttagatgaatgcaaggttcttgttagccagcaacaggaaatgaagcctgtacacacatggctacttatgaaacagcctgggttactcacctgaaatatgtatccacaggtgtaaaaccaaatgatgttttattgtgatggacctggcattctgaaaacagtgaatcataaaatgacaattccagtcttgtttaaggcaataaatgttatttcatttaaagtgttggattgaatttagggaagtggcttggtgcaaaaatttgttatttgggaagaaaatacgggaaactaactgggaaaggaaaagaagtcaaatgtggttgaaatgatcataaacacttcagtaaaatggaattttgagctcacatctgttcgttaacagaaacgtgtggtgatctgaatagattccatgacagttgtagcaatctgtgagtactccttaaggggaaatgcattctgtttcatatatccgggtatgtctataatcgtggtaaggatcacacaagggtcagttagaagggatgaacacactgccttcatttgacaagtgccatatgtatcttagtgaaaaggcattttaatcttattaaacactccacaggttgagctctttagaaataaaatgcaaaagtaagaaaaatccggactatcctttaagtgtgaactaacaggatttctctagtcaagtttctatccatcactgttaaaatatatattctctgttccaatgaacctggctttggccaccttcttaagttacatttctccgtaaatctccgatcttcaaattaatgtatcttgacttgtatgatttgtttttttttacctgatttgttttgttatttgggtatcccataagcatatgaaatattaagtctatgtagcagattaagtctgagatatcaagtaaaccaaaatccatggatattcatggcccttatataaaatggtataatatatttgcctataacttatatatattcttccacatattttaagtcctctccaggttgttcatatctaacatagagtcagtgctatatagttattatactaaattgttttagagaatgatggcaataataaagtctatacttattcatttatagaatacacacacacacacacacacacacacacacacacacacacatatatatatatatatatatatatatatatatatgtatgtatatatatgtatatatatgacaaatgcagaacccgtggatatggaagacaaactgaaatcaaacactaatttaatgttctctctaaccaaacctttgtttttgtctgcttctattgatgattctactattccctattctcaggacttgtgatattattcatttgctagtcttgctgtgttctctatccattcttgcttctgtgcatcttttattaattaaatactttgagctttatctctggaatatgttctctaattttcagtgtactgacaccacccagctcttctagattcttgatgtggcctatcataaaagtttgtatttgctgtctttggtttactctccaaatcatattttgactaatcttcctgcttcctgaggctcatttggttctttcctttgctgaattttttgcaacaatcattagaaaattaaatctagtaaaatagtcataacagtttatacatttagattttatatagtttctatgtgaatgttttaatataaaatcagaatgaggttagaaacttgagtttcctaaattttagtaattacaggattcttttataattaaaatattttaactgtaaaatattgagtaaaaatggattctaagaggtacagcttgttatcaagtctgaataatttcaaacgactccagttggtgggtatataatatagattaccttttaaccatagaaagttatctactattgtaacaatgtgctagcatggccaaccatttagtagaggctcaaacatgagatttgagacattgaacatttattactaattctgaaaaacattgtatcatcctttccatgtctagtggcccataccacataatgcattgcccctttcaatgtaaagaaattaatgttttattttattcttaatgtccttttgagtttttttaaatatatatagcctgcatgtatgtgtgttcacaacatgcatgcaatgctataggaggccagaagaaggggtttaatattctgaaactgcagtgatagactgtagtgaactgtcatgtgggtgctgggaattgaacaagagaactttataagagctgccagtataattaactattgagccgtctcccagccattataccatttaaatcactgtggcagtaatatcatcttccttttgtagtatttttctgaatttgttttctttggtctgttttacttggacatgtgtcaacataggaaacatctagctcgtcatactttatttttttgttttttgttttttggtttgtttttgttttttttttttgtttttttgtttttttgttttttttggtttgtttgttttgttttttggtttttcgagacagggtttctctatgtagccctggctgtcctggaactttgtagactagcctggcctcgaactcagaaatccacctgcctctgcctcccaagtgctgggatcaaaggcgtgtgccaccactgcccggccccatcatacttttaaattaatttttaacatttatgtttgcttacttggtttgtgctctattaatgatctccctcttttctgaatcttgcttaatgtttaaatagatttgcaaagtggataacatttataagttgtaaaactgtatatattgttaccacatatatgtgattgctctgtaatcataagctctgatgacagtgatctgataaaatgtcctttctttattagctatgaagccaagtctcaattctttgacaggtatctaaggccctttgaattcagcttcactctaattcattcaataagccccacttctctgttttcctacacttatggtcatctagagcagacatttatcatcttacatgatctttgttactccttctctgtgcttcctatatcattcttttattctttttcctctccactctattcttttgcctgttgaacattctggaggcagtttgtcacttctttcacacaacccactctttttttaatgccccagagcaaaactaatttctttgtgcttggaattcgcccagcgcttttgttatgttctattctatgttattgttgttcttaaacaacagttactgttatttgtgtatcatttatctcctccagtgaattttaaactttgttaagtctgcattacatgttttatttgtacaatgccaatcatacaagagcacatccattacatatttatatagtggggttagttttaagagcacataactgtttagctttagagtttgactgaaggtctgtatgtatatgatagtctcaaattaactgggaaattgtcaagcctattgtatgtaaatagttctatgaaatgtgatggtatcaactttttgaaatcagtatggtctaaatgggctctatccaataaacatgagactgtttagatttaagtaaagtgtctctcatcagtctgttagccccatttcaagtgctcagttttcatatggagctagtgtttaccttattggaatgtggtaatgcagtacactgaaatcaccataaggagttacattgggtttctttctgccagaatatgtatgcaaaggtgtatactttcccatatgcagctgttcaaaattcagtgtccttctcagaagacaattgagttagtaatattatacgaatcattttgattctttggcagaaaatcggatattcttgtcacttcaaatactataaattccagatgaagatgtgaagaaaaattacaaagaacctatgccatgacatataaactacactgaacacctgataaaaaggcagtggcaaataaatgtaatatcataggaatagctacggaatcaactcaggtatactctgaattttaagaaatggtaaatgtgacatttccaattcatgcagaaggaaaatacagatttgtcaataaatatgtctggggcaacaaggttagaaagagaggagaagtttaataaaaccacactcatgttcattgttttgaactaatttaattacaacaaaaccaaagatctgaatgtgaaaaatagaaaaatgaaaaaaaaaacacactcaaatattttatagtttaaaacattttattccttagtatgttttataatctaaatatgaaaaggggggttcgatcatttcatgagaaacaaaaccccgtggggaatattaatacttttaaccttcagaaatgtcaaaatatgttgcatagatcattggatagaatataaaaataaatttgcacaaaataatagcatcttatagcaaattgggggaaattgtgagcaaaacattcacaaaagagaagatatttaataccctctgcaaacaaatgattttcacatatccgtttaagaaaatttgaaggattaacaaagccagagtaatggaaaagctgagggtatggctgatctaatgccccatttaagttgtctgtttctagtggttgagctgatgttcatacagagatatgaaccaacttctttgatctcataggttcactaagaatttattctaagacaataaatggaaattcttaaaatatgtgaagaacaagttctgtttctagccgcaattgcttattgctactcagtattgctattctcagattgaaatcctcagacgtccaatctgttgtggcagtgaatattacgcttaaagaagttgcaagataagctggtcaaaattagatgctaactgagagggaaggaacaactatgcagagactgccccatccggggatccataccataatcaaccaccaaacccagacactagtgcatattccagcaagattttgctgacatgaccctgacatagctgtctcttgtgaggctatgctagtgcctggcaaatacagaagtggatgctcacagtcatctattggatggaacacagggtccccaatggagaggctagagaaaggacctaaggaggtgaaggggtctgcaactctataggtggaacaacaatatgaagtaaccagtaaccccagagctgtgtctctacctgcatatgtagcagaagatggcctaatcggccatcaatgggaggagaggcccttggtcttgcaaagattatatgctcccaatacaggggcatgccagggccaggaagtgggagtgggtgtgttggggagcatggtggggggagggtataagggactttcaggatagcatttgaattgtaaatgaagaaaatatctaataaaaattgtttaaaaacaaacaaggctgctatgaaaaaaattagatgctaacttgagaagaactgaaaggttgaaagaaaaaataaaatgagaaaaatataaattactaaaataaaaataacatggagaatcatttttataatcataaaaataaaggtaaaaatgaaaatctcaatggctaattttacagaaacactgaaaatgcatatttgtaaaatataaagaaataaagataaactgaaacaaatagctaatacttgaagctataaatctacatttactctcgagtgcaactctcacaaactatgttgtaaacatattttacatattctatggagctcaaatgcttttgtagcatgataaatgtttacatttacttttggaaatggaaaattttacttagcattacttcccagttcttttaacatatagtttaatggatggttttgataccaagttctgagtactgttataattggtttgtatgcattaattaatttcattctcataatttattgcatttaaaggaaagtgaatagtatgatttttgaagtataagggtataaccccagggccttgagcatggtgagaaagcattctactactgagccatatacccaaatggtagggatttcagtactttttttcagaaaggaaaatttaaacacaaagtttggacatttcctgaggtcatacacatatatgtgcatgaaagcaactgatttaaaaaagaggccatagccccctacctctcctgggccacacagtagagctggcctccttggtatagacatgggtgagaacacctggagggcatgagggcaggagagccagctgaggttttaggtgagcctgccaaggcagtgctgaagagttccacctggtagtatgggcttaggagagcaggcaggtctacccgaacatactcaatctatgaagtactggtccacatgaaagggccagtcctgcagatccaaaatgaagggacctccacgacataggacaacaacaatattctaaaagcaaacccagggaagatccaggattggtcatgcagcagaatccagaggccttgaaccagagcaatgactcattgcagtgaacatttgcaagtaaagatgtgtggacagaggaatatattgtgggacacactgtgacatactacagctttcacaacacgattatgttttgttttgtttttatttatttttacttttacttttatttttgtattttcttttgtgggggttggaaggtgtgcatgatgtaaagttcacaaagaatcaataaatagttttttaaaaagaggttatacatttgaaagagcaaagaggggtatttcagagcgtttgaagggagggaagtgaaggtataatgtataatataattatattaaattatgatctaaaaaagaagagaattcttaaagtcatagaactattgaaattactgcctgaggtgaaaccaagccaaactatttttaaaatgatacatttaaatctctctctctctctctttctctctctctctctctctctctctctctctctctctctctctctcacatacacatacacacacacacattcacacacacatgcgcacaggcacacacacacatatgttaacagatatgttaacaggtttttaaattttatataattaggatatgtgacttctttatcacagcatatatgctatcaaaatttaattaaaggcttacaataagtctgacattttgattttattttttcctttcttaaaaaaagtgtttaaaaatgttagtaccatggcacatgttaataaaaaacacagtcatcttcaggtggtaattgaattctgttcccataaagttaatgcagtttataagtaatggggcaataacataatacacttgaaagttgtactttgaaaggtaaaatgtccaataatttcaaatctgatgattattacttctttaatattgcttcatttttaatctagctactcatgctgatatgttctggattcattatgtagccagtaaacctacagaaaatactcttgaatcaagccaatgaccatttttttctactcccatatacatatggctgaacatttccagtgaagatatttatgctagaacctacctgtccttaaattaatgcttgctttatggctccacctgtagcccacaatgcttctaagctgattttacatgaacccagtcgtccttctgtaccatttgtttcacgtgggagttattccaaacattgaccacacatttctattcaagaatatacttcagcattctacttcatggtcagacttaagattctgactgtattcattctctccttatttccactcccctgcttctacatgtcctttcccttataccacctaagttcaaggtgaataattttacaggaccttatagtttggaatttcatagccttaattttcttcacaggttaaatttacacagaagaaggatttccctctattttaaacaaacaacacacacacacacacacacacacacacacatagagagagagtagacacagagagagtacacttatgcacatttgtggtattattgaaaagggtgacaaaagcttgtgttgggcttctgttctctctgtgaagtaccagtcatcattttttgagattaaattgggagggaattggtaaacagttttgaattatctaagtataacttaagaatttggaggaaagaggccattagtaaaaacagaagagtaggtagcattctatgctcaaatgaagctggaagtcaagaatttatatgcataatttcttcaagatgtgctcagtgtgctaattgaagcagtggagaaatgtgctaatccttgtctgggtttcatcagagaattcagcagaagggcaaaggtgaagatagtacaggttgctagaagcaatgagctaggaatgaaaacaacacaggaagaaggaaacattgtgaggtgggaagaaagcataaggataggtaggatctgtgtgatgctaacataagcataggtgatgaggcaagctaaagtgacttgagtccatatgaacagaacatctaagaatttgtagccattaggagctggaatccagacgatgagggattctcattggaacattagcttaggtaaaggtaaacagttgacttcctactagtaaaataagaacatctatggaaaataatatgaatatgattctcactgtcaaagaagaaaaaaatagtgttcacaagaggagaggttgtttgtttgtatatgtgtatgttgtatatataaaattatatacagtataaatgggatagaaagaatttggattgtttctaaatttatatatttggagagaagattagaaggggtaaagacaagattattttttcacacatgttatttgttttttgtttaattacaataaagtactattttatagtttgaaaaattcaaaaactgaaaaataataaaaggtttagatggttactccatccttttctctgccccatggtaaaaggtttgtactgagtctttctgataggcataacaactttcatttaaaaatttcctactgccttttagtcatggtagtagctcatgtaatttataatttccttctgttagaaatcttggcagaaagtgtagtctaaaagaaaaaaaaatactggctcctttaaatagctcacagtgggtgggcagagtggtttcaggaccttgggcaggaaatgtcactacagggctactttagtcaccaaagcacatggttgaagactgtttgctacttaggagctttttcaacatttgggtcaggaaccacagagagctgcctcctgagtctagcgttcttttcatgggcattgtgtttgttactttatacttttagcaaatactgccccaaaggaggacctttagtcatttagttcacaaaggaccaagcttaaagaaatagctgttttactgagcatatatggcatgtcagacactgacaattgtggagtttgtctgagagggaggctgctatttgcagaggcaagacgatataataaaagagaatagcctaggtaacagaaagtgctttattgctattcctaacctcaactctatgtcattctcccaatatcatgctctacaacctttagcatggcacttgcccagatggacccacggttcctcctctatagagtggaaagactggaccagatcaatgattttcagagtttagtatgtatttgaattatctagggtgcttattacagaagcagcttcctgtggcctcccagtctgatttattgaatcagattatccgggagggggaggacagaaataggcatttttaacaagctcccctggtagttctgatacaagtcgatcttgaagcatattttgagaaattttggactctatagtcttttccagttccaatattcaattacatgccatccaggtggctatggttggaatgtgcttaaaaggagaagtggggtaaaaggaatgatttctctcattcagtaattctggagtcagcaaatacttattaagcttccattttctgcctattgcatactagtttatccatatatattttattgattttactgtcacagagagaaactagggaattatcacttaatagagagtaatgctattattgggggctggtgatatggctcagtggataaaggtgcttgctggcaagtctgatgatcttagtttgagccccaggaaccaaggagtagaaggagagaaataatttgtacacattgtactgacctccatgaaggtaccatcacacatgtacatcaacctatatacatacaatagaatataagtgtatacatgcaaaaatgtaaatagcagtatttttaatatctggatcagtgcatagtgatgtgcatatgaaatagaatttgatagactgattgtgagactagactgttggcttagcttttaagaatacttgttggtcttgtacaggactcagattttgtcacctgcacccattgatggctcataaccatctgtttaagccagttacacagtatcggaagccgtcatctgctctctgcaacatcacgcatgcagtatgttgacacacatacattcaggcaaaacactcatacacataaaattattctaaaatgtaaaaagtcttttttaaaaaatcaattatagataactacaaaaatactaaaagcaaactaaaatattggccaatctgtgagtagataggaaaattgtaaatgcacacacacacacacatgaatgctaacataaaaagaattaaatgctgctacataatagatgaattagaaaacattagactaagtgaagggatttagttaagaaagaatttattctactattgtctttgtatgacacattcagaatagtcaaatcaatgggggtggtaaattagtttccaaaagctagatttaattcttgaagttaggtaaatagggtataatgaacaattagtaatatgttcattttggtctgacaacagtatcataaaatggttgtaatatttgcaaactctgaattatctaaagtttaatgaatcacacactgtcaatgaaggaacgaatgatctacaaagcatgttctactaattcctgtatttgtctctatatatgcatatacatatacataatactacttaccaaccttctgacaaattgagagaaagtataagatcccttaataaaagtagactcatggctgcggatgtggtttagtgatagagtgcttctctagcatacacaaatcctggattcaatatttagcatcaaaatataaatggaaacctaaatggctggtagttttatcagtctttttaatgcattcattaaaaagctctatatgttccaactctagtgggacttaggaatcagtcctcccaaggactttgttagttaatagcatgtcaacatttgttgtatttgctttaattaaatccaagagtttctgtgcatgataaaaacactggaacttatgtggttacacttggtcttactagattttgtagctgtgaaaatagcatcatagatagattaactgcattgtagagaggtttcacaatggagtactctaaatacagaattatttaggctaaatatattctagtttaaattgacattcagagaaccaaataactctattagaaaatggggtacagaactaaacaaagaattctcaactgaggaatctcaaatggccaagaagcacctaaagaaatgttcagcattcttagtcatcagagaaatgcaaatcaaaatggtcctaatattctatccacctcacaccaatcagaatgactaagattaaaaactcaagtgacaacagatatttgtgaggatgtggagaaagaggtacactcctccattactggtgggattgcaagatggtacaaactctctggaaatcactttggtggttcctcagaaaattggacgtagtcctacctgaggaaccagcaataccactcctggacatatacctagactatgtaataaggacacatgctccactatgttcatagcagccttatttataatagccataagctgaaaagaacccagatattccctcaacagaggaatggatacagaaaatgtgatacctttatacaatggagtactactcagctgtttaaaacaatggtttcatgaaattcttaggcaaatgcatggaactagaaaaaatcatcctgagtgaggtaacccatactccaaaaggcacacatgatatgtactcactgataagtagatattagcccaaaagctcagaatatgaacatataactcacagatcatatgaaacttaacaagaaggaagacaaaagggtgtatgcttcaatcctaattggggggggacaaaataatcatgggagatagaggaagggaaggggggacctgggtgagagagtggagggaaaagggggattgagatcaggtatggaagggacaggagagaagcacagagggtcagcaggatgaatagaaatatgtagcagtgggtgtggagaacagggggaactactagaacgtcccagataccagggaagcaagagcttctcaggacccaatggggatgacattagccaaaatgcccaacagtggggatatagaacctgaagagacaatctccactagatatgcattgccctatgttgagagatggaaccacccactcatctcaaaatgtttaacccagaacttttcctgtctaaaggaaacacagacaaaaagtggagcagagattgaaggaaaggccatccatagagtgccccaccttgatatacatccgatcctcagacaccaaagccagacactagtgctgatgccaagatatgcttgcagagaggagcttggtatagctgtcctctgagaggctctgtcaacacctgactaagacagatgcagatactcacagccaaccgttggactgatcccagggacctcaatggaggcgttaggggaaggactgaaggagctgaaggggattgcaaccccataggaagaacaacaatatcaactaactggaccacccagagctcccaggaactaaaccaccatacaaagagtatacatggagagatacatggctccagctacatattcagctacatatacatagcagaggataaccttatctggaatcaatgggagggggcacatggttctatggcagctttttgatccagtgaggggggatgctagaggggtgaggcaggaatgggtgtgtgggtggggaagcacactcttaggggcaaaggggaggggggtgggatggagtgtttggggagggaagacttggaaggaagataacttttgaaatgtaaataaataaaataaccaattaaaaagaaaacaagagaaaataataagcagatgcttttaatttcctgtgatctctttacactgaaatacaggtctcagtgtcacaagagctgccacgttctttcagaatgtatgaacttttcaaaaaagaaacaggccttttttaatgtctgtgatccgagtatagtgtataaaacacattggatcttgattgatgttaaattcctctaccatatttctactgggaaactagaaagggccatcattcaagtaaaaatatcttgtttttcataatgtgtgcagatgtggccactcactacattatacacacatgcatacatgacatgaagattttaatgcctaaatgttaatcacatttccaaaactattaactaatggctggtttgaaaactttgaagagattagtagcatataggaaagtatgcatacacatagaaacaacacccctttgcaggatatagattgaaatttaattgaattgtctggcttcaactctcctattatttttattggtcttcatagaacaacaacaacaaaaagctatttaggagatccgcagagcagtgaaaaaatggcttagacacaaaatatgtccagtatttctaaatggtttggtatatttatttattcctaataagcatcacaattttagcctttgattctttttgcttctaaaatcacaaggaactacaatcataaatcttgagactaactgaaaattgaagctcatgagtccatgtgctttatttgggagagctcatacaaatttctggttttatttgaaggtacataatttaacatgcttctatattgtatagtagtttatgacttttatggcatttgtattttgaatattttggggggcctcagaacaactctttatgataaggaaagcatggttctaaatagcaattcaattcaaaccatgcagcctggagatatctataggcatgtagtttagttgttccagtctatgtgacaggtactgaacctgacaggtagagaaggtcaatggttggctcaaggtgatgcttaattgaatgacaaatatcaaatgagactctggggtagaaaaacaaattatcaaaacaaccagcagtagttgagcatggaaatgtctactttggggtgggttctagtttgctttctcttgctatgataaaacaattgtactaaaagcaacttggaagggaagcaattactacatcttatactttcaagccacagtccactgccaaaggaaatcagagcaggaaccgaaggcaggaaccgaaggcaggacctgtgcttaatggtttggtcactggctcatgttcatatagatttcttttacttcccagacccacctgtctagggatggtgccacccgtggtggactgagctcccccacatcaaccatcaatcaagcacatcttttacaggcatggccacaggctaatctgattgaggcaattctttagttgaggtcttctcttctcaaataattcaaggttttgccaagttgacaataaaatctaaccatcacagggtcattagcaaaatcttttctcttcctcagtaccttttctatacatcagtttgactctttcttatcattgacattactataatcttctaaatatatgtagcttctgtagtgcccaaagcagttaaatccctatcagtgggcataaaacttcttggtctgacaatctttcttttatgttgccttcagtatttcaggttgcctgaggtgccatattgattaagctacattctggtgaactaaatatatgtagaatattatatggctctcctaccaagcacagaactataagttaatggatctctcttgttgacatcataaagtatgcaggcctgaagcacaactgtaatattccttgtaggaccatgtatttttacttgtgatgctcataaaatgaatagttgctcagaggtgaactgaactgaaaagctatgaccgaacatggatgtttatatatgtggtgacacagtgggagaaagatgacagggaggagatacaaagtgaatgccagaaagagccaagagcatgaaaaaaataaaatgaaccagaggcatgatgacctttcactttgaagatcatggtgagatttaatcaatgcataaatcctgaatttggttagaggtgataaaaacatatttcactttacatttttattggtgttttgtgtcccccaagtataattgaatctgtaacagtagtgtagagccaggtcatttgggagattaattaggaatgagatatatcagaaggtgagtgtgtgtatgtaggggaaatactgataatgaaagatcttcaagcagcactgattgaatagtaatttttaaaaagtgtgggtacagttgttattggtctcttatcctgttcctctcttttctttgactcctcctcccaggcttcacattaggcagtcatatcattcaaatataccctgccaggccctccaattcagtataatcacccacaaatcatcatgttgagagatgctgtttaaattcatgtctcctgtaacctatttccaacccttacacttgatttcccctgccctgctcctctcctcatcacctctcccaccttcttccctcccataatctaccttcagtatttattttattttcccttctcagaaagattcaactagccctctcccccttaggcctttattgctatttgacttctttggatctgtagattgtagcatggttatcctgtatttacttataagtgagtacatgccatgtatgttcttttgggtctgggataccatgctcaggatgatattttctagttacattgatttgcctgaaattttcatgatgtccttgttttaaatagctgagtattattccattgtgtaaatgaaccacattttctttatctatttttctgtcgagggacatctagcttgtttccagtttctcactattatgaatagagatgccatggacatagttgtgcaagagtccttatgggatggtggaacatcttttgggcatatgctcaggagagttatagctgagtcttgaggtagaattattcccaattttctgagaaacaaccaaattgatttccaaagtagttgtacaaatgtgcactcccatagcaatgaaggtgtgttctccatgctccacctcctcatcagcatgtgctgtcctttgagtttgatcttagctattctgatgactaagggtgttgaacatttaatcaagtgtttcttagccattagaggttcctccgttgggaattgtctatttagctctgtactccatgttttaaaaatttggttgtttggtttgttggtgtctagtttcttgagttctttatatattttgtattttaaccctctgtcagatgtagaggtagtgaagatcttttaccattctgtaggctgcagttttctcttgttgatggtttcctttgactcatagaagcttttcagttttgtgaggtcttatttattaattgttgatcttaatgcctgagccattagtgttctgtttaggaagttgtctcctttaccaatgaatgcaaggctattccccactttctcttttgttaggtttagtatatctggttttatcttcaggttttggactcacctggacctgaggtttgtgcagggtgataaatatgactatatttgcattctatatgcagacaaccagctagaccagcaccatttgttatagatgctgaaactcctagaactgggggctatggaacctgaagtggctacttactgaagtcaggcaggactccaagtagagtgttaaggacttcaacccacccacaaaacctttcatctcaaatttatcctacctacatgaagttcatgggtaaggttagagcaaagaccaagagaatagccaaccaatgaatgacccaaactgagacccatctcatgggcaagaatcaatcccaaacgctattaatgatactctgttatgcttgcagacaggagggaagcatagctgtcttctgaaaggatccacccagaagctgactgaaacagatgtagagatccacagccaaatattagaaggaacatgggagtcttatggaaaatttcagggaaggattgagggccacacaggggatagggacttcacaagaccaatctagagccaactaaacttagaccctttggtgctcccagagactgaatcatcaaacacagaggatacatggactacacgcaggctcccatgcacatatgtagcagatgtgcagtttggtctttgtgtgggccccccaacaactggaacaggggctgtccctgactcagttttctgaggatcctatttccctaactgggctgccttgtgtggcctcagtagcagaatatattcctagttctgcagtggtttgatgtgctaggtagggttggtacacagcgtgggtagggaggggctctcccttctcagaggagaagtagagggggaatggagggaggggccctgtgaggaggggattgggaggagaggaggtggctgtgatcaggttgttaagtgaataaatcattaatggaaaaataaattcatggattttcacattgtatgtgattcatcccagaccttagattaattgctactaaactaaactcccttttggactgtgaaatttcatttcctgcaatagccagctgtcaggtcacaagaaacttttctgaaacacccacaaggattttcaagccaaacatattagttatcatgttttaatttttaatgctttaatttgaccaatagcagtttgcttttttttttttttttttttgtgaagtgcctgaactacaatgttttccctttcttaactctaaaagtaattttctcaccttattttatttttctttctcttgataagttctgaaagcatttgacaaaatcctgtgtggataacctctttcctttttatctgtggtgtaagctttcttaggtcactggaaaaaaatggcttctcagttctgaatctaggggacagaagaacaacatcctcttgcttgtcttcttgcttcttgggagaggctcaaagtgcttttcgtctgtaaggaccctgaaaagaaccaagtaaatgtcaagggttaaatgctcaattcaaattagttctgtgggtctgtgcaaggcgcttaccttctgtgagcttgcttcagtcactgtccacagtgaagacaataatagcaacaaactttaagtgattttgtagaattagacaatgtaagtaaaagatttaggagagttactgcctaagctatgttcaacaactgccaccacagaagtccaggtgtatgctctgagaactgattgatttcataggcctaaggttgtaccataggcaggtgtgttctaaaaaaaacaaaaacaaaaaacaaaacaaaaaccaaaaacaaaaatacaaaaaaccaaaaccaaaaacaaaacaaaacaaaacaaaaaaaaccccaaaaacccaaaaaaccaaaaccaaccaaacaaaaaaattcattgaggaccctgacaatatcctaagttacaaaatatttcaatagataagattctttatattctttctccccatttccctctctctcgtatatgcatatatgtgtcaatctctgtgcctctatgtctctctgactctttctctgctctagataaaatttatatagcccaggatagccttaaactcactgtgatattgtacagtagtaagtgttgtatgggaaaacagtgggcattttaactttaaatcaccatgggtaatttctatttaggggtctgcttattactctttgaaaaatcactgctgtaaaagaatcatatttatcgctattccttttctatcatgtatatttatcatgccaatcttttaagacaactattagaacagctgtaccacacaggtaatactgctgtctccctttcagtaggacaaaaggcataagctacagagtattttcaatcatcaaaatgaatcagcacaagtatgtatcctacgtctcctgctcaagggcaaataatttcaaaatggctactgaagatacagccaaagtgtctctaaccacagaattaagaaaagtcaatttaacatgtaggaagataacctttgacaatggaaatcatccgctgacctcatgtcattagaaatgtactctaatcatgttactgagttggctagccaataaatacatgaaaagtatagaaggaaggcggtagtattgctttgagattataccagacatccattataccactgctgcttaatgaacctgatgattttttttctttttagctgcaaaatgctgtgtcttattgctttgaaatacatttccattgtggcatacctgaaaaaagaaaaatgagtgctttgaggaattctgaatcctcatttgtccttagctcatgctgtgcaacacctggctctccacttattgcagaaatggaattttcctttcacagtgattttctaggtctccctagcattttggaaatatacatggctctacagcactgagttctacatggttttatatgtgattcctatatggactgtactaagttgtcttcttcagtttttgagtctcattccttttcaggtcagtggtgctgcccctaaactttctcagttttatgcaagacagaaatttatggatttatttatttttgtagtttagggctagttagtatttgttaggaattagaaatgggggaaggcctttcttgcatgtcctttaaaaaaaaaaaaaagaaaaatggaaagccaagatgagtatggttcctttagggggtaggaaaaattcgatactttttataaccagcaatttactttattggtacctttgtaaaattcttaaataattttaaacatttatatagttggctggaggcacttccatcccactcggtttaattatgctttgcttgcatgggcataaatgggggttctttactggaacaggggcaatttatcagagactacactactaaggattatgtagttcttctttcattatccattaacttcccatgggtcctggggggggcatgcatgatgaaatggtgactgttctagtttgtatgggtcttgtgcagctaaccacaattgcattgagtttacgattgcaatggtcatgtcttgtccagaagatacttccacaactttcctaatgagcctctggctcttaaattctttccccttcttcttcacagatgttccttgagcctttgggggatgatacagatgtcccatttaaattgaaacactccatagttgcttactgcccatgccttgaccatgtgtgaattcctgttttaactaccaaatactgtaaaagtcatcttctatgatgaaaatagctacattaatccatgggtataaacatacatatcaagaaagcactttgacagtatgtctatttagcaatacaccagtagtagatgcttccctacagccaatggcctcgacagtcatgggttcttgaccaagtttacagtaccaggtatgagatctcttctgtgttgcccattttaaatcagcagaacacatgtgacatgaaagtaaagggacagaacatgagggatatagacatttaagtttggttagagctacacaggaggatgggagagaagaaaggcagaaggacaaaccaaaagtaagtatcaatgaaaaactacaattttataattctattaagaacatgctttattgtttgtttttattttctattttaattttaatttttactcttcacatacattatatcctgacgataatttcccctacctccattcctctctgagcccccacacctcccttcactcctccatccactcctctatcattcccttttccacaaaaagagagacagagagcgcgagcaggactcccagggatatcaactgaacaaggcataacaaagtacagtaagactcagtacaaaccctcatattaagtttagacaaggtgacccagtaggagaaaaagagtcccaagtgctggcaaaagagttaaagacatcccccactactgttgttaggggacccacaagaataccaagatatccaactgtaacataggcagaggatctagctcagactcttacaggctttctgattgtcacttcagtctctgtgagtccttctgagccctgttttgttgattctgtgggccatataaatgtggtttccttgaaccctctggctccttctcacctctcttctttggggttttcctggctttgcttagtatttggctgtgggtttctacatctgtgcctatccattactggataatgacagttgggctagaatatagcagaatatcattagaaatcatttcattgacatttttgccagttatatttagttttatcctgggtctctgggctgaccagcctctacttcctggctatcctcacagtatcaggaatgggctctctctcatggtctggctctcaagttcatctagtcactagctccttattcctacaagttctgcatcaacattaccccagcatatctttcaggcactatatattgtaggttgaaggatttgtggctgtgttgatgtccaagtcccactccctggagccttgcctgattacaggagagaccaggttcaggttccatattctctatccctaagagacttcattagtgtcactctcatagattctagggagtttccactgcacaaagtttcttctatattgtctgtcatgctcaaatgcccaccaatttcagccatttaccccagtactcccaatgtcactctcagcctgaaccttcctgtttccatccccacttgccacccagtccacttgaaaaatctattcaatttccgtttcccatggaattccatgcgtccccacttcagccttgtttggtacttagattctccgagtttgtggattgtaacatgactatcctttacttaagagctaatatctacttataattgagtatatactgtgttactccaagataatttatattacttgaggctactgtgaatagtgtctccttgatttctttatcagtctgtttgtcatttgtgtataggagagctcatttttcttttattttgagttaatcttgtatccagatgcaagtaaatgagtttttctgttgtagtagttctctggtagaatttttgggggttgcttgtgcatctgaaattcataatactttgacttctttctttccaatttatatccacttgatcttcttcagttgtcttattgctctagatgattcttcaattattttattgagtagatatggagaaagtagatcactgtgtcttattcttgattttagtggaattgctttctgtcagcttactataagcactggacagtagcttgggcaagtgctgagggatcattgttagtttccagtttatctggagttttgggtgctggcatggtgtctggtggattagaagacttctgcctggaggtgtgggctagcatagggtgaggaggagaggaggcagagttgcctgtaggcagtgggcactggagaaatatccacaggtagggtcttatctggagttctgggtgctcacatactctatttttattttttttattttttaaattaatttatattttaccttccatagtccattccccgcccctcccacccaccttctgactgttccacatcccataactcctacccaccccctgtctccatgtgggtgccccacccccaccccacctgacctctaaactccctggggcctccagtctcttgagggttgggtgcatcatctctgaatgaacacagacccagaagtcctctactgtatgtgtgttggggacctcatatcagctggtgtatgctgtctgtttgctggtccagtgtttgagagatctggtgggtccagattaatggaggctgctggtcctcttacaggatcgcccttctcctcggcttctttctgcctcccctaattcaacaataggggtcagctgcttctgttcattggttgggtacaaatatctgcatctgactctttcagctgcttgttgggtctttcggagggcagacatgataggtccctttttgtgagtgctccatagcctcagaaatagtgtcaggccttggggcctccccttgagctgaatccctgtttgggcctgttgctggatcttcttttcctcaggctcctctccatccctgtaattctttcatacagaaacaattatgggtcagagatgtgactgtggatggcaaccccatccctcacttgatgccctgtcttccttctggaggtggaatctacaagttccatctccctaccattgggtatttcatctaaagtccccaccctttgattgctgagagtcttttacctcccaggtctccaggtctccggtgcattctggagggtctccccaacctcttatttcctgagtttgcctgtttccattctttctgctgtccctcagggattcagtcctttaccctcacccaataccagatcaggttaccctctccccccactctccacccaccccatccactttccctccaaggtccctcactccctccccacttgtgattgctttcttcttcctccctagtatgaatgaggcatcctcacttgggcacttcatattcttgacctttttgagttctatttttttaaacaaaaagttttaaatggaggtacatacacttaactggtagatgatgttccttgcagaaagaaaaggttattaaatgaaaattccaatgctaggtattggctaatttgctgcaaattggcggtcaggaaggtactattgcagatgctttgaactgactacttgaacaaaattgaagacattattgctaaagactgggttgctgaattgcaagccgggcggtggtggagcacgcctttaatcccagtacttaggaggcagaggcaggcagatttctgagttggaggccagcctggtcttacagagtgtgttccaggacagccagggctacacagagaaacccggtcttgaaaaaaaaaaaacaaacaaaccaaaaaccaaccaaccaaccaaccaaccaaccaaccaaccaaacaaacaaacaaacaaaaaagactgagttgcaaggcattgagacccaaagctgaatatgagctagaagtttgggctttgatatctagaaagttctatgcaagctgatgttggcgaaaagtaaccagtgttcctacccagatgtgtttgtatccaacatgctgccataatgatatttctcacaaagtataccctttgtacaatagtggcatgactattactgaggcaagatctattgtcttaaacctactcatgggatgttgaaacataaattatcttagatttagatatattttgctctgtctacaatattttaaatgcatagaaaaatattttcaggcttggggagttaattttcatttttccaacattctggactgggcaatgtttacttaagtgaatgtaattaatagtggtcagctttattaatacaagaaaataagttatgttaggcattcagaaagttttgggtattttgaaaaggaatatccaacattagctgatatcctaataatttgaaaagtccaaatctgaaatacttctggcccagagcattttataaaaagcatactcttcctttatttgtttgtgcatattcttgtatgtttcaaaatgttcattgggggtttctgaataacatcaaatagtattgcatgcatagatgaatgtttactttggggaaaactgtagttcttaaagaagatatgaaatgggggtcctaaagacaagaggtttcaaaagattaaacagataatatggtttcttaaaatttattgatttttattttacatgtatgaatgtttgcctgcatgtagttatgtgtaccatgtgcatgcctgatgctcacagagactagaagattgtcataggtcccatgaagcagttgtttacaaatggttgctggctatgcaggtactgggatttggtccatgggcctcagcagtaacaggtattcttaactgctgagccatatcttaagacctgaggatataatttctatggatatgaaagaataatcagtttctttatatttataatgatgtgaaatatagctacttgtagtctgttatttaggggtatttaaaaatattttgagattagttttatatttttgcatcacatagatacaacttcttggcttaattctatttgattatatggagttttggttcactttttgacataaagattattttggtgattattagtaaagagatgtttgttattcaggaagacgcagagtggactgttattattagtgaatacagacttttataaattatgtgaactaagatctggcaaacaacttaaaagtttttttaaagtaaaataattacaaaagaaacagcaaagatggaaaggaacagcttgacttatttgtgctgaaaaaatgagccacctgtttaaacgtcttgataaaactctttactctgagacctgttatcagattcagcctttttttccccctagagtgaaatataagatgtagtgaaattttaacaagttatcacttgcttactgacactaatgaagccaggaggtttgagttcaaacaaattgttagcattgacaaaagaatgaaaagcaaattctaattaatatactagacacttcctttttactactcatattaaaatgagttgagtctttattcctgacatatatatcagacttttctgaatatttcaccacaaagcgtttaatattacccctggaaatcaccatttctgcaatgaatatgcccgctgttttcatccagatggaacactgtcaaaaagatgatggaacattactttgtattccctctgagtttgaaccagtagcattcagtataggtacgccagcatgtggcatccttatttttatgagctgtagatatcaagagagacaaattatgatctgcatcttagtatgactaggaatgacaagagagacctgggatatgtatcaggagatttgtgttctaaattgagatttaccactggctacttatatgacctctaaaagatctggttggccttgcttttctggcattatttttaaagaagtggacttgttgaagatgactgctacaattctaaaagcccacgatacagttttcaattataatctctaaaatgctctattttctcattttgttcatgttttctgaattctcactaaatacccttaataatatacaggtattagaacatactgatgattatgttgaaatatcttttttttaagcatctttcaagtaggctaatgattaactcattccagtatgttcttgcttattctttattttaaaagatatatttatatgatttatttatatgaatacattatagatgtgtccagacacaccagaagagggcatcagatacttttacagatggttgtgagccaccatgtggtttctgggaattgaacagaggacctttagaagagcagtcagtgctctttttttttttctaaattatattttttatcaggtattttcctcatttacatttccattgctatcccaaaagtcccccatcctctcccccccacccccctacccacccactccaacttcttggccctggcgttcccctgtattgaaggatctaaagtttgcaaaaccaatgggcctctctttccaatgatggccaactaggccatcttctaatacatatacagctagaaatacgagttctgggggtagtactgggtagttcatattgttgttccacctatagggttgcagatccccccagctccttgggtactttttctagctcctccattgggggccctgtgatccatccaatagctgactgtgagcatccacttctgtgtttgctaggccccggagtaacctcacaagagacagctatatctgggtcctttcagcaaaatcttgctagtgtatgcaatggtgtcagcgtttggaggttgattatgggatggatccctggatatggcagtctctagatggtccatccttttgtctcaactccaaactttgtctctgtaactccttccatgggtgttttgttcccagttctaagaaggggcaaagtgtctacactttggtcttcgtttttcttcagtttcatgtgttttgcaaattgtatcttgtatcttgggtatcctaggttttgggctaatatccacttatcagtgagtacatattgtgcgagttcctttgtgattgggttacctcactcaggatgatgcccttcaggtccatccatttgcctaggaatttcataaattcattttttaaatagctgagtagtactccattgtgtaaatgtaccacattttctgtatccattcctctgttgaggggcatctgggttctttccagcttctggctattataaataaggctgctatgaacatagtggagcatgtgtccttcttaccagttggggcatcttctggatatatgtccaggagaggtactgcagaatcctccggtagtactatgtccaattttctgaggaaccgccagactgatttccagagtggttgtacaatcttgcaatcccaccaacaatggaggagtgttcctctttctccacatccatgccagcatctgctgtcacctgaagatttgatcttagccattctgactggtgtgagatggaatctcagggttgttttgatttgcatataataccaataatttctaggagtgcaggcctcgttagtaacctttacacatgcagagaaggtgcatatacataggtaagggaaatgaatatcttctatagtctatgaaaaaaaacatgacattattctagacattaccttcttcccttgctcttcatcaattttaaggcagactgctaattctgctttattttctttgactttgcaattgtcctgtgaaaattctaatattgggctaacattaaatacctaagaaggagaaccttaaaaatctacacctgccccagccctatcaccagcagaaagttagagaggcaacaggagcagaaggttaactatactgagccccaacattatttatatgtgactttaaaaagcctgtcaaattgtttccatgtctgtcatagctgtaagacacaagccatttcaatacatgtaatacttggaaataaactatataaaatactcatgccatgctatactgaagctgtccatgaaagtgacaacttactgtcatgaatgatgaaatgttctttgtgtttaaggcaattgtgttgattgtagaggaaaaatgagcctacctacattttttttcctgaggtggcattttatttgaataggaaagctttttctacaatgatgctggccatatatttcattttgactttcatttacagttgtctttgttgtaaggggaaacattttaatcagttcctgtatgaaggtcagataacactgtgaacaaaagtaatttctttatgataatatcaaaacagaagcattgttgcacttaaattatgaaacatcgtttcccttatctgaaatatgattgtatatatgactgaatagaatctggaattatatcttatatatgctgtgggcaaactcaagtaattctcttcttttcaaggtctaaagttatattagctaggaatgaaactaggagattatgtcctcaagtataaattatattaaggaattggggaggtatttgtgtgttttatttgtttattggtaaactgaagccttattgacatcttctaccctttgatgtcttagaagacatcgatcagtttagtatttaaatttccagtgtgtagtatttaaggcaatactgtgggttagagaaagtattcatagtaaaaaaaatgttatttttgtttggtttgggaatgcaaaagacacatttaatggctacacacaaacatgtacatctggatgcttcttacatattatctttttcttcctagccgctatatagttcttaccagttgccagctgagggaatttttgaaactattcacttctagatcataaaaatattgatttatttgcaaatgcatgagtacctttcagatcacagtgtacacatgaggtacagtgacagttcaatgcaagcagccgccccaccttcacctttccattacaaagaaggcaagtaatctttctctgccaatattgtaagacatttccctaccttagattgcactctaaactctacatatgagttacaagttccccagaatgtgacaaaatttgtcatattttaaagaactagctcaggagacttattctagatgtatttatgtgtttgtaactacaagacattttactagaccctcaaatttttctctatgtttttaagaagctatatcccagaggtgagacatgttgccagttccattttgggtcataagtgtcatgactacctgcttcactaatggtactactgaggaaaatattatttaatcttttatgaatattcctaggaatatgaagagtctaattaatattagaaatgttctctagctaccgatacctgctatatcagcaaggtaaatcctatgtcttgtgatatccaaaattgacctagagacacacaataatttttaatggtgtttatgaagcatcataattagaagaaaaaaatctactaatatgtgcaaaaaatctagtcaacatccctaaaatccaaaattgttgaacatatgtcaggcattataaagatgtgtatgtgcatctttatagtatattgtcagcccctggactacttcatttcagaacttcttaatctcttttaaacaattagtaatttaagaaggaatggatgatatttaagcatctagaaacctatagaccattttaaagcttcttcatcccctttaaatctattctgaggtgatctttgtaacttgtgggagatagaaatctagttccatttttctgcatgtgggcacccaatgtttcaaggaacacatattgaagatgttatgttttccaatgcatgttatttttcccctctttctatatgatttatttagaaatagagttatttctaaaaactcccttttttcccctttgttctgtgtctgcttttattccaacactgactattttgattacaacaactttaggttttatttttgaacacagacagaagaatacaacctgctttgttttgttgctgtctttttccatccttcaaatctctgaactactattaaggttttatttctgctgaaaaaaaagcaaaagaatgctttggatattggagactttcatggtttcctatgaatctcaagattgactattctcattatatgaagaatggtattgatacttttatgggaattgcattgcatatttaaataatattgaatcttaaagatatttcaagaatagttttttttcctagtccacaaacacaggctatcatttcacttacctttattttctttattagtgttttataattttcatgtcagacgtcctttatgcttttggataaattctgtttaaaatatattaatgatatattttttagccattataaatggaattaatctcttgctattttattaaaaatacataattctttatgattggaaggatttatgcataccacagcccatgtgtagaagttagaagaaaacttgcaggaatcatttctgtcttccaccatgtcaatttcagggatttaactcaggttatcaggctttgtggcaagtacatttaccctctaatccagatttttgtgtacttcttcttgtagcctgtgactttacttaacttgtgcaccacatgaatgcctattgaccccaggggtcagaagagacattagataccctgcaactggaattgtggatgattttgaactgatataaaaatgttgggaacctaacctgagtcttcttcaagttctgcatatgctgtcaaccactgaaacatctttttagtctttatgccattctttcatattgcagctcagatgggtgcttgttattgaactctgtttggtctaccactgaccctgcttatgtcctctgtgttttgtcggcatttcttttattatatttattcctacccaactattgaaacatacttgtttcttatctcatctttggtatgcactaaaccaaagcttgttttcttgtctgtttttctttcacaagcatgtacagagcatttggtttgaaaaagtgttctaaaccaataggaataggtttatgaatgaaatgtgcaagattatatgtttttgtgtgtattaattagttaattccattttcttagaacctaggacatggactagaacttagtgttagcagtaaactttctgggcttgatgtcatgatttctgaactgtggttttatttggtgcacattttttcttcctaaatactcattcgatgcacatagtgttgccctagcatgtatattaatattgtgttctaaaacctaataaatatttcttgcttgtctgaatttctctaacattcctgtcacaatttgtctgtgatcctattgtctatcaaatggcttatgaaagtgataatcgaaaggattatgaagtgctatgacattttagttgtcatgtttagacagaacacgaaaatggtgctcttctattcatctaacaaacaaatacttattgaatacctactcatgtgaaatcatactgttcggtgaaatcacactggtatatttctgcccctttggacgttgtattctattgaagagcacaagcaataggtagtaaattaatgaatatattattacaagacacaactaatgccatggtggtaataaatagtcagatgtgatggagaataaggaggagcaacaggagggaagagtgaagaactttaaaaatatgttaaagaaagcagctctgatatttaaatcgaaactcaaagcatgagaaattttaacaatgtgattatttggggcacactgtctgagggggagttacagagacaaagtttggagctgagatgaaaggatggaccatgtagagactgccatatccagggatccaccccataatcagcatccaaacgctgacaccattgcatacactagcaagattttatcgaaaggacccagatgtagctgtctcttgtgagactatgccggggcctagcaaacacagaagtggatgctcacagtcagctaatggagggatcacagggctcccaatggaggagctagagaaagtacccaaggagctaaagggatctgcaaccctataggtggaacaacattatgaactaaccagtaccccggagctcttgactctagctgcatatgtatcaaaagatggcctagtcggccatcactggaaagagaggcccattggacacgcaaactttatatgccccagtacaggggaacgccagggccaaaaaggggaagtgggtgggaaggggagtgggggtgggtgggtatgggggacttttggtatagcattggaaatgtaaatgagctaattacctaataaaaaatggaaaaaaatgtacaaggttcatgaaacaaattgactatctttatggaataataataggttatgaagagaaaatatagttgaaatttagagttaggggaaatgaaagaaatagcagggtttaagacaatgcagggccttgaatgttgtgttgaggcatgtagaacttgtcttgtagggagtaaaaacatggaaatactaaagagaatgatgcaaccaaattcctgtgaaaattttactctggatactgtgtggaaaacagaatggaaggatgttaggatgtaggaacaacaggtgtggtctgctgcaacagtcttggagagagtgtatcaaacttagcaattctgaagaaatgaaaagaaatgccagacatggcgaattattttgagatgcatattaattgctcatataattgtctttttacattaactgcaaaggagggaagaagaaggagtgaaaggatatgtctctgcctggctttggggcacaagtttctagttgaatgagtgagaaaagtgtttatgtagctattatcaaaatggcagctatattgatgataatgaagataatttttgattacctatagttgggggacagataaaacgggagatctgttcatggatttgtttaccttccttgaaaaaaatctaaaaaaaattctacatattttaatttttcaagtcaccttggtgcttgatttaagatattttttccactttctacctcctctgtaaagtgtccacggttacattaattctataccatgaataatgaaaagatcttctggggtggtgttgtacatacctgtaatcccaggatttggaaagtgaaacagggattggaaaggaaaaacggatgtgacaaatttatggacagcctgaaatcttaaatggaaataaagaaagaaaggaacaaaggaagggaggagagagagagagagagagagagagagagagagagagagagagagagaagaaaagaaaggtttatggaacaattaaatgaaaagatccaattgtataaatgttacatattttttcaaatgtgcacatgtcaatctttatcaaaataatatataaagacatcaaacattaaaagtcacccaagaatcatgtctcaaaatgaaaatatttgaataaccatctaattagtatctctgggcttggcgcccaggagtcttgggtgtttttctacaggctgacatttgaaaagcactgctatagataacctttctcaacctttctatggttccccagtcccatttatctgtctggtaaagactcaaaaatgtatttcttctcagaaaccttttatacatgcacaaaacaaaatacaaagaaacataaagaaatccagacatactgaaatacagtcatcaagatattttcaaaacatattgtacctagtcattttcgtgctttttgttaacatgttaaataatgagatctaacagatgtcctaatagaaccataatttaaagtactgaatgagcataaagaatattttgggacatttgccatgactttaatgggatataaattatcttaatttctattagtgacaaagctatagatactactgtttgtgatttgttgtctcgcttcataatggaaggaaatgctacatttctatgagctgtgaatgaaaataatggcaacatggttttcccaacccaggttcaaaggtatcaagtgtagaagctgtgcttttgagtttgtaaccaggtcatacagaaaatagtgaggatgtaatgaagttaggaactaggatgaaatactagtcaaagaatcaaaatctgtacatgaagtcaggaagccatgatatttagtactgttaattaaaattactgaaggaggagtcaaaactaaacaactgtgcctgcattgtctgcctcttaacttatatgtactgtcttgccactatgcatcccccttgcacctagttcgttcagaaggcatctatggagaaatatttatagtgttactgtgtgtgtgtgtggtgttgttgttgtcatctatggagaaatttttatattgttactgtgtgttgttgttgttttttgtatacaggtatgtgtgaacatctctgaagatcagaggccaatgtcaggtgtctttctaaattgcttcttgactttaatttttgagataaggttcctcactgaacctgaaacttgctgggttgggctagactggctggccgggtttctcttgggtctgcctcctcagtactaggattacaagtgcaaatatgtctgttcttttaacaagggtttaggagacccaaactcaggtcctcatgcttgtttggcaattcgtttttactgactgatttgtcttgtcagctcctaattggttattgttttgttattttttctagaattttgaaagagatcccagcatgtgaactatgcacatacagcaatggtagacttgggaacaggctaattctaaaagcagtaagaaatataacatggacatagagtgggttagtaggaaaggcaagaaatgaaactaacttaattaagcgaagtcctgaaagcactttctgagcatatatatgatgagttacgatttcataaaaaggttatagttagtgagaatcaaaagccaaaaagagccatggtggtatattttgtttaatataattaatttctaatacacacacacattatatatgtgggtgttttggtcaaacaagcttcatacatacatcatctccaattccaatcggaagcactcaccacttcttcttgccaacttcatgggcatgtactcatttttaacccattcatttcaaatagagcttccaatatgggcataggtatagagccatccactgaaacataccaagtgccacattatagaagaaaaatgcttctctttcttcagtagccattaactaaagatagttccttacttaggggtacagcctcatgagtcctttttctacccgtgcttgaatgttttttctagcttgatcttctgcatatctcatgaatgcaaatacagcagctgtgagattttgtgtgcaatggccctgtcctgtccagaaaacactgatttgcagctgtactccacaacatccagatcttacaattttcttgtgccctcttctcttcaataatgattcctgggcctctgagaaaagtgtataatgtagatttttcatttagagctgaatattctctagttacttttttctatgtattttgaccaggtatgagtttgtatttaccaccatccactgaaaaacaagtttctctgatgggggacagttgacaactgcccaaatctattggtataaagataagtattggtggacatgtatgtatttgtttgtgtgtgtgtgtgtgtgtgtatgtgtgtgtgtgtgtgtgtgtgtgtgtatgtgtgtgtgtgtgtgtgagagagagagagaaagagagagagagagagagagagagagagagagagagagagagagagagagagagagagagagagagagatggagatgtgttcttgagagaaataattctgctagctaaatagaggaaggcaaagcactttcaagtctttggtaagaactcaagaaccccactgggaaaactgtgactctgtgaagtaaggcaacgatcaccagagttcacagaaaaggaaaaagatataaaagatgttaatgattgaattggatgtgtctcataaagaagaggactttagggatatctgaatttctaccttgaagtttatatgaatggagatactattaacaaatctctaaatcatgagagccacagcaagtttctggaatagttatactttaaataggtaaatggcatgtgaaaatgttattgaaattggcatatagacttaatagaaattatgacataagtaggttagaaagcatatagggttagggattatatgtccattttagtacagctttcatgaaatgtcaattaatagctataccacagatagtcatagtggtatcattaatccttcatctttcattttatttgtggtaaagtttctgacaatatcagatatcattgtctttttatattaagagtctggagttgttttctcttacttttctaatacagctgctggaagacagagaaggctcatcacttttatgggagtaagaagcaacatcacttgtatggctcttatagtaaccacatggcatggaaactactctcagcaactcaaatgcactaaaagataattatagctgaagatattcccatatttattgaccattcatgtttgtagtctgagataagggaagagattcacagtgaaagtggggtattgaaatgcagatcaattttactagaactgggcaaaactgtgtttgttcttggtgttcctttctcctctgcctgttgattctaaattattttacatggtccttttgtgttagatcctggttggatcaaccttctgtatcttgactacactttccttctgtttcaaatgtgattaacctatgagatgtatcttcctataataaaatttcttgtacttctattaagtacctactatgaaattctatggtcatttgtggattaaggtgtgttggaatttttaagaaaatttataccttataagcattcctaggatggtgctctaaccaaaagaacttactcaaactgtagaaaccatttggaaagaaggaagtaaacttaagggagaagaatagtagaacaaatatagtgtgaaaagggaaaataggggagatttaataaggaggagatgggaatgttaagttgaaggagagtaggagaaaggtacaaataccacccactaagcgtgtttggcagtcagagaaatttattaatttattaacttatgaaaagtatacaggaagcttagttttaatgaactcacatgcatgaatactattctgccttaaaaccattggctattaaacaaaaatcccaatgccaggcactgggtatttccttgaaatatttggtcaggaggatccaagaaagcctcagataatgtagactattgacatcttagtttgggttcctgatgcgacttgagggtatgatcctattgctggtacatcatacattttgcacataagatttaaataaatcaaggtggcactgacctggaaacctcctccccaagggctagttttcatagtgtttggtattgctatacaggctatgagtagagaaacatttattaacaaatttactcagccgtgaactctgtgagctgcaataatgaccaatttgtcaagccatgcccaatggtgtaatagtggcataaatatcttggcaagaactcacagttgtctgatagcatttaaatcccatcaagttggagaaaacacatgccagcttctgtttaagacccaaatggctagaggagtcatagaccctagggtcgaacctactgtttggtaaattggtgagtacacagatttcttctcaatatgtatccttatgccaatataatagtggacctctcactgatcatcaaagaagcatcgttttgcaatagatggaggttactacagagaaccccagcaggtcaagatgtaaagaacaagtgattttggagggtgagtccctaaagaggatattcaaaactccacctctccccaagaatcaattctaaaagacagaggattatagttgtgagatagtgttttttgaacatagcagcaatgttttgcccatgaatactcaaaatctatagttgtctaaacaagacctgcacaagatcaaaccagtcaacattccagcataggtgaatgcagggatcacaatgctctactccaagtttcaaagctacaggtagttgatggctgttggaagtggaagattcaggtaggttgtccattctccagttgttatcccttcactcaattctatatggacaacactaactgaacatattaaaacacagatgcgagcataaatttgggaggaggatgtggagtagagcccagtaggattagaataggggaatgaagggtatatgtgagcaaaattcattgtatttcctttcatggtcacttttctagtttcatctctatcacacacacatatgcacacacacacacacacacacacacacagtaggatatgcatatgagagttaaaccaggatagttttctttttgagtctgtcttacttcacttgacatagtttcatactgataaataaacacacacacacacacacacacacacacacacacaaacacaagtgaatgacacagaacaaatatgaaagaaaatatattaatttatttttttaaaatcagggaatagtgaataaaattatatatgttaggtcaaattaattaatttgcagtggattgagtgaatgagagcatatgagttacttttaaagacagtgatagtgaattgagacagaaggcaatgacaatagagattggcggcagtaattatggctttatatttgcattctacatggggcctgaaagaatgaattatatatactgtgtggtataatggtttgtttaaaataattggcaaaaggtccagggaagtattaaacacacacacacacacacacacacacacacacacacacacttaaagatgctgaatatcaaatgaattactcaatcattaaaacctatttgttcttcatcaagacccatattgaaaaagttctatggctcataataagtgttctgacacagcagtctaaaatggtcactcatccatatgtgatacgttagggtattcttttttatatccttgtcttttactgaaaatagatttttttcttatatcttgattattgttttccctccctctactcctccaggttgcttctttttttttttaattagatattttcttcacttacatttcaaatactatcgtgaaagtgccatataccctcccccaccctgctcctcaacccacccactccctcttcctggccctggcattcctctgtactggggcatatgatcttcccaagaccaagggcctttcctcccattgatggccaagtaggccatcctctgctacatatgcagctagagacatgaactctgggggctactgtttagttcatattgttgatcctcctatagtgttgcagacccctttagctccttggttactttctctaactccttcattaggggccctgtgtcccatcaaatggatgactgtgagcgtccacttctgtatttgccaggcactggcatagcctctcaagagatagctcccttttctgtctctttttagaaatcagattggtatctaaagtataacaatgaaataaaataaaatatttaaaaataaacaaattggaataatacaaaactatcaaatggaaggaaaaacacaaacataaagcacagagacagatatagatatagagatccactcattttgacacagcaacctccaaagatgctgttaggtttattttattttgtctatctacagctgagaatgagccttacccttaagggttgcttgtttcccccagtgagattctctagggggaaaaaaccctaatttttcatttgcaggtggctatcaattggagagagcatctatgttaggaatggggtcatgtgtctacctctttcacctctaggacctcatttggtacagacccatgctgaccctgagtatcctgctaccaaatccatgagtatctagaaggccttcattccttggtgtcccctatctcctcttgcttgtatacaattttgtgcctactcttctgtagagttctctgagctcttgggttgggtcggggatttgatggagacatcctgtttagactttagtgttccaaggtcttttattctctataatgtcttgctgtgaatctctctgtgtggttctatctactacagaaggaagcatctctgatgatggctgagaaaggcattaatctatgaatatagtagaatgttatttggagtcaatttattgctacatttctttactaaaacagtagtatttggttaaatcttaggttcttggtcattaaagcagtgttgggtaggggttccatctcatggagtgggtcctaaatcgaatcagatattagttggttactcccacaagctttatgccattattgcactagtgtgtcttacaggcaggacagcattgtagatggaggggtttgtaactgatttggtgttaatgtttctccttggttgagtccagaatacctactcatgtgaacaatattaataatagatagggccaaggaagtatgtaagtttcagcttgacttgtccatattcggtgagctggataggtgttcagtaatggggtcttgccatcaatttgtggagagcaacctatagttttagtaacagccaaggttgtttggtgcttccgtgggactcatttggctaactcaatcccagtagtataagcttcatttggtgacaaatgattttgggctctgtcttcctttggccatttaattaggcagtctatatatattttaggaagctttcactatattaggtttccacactacccctcaagtggccctcaattttatgtctttccctatgtcttagggtttctattcctgcacaaacatcatgaccaagaggcaagttggggaggaaagggtttattcggcttacactttccacattgctgttgatcacaaaaggatgccaggactggaactcaagcaggtcaggaagcaggagctgatgcagggagggatgttctttactggctttcttcccctggcttgctcagtctgctcttatagtacccaagactaccatcccaggtatggcaccacccacaagggactctccccacttgattactaattgagaaaatgccccacagctggatctcatagaggcacttcctctactgaagctcctttctctgtgataattccagcctgtgtcaagttgacacacaaaaccagccagtacactctatattacctctcttattccctttgtcaccttcacttgatcctcccattccatgccgttctattcatcattatctagtctatttcccttttccagtgagacctatctgattctaatacctaatctcttcctctatacttaatttatttggttttatggattatatcttggttctcattgaataaagaacttatattcacatgtaagtgaaaacatatcatatgtgtctttctgaatctgagttacctcattcaggtgttcatgatttcatttttttgacagctgagtaatactctattttataaatgtaccatattttttatccactcttctgttgaaggacatctaggttgtttccaatttctacttgttatgactagaacagtaatgaacatggctgagaaagtgtctctgtggtagaatgagacatccttttggtataaactgaagaggagtatagctgtatattgtagtagattgattctcatttttctgagaaactgccatattgatttccataatggcatgcaggttttcagtccaacctgcaatggatgagtgtttccctatctccacatcttcaccagcatgagctattatctattttactgatcttaactgttctgatgggtgtaagatgaaatctatgtgaaggattgttttaaatgtgtgttgttcgatttttaacccttgacaagttttggttgtcttttggtagtaattctgtgatcagtatcataatggtatttgggaaggaaaactcataataagatattagcagcgagagacatcaaaaatgcacacaaaaccctttcaatgatctgtaacacaagctgcaaagaaagggaaggctgagatgatagagatcctctttaaaattaaaaaccatagaaaagtggtaaatactataaaaggcaatgctacataaatcattatctataggactaactaaatgacatatgcattaatgttggcagcttgtactgtatgtagagtgcagtaatttgtttcctggaggtatctgacatgaatcctagcaatagaacattgatatcaagtgtgagccctgtcttaatgagtgtctcataccagcatggaactaggagctacaaagctctctgtagtgttggtaaatcaagctttatggtgtggaaaaaagaaaagagcacattcactctacttattcagaagtaggaatcatagcaaaattctattttattatagaacttcagttaatatagggtatgggaaaaattacctgctttaccatctaggaaagagtattaagggatttggcccaatgtagtggtgcacaaatctaatactagtagttgagatgtgggagctggaagattgctgtgtgatcgagtctagctttgtctacacagtgagtttggacaccagctagctagggtgacatagtaagaccctgactcatgaaaacaaaataaaaacaacagcatcaaaacacatatttttccacaaagaagaagaaacttttgacttgggaagtcaaatgttaccaataagcacagttttaaaaacctgctttttgtgtataaaatactgttaagtgcaataaaaatatatacatgtatgtacaaattagagcaaaatattgaataatatttacaagtatgttcaatgataacatgttggagacttttactagaaatgttaaaatgtaagattgtgtgaaatcatgcatatcaaggaaacccacgggaggaactggccatttacatttggaacatgacaaaagttaacaggtgaagatgggacaactttatagggagagggggaaaacatgtgtggtattctggaaggcagacaaaacttggtatataattaagactcaaaacagctgaggctgctgaagcataaaaaacaatggggagtttggctggacctgagactaaagcaggagtcatgttgtaaagcacatagtaggacatactatgcttttcatctttattctaaaggaactaggaaggcagggataattaaaaaaaacatgatatggctgtgaggaagtatagtacagtaagttcttattttgaatgaaatttattttcatctgacacataatactaaaattggccatggctatagctcagtggtatagtgctgacctagcaaacacaaggtcttaggtttcacctttcatacaaaaaaaacctcaaaatgtacacaataatgggtcactgtattattagatataaactgatttttgaagctggttaaacagttgtatctgttcaaatactttctgtaaccttgtttctaagccaggctcctgcaataaagctcgggctggcctgtaatacactttgtagcctttacttctatggttttcaaccactgggttatgaccctttgtgggtagaatggcctttcataggggttgcctatactactggaaaacacagatatttacatttggttcataacagtagcaaaattacagttataaaagtagcaacaaaaattattttatagttgggagtcaccacaacatgaggaattgtattaaaggttcacagcattgggaagattgagagccactgtctcactggcttcaaatttggggtccttttcccttagagtcccaagtgctagaatcatagatgtttatcatgaatgactgctggtttaaaaaatcctcttgttatgctgaaaacacttaaaaatccttttatctatccttctgaaatatgcaggatgttatcactgtctatagtcactgaattgtacgatagatttttcagaatttcttgcttctaagtaactgcaagttagttaaacagatgaaacagcgaaataagtgctgacaaagatgtggagaaaacacacaatataccacttggacaattgtactacgtacctgattagtgtttgttatcgagtttgttacccatgtgtgacgacttgaccatgtttcatgaaaacttggaaatctaagaattgccaaatgataagtttttcaagagattctgcatgagttgaaattatggcttaacacacacacacacacacacacacacacacacacacacggagatgttggtactaatttggagtgggtataagtaaataaagagagaaatttaaaatttgaatcatctccacaaatagaaaaactataggacagagaaaaaagagagaggggtatgggagggagaaagaatgcatgagctatctccataccaaagtaaactgtaatcagtactcagtggtttacatgtatgttgtcaagaactggagtgactgtggtgctttggttagtttcctattgactaattaatcctttgtactttcttttactaaaacaccttggccctgaaactagctgttacacaaattcccttactgaagttgggctattttgcgtatcctgtgcccccatgaagggtatcttgtgtaagaagtcttgattacaatagttaccctctgcttgtttgcacctcagtttcttaaagaaaaacacattcagaagaaacgactttaatagggccttggaaacctaggcaggctgccttgtaatattcatacatccttaattgcaatattgagtatgtgtctttgatgggtctcttatggcaggtgtattggctttcttttccctcctggtattgctgtaatatttctacataacagcagagggtactgcaaatatatcctgatagaaggtgtgaacaggaagatagatgtttgctcttccttttgttcatattctaggaaagctgcccagaaggtgatttttttttcctaacttaaagtaactaacatattttttttcctttagggtcactaacttgcatttctcccctgtattcagtcctgaggatgaatggcaggacatcatgcatgcgagatagtcaaatcaccataccactctgatgtgtagtccactcctccctttctccattttatttggaaacagaagctttgtaagatactcagactgacattgaactctctatagcccaggaagtcctcaaacttggaatcctaggtcagcctctaaagcagtagctctgattctaggcctatgccagtaggcttgctataatgtttttcacttgcaattgatgaagccaatcacttgcttccataagcagtagacaggttgtagctgggctttcctttcactacatttccctgagaatcaataaaggcctttgaggaacaagagtcaatgtgagacttttagagaatgactatactacaaagcaaatcctattggcctatgtgagatttcactataaattaagtgatttgccccctttagttttatgagattgcttagacaggtgaccagcaaatcccagtgggtagaactcaataaatgtgagttttttttctattgcctcaatggcaaatacacatctggagaggatgtaagtgtctcctgttggaaatgaaagcaatgtttatgaagcaaccattcttcatattctttgacaaaaatatattgtgactttttgtattttatttttaactacattgttttattgttttctgttatgatagatttctgaattagatagtgatcaacaaattgcttgctagaacctttgtttgagtctcagatttctttttaatgttttaattgaaaatagttttttttctctcatataatatacaccccaaccacagtgtctcttccttccattcctcctagctccctagcacctttcgtctctcccaaatctactcctactctgtttccactttagaaaagtataggcctccaagagatgacagccagataagacaaaacaagatacaataagacaaggcaaaagccctcatatcaagactttacaaactgggcggtggtggcacatgcctttaatcccagcacttgggaggcagaggcaggcggatttctgagttcaaggccagcctggtctacaaagtgagttccaggacagccagggctatacagagaaaccctgtcttgaaaaaccaaaaaaaaaaaaaaaaaaaaaaaatagagagactttacaaggcaacctaatagaagagagcaactttttaaggacaggcaaaagagtcagagacacacctgttcctgttaagaatctcacaaaaaaaatgccaagctaacagctataaagtacatatacaggtcctgatgcagatccttgcaggtcctacgcttgcagcttcagtttctgcgtacatatgggccctgcttagttgattcactgggccatattctcctggtgtcctttacttgtgtggcttccacggtgttccctgatctccaagggaagggacttgatgaagacctccaatttagactttctgtatgatgtctgactgtgggtctctgcactggctcccatctgctgctggaggaagcctctctggtaatgagtatagaagaatatcattaggaatcatttattgttttttcccagtattgttttgttctaccctaagtctctgggctattcagtctagggtccctggctatctagacagtgtggacatgggctccctcttgtggcatgcacctcaagtgagaccagtcattggttggccactcccacaggttctgtatcaccattgcctcaggagatgttgccagcaggacaggttatactttaaaggatttgtggctgggtggtgtccagaggttttattttctcttctttctatagcctgtagagtgcctttctacaccaagaagctgaaagattgtaggtggaaggttttgtgttttggtgtccaggtttctctttctgtagcctgtagaataccttctcatgccaaaagaatcttgggtttcttatattttattttattttatgaatgtgtatgtacatgcatatatgtaactgtaagcacatgcatgaaggtctgagggcaagttttaagtcttagttcttctcttctaccatgtgggtcccagaatcaaactcagggtactgggcttgacagaaagctcctttacctgctcatccatcttgctggtccaagattcagtttgctttctttcttaaatcttgcattcttaatgtcttccatctgcttttgattcaaatgtttgtgtttaactcaccacctaagataatttcttggtggcattttacttctgactagtaagggagttatattgtgatttgttggaagagtgtgttttgtattattctaggttaaaggggatggcaatagcttcacctttgccatttgtccttgctgtctgtcatccagagcatccatccattttgaatatacagcctgcccaaagcaaatatagatgtgatcctagagcactcaccaacacacagtgattaggcttagacgataggatagagggcagtagcattctggaacaagcttgctctggctagtatcagatgtttgtgttcattttttatagtgctgtatttaatgacatatcagtggtacactgagacaaaccatgatggtaatattatcatagctatttgcaaaggccccaatcaaagtttttggaatggatcaatttgtattcttctacatgataaccgccagttgtgccagcaacatttgttgaaaatgctgccttttttccactggatggttttagctcccttgtcaaagatcaagtgaccataggtgtgtggattcatctttgggtcttcaattctgttccattggtctacttgcttgtcgctataccagtaccatgcagtttttatcacaattgctctgtagtacagctttaggtcaggcatggtgattccaccagaggttcttttatccttgagaagagtttttgctatcctaggttttttgttattccagatgaatctgccgattgccctttctaattcgttgaagaattgagttggaattttgatggggattgcattgaatctgtagaatgcttttggcaagatagccatttttactatattgatcctgtcaatccatgagcatgggagatctttccatctgagatcttctttaatttctttcttcagagacttgaagttcttatcatacagatctttcacttccttagttagagtcacgccaaggtattttatattatttgtgactattgagaagggtgtgggaaagaatctttacctatcctaaatcagataggggactaatatccaatatatatatatatatatatatatatataaagaactcaagaaggtggaccccagaaaatcaaataaccccatttaaaactggggctcagagctaaacaaagaattctcacctgaggaatacagaatggctgagaagcacctgaaaaaatgttctgcatccttaatcatcagagaaatgcaaatcaaaacaaccctgagattccatctcacaccagtcagattggctaagatcaaaaattcaggtgacagcagatgctggtgaggatatggagaaagaggaacactcttccattgctggtgggattgcaggcttgtacaaccactctggaaatcagtctggtggttcctcagaaaattggacatagtactactggaggatcccgcaatacctctcctgggcatatatccagaagatgttccaacaggtaagaaggacacatgctccactatggagcatatggacatgtggacatatattcatagcagctttatttataatagccagaagctggaaagaacccagatgcccttcaacagaggaatggatagagtaaatgtgttacctttacacaatggagtactactcagctattaaaaagaatgagtttatgaaattcctaggcaaatggatggacccggagggcatcatcctgagtgaggtaactcaatcacaaaagaactcacatgatatgtactcactgataagtggatattagcccagaaacttagaatacccaagatataagatacaatttgctaaacacatgaagctcgggaagaacgaagaccaaggtgtggatactttgccccttcttggaattgggagcaaggcacccatggaaggagctacagagacagagtttggagctgagatgaaaggatggaccatctagagactgccatatccagggatccaccccataatcagcctccaatcgctgacaccattgcatacactagcaagattttgctgaaaggaccctgatatagctgtctcttgtgagactatgcccgggcctagcaaacaaagaagtggatgctcacagtcagctattggattgctcacagggtccccaatggaggagctggaggaagtacccagggagctgaggggatctgcaaccctatagatggaacaacaatatgaaccccccccacccccagagctcatgtctctagctgcatatgtattagaagatggcctggtcggccatcagtggaaagagaggcccattggtcgtgcagaccttatatgcctcagtacagaggaaagccagggctaagaggtgggagtgggtgggtggaggagtgggtgtgggagagtggggggtacttttgggatagcattggaaatgtaaatgaaataaatacctaattaaaaataaaaagtatcagctatgtcatttgaaggataaagggcttggatggggctgagttgtcattcagtttcttgcatttacagcagagttgtctaacaggctgaatccaggtgctagccatttactgtaagtaagaaatacagactcttttgtcactggaacaatttaccaaacaagtaccttcctgtccattcatggcaaggggatgaaactaacaaaaggaatcttcaacttgagtatactgtgtaagtgcttcagctccttggcaggcactgatgcagttcatgtgtttccatcccatctctgcagattctctttgcttaatgactataaaatcactgtataaatagacactgatattgaagatggcaatttccataaaatgtattttttttcttttttttgacaaaaagtacattttgtgtgtgtgtgtgtgtgtgtgtgtgtgtgtgtgtgtgtgtgtgtgtgtgtttggaaggatgcctcacacacctggcttttactgttttctttttaaaataagcatttaccttacttgtaagttaacatttttgactttcagaaaacttaaggagtacttcttaattataaaataggactgctgacaaaaatatctatatataaatatagaggtgttttattaatactcattttaaaaaatcaagcatttgagtggaagttaaacaaaagatatgagcaaagctatttacagaaaaataaattaccaaaactgagagagcacattcatatttttattgtacagaaattacatatatttgaggagacagacatagttaccctgacttaagcattatataatgtatatattgaaaatattgaaatatgacctagtacctctgaaattatacatttttatgtttttctgctcctcaaatctgggaatctggggctacaaattatatttttttatgagttagaacagattgaaatgtaaaaagtcaataaacatataaacaataacctcataagtaaagctataataaagatgaaaacagtatatcagtgttggtggggatttcaaaaaaaagttcactaatattttattagtggccagaacaattaattaatagacaattgaagaatatttggaaaaatctttcaaaatataaaatttatttagctttggaagatcatccttctgtgagtttatcatattgagatatattcatatgaatattatacaatacatacactcaaataaggatattcattataagactgttttagtggttggtaattattcttatagatgatgtactttgttagttatggattaaaaaggcaatggtcccctataaaatatgaagtaggtttatttgtactaccatatgaaaaactttatgatatagtaataggtaaaacatgttacccagttgtaaacattatataacatcattttgatctgaaaattctatatcattttatctgtgtagtaaataaacatttaataagtgtgccactttgtgtttaaatttcatagtaaaatagttatatttttatatttttcctcaagattgtgctcctcccccaacaacatattttggagtaactactgttttttttccccattcaacattataaaacccacccacatcccctcccatacatatattgatatcctacccatctaagcatgttatttgttgcttatttaaggcatctgtttttaaatttatagaaatgatgtttatctttttttaaattaggtattttcctcatttacattttcaatgctatcccaaaggccccccatacccacccccccaatcccctacccacccactgcccctttttggccctggcgttcccctgtactggggcatataaagtttgcaagtccaatggacctctctttgcagtgatggccgactaggccatcttttgatacatatgcagctaaagacaattactgctccccaaatgtataaataaggatgacagcaaaagtgatattgtttggaaagagaggcccattggacttgcaaactttatatgccccagtacaggggaacgccagagctaaaaaagggggagggggtgggtaggggagtaggggtgtgggtatgggggacttttgggatagcattggaaatgtaaatgaggaaaatacctaataaaaaattaaaaaaaaaactttaaaaaaatttttaaaaaagggcataaaggaaaaccctgcagcataggaccattgtttagaaggaaaagcaatcactgtcagaaattctgtcctagtgtacacttttatgccgctaaatagaatgtcatttttactgtaacattagtctttatctatcaatattgctttactataataatatgcccataccgtcttcattgtttcttctgattatttttcctgtatttctactttctttgattacctgtcccatgacaacacagtagcaattttttctttttttaaaatttatttttttcagtcacacacacaaaaatcctgaatatggtttccactctctctcctcccaatttctccccacctctcctctcatcaaggtccattctctttctgcctttcattagaaaacagccttctaagggataataaaaagatataatatagtaaataaaatagaataatattcagccgaaccaaaacatcagaataagacaaaacaaataaagggaagaaaagcagcacaagataaggcacaagaaacagaggcccactcgtttgcacactcaggaaccccataaaaacactaaactggaaagcataatgttaaacagagcaacaatgcaggtcctgggcatgctccttcagtctttcaaaattcacagttgcgaattcccctgggatacagtatataattttggatatttgactgaacttggaaagttgtttaagcagagcaaatgaatagatggtacttctaactcaaaacattaggataacaagacagaaaagagatgcagagaaaagaaaaccaaagaggaactctgcctttggacattgccatcagtgaagatcatgtgcagttttgcattttaccccgagttactgggaacctcctcacatgatgagctggcgtaaacacatgggctttaaatgcaaaagacttggtcttgaatctcagctacacagtttgtagtaatatcatctagaaaaatttcaataatttttgggactcagtgtccttatttataagctgacaatttgtaatcagtgaatactacataagttagacattaaagatgacaacagttgtctataaattatttacatatgctagatatcccatgtataatagtatctattctaaaaatgctattattgtctcatttataaatgaaaaaatcagctattaaaaggttaagtatcttctccaaagcctagaagcagtgaatggcactggcaggacattaaagtaatctgatggcagaatatgcagtttttgcaaagaaacaagcctttaaattctttgctttcaactctgggatgccatagagaatattcagcattgttgtttattgtcattgagttggcaatgccttggctcaggctgaattcttagagtttctaaagatgggagattgaattgatcattataccatgctaagttcaaactcatgtgtaggagactacattcctagatgatcatgtctcctttagtggccagaggaacatgtgtgaattgagtcacaaaacagaatatagacaacccaagttcaaataattcccatgtatataagacaaacgtctacagtttaaaataaagcacagcttttttttttccgtctgtgcttggagctgatcctgtgccacagcactacatacccaaacaccaccaggaaagagctggtctcccaggagtgcagacacacctgtgagcacaggtaagaccacaatttctgctcatagggacctgcccagaaccctcaggacacaagacaagatccctccgttttttttctgctcccagagcagatcctgtgccacagtgcccagagctgatcctgtgccacagcattccatgcccaaatacctaagaaagagatcaggagtcatagatgcatcaccaacagattacaagagatagaagagagaatctcaggtgcagaagataccatagaaaacattgacacaacagtcaaagaaaactcaaaatgcaaaaagttcctaatccaaaacatccaggaaatgcaggacacaaggagaagaccaaacctaaggataataggtatagaatagagtgaagattcccacattaaagggccagtaaatatcttcaacaaaattatggaagaaaacttccctgagctaaagaaagaaatgtccataaatatacaagaagcctacagaactccaaatagactggaccagaaaagaaattcttctgccacataacagtcaaaacaccaaatgcataaaacaaagaaagaatattaaaagcagtaaggggaaaaggtcaagtaacatataaagccagacctatcagaattacaccagacttctcaccagagactatgaaagctagaagatcctgggcaggtgtcatagagactctacgaaaacacaaatgccagccaaggctactatacccagcaaaacacgcaattaccatagatatagaaaacaagatactccatgacaaaaccaaatttacacaatatcttttcacaaaatcagcactacaaaagataatagatggaaaatgccaacaggaggaggggaaatacaccctagaaaaagcaagaaagtaatcttctttcaacaaactcaaaagaagataacctcagaaacataattccacctctaagaacaaaaatagcagaaagcaacaatcactattacttaatatcttttaatatcaatggactcaattccccaataaaaagacatagactaacagactggatacttaacaggacccaacattttgctgcatataggaaatgcacctcagtgtcaaagacagacactatctcagaataaagggctggaaaacaattttcccagcaaatggtctcaagaaacaagttggaatagccattgtaatattgaataaaatctaatttcaaccaaaaattataaaaaagtataaggaaggacacttcatactcatcaaaggaaaaatctaccaagaagaactctccaattctgaacatctatgctccacccaagattcaattcacagaccatatgaagtccaagaagaaagaagaacaaagtgtagatgcttcagtgcttcttagaagggggaataaaatgctcacaggaggaagtatggagacaaagtgtggatcagagatggaaggaaaggccgtccagagactgccctacatgtggatttatcacatatacagtcatcaaacccagacactattgtcagtgccaagaaaaatgcttgctgataggagcctgatatggctgtttcctgagaggctctgccagagactgacaaataaagaggcagatgctcatggccaaccattggactgagtatggggtccctagtggaggagttagagaaaggactaaagtagctgaagggctttgtaacccgtaggaagaacaatatcagaccccctagagctcccaggaactaaatcaccaaccaaagagtatacatggagggacccatggctccagccacatatgtagcagaggatggccttgttggacatcaatgagaggagaggcccctggtcctgggaaggctcaatgttccagtataggggaatgctagggcaaggaggcaggagtggatgggtgggtggtggagcaccctcatagaagctgggggagggaggatgggataggggggttcaggaggagaaactggtaaaggggataacatttcaaatgtaaataaagaaaatatccagttaaaaaaggaaataattaaaaagtaaaaaaaacccaaaaaacaataaaacaaaacaaaacaaaaacaaaacaaaaacctgtaaaactttaagttgactggagataccctgaaactttaaggtgactggagatacccagatgtaattctggactctttttagtggtttgtgtgtccttttatgctaataccattatgctgcttgatgactatagcttgattgtatcttttgaagatgtataatggctccagctttgttcatgttattcagggctctcttgactattttgagaccgtcctacttccttacagactttaggattattttactattttaggggaaaatattgtgatttctattgagcttacattctgtctactgattattttgtataaatggagtttgataatattaaatttttcaatgctgaaaaaaagaaagcaagaaagcacagtcattgtaaagagtatggaacaaaaaggtatgaatgcagtggcatgcctcagtgagagacattatttgcatgaaatcagaaaagaggaagaggaggatgactttgtatgaagaagtattttctttctacctacctatgaaattattagatatacttctttgtttcttttgtttgtttatttgtttgtttgtgatcagttttcattatgtagccttggctagcctggatctcactctatataccaggctggcctcaaactgagagggacctacctatcctgtctctcaacaactacgattaaaggtgtgtgccataaagccttacttcttaggtatactttttatcaataagtatgtaggacaaatactcccagtttaaaagaaaacacagtcattttagagggtaagaaccttccttatcatcattaccctaccagatccactgtcatcttttatcagaatatgttctgcaacatttttctacctagttagaagagccaagatctacaacaatgacatatgactgtgggagggggggcacagtttgtttcactagtttatactagatcaagaagttacaaatatcacttcctggctatattatctatttattttagtgtcatctttcacagtgcttcagctatgtcttttcattatcattttaatggccatcacgccaacaacactttacctttgatagactttgtctgtttttgaggatgctgtcctagttgctcttctgcttctaattctttccctgtacagcagctagggtggtatgtttcaaaatagagataagctcactacctttgataaatattttgttccatcattctctcaggacaagacaaaatgtgaagtctatgataccgcatagtttctgaatatgttttaaacatgcagcaaaacttttttttataattttaacagaggttcaaactttatatgcctcactacaggggaacgccagggccaagaagtgggagtaggttggtaggggaaggggggagggtatgggggacttttgagatagcattggaaatataaatgaagaaaatatctgattaaaaaaaataataataaaagaagttgagaaaaaggaaaaaaaacaaacaaaaaacaattacattcttcagtgctaaggccaaacgtccccttttcaaacaaaatttatttatccatcgtatactagattgagtctttatgcaccacctgtctccttatgcatgctataattaaatattaatagttaataaatattgattatttaatgtttaatcctcctaatagatcattatctctgtgacaacaaggttatgtctatctttgtcacgatactatagcctttgtgctcattgggttatatagttgattttcagtatatatttagtgagctaaattaaggggtactcagattgtctaattgtgtaagggagagaaacaattttgtgaatctctgacataatccagcacttgactcttatgtttagtaatctatggcttatttctgatcatacaaatgccaagaagtactcagataaatttgggaagccctagtcaatattccagcatgggtgggaagagaccttacaaggtcacacacttagatgaggagctacaggttaacagatgctaagggaggagaattaattattttcaggaacaaagttcactcaataggttgcccacgcttaagtggtgagctttatacccatattgacagacaccaagagcaaatataaatctacatattaattcttttataaaagctaggggaaacaaaaatttgtcatggaatgtagaccagaatgtttaataaaaatcccactattttttaatcagcgaaggatgtctttagtccttcataaaataatcttttactgaggaagatatatcaattttttgctatataggaaataaagttaggtataattagttgaactagatcattttcttataaaaattctgttttgaagtttttggaagatatttatcagcatatctttttacctacagaactatgcgtactggggagagttaatcttaattttactggtgaaagcattggactgaatttaccttttaaaaatagaaatccattttctttttaacatgagatgatcattatatcaaccaatacgatacacacacacacacacacacacacacacacacacacacacacacacgtcccattgagaagaaagatttaaagatttttggtagttcatttcaaggataacattatttctgttttgaaaaaggtacagatttcctaaatagtttaatgtgtctctgaaagactaacacaggactgctgttgtaaggaaattgatgacctggtgtatttaaatatttaaaaaaatcttaaaaattttaatctctgacaattacatacattcatgcaatgttttaaggatattctcacagtattatcttcacaacttctatcctgtcccatccctacagacttctttcttctttttaattagtcccctcctatttccacatcttagtttttgtttctgtgtgttcttgattacattgttatacccagaagagagtgttttgtatgtctttgccctatctttcagtgcttacaatatttctgacatcttttctgtgaatttctttgagccttgaaaaggataacatagatataaaattatgacttattgattgtgagtccctgtattatcagccaccaactgcagtctgaaacgtctttggccaagaaggacagtagcagtagtccaaagatataaatatttagaagggaaatttatctatatacatgtttagattaatagtagtagtatgtgacatccctagccatcatgtttttgcttagatttcaagcactagttatattttctcaagaagtgggcctcaaatccaatcacaaggttacctccaaacaatgacaccactattgtccccatggaaatatctttcctagaatcttatagtacttgataagattttcaatgccttttctcactgcaaaagcctgcatacaatctattggcactatgaattcttgctaggtggatagaggcttccaggttaattcccccattgtttgtatttgtgttgcatcctcaatatgtggtctctttaacaatactaatgtataattaaaaaaataacaactctacatctgaaagagatttaatatctcaaatgtgtaatgaacacaaaacctggacattaaaaaacaattaaaaataaactatggatagatacaaggaatctgaaaagctataagctaataaacattgttaaagtgtgtaaaatttttgttatcaggaaaatgtaaataaaatgacttttatattctaactcactccctcagaatgacaacaaatactggcgaggatgtggagagaagggaaacttttttatgttgatgtaattgtaaactggtacagccactatggaaagaagtatggaggtttctaaaaatgaaaaaaaaaaaaaaaaaaaactaccatgtggcatagttacaccactccaagccacaaatttaaagggtccaataccctgaaacagactgtatatacatctatgttcattgctttttagttcctgataaaaagtggaattgtataagggacatcaaatatcaatagatggtaaaaatttaaattattacattttgcattattctgttatttttttaaattgtaaaattaatatccttctattttatttaaaatttatatcctttcacatcatttcaccttcctcttccaccaagttccccccaccttgttctcttttaaatttatggtctttttttgttaatgtgggggtggggtgggggggacatacctaatatttagggattattgcagaggaggagccaaggatccagggagttttctgtttgattatgtctcctagaaatgttagaaactacacccatgaagtctcaccaacatggcttcataaatatgtcctgaccaaagacaatcccaacagatatgctcgtgtggacagggcaaagctcacaaggccttaacccaagacaaagaactgcagacaactaaagaatactgagagtgggggaaatcgtcttcccaaaggaagagcacagcaattggttatccaataacaaattatcagccctgaagacatacaaacaagtaacattatattgtttgcacgtattgtgtttatatatttagaaatatacatatagatatgaaacagtaattacaaaaaagtagcaatgtattaaaagaaagcaaggttggaatatgtaggtggtttgagggaaggaaatgaataaaagggggaatgatgtaactataacctccaaagactaaaattattttaaaatattttaattttattaataaactcagtataccttttatgggtattatagtggatagttttatgtcaaattgacacaagctggagttatctgataggtgggaacctcaattgagatatggctgtaaggcattttattaattagagattgatagggagggcccagcccattctgggtagtcctgggttctataagacagcaggctgagcaagcagtcattaggaataagccagtaactagcacctcttcatgacctttgcatcatctcctgactccaggttcttgcacagtgtcaggtcctgtcctgatttctttcagcgatgaacagcaatatagaagtataaaccaaataaattctttcctcaacttcatttttggtcatgctatttcattcattgcagcaacaaaaaaccccaaactaagacacatcagaaccagtgacagatctgtcacagacctgaccatgttgatttggggaagataatggaaggactttgggagtttgggctagaaaagccactgactatttaaaacttggtgagatgttctataagagcttagaagctaagtatgttgagaacagtgctgaagatggaggactcgcctgtgaagtttcatagggtaggttaaagactctatcagggacaatttgttctttgacttaagaatctgtggctctggttaggtggagctgaagaatctgctctaataccagagataccagatataagagactagaacttctaatgtgaaacctttactttgctgggatactccatgctggtcaggtagagctgagatattagcagtgaccaaaaagcgaccagcgtcattgaggcaaaaatcttctgggaaatgtttcctgagagtcagcacaggagagctgtattctagggcagctaaggttgtaccacaatgctagcagccaaacttgttagtgtaagagtaacacagatggtatgggttttgaagacatgaagaggtcatggagagcagctgaggattggcactgtgagaggccattggtgaaggtgcagcctcagtagccgttggaggcccaggactgaaaatgtcatgcagagaatttgaagctggggaccataaagagagcccaggagaggctattgctgaaagtgcagctcagatgcatcagaaggccccagtattttggagatgccagtaccatggaatgaccaccaagaacagcatcagtggtgagtgttgcctgcctgagcttagaaaacaagttgtttgtgttgcagagaacagagctgggggagtgacccaagtcctttggaggagctcagaagagcctgagggaatcccaggcattggacattgttttgatttgattgtgactgtactgtatcctggtatttccctcttgaagtaatgaattattagacttttattttattttattttattttattttattttattttattttattttacaggagaacagaggtgagagattgaatttaaaaaagagatttgggttttaaacagactttggttttcttttttaaaagattgaattttaaagcatttcaattttgtaagaattgcaggaaacttttaagtttgtaaaacattttatcttgagattacacattagaaaggaaaagttgtggcttgacagtgttgcgttcgtctgtcaagttgacaagagattaattgtactggctaattttatttcagcatgacataagctagagttttctgagtggatgacatgccttcataagatactgctgtaaggcattttcttaattagtgattcataaagcagagtccaaccagttgtgggtgttatcattcctgggctggtagtcctagttaggaagcaggcctctgcatcagcccctggctccaggttcctactctatttgagttcctgttctgaattccttcaatgatgaacagcaatatggaaatctaagaaactcctccccaacttgtttttggctatagtgttttattacagcaattgaaacccaaattaagacaggtataatataatttatataattaatcttgtatctggaggatatcatccttagtgaggtaacccaatcacaaaagaagtcattaaatatgcactcactgataagtggatattagcccagaaacttagaatacccaagatacaatttgcaaaacacaagaaaatctagaagagggaagaccaacttgtggatacttcattcctccttagaatagggaacaaaatacccatgaaaggagttacagagacaaagtttgaagctaagacaaaaggatggactttccagagactaccccaccgggggatccatcccataatcagccactaaacccagacactattacatatgccagcaagatttttctgaagggaccctggtatagctgtcttgtatgaggctatgccagtgtctggcaaatacagaagtggatgctcacagtcatctataggatggaacacagggctactaatggagaagctagagaaagcacccaaggagctgaaggggtctgcaaccctataggtggaacaacaatatgaactaaccagtacccccagagcttgtgtctctagctgcatatgtagcagaagatggcctattcagccatcatttggaagagaggccccttggtcttgcaaattttattgtgccccagtacaggggaatgccagggccaagaagtgggatgggtgggtaggggggcatgtcaggggaagggtatagggaactttcgggatagcatttgaaatgtaaataaagaaaatatctaataaatattttaaacacacaatatattttgatcatattctttctcctttcccaagtcctcaaagataattcttgcctctatttacccaagttcatgttctgtctctctcagaaaacaactgtccaaatgaaaatcaaatctgacaaactaagcattagaaccaataagacaaaccaaccaaacaaccaacaagcaaaaaaacaaaaacagagccgggtgtggtggcgcacgcctttaatcccagcacttgggaggcagaggcaggcaactttttgagtttgaggccagcctggtctacagagtgagttccaggacagccagggctacacagagaaaccctgtctcaaaaaaccaactaaccaaccaaccaaccaaccaacaaacaaacaaacaaacaaactttcccctccaaaacaaaaaaaaaaaaaaaaaaacaaaacaaaagtaggcacacacacatacaaactatggagtccattttgtgttggtcaactactccaagggtacaatatgctttaacttcattttgaacatgagggttgcttcttttcctgaatcatattgtagagactaaataaacaaatcatattgtcactcttttaccttctttggcttcccttcttaaacaaagatgattatattccataggagacaacaacaacaacaacaacaacaaaaacacaggttccaggcaaaaaatattttgttcagtagtcaagaaaatttctgtgttctgttgtattggggacaaacaacaacaacaacaaaaaaaaaaaacaacaaaaatgaaccaattttctttgccatcgaaatacaggcataccctgtaggctttgtaggctaagtcccagatgactagagcaaaccaactatcaaaaggaactaagtaatgtactccccacagcaccctacttccctccgtgtttataaattgcatttctacagtgtctggaatggcaagacattttttttttaatttattcactttacatccagatcactttcgccctctcagccacctacttccacaaacccaatccccatcctccatcctcttcccttttgagaaggtgaaggcccactggatctcccccaacttcagtgcctcaaaactctgtgagattaggcacattctttcccactgaggccagaaaaggcagcccagctagtagaacatagtctatatacaggtaatagcttttgggatagcccctgttccagttgaccaggactcacaagaagaccaagaggcacatttactacatatgtgtggggaggcctaggtccagcctgtgtatgttctttggttggtggttcagactctgagatccccaagatccagattagttgactctgttggtcttcctgtggagtttctattccctttagggactgcactcctttcccctactcttccataacattgccaaaactccatccattgtttggttgtggacctctgcatccaagttggctagaaaaacatttttaacaaggcaacttaaataccttaattaaaaatacttcattgctatgaaacatcgatagctatctggaccttcaataagtcataagccttatcctggtgaagaatcttgctttgatgctaatggatactgactggtggtagaagttactataagccagagtggcatatagcaacttcttaaaataagaccacagtgaggtttcctacatcaattgattcatcctctttgaaagatttctctatactttgtcatgcagtttgacaacactttaccaaccatggaatgtctttcaaaattgaatcctttcaatccctgcctctgcctttttcactaggtttataaaatactaataaatccattgttgtcatttccactggggttcacactatgtgtaccagaagtacactctctcaagaaactgcttaattttttcatccataaaaaacaactcttcatttttattcatgggatttgtagcaatttaatcgcatctttaggtcccaacaataattctagctccttttcttctgaagctgcagttgtttcatacagcaaagtactgaatcccttagttatccatgagagttggaatgactttctccaaaattccttccaatagaagactgtttgacctactttgtttttgtttttttttttttacctctttccttgggttactaatttttgttatggtacctaaaatgaatagatctttttcaggaaatgtacttttttttggttccacaagagcatcactatctagtgagcttttagtcttaccatgtatgctctacagtttatgatccaagagctgctgtagatgaatctcgtgatgacaagcacaagaacattgttaactccatagtacatctttcttggagcttttaggtgagcagttgatttgacaaacaacagtacaataaacagacaattaatttgtctttgtttgtcctagctgtagaccttaaaatattcatgaaagcatagtataaatagatatgctattgtcctggctttattaagccatataaagttcttcaggatcaaaggcatttccaaaggttaaatgaactcttggtttcaacctagagtttttggctacattagctcttaacaagaaagtcagattgacctttgaagacttgaagccataagatgatgtctactcacacctatcactattagcactagttagttgtcaacctgacatacctggaaagaagaaacctgattgataaattgactctattgaattagcctgtggccagtatagtgggcatttcctttttcttttctttttattagattaatcatttactttacattctaatctgatttcagcttctccccctcctgttctcatctcccagtccttctctcacctcatctccccctataactcctccctttttcctcagaaaagggggagacctcctatggatatccaccttggcacatcaagttgctgtaggactgggcacatcttcttctattgagggtagacaagacatcccagttaggagaaagggaaccaaaggcaggcaatgttgccagaaacagctcctactcttgctttaggagtcccacatgaagaccaagccgcacaactgttttatatgtgcaaagaacctaggcctatcccttgcatgtgctctggttggcagttcagtctctatgagctcctatgggcctaggttagttaatgttgtactttttcttgtggtgtcagtgacctctcttgatccttcaatcattcctcctcttctacaggattccccaagctccatttaatgttagactgtgggtctcttcatcagtttccttcagctgctggatgaagtctttctgatgacagttatgctaaactcctgtctgcaaatatagcagaatatgattaatagtcccaggggtggactccttctcatggcatggatctcaagctggaccagtcattggttggccctttcctcaaattctgttccatcttttacccctgcaaatctagtaagcaggaaaaatggtgggtccaaggttttgtggctgggttggtgtcccattcccttctttggaagttttactctgttacagggtccatatcccccactgctaagagtcttagctaagatcacccttatagattcctgggagtttccattttcataggtttttaccttgtcccagagatgctcctgaatccagttgtctttcccagtactctccctccatcctctccccacctcatccctccttttcccacccccatctgtcccccataaaatcccctccctccatcaacctgtgctgtctaatcttccttttatcagtgatattcaagcattcacctttggctgctccttattccttagcttctttgggtctgtggtttgtagcatgattgttctgtactttatggctaatatccacttataaatgagtatatactcatttcatttcattcaagatgatattttctggttccaaccatattctatatacgcaaaataagctacaccatactatgcagactcttgctaacctatggtcatagcagctttaaacctatgctcatagcagctttattcataatagccagaaaccgtaaacaaactagatatcctttaactaaagaatggatacagaaaatatgctatatttacacagtagagtattactctgccattaaaaaaatgacattatgaaatctgcaggcaaatgaaagggcagtagggtcaagcctactgtgggcaggacccattccaatcaggtgggctaggacagggtaggaaaagtatttgtgcaagctagaggaaacaagccagtaaacagcattcctccatggtctctgcttcaattcctgcctccagctcttgtcctgcctccccttgaagatgtatggcaaatcaaccctttccttacccaaactttgtcagtgttttatcacaacagaaaaataacacagaacagaacagaacagaacagaacagaacagaacagaacagaacagaacagaacagaacagaacagaacaaaaagctaagctacaaggtaggaaagtcctagatggcatcttctcccgatagaaggttgtttaatgtacattgaaaaatctgttgcttagagtcacctccttcatccatcatcttggctaggtcttctgcataatttgctctagccccagccccagcatttgctacttcaccatttaatttaatgttatgaagacatttttttttactcaaatcttaagaactagtctcttcaaatttcaacctttttgtctgcaacatcctcatttcttgcagatttcctagaattgaagaacgggaggatggttccaaatcaggcattggcatatgggaatgttgtggcagtttggtcttctttccagaccataaacctttctatagttcagcaagaaaactttgcattgtcatatcattcattgcactcactgacatagcatgcttacttagcccacttcaagaacttttcctttgtactcataatctgcctcattggtgcaagaatgcctagctttttctttaaagtgagagacttggggctcttcttttgaatttcattatgagaggcctctgtgggattgatatctggcctattttaatattgttgtgtctcagggaataaggagtccctaggaaagcaatgaaagaatgactgctctgtgtagcagccagaaaatttgtcttaactttcttctgtggccacagttcatggcaccccacaaaattgcattatcatcacaaatcactaacaacaaatcaccataactgatataatatgagtgaaaagtgtgaaatattatgataatggctaaaatgtgatacagaggcatgacgttagcacatagtgttagggcaatggcatggatggacttggacttgattaatacaggctgaccacagaccctaaattcataaaacctgcagtatctgagaaacatagtaaagtgcagtaaaatgaggtctgccttggagaatagaaggaaatggttatattgcatctagagtatgtcatataatagtttcttcaaatttttactttctatgaagataatattatttggtcttctagacatcatgttaatttgcctaagttaacatacccagaaggtataatattgacctcagggtaatattacaacatttcaactgtctcagttaagatcatttaaattatgatggtgctgtcataatccccaaattttagtggttttacagtagttttatttttcatttatgtaaatgtgataactagaagctcctcttagtgactagtcatcatataaccagtcactgttgcataaagatagcagtgcaaggtatcacaatggtaaataagtgctttggcctgaacgtgctacacaagtgtggccagagccagctacacggccccatcaatcacaatgaggccataaagtgtgattaatgcttaaagtcaaagagctataagtatttggaaagcataattaatggctgcctatgttgaatactgaaaaaaaatgtagaatttgccctttaaccttgtattgtatcccctttcttccttagatatcctaaaccattaccaataaaattccatacacacgtgtacatatacatgtatatacatttttactatatgtgcgatcatatttttatacagcttatagatttatttctacacatttacctcagtctcattgttgcttgcatagtattcactaatatgggtatgttattttcagtgccacgaaaaaaaagatgtttgccttgtatttgcattgcacatgaacaggtccttctcatgtatacatttctatttggagttctttagttgtttatttttggatattttctttatttacatttcaaatgttatccctgttcctgatttcccctctgaaaaacactctcccccatttcccaccctccccctgctcaccaacccacctactccagcctccatgcccttgcattcccctacactggggcatagagccttcacaggaccaagggcctttcctcccattgatgcctgactaggccatcctctgctacatatgcatctggagccatgattcccaccatgtgtactctttggttggtggtttagtccctggctgacctcaagctgtactacaaagcaattataatttaaaaactacatggtattggtacagtgacagacaagtagagcaatggaatagaattcaagacccagaaatgatcctacacacctgtgttcacttgatctttgacaagggagctcaaaccatccagtggcaaaaagacagcattttcagcaaatggtgctggctcaactggaagttagcatgtaggagaattcaaattgatgcattcttatctccttgtacaaagatcaagtccaagtggatcaaagacctccacataaaaccaggtacatggaaacttatagaggaaaaaagtggagaagagcctcagacatatgggcacaggggaaaaattcctgaacagaacaccaatgtcttgtgctgtaagatcaagaatcaacagatgggacctcacaaaattgcaaagcttctgtaaggcaaaggacactgtaaagacaaaacgacaaccaacagattgggaaaagatcgttaccaatcctacatctgatagatggctaatatccaatatatgcaaagaactcaagaagttagactccaagaaaatcaaataaccctataaaaaatgttgtacatagctaaaaaaaaaaaaaagaattctcaactgaggaatacccaacggctgagaagcacctttagttgtttctaaaacaagaatcttctaaatacttttaaaagtttgccaaatattaccatactgccttcccaaatgctgcatactaataccataattagtatataaaactgcaagctacacgttggaagaatatttacaaagcaaagtgttggacgatgaaggatttaaatactgtatgattcactttttgtctaaaaacatgtaagatcctttgaccactacttttcagtttaaagctgggaacaaccctaaaaatttactaagccttttgatgtacaacacttttggttgtatattaattgtcagacacaatttcctatatcagctgaaagagggtgttagggaaatttaatatttcttttttattttttgaggtctatgcttaaagttaaaactcaagtaaaactccattgtgtaaatgtaccatattttctttatccattctttgattgaaggacatctgggttgtttccaatttctggatatgaataaggctgctatgaacatagttgagcaagtgtccttggggtatggtagagcatcttttgggtatatccacaggagttgtatacttgggttttgaggtagattgagtcccagttttctgagaaaccaccatgttgatttcggtagtggctgtacaagtttgtactcccaacttcagtagaggagtcttccctttgctccacatcttcatagctcaagcaatgagctattgcttgaggttttgatcttagccattctaacaggtgcaagatggacctcaaagtaacattgactgaaaaagagaaattctatgctacacgttggcttatttgcatattgccctgagtattcatctctttatagtatgtcccttatgttctccctcaacagaagctgtttccttcctcttcacttgattcttatttggaccatatgtcaacattttggatcctcatttttattagtttttaccctctttctcttttgtaagttttatctatgtcttttttcttctttatatgtatactttcttcctctatctgtgtcctatctctgcttattcctgttgctttgtttcccaaattggtatttctggctatgcatgttttactctttgtgtctgctctaacttccatttctattagagtgaccaacagagtcagctgttactgcatgagctattttcaaatgataggaagttcctgaggataggatagatagagatatagagaataaaaaatgtcccgattgcttgaaatttggattagataagtattgtgatcttgtcagtttaagttttattgagaaccaacttctttttctataaatagaatcttacaaatattgctgaatatttgtttttttcttagatatccagaaggaccttatgactcctcctcctctgtagtcattatccttcattataactaatgacagatttaaaagaggttaagggattgagataaattaagaaggtatgatatctatctatctatctatctatctatctatctatctatctatctatctagatagatagatagatatagtgatatagtgatatattctgatgactccaaaattccccagatgataatattatgataactcatatgtgtactctgcaactggatgatatttttactccatatatattcataaattaagcttgttttagttccagaagtgcaatatgaagacattctctgaacccacggtgtctgtcactttaagggagaaagagaagaaagtgtagaaggcaatttgcaaattatacctgaatgtcacctgagaataacatcatcattgcaatcatctgttggaagatttagttcaattacatttttaaagactctctagtcaagagagtactacttatatcagaatttggtactccaaggaaaggaatactaatgcattcattagccattgacctatcatcttccttctttgcaattttgcacatagcctttggggagcaggggattgtgtgctaactctagggaatcaataaacacaaggctctctgggggaatatgaactgcaggagaaagaactattgcatatttatgacaatggtaaggagaacagactattttttggggggggaggtaattttgaaataattgaatagcagcaaaattgtcatcatagtgggtattatgcatgctcctgtacactttcttcacacaacagtaagctggttgtaaaatcaccaggagaaaagttataatgcaataaaccaaagattttcatgggaaagctccaactgctgctgacacttttattatttaaacagatgtgtggaaccttatgttgggagcccactggtcagtcctaagacattcgttgatcaatgatgatatttcaggctgactgctgctgcagatgaacactgctaggagattgattacactggcctttctctttgactgtttgaattggcagtttggcagattttctctttcaatgggaaatctaaatcacccattgagtatgctgcaaactacttctctaactttcttttcccttacctcttagcatatataggttgatcttcattattttctacttgactaagcactgtagtattcatacatctctacagatgggctataccaccttaatactaaagagacaaagtttatcatcttttgacttcatttagcattgaatgtctacagcaaaataatgtagtattcattaaaaagatctggctatgatcatgcatgctcaaagtcaagcctctattctgtgattttttttctaatatgattttggctaagtcacagctgtttttttttcttgaaaagtaaaatcatgataataatacctcaataaatttttgaaaggtcacaacgatatgtaacagcttggtaatatatgtctgacaaacacaaatgctcaataaattataattataaaatatagcctatctttttacattaatttagttgttgacacagtgttattaaatatatgcaataagtatgtatatctatttcttctaatcctcattgatcttaaatgaagtgggggaagcaatgcgaatgtatgaaataattatggagttaacttagtctattgcaatgatgatttacctaaatcaaaaaagtcaaatatttaaagtcacatattttctttcataaagaatagagaaaattaattatataagctagaactatttctaaactgacttatcagttgccaaagatagtctatatatagtgggaattcaagcacatgaccacttggtgaatggattcataaagagccttctcaataatcattgtgggttgctaattaaaagatatcaaaatcattagacaatcctttctgggaaagtttatataaatttcagatagcttttagattgaaacagtgaagctatataataatatgtaataatataacaataatagctatattagctttggaggaggatagcatggttaaattctaaaaatattaaccagcatgattaaataggtaaaatataaaaaaagctgagaatggctgtagggagagttatgtcagatctgaagcaatgaggcatttgttttaacaaagtcactgggaatgaaggaagcttttcatagaaaggtaaaggaagaggagctagagtacggatgtagttgaggtaaagttggaaattgtaacgctaaaatcctcttctgcactagaaatgttgttgcttctgatgatgtatcgacctatggagaatgaaggacatattgaacacttaaatgattttccagagttttggtttggattcttcaaaagggggtgtatttacgattgggattaagttgaaagtggttgatttgaaaatgttgcatgggagtgggacaccagggaaggcacacaagtgaaacatacaacaaggaatgagctgccacttcttggtgggatgtacaaaagagtgatggagctggagttaaaacttcatatagcttattaagagccactcactacatactatttacatagcatttacattttagctccagtattggtcatgctgcatttatagtagaaaattatttatagggcagaaaaaaaaaacctaggaaaacttatgcagaggtattttagagtgggacaaaaagataggacaccagtggtgttcatggaaatagaaagtatgctacaagtcatatgtggagaattatattttagataaataatgttttattttaaacaaatgaatatttttaaaatgttttattcatttgaagtcttgaacacttaatattatatctgtgtagggctgaatgctacttgttaaagtctcattgaccataagtcatgtgtcaaccagtaccccctggagctcgtgtctctagctgcatatgtatcagaagatggcctagtcggccatcagtggaaagagaggcccattggtcttgaaaactttctatgcctcagtacaagggactgccaggaccaagaagtgggaatgggtgggtaggggagttggggggagggtatgggggacttttgggatagcattggaaatgtaaatgaagaaaatacataataataataataataataataataataataataataaaagagctggaggtatggtaggtagtgactaagtggcttcccttgtgaagagcatattacaatggacagagagtagaaaaagacaaataagcaaatagaacttaatcacaaaatgtctcaacattttagaatataaacattattacttccacatttggtaccacttgctacgctttattccacttatcctttctctaagagacgaaaacatcaataaatatgtcagtttgattctataacctttcatatgctttcagaatttggatgagcatcattctttatctagggcctttgtctttattcactccaaaactactatctgatagcaatataatccctttaatccccaacagagtgaacaaattattctagggtctaggaatttctggaagtgtatggtatttgcttcctttgccataccatcattccttcctgaaaggaaagtgtttgggaatgagcaatggagaaaatagacatttgtactatgtgtacatatatacacatattgattgaccagacttaattttactggccatttttgggcattatataaataaatagttgctgtgataatctgatgagagagttgctcaaatatccactctgggtattgggaagtgagaccaccctattactctcctttcttgtgcacacatctggcttcatgttgcaaagctttttggcaagaatagtatatttattgacccccaaacttgaagatttggatgcaaatttgtcttctctgtgctgggaataggcaagaaatagttcagtccccttgtcacctggcagtttccaacccacttgcttctcccagagttctttatccctgtagcagggttacaaaagtatgataataatgtatgaatgcacgataataagcacagagtgatctgctgtccttatgcaaagatgattaacttcttattaagcctcgttgtttattggtgagttaagggcatcataataaggagctagctatgttgatttgttgagctaatggctaaacccagaacattttctgaaaatttgcatgcctttcatcccagtactcaggaggctggtctacagagtgagttctagaatagccagggctattacacagagaaaacctgactcagaaaaaataatgtgtcaaatggatcttcgaggtgaatttaggaaatatggaatgtcacacagtacatggtatcactctgataattttataacctggtgaggtttatgcccttcaaatacaaatccattataaaagaataaatctttaaacagtattcagcatcattaaatattacccagcagcccttcctgcttttccacctaggttttcttccattcgttatcctaatgatcacagtggtttcttttacctttccaacctctttgacatcacttatcctgggtttctgataaaccttgtgtatcacactgcttctcatcttctgatgattcaacatcaactgaaaagtcttagctcacttgagaaacctgtaaaatagtttgtttctttttctcaaaatgtcccttgatggtgctggtgagagccccctttccctgttactctaatctaagttcacacttttgttattatttttcatttttaagccctttcaatccaaatgcttaagactgggtactactcatttttaaatgaggatgtcaccattgtgtaaaatgtcatcctgtcatttaaataaacaaaagagctgtctgttctgatgattctaaaacagacgagtaataatccactgcatggtggtactctggaggctggggcataaaaagcaccatggggatcagttcttggggaggaacaagaaagaaagaaaaataaggggggaaaagtagtaagcaagagactcaagagttaaagttggttagtccggtgaagtcgtttggtgaatctgatgcccataggctatttggagattaatttcatgaagatgagggaggggtagctcaggataaaggctaagtgcaaatggcatgagaactatatgtggttttaaatatccagagacaaatgacatgatccaaataattatgctacaaccaaatagaagaatagtgccacgaagtcagatcaaagaagcaactgaggagcccatcttcatgcccttgaaagccaaaaggacagaattcaattttcattttgcatctaattgagaccattgagaagatttttgctgggttctctcacatttaactttgagctttcaaaactttcttccatttccataaaaataaagccagatgtcagtagattatcatttctgtagttaatctttgaaaaatacagtagaaatttgggtatttttttatctgaaatgctcagaatcaacattttttttcatgttcaggacctttatatttttataatctttttgtagacattaccatttgaacatttttgaattgcatttcagaggattttgtatttccagataagggtatcgatttatagctatggtttcattgaggcaaaagtgtatatgtggctcaaaattttattttcttctgttttgtatttcagctgccagagaacttgaacaatgaagctgccacttcttctggccctggtggtctgttctgcagtcagtacaaatttgaagatggtgtcaaaaagaaattctggtatgttgctggtgacttcctgctatatggccaaagtgtgcggagttttttgtttgtttgtttgtttggttttttttttttttgagcattcataggtcacctatgtatttaaatagggatgtctttaaatagaagctcttatattacattggaaagcagccaaagtaaaaatgaagtttgttgcttaccaccgagaaaaagttgggaaaccagtagaagtttgttaaaattcaatggccagcatactctcagtggacaacaaaatatgaaagggctatttacagttggttacatttactggtgagtaaccacctgggagcaaacatttataaattagaagagaggaaaacttttaaaactacgtataatttgtgttctaattccatatacaacaatatggtttgaagagttgttttggaaaaatatcagtgagctctccatatctgtatggaattcctaatcaaagacatttaaaggattcagtttcaaataataatttcataaaaagaaatgttcttgagcaggaacaccttttcctagaacatggctgtctggcagccaatcatgattatactaaaagattagctgccgtcagtagatattttaatcaaatcttaataattgtttaataacatttggagatgtgtctttctgttctgattacatatctagttataattacaaaacatgcatgagattttaacaattgattttctgaatataaccattctacactgaggaatgcattattatatcaaaactaaaaaccaagccagggttttttttactgacttctacttccattatttccatcaaaggtatgcactttactatcattaagtctaaaaatcatagcaacaaagtgcatactaacctttcaaaacagtatgtcttgaattaggcttggagtttagtgcttattttctgaggttaaaatgtacttactatttgaaatagaaaataaagagtgttgtacagctaatagcatattaataagtttcaaaattgttgactagatttataaaagagaagaacaagactgaagtctggataattgtagaatggtaatgggaaggctctgcatgggcatgtctttgtgttacagactcctacatttaagtcacactagaataattagtatctcttttctgctccatttgtgtggatggttttagtctagcaactctccaacttggcaaatcttttttgactgccttttcttttttatttattttttcttttcaagtcacattttcccttccagtcttggttcagagattacgtactagcaaacgtaacctgttggaccagatcccatttttctcagtcagttatgttatgatgtctgcagcacaagcctgaaagggaagaaaatgagttaagtgtttaaaaagctatctacattgtgatcgtttaattatagcaaaacccacaataaaagcaaaacagacaaattgttaacgtttggtttgttcattcataaagagtcagactatttaagcttattatacatagagaaggttattgatattctgccgactttcagagatcaactttctaatgttttgcttctttgtgttcacttgtgatttcctgaggatcttagctttgttttctcagtgaggtcaagagcatgtgtctatattaaagaatattacacaggaagttatttacttgaggtaagacacttgggttttctattgctttcagtcttttgtttccacatcatgttgctacttgctttggcccaatgacaatgatgacatggaagaaagtcttcctgtaggtctgggcagtgggagggttttaaatatgcacaatgttattcctcctcagtcttcccgcttctccatatgatgcgtagatgcgtagcgaacagacagaaaagtctaataggtgaatgctggctcgtgcataactgcatagtttgttttttataaagttttgtctttgcttatatacagttttttctttatatatttgtttattgtttaatttcacaatacagtaaaattgggtatacaatgggtaaagaattctgagtgggtcataggtgatgagaatgggggagcaggtcttttcactcctcccttctgtttaattatcccatcaaaaatttccattgcatcagtacacatctgttattactactattattactatacaataattattttatgtagaaatgtacatattttctctgtgtgataatcagatttgaatacatttatcattgaaaaacactaaagaatgcttcatcaaatctttagcactcagatttgcttcatgcactttatgatgttttttgcttttgttaattaaagcgatccaggttcaagcttacatggttactctttgtagcattgtcaagaaaactcagagcttctatttttcttctcatttcccttctcttgagttgaaaacagtagaacgattaagtccattattcactagcatttatgactatttaggtcccaacgtgaagctctaatcatttccatgtggtttattctagacaggaatccctttccttacatttctaatgccaagggtgtctcttatgcaccagacagaagtacaagggataacattttctacttctgtacttgccaaatgttgagaaattacttaacagttggaaattctctccccatccccctccctctccccgtcgtccttcttcctttccctctctctctttctctcaatctcattttattttgcagtgctggggactgaatgcaaggcctcatgtgtatttggcaagtgttttttgactgaactaggtataaaaagaatcacctccaagaatatatagtaacaaatctcattgttttctaagatgtggagtttttatgggtaaaacatctatactgtctttctatgtcatagtgggcatgcccaacttatataggaaataacaggactggagttggttggccaaatgtgagtttgttaccaccttcacattatactcataatgtcaataaacattttcatttttaatttaacatatgaataaggttatttggaatgtttattctgttaaaataagtttacatttctaaaagctttatggaaagacattgccaaatacctggatacagataaatgccaaaaaagcctatttccttttttagtagaggacacatatacctaaaactgagttgttttcttgttgtttgtttttgtttttgtttttaatttagtggttttatttattaactttacattcctatcacagcccccctacatccagtccccctcttacaaatcctttccctcccattatcccctctccttctcctcatagaaggggaggccccacccaaggacatctactactagacaggaccacgcacatcctctcctgctgaagcctaaccaggtagggggagggaatccaatggcaggcacagagtcagagacagcccttggtccagttgttacccgcctgaagaccaagctgtatatctggtataaatgtgtaggtgtcctaggtacagctcctgcttgctctttggttggtagattattctctataagcccccatgtaggtcttcttgtggtgttcttgacagttccctctggcttactcaattctatcccccactcttcaacaaagtacctcaagttttgctgggatctctgcatttgttctaatagtatgttctggagaaattcttcttcttcatgaaataggccactcaaactcttctaatttgctgcattttagaatttgataaatgatgtttgtggagtacgtgtgaatgttatcatttgggccccctttacattgtcttggattttcattgctgcccttgttactgtttctgttgctgctgtacaaaattgcaagctgtgttgtgcagttgttggtattctgctcttccagcttggatgtcagatcaaaggacatagcatcagtgttgcaggagtatgtgtttaagtttgtaccaaaagtggatcatcatgcagtcagtttatctgtaggatgaccatagtgatcaacttctctgtgatctgcctattgtaaataaagctaacaaaatactttaataaatcaggaacaatgtagtgagaaggatgcgaatgcctactggcacacaccaggcacttacatggttggatagacttaaacaatatcattcaactttatgtaatgagagaatttgagatttatgatattctggcattttctggttgttgaaatggacaacctttaaaattaccagaggagtaaaagcaaacactaaaggcagaaataggggttatatgaactaacttgactgaataagccagagtttttcaaaccccttccaagtgtaaacaaagtaacttcccttgtgagtcggattgttatgtaattctgaataacatcacatgtcctttctctaagttctttgatgttttgtttcaaatatgtgggtcagaagtaaagctgctttaagaatattcatacagagtcaacaagaatatcaacaagatggtactcaattatcattttataaactcattgtagtgagctacgatcaaggagaaaaatgccacccaactatctttagtctatctttaaatagacattctgatacttggtacgtgagtattgtactttctttagttagggtgagttcaacagtggaatttagagttttgtggaaaaggaatcttgggtgggaatgattggctaggtcagtagaagtattgcatgatgaagtttcgagtgaaagacaaagtttagaacaagttgagagtaggcagaacattattcattagcctgaacttgtggtctggatcacactcaatgaaatgcttagtggagaagatgaaagagaaataattttagagttcacattcattgggttttatatggccacaggcatagcatattaaaaattcttactgagcatgcagcattctactggccctagtgtgtgggaggaaggaaccaaaatgaaagcttactcagtcaaaactatttaatcttatggagataaatgaatggctaataaaattatagtaaactaatggaataatacatagttatcaagatgatatttggatttaggcaatattcgtatactaaaatgtgactataagatgatagtaactaataaagcagaaaatactgatgtttaaaatgtgcacttatgctgattaaaattgaaatagaatttctgatgaattttcacatttatagacaaagggaattttttcctataaagatgctttaagtttataataaaaaatagcctatctcagacttgaggtgatttctcagaagttaagtgaaatggtcagggttctagaggacattagctcaattatcagcatccacatggtagctcacagtcatctggaattatgcctgttctaagggaggattttatgccatcttctgaccttagcctccattatgcacctagtatacagacatacatgcagacaaaacactcatatacattaaaaattaaaatgaaaaactaactgatccggctaattgaaagtaagtagccttattcaaatatgttacaaatggaactcctggtgaataacacaagaaaattggatttaatattcaagtttcatagtgcaggactctaaagatagatgagtgggagaaggatgagattaattctacagaagaataggaggttgagatcaagtctcttaaacccaagtagaatcagaatgggctggaaaaaggcaggaggaccatcataggaaaggacctgtcttctaaaaggtttttgacagagactgacaaatacaggtgtaaatgcttgtggccaaccttcagactgagtatggggtccccagtggaggagttagagaaaggactgaaggagctgaaggggtctgaagccccataggaggaacagcaatatgaaccaaccagacctccagagctcccagggactaaaccaccaaccaaagaatacaaatggagggacccatggctgaagccgcatatgtagcagaggatggccttgtcaggcatcaatgggaagagaggcccttggtgctatgagggctcagtttcccagtgtaggggaatgccaggacaaggaagtgggagtgggtgggtgggtggggagtactctcatataaggggggaaggggatgggatgggggttctggaggggaaactgggaaagggcttgcatttgaaatgtaaatacttaaactatcaaataaaaaaaggaaaggtcatattggcagtgaatagagatagcaaggtgtgtggtgtatgtgcctaggagaagtgttgtattcattattagtttcacattgttttaataaaatacccgagaataccactataagaaatggtttattttagttcagttcggggacatagtctgtcatggtggggaaattatagtgccaagttcttgagttatctgtttgcattgcattttcagtccagaaggagagagaaaatgctattactcagctagctttctcctttatattcagtctagggacccagcacagaattgtgcttcctgtgtttagggtgagcctttatttctatttcatttaatgcagtctagaaactaccacacagataggaccagagtgttgtttcaatagtgactctcaatctcaagttcacatcaacagaaaccattccaggtgcatggctaggtcatggattggtacaacaagttaagtcaccccagatcatagagtggtaaagatcttacttttcatgggtatattgtcaaatgattgtatagaatagctagataggcaaaaatcaaatctgaaatgattttcatgtgggcaaccagaatttgacatggaagtttaactctaagaagacaagtagaattagtttccttttacgctttatcaacgttttatttgaaaatattacatacctacataacaattaaaagagccacacaatggccacacaatcctcacctatatcactgtctgctaagaggacatttttaaatgaattgagactaaataatgttaaaatctgtttctatgactgttgagataattttcttttcttttctactttgttgtattaataaagtgagttgtagtgaatatttcaaacagtaagttgatctgcttcaagataataatagttaggaccaacctcgaagacatccttcatcaagatgtaccattcatctgaaatttcacaaaatattttgctacttcttgcctagttttgctcaatattcatctactttattcatgactataatgtcttgttacttttttgtagtattgccttcattagattgtataaggatgaaatttgcttcatcaaatgacttgggaaaacttctgctttcatatatatatatatatatacttttatttatttattacagttcagtcattcagtatccccctctcagtttctcatcccatttggcctccccatgtctccaagaggatgtccccaccactctcctgggcctcaagtctcttgagggttaggtgcatcttctatcactgaagccagagcaggcagtcctctgctgtatatgtgtcaggggcgtagtaccagctagtgtatgctatctgattggtggctcagtgtctgagagatctcaggagtccaggttaggaagatcagcagtctcaacttctgctttctttttctctctttctttttttctttttctttcttccttccttccttccttccttccttccttccttccttccttcctttctttctttctttctttctttctttctttctttctttctttctttcttttcttttcctttcccatacaggggttctctgtatagccctggctgtcctggaactcactttgtagaccaggctggcctcaaactcagaaatctgcctgcctctgcctcccaagtgctgggattaaaggcaacttctgctttcttaaatggcattttcatcttcaaattattaatagtaataaccccagcaattacttggacttagaattgtttctttgacattgaaagcttgatgctgtgattttaaaaattggatctaggactatatatttctcttcttttttaaagtcagatttggtattttgtggattttgacgggatttacctatttcaagtaaccttttaatttattggcagggaagtatacacgttatatagttgtctcctaaaacatctattgttccttatgatgaaaatttaaaaaatcctttcttctagtttctgaaacacacagtattttattaatatgttgttttttaaaaattttctaatttaagtacattctgtatatggtggagaaaatataataactatctcaagtatctgatgttcactgaattttactttttgttctattttatgaacctattctggatagttttatgtcaacttgacacaagctaaagtcaactgcgaggagggaacctcaatgaagaaaatgcctccataaaattggacgataaggcattttcttaattactgattgatggggaagggcatagcccattttgggtggtacctcctctgggttagtggtataagaaaacaagctgaacagccatgaggagcaagctactaagcagcacccttccacggtttctgcatctgctcctgaattccggttcccacactgtgttcatgtgctaacttccttcaatgatggactctaatgtagaagtataagccaaattaaacattttctcccagagttgattttggtcatggtgtttcagcatagcaacagtaaccctaactatgacaaactctattggtgaacactgaatatgaatagttaatttttgctacatattattcagtacttatcaatgaagtcaaggtaattgataccagttcttgtatcttctatacaatttctggctttgtgttactcatgaaataaattagatgatttttttattaatatgtctaattataattgtggatttgtcttattattccactatgtttgacagtaatagcctcataaattttgaagctcttgtcagttacataaatttaaaattatctttgcaaggagtaaccttcttttcttaaaagttttctctttgtctatgctagatgttgtaagtttattgttttcttgatatgtcaatcctttattattagcatttgcagttttaaatgagaagtatgtttttgttaactacatataactgagtgttgctttatatattcagcctgatttttttctctttacatagggaatgcagttcatttaccatgcatatctttttttattagatattttcttcatttacatttcaaatgccatcaccttttctagtttcctctctgaaagtcccctataccttcccctcagcctgctccccaactcacccactcccgcttcctggccctggcattcccctgtactggggcatataatcttcgcaagaccaagggccatcctcgcctacaaatgcaactagagacaaaagctctgggtggggggtggtactggttagttcatattgttgttcctcctatagggttgcagaacccttcagctccttgggtactttcttcagctctttattgggggccctgtgttccatacaatagatgactgtgagcatccacttctgtatttgacaggcactgacatagcctcacaatagagagctatatcagggtcctgtcagcaaaaccttgctggcagcatatcatctttctgtttttggaacgctgtctattctattgtcatgtattttgcatttgtttcttctcatttttcccattgttgttgttcactcatttctcacttgtgattcagtttttgctaaatgaataatttttgacattccattttgtgtcatgtctagcgacttactttgtaactgtaacttttttttatggttagttgttgcttagaggtggaggtctcaaattatggcccatggacccatacaaacctctctgcacagcagtttttgtaaataaagttgtattgggaaacagtgacatttaatttgtgtatattatagatgagtgttttgtgctctagcgtcagagaagaatactttctataagcaaactattggccacaaagcctcaactacttttttttaggctcagactcaagtgctctagtgcatcaattttacagtgtccatccagaatctacaatctgccattctatgcttcacccaggaaccacaatatacttgatactaaattctttctgtttatccctgcatgcttatacttgttatatccctgttgtaatccaactttcttagacttgttacttctcagttcacaagtataaaaacctttccacggcacagattatggttagccaactacttgtcttttgtgttttcatcataatgtcttctacattcattatgaaaaggtcttatactttcattatttttataggtacttaagagagttagccaatatagtttttatattttgttcatgtgtttactatagcttgagctctattttattcctgataatatcaaatattttggtaacccccttttttccttagattataaaataatctttttactgttttgcagagcacggatatgctagaaaaattgctttcttatgtaaaatatctttatattttcttaaaatttgagaatttttttgccctgaatatagagtgcagaactgacaacttcactagtctatggtgccaatgcattaattcttcttcttcttcttttttttttttttttttttttttgctttgggaattttcttttttttaaattaggtattttcctcatttacatttcctaatgctatcccaaaatcccccatacccacccccccaactctccacccactccccctttttggccctggcgttcccctgtactggggcatataaagtttgcaagtccaatgggcctctctttccaatgatggccaactaggccatcttttgatacatatgcagctagagacaagagctccggggtactggttagttcatattgttgttccacctatagggtcaatgcattaatttaaatgagaaaccaatggccaatcttattttttctccttctgtgtgtggcatatatttttctctgtttgtttttggtaatttgtctttggttttttagagcattgtcattccagattttgttacaatctctgtacctatcatgcttagagatagactaggtaagactcttgaatcttttccttcaagattcttaacatatttgaaaatgataacttttttttctttttctgtatcaaacacagcatgcttgtaattcttactatgtctttgtttggctaatgtatgatgttcttcgttgattttgtttgctaacttatcaaactccaaatgagaagttttcctgttaccctcattgtctgagcactcacttgcttatcatcataaagaagatataggataaaaatagaaatcaaaagcaaaagaaaccttagaaaccacatgaatatttaaagattgagtataacactttcgcataaatattatttcattgaaggcctccttgtagaagaaaatttaaagctcctagaaaaaaaaatgaaaatgttagcacaacttatcaggccctatgttggctacatgtttccacataaaaacagactaaggttttcacaaagatgagaaaaatctacactacaaaaaggagagtccaataaatagcgatggtgtgctggcaaaactctatatccacatgcaggataatgaaattatagccacatctcttatcttgcccaaaattggctcaaaattagatcaaagaccttaatttaaaacttgaaatgctgaaatcattggagaagccagggaagatccttcaagatacaggaataagcaatgggtagaaacccaaagagcatgactccaataccataggaagcaacctgcagaattcccacatgagattgcacaaaatcaggatgctcctacacagaaagggagagtattatcagtacaagcatatatctcacagaatcagagataaatctttacatgctatacttcagacaggtgactaatatctaatatatacaaagagctgcaaaaataaacatagaagaaacacaaatggttattgtactggctagttttgtgtcaacttgacacagctggagttatcacagaaaaaggagcttcagttgaggaaatgcctccatgagatccaactgtaaggcattttctcaattagtgatcaagggggaaatgccccttgtgggtgggaccatctctgggctggtagtcttggttctataagagagcaggctgagcaagccaggagaagcaagccagtaaggaacatcactccatgacctctgcatcagcttctgctttctgacctgcttaagttccagtcctgacttccttggtgatgaacagcagtatggaagtgtaagctgaataaaccctttcatccccaacttgcttcttggtcatgatgtttgtgtaggaatagaaaccctgactaagacagttaccaaatgctttatctgttaactttcaagaacatggcaattaacattgctttgaaagtccgtcctattctgttctccatgtctgtcaagatacacatactggcaaagatatgggtaaggggcaatccttatttactgcttgtgggagaacaaagtgtgcagacactatggaaatcagaatagaggttttgcagaaaactaacaatagaactaccctcaaccctacgtatattttctggctataatcaaaggctcatgtcctactacagagacacttgggcatcctggtttgttgctagtctattcacaggaataagagaaatgtatcaacctagatccccatagtagatgcaaatactgaaaatgtggtaaatatacacaataggtttaattcagctacaaaggaaaatgaaatttgcaataaatttaatggatctggaaattattatgtgagccaaggcaaacttagaaagatgaacaccacatgtgatattgtctttttaaaaaaaatttactgaagttatcacattacttatgaggaacatgatccttggatttgatgaactttacaagtgtgtctttgtacatgtgtgtgtatgtgagagagagggggggagggagggagggagagagagagagaagagagagagagaggaaatctatgtaacgaaaatccattccttttagttatacccaaagaacagtgtatcagtgagcattaagttcattactttggttgttgtagaatatcagtaatatgcaatatgattgatacattaaagtcctctatgacactggttcttttaaattagaaatgtgtagagatttatactaatgaagatacttcattagtttaaaagctgaaaagtctgcaaacaatttatgtgtgaattctccctagttctgtgtcatcgtctgcatacagaaattagaatgcttgctatcaccttggattaatttctatccacaacactgaaaaatgacagaacaattaagaatgattacaccttcttaatgttgatttgggacttatcccatacacaagaatagctaagaactatagtagatgggctcctcctttcccttgcttcgaaatgaaaggatattgtatttgctggaaaggaattttgaattcctgttatttctgctagggtgcctttccatcataacccgactcatgtaggcatgacaggggaaagtgcatcccttgggactctacaggtgtaatttgcactaaacgaaatacgtgcctgcaaagcacactcgtaatgcttactgtagatttttttcctcagtggaaagctgatacccagagatttcttaaaatattcagggtacattccaatccatcagagagatattgaatatgtagcttacctttttcatattctaattaatgtcccatttttgcttccatatatttatttaaaaccatcacagtgaagcagaatgttttatgaggatggcaaagactttcctcctgtgatagaaatgctttgacattcaatgaccttcccccaggcaaagaagagtcagcactacttctctctgcctgtgtgacttaggagaactgtatcttaagtgagcactccctaaatggctacagacaagaaacatatggtttttcagagattctcattaatcccttgagatgaatgacatgttcttggcattggttctttgtgagggaaataagatagtggttggtggttgtacaaaactaaattctgctaagggataacatagatagatacaggatgtttattaatgcaccaaatatgcaagcagagtgtgtcacaagtcttttctgggtaccttggtgtaaaatggacaaaggcatactctttgctctcaaagaactcagtaaatcacagaggaagggagacactaatatgaatcatatgttactatatgtcaggcactttgctaaaacacatggctcttcataaaaagaagtcactaatctagccagtgctacacttgtcgatttgcatagctccagagaaagaagctttgcatggttgaataatttgaccacttttctccagctaggaggtgatagagccagatttcaacctaggtttatttggctgcagcatcttgccattatatactctgccatgctgtacttttgtgtgcacatcactgcactcattttccagttgagatatttaaagggcaagttcatctgaggtctccagctattcagacaaatccagacctcaaatcactgtctgacttccatgttcaggcttttgtccttaaagtatggctatgtcttttaaaaggtgtgaaatagtatgagtcatgggagaggcacagttacagttctggtaaatattttctttctgtcttgaggtcagagttatcagggaaggcttcttgtaagagatgccatttgataacaattgtgaaaggctaagctgagaatagagatggggagcagtattcctagatgagatctgtagcactaagtgtgaagtgtgtaaagtgatcactatttttgagtagtaagcagcttggatagtgtaaacctaagtaattagaaaacatatttgcacagaaacaagcagttagacatacggtgtttcaaatacatctcctgtttttaaaatatagaaaatatattgagaatctaagaaggaagtgtaggctgtggtgcaccagttgagagagtaggaggcaaggttgctgtgactttcaagtcctgggctagagattctgttcaaatgttttccattagctataagaggaagggccaatcacagcttcattttcaattctaaaagtataattttgaataaaagaaattactgagtaagtcatttctgtcaattataaattgaagcttacttttctgttttcttcagtgttcagctgagtggaacgaatgattttcaaaaggaatttatttctggtcttcgaattaccagcaggtggcagtgtgacacattccttctatagaagtaaagtagcattttttttttccccatgcatgcctagctatctccagggcctgaaattagaactgtttttcttgtcacctgggtgtgattggtctaatatttacacatacatcttaagttccagaccctctataatgtgctagtttctgatcactccttgctcagggtctctctcactggatctttctattttcaagaagaatgcaaagctcaagttaactttccaagcggttttccccagttaggaattcaaagtgtcaagaagcaggagtgagtgggtagggaagcagggtggggggagggtatagggaactttcgggataacattagcaatttgaaatgtatataaagaaaatatctaataaaagaaaaggaattcaaagtgtaaaggcacagaaaggctgtaaggtgaagagtttgcatttggcagtcctccacctcagccactctgcttttaaagtgcttgcttccttaccagcatctatttctcactaaagtttgagtagtatcccaaaatgttcacaattgccttgatctttactcagaacattcttgctcagttcatctttaaaacagtccagggtgataggtgaggacatagatcaacctagggctattagatccatttcttcctaactgttcgtattgcagtcctaccgggtgctaggagtgtatgatctgaagcacattgcaattctccattcctctccatccttgccactgccttcatatcgtttccatcctgaacactgcatatgactctaacctgaagccttcatctttcagctactcctctgttacctcccgtcattgataatatgtgtaggtggagttttaatttatacatgttatgcaatatataaaaatttatctagtaatctaatatgtgtggatcaactaatgcttgctatagatgttttcctatgaaagagacacccttttggttcactaccacatacagggaaaaaaattcatgtgtcctgtgtggtacatgatctgtggcatgtcaggtccttcttggtctattccctaatttatgttccacaacatattaggttaggaactaattttatataaatataaaatatttatgtcatatgtatgtatagatgtaaatacatccccatatatacagatgttcttcaagctattgttgagtcccatcctgataacccatcacatatggaaaatactgtaagtttaaatgaatttcaaagcagcacagtttagtgacattagtatactatggaatattgtatttgtcttagtgtcctgataatgttgctgaccatgaactgcaactgaaattgctcagggtcatgctacatgttagtgtgggaaaagatcaacactcaaaattcaaagtagaccctttgtcaaatgcataatattcttatattgaaaacttttctattagagcagtgtaagttgaagactgtatgtataatccatggtggccctaggagggatcaatcttgtttctgtatatctctcatggatgacatataaatcatccttagttctttgtaattctgaaaacaaaatcttcacttctgagccctgggtattttatcctctgttttgcctcacttgtaaatccatccctactttccctttgtcatcctaaaactgctcatatttaaagacctatttcaagcattgttctctcagggtagttttgtttgaatcttctctacccctcctgctcttacagctagaattagttacctgtcttcctctgtgtttctttcacatttttgtttgtgcttctatgttagagttgatcatattgtgattcagttattggtatatctgtcctttgtattatatctatgaacgtttgtaaggcagaaattgttggtttgaattttctggttgtattaggctgtcctctacatcatagttgattataagtacatattagatggtagaaaaaatgcatgtggattgtcgaaccctagctgacttgaagagcagaaggtttgtggtataaagttattgagcaacctgaatttctaagcatcacacctgatagcttgtaattatggctgagatggctgagtacatgggttttcatatttagatgagaatttaacaatggtaccctgaacatctatcctcatcagcaaaatttcacacacacacacacacacacacacacacacacacacacacacacacacacgttcatctcttgtccatatttctatgtccactttcttttcctggtacataagaatatgaaagctatatggaggggtactcactaaataaaccccagtatctgccaatatcagctctcagcacatatttgtttaaattgtcttctcagccatgggcctttgccccattctttttctaattgttcctttatattctggagtagagcttgtgaatgaagctaaaatgtcatttacctacttgtcctgctacttagtgaatgtcatgaccaggatgctacataaaactattattaacattataacaatttgtcattttgtttgctattatttcttatgagtagggcctctctacttcctgtaagaaagtcttagttcagacccccatgtttagaagcccagggtgtaaaggtgggctccttgcctataaaaacaaagatgaggctggactgcactgtgtcctaaataatcttcctttctcttttccagtgtggttttcagaattattcctcatactttaattttctgaatattaagatcaggcttgccatactctgacctcttactggtgttactcaaagtgacttgtatcatcagacttcttgcatcctcctgtgcacatttcttggtgccctttcgggtgctcacagtgaaggctttgtttgccattttcacattcttaaatatttatgctactttgaatgtccacttgggaaggcaagaaaccaagaattatcttttgcattattttgcataaaattaacatgctgatttttttctacaaacccataggttacagattaatttacataaacctgacattcaggaagctcaacctttaccttgtcaaagaaaatgaaataaatcaggacaatcaaaagtgagtatatttaaagtaccagaaaatgagataggcaatgggtgaaacttcttattgttaattgttaatattcacagaatcttatttttctttgttatttttcttgtggggacagcttgttaggtagttaaggctggtcttgaatttgagatcctcctgccccagtatcctaaatgctgataatctgggcatgaaccaacccactcagctactcacaaaattttagtgtatgaataaaggcatcaaagctattttgtcccaagtgtaagaatcccattgagagcccatcactcaagtgacgatccagggaacagtttccctttcaaaacaaaatgtccactgagctagatgctttaattttggaaagctcttaatggtagggagcaaatctgttcttttacacatttttgctaatggattacatttctgtgttccacaaccagtctaatccgttttaatcagaatttgtagttgatggataaggattaaacgagtccacaaattctctgaaactgattgaaaaactgtttgtaggagcctgtgtgaatatagttacatatctgttactttcctgaaaattgtaaaggtcttctgtgatcctttctggtcatgttctataagccaaatatatgacttatagagttggtaccctgtgcattgaagaaagctagatttagattaccactttcttgttgcagactgttcttactaatttctttacacgtgtgactaatgagtgtttggattgctctattttcaagagaccaacattgccttctgttcagctcctaattctgtttgtgcttccaaacatcttgtctacacaatttacaattaaatgacggtgatctctagttgtttttaatgatttctcttaattttagagattctaattacatcattttctcattccattttctctctgaagaatttctcatatacctctcctagctcctttttcaaatttatggcctcctttttctattaaatgttgttatacgcacgtatggcccttttaaatttcataatttgtgcaaatttctacacttgtggtcatttcaattctatggacaagtagcaaaactgggttttttttttttttttttttttagaaaactataatttgaactttttttcttattccaatttctctcagatgctccccatctctccatctaccaaacttcatggtctctcattatctattaaaaacaaacaaacaataaacctaaagaaaacctcctaaaatcaatacaaacaaaaagcaatgaagacagaaagtgccaaacaaaaacaagaagcacacaaaaactggcatctgtttagtgtgggtcaactactcctgggcatgaggcctgttctggaatgtagctgacatacccagtgtcactccattggagaaaacaattattttctgacccaacacccattgattgcaaacagcttcttggctaaaagtagtctttgtgtcaacctcccttctcagtgctgggatgttgttctaaaccttggcagttcttaaacatactgacccattctcagggaattcaagcgtgcatcattggtcttgttgtgtctggaaatctgctgccttggagtcatctaccacctctgactcctataatctttcaggtaccttttctccattgattccctgagccttgaggggaggtatttggtaaagatatttcatttagaaacaagtgttctaaagtctcccatggtctgcacactgtccagttatgagtctctgtgttaattgtcatctactgcaagagatgattggggctgagtgaagctctgctcccgttttaaggttcctctagtttcttgtctgtcctgtgtcaaagagttgcaactgagaatccttacccattattttatttttataacttacccattttatctatataatgtttcaaacttagaaaccaatttaagcacaatggctaggttgcctctaacttaagaaaattatgaaatttcattaataccaacagagttcttatcttttactttgtgactatctggagtttaaaaaactgtatatccttaaacagaccattcagatgcatctaattcaattttaggaattttatgttatcatgcactgtatgaaggctttaaaattgatctttttctcttttgtcattgatcagactttcccctgatacaaaaatactctcttaataaattcaatatacttaattatatgttaccatattaaataaagtaatttataacatcaaactagaaataaattaatataaaatttcaattgcatagtttagtatgacattttattataatgaagtttgtagcacattaataatgtcattggaagaacataccaagtacagatttctctgaaagtcactaggtaaaactgttgttattcactgatgaccttggatttaggcgtgggaaaatcacaatctcagcagctctgcaatatgtgaggaatgaaaataaactctaggatgaaaggttataaaaactgtaattatggtatcttggaacagagagctctaatgatgacttgaaagagatgagacatttttgattaggaagagttgtctgttttcagttagaaatggatgacttaagattaagggtgacatttgcttttaagagaatcatgtcttgcgttggttagagattctcttacctagggcaagatgcttaaccacacgatatcttgagtttacttcaatttctaagtttctacccttgggcaaaaaaatttgtatctctgatatgccagtgctgacatgggctttttgctgatttgtctttcatcttggaattttcaacttcattcttaattatgtataggacatatgtccctcttggggaagaatacagatggaaggaaagaactcttgtgttgtgtggccagaatggccaccattaaatatctaaatggacattgtccctgtcatctttgcatcagaaaggtttcatacttatttcaattttgtttacatgtctcaaaatatttttacatactttgtatatgaattgccttcagatttcatgttgtgatctaaatagtttgttttactcaaatgttgagaatgatacaataaaatagccaaaatatgtctacatttacaccttagtatgcagatcagtgtggtaatatattttgactaaaacatgctatatgtttaaaacaagggaagtttactttgttgtaacttatcatgatgacacaattatgaaattttaaattgtgtgtgtttatatgtgtataatagaacaatggtgaatatatgcctaatataagtgatcaaaggaatatattcaaagtattctccccgttaaagtatctgtatagatcaagttaataaaatataattatatgaccccggaatctctgctctaaacattcttagagatccttttgtcaaaagtttttatttctacgtcaattattttcacagttatgtttcagctgatatagtcctggaagagtgtcaccggacgccttagggaggaaaaaaaataagttgtgtgtactcaatagtatttgttaaataaataaataagtccatgaatgtatttagatgtcttagctttcctgtcagaagttataatgtctcaaagttatcaatatcattgttaataattacataaatgggtgggggagtggatgaaatctctttttgtaattctagcagagttgcatttttttttctagaaatacacatacaagtttgccaagccttctccaatgctctaatggaaagttgtttttgctatttcaaccaaatacaagtacggttgtttcctaattttataattgctaattgccaagcactatatggaaattgtttggctgaaagtacttctctgagggagctggccatgctctcgtaagaggccatttctatagaaaagaaaggatctctttgcataccctgttttcaagtgaagtgtgcttcaatacttgaagcatctctgccaaatcctgccccagtgcacaatcctctacattttcttcctcttgtagctgacctgcactcttagagtacctagcttacacaagaagagctctgttggttaagtgttggtagagtactcacactttgactctaatattaatacctacactatagttaaatcgcattctatatgtgagctcttgtattctttttaaagggaaaagatgatgaagagtttggattcaggttaaatcatcttcatttgtgtgtacacatgcatgtgtgtggcaatggagctcagggtaacttaaaactcactatgtagcccaggctgacttcaaaatctcaataatccccatgtctcagtcttctgagtactgggaatgtaggcatgatctacctgttttccaattgagctttgtaaacttgggttcattggagttgcataggaacaagcacagagatcagaaagataggcagagtgatgaggataatggtttctcccacttacttcataccatagtagctttactttgcttgtatctgctacactttcctaagtttggtttaaagtacaataattgacaaggagaaagtgcatcattgatgtaaattcatcattaaggtaattgaaatgattgtaactactgccttcatggtccaggattttgccttttggtgttgctgattagactgaattgatcatacaacagtgtgatcaatggctgtaagagtttatcttgttggccacctgcctgcatttgctcaggttaacttagcagaatctttacattaaagatgtggggattatgagcatttagtaaaaagacagaagacagattatgtattggttgcttttctatcacttttctaaaacaacttgaccgatgcactttatagaaggaagattttgctttgacttttggttccagaagtataagaatccgtcatggaaaggatacatggctacaaacagcagacgtggaggcagcagcaggaagccaaaagcttccagcttaaacagcaaagcatgaagcagagacatctagtagtaacatgagtctttaacccctcaaagcctgcccccatgacatatctcctcccaagagactatacttccaaatcctcagaaactggaggaccccaacaactagggtctaagtatttaaataccagggcctgtggaggccattctcattcacaccaacacagattgctgtttttttttttttcttgcagagaatgaaagggtgggcaaatagttctgaacaggacagtatggagttcttttaatacaccctccttcttccttccttaggtctaggagtaggctttctgtaaacgatcacttgcctgtatactgagaattaaatttgttcatacaataatgtcattcctagagggaatattttatcattttattatctttcaagtgttaaaacccaaccgatccttaactataggaagcataattagtattcctaataggatgacaggaagtcagacacatagtatgttagagaagggtcagggaaaggagaaatatacattgtggcctgaaatgcagcttatattttcaggttactcactgatttttgatccaaagtgtgataggttctcagtagaaataccagcttcttatttagattttgttattactgtttagcattgacagtgtatagtggtcaatgactagataaagtcaagtagataataaccattcacattccagatttatacatgagggccagatgaacaaggaggaactagtgaattgccctgaggtcacagggtaaattgctaacaggaaccaaggatggagagagcaggagagatttaagaatttcttccatatgtttcatcactgcttctaagaatgtcttctagtaacaaagcctttcactacaccagtgagacaccttgattgaaaatttcagtgaaggttccttcagtaccctaacattttgaatcattagaggagcataatctagcttcaccttatgggggcgatactacaaatgattcaatcttattgcaaagtatttccagataatggaagtacaattgttatgacattgtttatatataagacatcacaagtagagagtttcaacatcgtatcctctcccaaattgctcttcttaatatgatgtatttgccagtagggatgatttatattcagatttcacatagtggtgctccttccacacttcagtttgcttaaaaagctgctgttaacactgtaattggcgccaacacagcttccaccgtcccatttcactcaaggattagcattgttttgcttaaaacatttaaaaccattttaaagtgaggagaatgaggacgaaggaaggatgaacaatgactggttcaaagtcaacgttcaggcttatttgtacaatgaataggaatcaaacaatcctttgccaggtcatggcaagagggaaaggggcattcctttgtcactcagttaacaaaaatgagtaatcttaaaagtctgctgaagccttttagctgtgttccttgtctgtcatggaaactaccatggacagttaagaactttggaattgtttgtgctccattatagtttaatcatggatatattaaatatcttcttactgtatgataagttttacccattaatagccattaatacctgcatcattcatatgtatatatatacatatcagtacatatactaaaaagcaaacagggaaacatctgggctttaaggacatttactgcctttcttagatctgtatgtctaaattcagttatcttcaacagactagggtctccatggaaacttaggtgtccctttcacaactttagtcaatgacctttttggatctctttgcaatgactgtgtcacctagactcagtggctgtatagcatcaaggaacatgactccatgacaccatggattgtctttcatttctacaaaactagtaccacatggatgacactgacaatttctgctatcaggttccagggcttttatcttttttatagcacaaagtttcaaaccatcgaacagaagtcaggtcatgagcttgaagtgggtgatcactggtactcagaacccttctcccttttcattcaaacctgaacctttggccattggttgtatcactcagttaagctgaatcttcccatctcaattaacctaatttagaaaatcctctagagctttatcatcttaggcgatcctggatcttgtgaaactaacaattaataaatgaacagacaattaggagaggccttacttttagaatgtacccatttgagtttaatagtatatgtacaataactatctctgaatctgaagcatattattgagttagtaatgatttttataagatgcagttgtgaactatgtaagaatcactataaaaacctgaagaaaatttgtagaaaggagactaacacggatcttgctctaatgcttgatgctcaaaagacagcagctgccttgttagtgttattatggtttttaactcagaatgtttaattgctaaatacataatgagcatgataggagtcccaagataggttgtacttctgtcatcagaagaaaccttttgtgaattcatgtttgaaatgtagcactggacagtttattttaatttcttttcctttctttctttaactgatcatcacctgcagtcttctttaatgtttaggatattataaaatattgatatcattttatgaaaggctatttacacaaaggaaccaagtttaactcagtatatgtccagatataacccttatttttcacccttggcaaagtagagaacattaaaccataactggaaagcttactaaattttgtttaggatgctaggatatatttcaaaatgttgtaagaaaagagttttaaagcaagtaatttctcaggaaaggcattctatttaagatttgttattttgtgaaggaactggatttttgtcttggtgcttctaaggagaggcaggacatgaataaacaggcagagcctatctcgacaagtttctgttttgctccttgaagaagtttgcactgtatatgaggtatgggttggtgtttgaagctccttgcaaccctttagttctgacgatttctctgtttttctcaagaataatgccctaccagctatcataaaacataatacttggatttttgattaggcaagacagaactgagcgtttgactaaattctctcgacataaaaactaaatgcttggttgaagatgcaactcagtggcatagggtgtgggtaacatacacaagtaccaggattgtcttcctagcattggtttttaaaagtcagatttctgaaggactcattgaaataattgatctttatcaaatctgtaatttagaaagctataacagccacatgctccctcctcaatgttacaaacataataaatagctgctggaaagaggaaactattagagctcactgtaagttgtacagggacctctagggttcagtattactattgtggaatgtctgtttgtttgtttgtttgtttgttttttggttcagctccccttgagtcaaccatgcttttgttagtggtagtttactcttatcctgtaggtcaccagaataaacttaacagttcaccaaccagacttgtaagtcaggcatcagcattctatcaggggtgaatagacatttgcttatacctgctcaggaaaagtcacacaacaaaaaactcagaataaaacatctcaaagtggcatatatttatcaatatgtctgtcctctagagaattggttctatgaccttaaagtacccacatccaaagtcactaccatcatctcttacatcttggctggcttgtttttcttcctatcttcttacaactgcaatgtattttgcagccagagcaatcctcaaagcaaagctgaactgcactactactgtagagaaaacccttgaaaacatctaatcatgctcaagggaaatgttggagtcctgtttagaggggcatgaacttactgcttcctgtctttctgttagagtctgctgccagtctttgctgattcttccttatagggcatattctttttgtctgcaatgttacatcacctgtcttaacactcccactcacctgtcatttctgagcttaaatgccattttatcacagagattgtgattaaccacatgcacaattaggatcacacaagtttcctgggtttaatgaagtaaagggggcgttttttctttaaatagtaggacctcttagggcttttgacaaggatatgtgtactatgaaatgaaataaagacatgaaatgcctgttttcttccttccagttacctaccgcatttgtttcatggctttctttaccatgaaatactccctggagtctcagaaggcacaggttgcttatctattgattctataccctcattacttaatgtattacctgacactttacaaaaggacagcaaaaaattctaatgaaaagtatgaatgtgaatctttgtagttccccccccccattttttttgtagtagggtttgcatagaatgatttagtacttttaagataaatgtcttcctacttcaccacttttaactaactcaaatgaatttcagaggaaaatctaaaattagattcaccagtaattagtaacagttacagattactaagagcaatacctggattttataattataagtaatagacttttaaagatagctaagattttattgactattttaactctctccttttttatatacatccctggctggtctggaactctgtgtaaaccagtttggtcccaaactcatagagatctgcttctctccacttcctgagtgctgggattaaaagcaggtgccatcatgcctgtccgtattttagtacttcatttaacctcctttatattaaatattaatataattctttaaatgtaatccttaggcctttgtgaatacaaaaacattctggtgcaagagctgaaaagatggttctgtgggtcaaaactcttgttgcacttccagaggaccaaagtttagcacccacatggtggctcacaaccatttctaactccagttccaagagatctgccatcctattctgacctctacaagtaccaggcatacaagtggaacacagaaatatatgtaggcaaacacccaaacacacatttaaaaaaaatagtacagagtaaaatgaagaatcaacacattaaacttcaacagttgtctctcaaccatgtccaaaccatttgtaggtgtgaaaatccagtctgaatatgattacagtaggatctgaccttgagagtatgcacagggatcctcaaagaaacatacttactaatgctgagccccacaaaccacaattccagatcatgagtacatggtgtatatgtgttgctaagattcatgtaggtcaatggtattgttatgtgcatttgaaaactcagatccactttgtgtcctgtggaacctattttgattgctgtcagtcatgattacaaattcagttgtgtttgccaggcactggcatagcctcacaagagacagctatatcagggtcctgtcagcaaaatcctgctggcatgtgcattagtgtctgagtttggtggttgtttatgggatggatccctgggtggggtagtcttgtgaggctatgccagtgcctgtcaaatatagaagtggatgctcacagtcatctattggatggaacacagggccaccaatgaaggagctaaagaaagtacccaaggagctaaaggggtctgcaacactataggaggaacaacaatatgaactaaccagtagtcccagagttcctgtctctagctgcatatgtagcagaagatggcctagttggccatcaatggggggagaggcccttgatcttgtgaagatcatatgccccagtacaggggaatgccagggccaggaaacaggagtgggtgggctggggagcggggagagggggaggatataggggacttctggcatagcatttgaaatgaaaatgaagaaaatatctaataaaaaacaaattcaattgtgatctttaaaataaaacaactgagtagatcttggggcaatcaaattatgacttgtggtgtgttaaataaactttgaaactaaatgacatactttgttgctttttggaggacccagtaggagggtgctctacagagtaatctacaaagtcactcactgatagggcaaaggcttcactctcagtttttttgttaagaatcattcctaggctaatgcactgaaagaaaaaaagtgaggacaaagggaaccccaggagaaattacttgtgttggttatctttcaattccattggagtgctacaatattgccagtgaaacttgtgttgagtttctgtgctgtgattctattggaaagttgactttaccaagatatgctaaagactcattaatagattactagccctaacaagaggaagattcaatctaatgagaagagtgagtgcctcattaatggcttggaaattaaacagcctccctctaactaatcaatgctaagtgactgacctttgtctaggctgcagctcattagtagaatacacacagatggtaatgtgctcaaaggtgtttaaaatatttgtggcaagaattgcgtgagtaaggcagacctgtcccaactgtccctggctcactttgctatttctcctgtgctatctgcattaactggaatcatttggttataagaatcaatttgcctgataaaatctacagctttcaaatttgtatataggtaacagattatgataaacattcacaataatttaccttcatgaaaaaagtctataggaagaattgacttggaataatggctttgctttattcagtaactcatttatccaaagataattgcctcaaggaaaaaaatagattccaaacctaatataataaatgcatatttggaattatatttgactattccttatttttctttcttatcaaatgctttcttaaatgtcactagttaataaatgatcctaatatctccaaaggccttacaagtgatactcagttccatcaatatgcttgagtttccctgataacaggcaggggtgacgttagagatgccatgtctctactataaataggacaatgtgtacaaccaccaactgagtagttctactctttgctttaatctatgcatacaatgtatttaaatcagattcagccagacaatccttcaacttctaccatatacccctacagcttcctaattccctgtctttttttttttttcctttttttgacccactgtctaattagtgctgctatgaagggccatctgttggagcacaggaaatctataggaggccacattgctgagaaaactggttttctttccatagcaagccagaaactgccaaaagctccttagctaggtatgagacctcacaagcccctcctatattcacgcttgaatattgactggcttgatcttgtgcagttagccaacgggccattagattcatgagttctgaatttgacataactgtatgaatctagcatggctgtcctctgagaggctctacccagaagctaactcagacagatgcagatacccacagccaaacagtggatggagcttggagacactaatggaagaataggaggaaagattgctgcctgaaggggataggaactccatagcaagaccaacagagtcaactaacctggactcttggggctctcagagtctgaaccaccaaccaaagaatacacatggacagggcctagcccccacccctcatatctagcagatgtgcagcttggtcttcatgcaggtcccccaataacctggagctgggactttcactgactctgctgcctgcctgtgtatcctgttcccttaactgggctgccttgtctggccttagtaggagactatattcctggtcctgtagtgacttgatatgccaggaacagttagtatctggtatgtgtgtgtgtgtgtgtgtggaggggctccctcttctcagagaagaaagggggtggagggaaaggcatgtgagggggaactgtaaggaaggggagctgcaatcaggatgtaaattgaacaattaaataatggaatgcagaaaatttcatgatttcaacagtcctccccaaataaaacatctagaaatcttccttttacagtctttccaccttttcttcctcattgcttcctgatgactagctctgttctcattttcaaatttccaaactagcaataaagccacaaatggttaagtacgagtaatttttaaatcttacaactggctttctttcatttatccaacctgtctcccctaagaggccacttgaagagttttaggagtttaaatatatcatctattaaccttacccacctttaaaatttcttctttaaaaacacaaagccatggaagtaggagaaagactatttcaaaataggaaggaaattagaaaagtgtgtgtgtgtgtgtgtgtgtgtgtgtgtgtgtgtgtgtgagagagagagagagagagagagagagagagagagagagagagagagagagagagagagattgggtgtgtaatagggcataatacatatctgtataaaatgtcataacaaaacctgttattttatataattaattgatgctcctttttctatcctcctctgcaaatatctctggttctggcctatacttccatacctataatgccagcactcaaaagatacatacaacatgcattggagatcagcctagctatatcataagaaaatagattacttaacaaattctggctctgtgatcttcagtgaaagtagctacataaggaattgatttgtatgacttcttttgttttcacgaggatgaaaattctccaagatcaaaacactcactttttgtttgttatttaatatttaatcctatttgctacagtgaccagaatttttgtttgtttgtttgagtaaaatccaggacttacatgagtttaagagagatgctgtcacaattcagtggtccttgatatttgtattggttgaggtcaaaggtagaggaatttaaaagtttataaagcaaagctaaagatgggaagtttgctcatttgtatattatcccaaccacaatgggtagatcttaagaactgctgttggttgatgaaatttggttaggttttggttgatgtaaagctgggagctgaaaatttgacagtgttctataatgagctttgtgtgtatcatttttaggtaagaagggtgctgacttttgtagcacagaagcctagctttttcacaatgcttttcctcgtacccttattaggttttcttctccatcagtctctactagttctacacttagaagtctctgggatttttttaaaactctactcaactggatactcaatatcagtcacaaaagttttgaaaatatgcccatttataccacacagcctgtagccattttgggtaaactcctagggccttagtatatttgtctgttagtatttcactagcatattattaaatgacaggtgacacaaatgtatacaacctctaagtgaatttacagattttagtgacatttctctccattaagttttgagtttaataagacagcagggaccttcatataataaagtggttcatgaattttgtttttcccaggccattttctcttaaaacatcaacaccaaagaagtaatatcatacacacacacacacacacacacacacacacacacacacacacacacaagcatactgattcataagaaaggaattagatttgtcagtgagaattgaaacaagggcactgttactaagcactgtaactattccaaaataagtaagactggatctactgactgtcattttgttttttcagtggcagactgtttggaatcacctatatctgagtgatgatgatgtttcaccaaggagtcataagcatttgtccagacagcaagaaacagatagttagattttctcaagtaccaatgtccctctgttgctggaaaataacaaaatttagttaagcaatggagttcagccagagacacaacaaacgtgaacagtgtgatcttgctttcctgtttgcatattagctgtcaggatagcattaagctgaagcgtatgttttcttagtcctttgctaaggataagtattttgaatgaatagtgcctcagtttcactttcataaagatggaaccaatagtttctttgctaattgacttgacaaaaatactttaggcaataaaaagacagagataggaaatatgtagtccacctagagatagtcattgtgttttgctattaaaacattataagaaaataatatttaattggggatattgcagaatttaatacgaaacacaacaggaatattgtgttttaacaatagaaacatattctttaaataacttttccagactctagaactacttgaaaaattttgtaagaatatacatatgtatattccttttgggaaacttttgggaaaattgaatgtactcatgaaacttcataattgtcaaaagcttagcatgtattttgtttttacccttgtgcatgtggcaggaagcaagaggaacatttggatactaggtttggtagtctttcctacgtattattctttcatatgtaccattgccccaaatattccaacatagaaccccttttttctgtgtcctcaggattattatacaaggtcacattcaagataccagtatgtatttagactatctctagagggtgttacctatgtataggatattacattattatctagcccttattctaaagtcaattgttaaacactagccactatttgcatgttttatgaatgatgggccattttcattgagaagaacttgtagaaagggcctgacacatggtgatcatttgaccacaaaaaagcacacagatgtgtaagttattcttcaactatatttttaagtatcccactttctatgaattcacacaggttatgagaaataccttgtagcagaagaaaattacaattgtcctttgcctgggggaaattttatggctttgattagctataaattttgtttgtttgtttgttttgttttgttttgtattttgagacagggtttctttgtacagccttggctgtcctagaactcactctgtagactaggctgccctcgaactcagaaattccccagcctctgcctcccaagtgctgagattacaggtgtgtgccaccacttcctggcgattagctatatctttaactaaaccatgaaacagccatttagtttttagggttgaaatttagacaccttctttctaacttacctctgcctttgctatatagttcccccaatatcaagacagctaccatatgtcctagtaagtggacaaagcttggcttttgtggattgcccatataatacaggcagtaatagctcataactcagagagtctagcaaaccctgccaaatctaaaactgtctttaattctttaatatccccaactgttcttgcactataggtaattgtcttttttttttttttttgccttttttttttgttcgtttgtttgtttggtttttttttttttttgtttgtttgtttgttttgtttttttttgaaacagggtttctctgtatagccctgactgtcctggaactcactctgtagaccaggctggcctcgaactcagaaatctgcctgcctctgcctcctgagtgctgagattaaaggagtgcgccaccatgcccaccatagtatacttgcctttgagtcaaacttcacatgcagtctgctgaaaaggtgcgatgtctatatctgattttataagcctcatgtagccataaccaaaacacacatattcaaggtccatctacatactcataaggaaccagtaagatgtccttgccattcactcctagtttaagagtagacttctggtgctgaagaaatgcctcagcagttaagagcactgactgctcttccaaaggtcctcagttcaagtcccagcaagaacactgtgacttacaaccatttgtaacaggatatgataccttcttctggtgtgtctgaagacaaggtattcacacacataaaataaattaattaatctttaaaaaagagtagacttcatttccaggcattttgcctccttgtactatgattaatgctattaggcgtccagcaaccttgccagcaggaattatagaaggggcaatgaccaccattctatttactggtcctgctggttgatgttaagtcaaatgttctgaggtgaagttgaaatatatattttttcattatgatctattctgtagaacactcaatctattccatggcattatttcctgttgtaaagataagagtattttctaaagtattcttggtttcatggcctcttagtccaggccctcctcaacagcaccatttcatttctgctctgccttagagagccttttgagactatggggaaggttttgaatattcaaaaatgagagggtcaatgaatgtaataaggtcttaataatgaagtaaaatataatatggaactcaagaaataaagaagacaacatgtagatatctttatttcattgtagcgccaggaaggagaaaacgttgagggtgcccacatgttaggttaagtttggtgactatggggtgtcatccattttgtaaactaagtggaagatataattagttttctaaggagaacaggaaaaatagaagaataaagcattacaaaagtactagaatttttaaataaatactacttgtaaattactctcttcaaattaattgtctctttcagcaggagctaaaccacctcccttgaaatgattctatcacacggtgaccacattaaaactgtaaaacatgtatgagtaaacctctctaatgaagttgtcacatcatgaattggcccctttgtaagctgctgttactcaggctctgtgggggctcacagtgtcatctagtaatacatggtatttctctgcctaccacttctgcttttctgcaccatttctgccactcttgaggtatatgtcagatgatgatatatagacttcaagattagcaatgagatgagatttgtgtgtgtgtgtgtgggaggggggaagattagaagtcatgctgatctaatttccttagtgctgattggtgggaaaacactagtgtcttttaattttctagagcttctgagagattttctttattgctatgtgaagttcatcaacctagatataaagcagaaaatataattctttctaatgtctaaattgccctacccagagagatgatctctattcatatatgtcatcagctgagggactagaatctatctttctttctttctttctttcctttctttctttctttctttctttctttctttctttctttctttctttctttctttctttctttcttccttcttcttcttcttcttctttctttctttctttctttctctcttttctttcctactttccttcttccttccttccttccttcccctttccttcctctttctttctttctttctttctttctttctttctttctttcttcccctctctctttcttctttctttctttctttctttctttctttctttctttctttctttctttccttcttccttccttccttccttccttcccctttccttcctttcttcctctttctttctttctttctctctttctttctctctttctttctctctttctttctttctttctttctttctttctttctttctttctttctttctttctctctttctcctctgtcacatctctctttgataaaggatctcgctatgtagcttgggctttcctggaactcactgtctaagcaaggcaggcctcaaacccacagagatccttctgcctctgcctcccaagtgatggtttaaaaggcataggacaagtgccctacaagggaataaaatcttgcaccataacagtgaattaattattcatgtgtggctgactatctatatagccttgtcttggggtttctatacttatgatacaaatgctatgaccaaaagtattggggaggaaagggtttatttcccaacaggaagtaaaggcaggaactgatacagtaactaatgcacaggtcatagatgaaagctgcttactgttattagacgcgttctcacgaccggccaggaagaacaccacagaccagaatcttctgcggcaaagctttatttcttacatcttcaggagccagggtgcaggaagcaagagagcaagaagcaagagagcaagaagcaagagagagagaaaacgaaaccccgtccctcttaaggagcattctccttcgcctcggacgtgtcactccctgattggctgcagcccatcggccgagttgacgtcacggggaaagcagagtacaagtagtcataagatacccttggcacatgcgcagattatttgtttaccacttagaacacaggatgtcagcgccatcttgtaacggcgaatgtgggggcggctcccaacatctccccctatccttttaataagagcaaataggccacccatattaatgagagtggagatagaggtcaaatccccagtgtgtaggtaaaggagccatgtacaggattagctcttaggcttacaggcttttacccagagcaaccctgacctgctcccgtgtcgttttgcctgggggaagggaactaggacactgaaccttcttgaaagatgacatgtctccctagaataggctcatatatgccgcagagcctttccattgcagtgcttagccgtgcaactctctcgggctgctgaagcacactcactctatcccgtgcaatgagtctagcctcatgggatataagagctgagtggccagcgacctattgcctaagcatagataaccatatatcagggggagctccatgttctagtcctgcaagcgcctgggcaataaccaccttgtctctcctagtttaggccttaagcttacagaccaatcaaagaagcaacactaatccacagcaaagtgtatctccaaataatattaatcccacccattttttaaagaaagaaaatgctgaggagatccaattgggtaatcctttggtcagcgacaggtccaagcgcgtggagttgacctgaagtctcaattcccgaaggatctgttcaaattcagccatccaattctgtaacatatactgaaaaagactttttgacaaattagctgccctagtaaatttaacatactgaatggaaataacacacaatcccggaaacttttgttcacatccctgctgagttatttgtcataatacatctagttgtatctggacaagatctatgagttgattaaccagcatgagacctctctgtatcttgacattagctgaggcctgttcatctatgactgtagtcactgaggctgacaaagtgttaatggtgtcagtcatctggacctgtccagacagagccaaggctgtctgaatcaaggctaaacccagttcctagttagtggtaaaaaagcaggagaatacttgagcattatacatcaccgtcattgggagtggaaatgtcgacattatcccccaacgctgctctctctttattattgacgccctggacatcaccaagacgagggacattagtattcccttggtcagtctggatttttcgggtgagtctttctggtacccaaaatgggttgtcttcattctgtgggaaaacacagatagctcccctggatcttatcaagataggatccgggccataccatttattatcaaggacatttttccatttaaccatctcattgggcctatctggctctgaacaatgacgttcagccgcagtatggccatgagcatcaatatttaaaaaattgagtgtaaagagtgccaaagacacagacactcttggtgctcggggtacagtctcctcaaaagttcccctcttctgttttataagataggctttgagggtgcgatgcgcacgctcaacaataccctgtccttgagggttgtacggaagtccagtcaggtgggttacgtccatctgacggcagaactgctggaatttttgagacgtataagctggtccattatcagtcttaaggagtctgggtttctcccaagcactccatgcctcaagacaatgttgaatcacatgtgaggctttttctccggttaacggagaggcaaacatgatgccagaacatgtgtcaatggacacatggagatattgaagttttccaaaggaagaaacatgtgtaacatccatttgccagacctgtagaggtcgaataccgcgtgggttaattcccacatgaggaactggcaagaactcacagcagctttgacattgagtaacaatgtcacgggcttcttttcttgtcaaggagaaacgactgcgtaatgtttcagccgtcacatgaaaattgttatgaaaatttcttgcagcctctaccggggatgatagggcagcagccaccactttagtggccttatctgccaaatcatttcccagagccatggggccaggtaggcctgaatgggctctaacatgagtaatataaacaggagatcttctagataacgaaactaattgtatctgctgaaaaatattggcaactctactggaaggcttaatcactccagccacttctaaaagatttactgcatttaccacataacaggaatctgacacaatattaaggggttctaaaaaggtttttaaaacttctaagaccactaaacattctaccacttgaggtgaattttcattatattgtttggataccactttaccattagccacataggcacctatgccagtttttgatccatcagtatataccacaatcccatttttaagtgggtttcttactgttatttgtggaaacacaacagattgattttgggcaaactgtaagattggatgttttggataatggttatctatttttcctgaaaaggaggtaactaaaactgcccaatcattagatgtggctgccaaggtttgaacctgtgcagcagtataaggtacaattaaaagatatggactttgcccaaagtgggtgattgctgcttttaggcctttaagggcaagctgtgcaattgcatcaggataccaatctattattttagctggggatacgtttggatggatccacaacaatggcccattctgccacaaaactgcagttggcaattgtgctgtcttaaagacacacaaactgaaaggctgcgaatcctcaatacgttgtaattgtgcattctgtaaggctttttccactttttgtaaggcctggttagcagctagagtaagagtcctaggggaggagatatgaggatctccttctaaaatactaaacaaaggccttaactcagcggaaggaatctttaaaaaaggtctaagccaattaatatctcccaacagcttttgaaaatcatttaaggtatggaggtgatctcttcttatctctaccttttggggcacaatcttatctggggacaccacagagcccaagaattgtcctgtatcagaaatttggaccttttctgtggctatctgtaaaccccactgacttaaagttttaagtagaaaaggatatgccttttgtagcatggtaaggtctttatggcacaggaggatgtcatccatgtaaaggagcaaaattaaagaggggaattgttccctcactggcaaaagagcttcttgtacataaagttgacacattgtaggactattggacattccctgtggtaagaccttccattgatacctcttatcaggttccatgtgattaatagaggggatggtaaaggcaaatctgggcctatcccttggacacaaaggtatagaaaagaaacaatctttaatatctataataattaaattccagccacgtggtaaggcggaaagtacagggagacccctctgtactgggccaaataagttcatttgctcattaatggctctgaggtcatggagcagtctccactttcctgactttttcttaattacaaaaattggagtattccaaggtgaggtagagggttcaatatggcctagttttaattgttcctctaccagttgaatcacagcttctagtttttcagaggataggtgccattgaggaacccacactgggtcccctgttttccatggtatgggtcgtgctgccccaatggccgctaaggaaaacccagaccctgtctgtcttggtttccattaggtgagatgggctctatccttccctgttcttgatgtcctaacccttttccttctttataacccatctttgccatgatattttttgctttagctgaataccctcccgatggggcgttttcattggacaaaataaggcccaaatgctgcataatatcccttccccagaggttaaccgggagtgggagcacataaggtatgaatttcccttgctgtccttcagaggattcccacgtcaaggcaacggagcttatagtgggacatgattgatatcctaggccctgtaatgaatgagatgactctgtggtgggccatgctttgggccaccaatgtgtagagattatacttttatctgctccggtatcaaggatgccttcaaactcttttccgttaatcttaaggcggagcttaggtctatcatttaaagatacaaccaaataggcagaatcatttcctgaggagcccattttctttatctcaggtcctgcaaatttctccctggtattatcagggaggagcagcagctgagctatcctatctcctttactaatagaaaaaacgcctttagggcttgagcacaggacctgtatttcaggggaatgttgacaatccataactccagggtggactactaagccctgcaaggtgagtgaacctcggccgagaataaggcccatggttcccgggggcaaggatggtataggctccaccggcaccggctgaatactcatttgaggcattaataggaagtcggaggcggcacgcaggtccacccttgtgggtcttcctgggtcgcctctctgactgcttcctgggtcctgacaaaccggttcccatatctttgagggccctgggaccgagggcccgatgacccgttttttggcacatcagttgattgactatcaggtgggggaaggactctgccctttatatccctcacagagcgacactggtcagctctatgataacccttgccacacttagagcaaagagtgagagtccctccctgtttatctggagctctgcaatctttcttaaaatgcccaggctttccgcaattaaaacatgtcctctgattatttctgctcatggagcggttctgagattggaggatggcggccgctaagcctgcattggtgagaggtcccccaagctctcgacagaccctgagccagtcttgtaagcctttgttctttcttggggctatggccgctcggcactcctttgtggcttgctcatagattagctgttctatcagaggcgcagcttgctctgactctccaaaaatacgctctgctgcctctgtcattctggccacaaaatctgagaaggattcctgaggtccctggattatctttgttaactgcccagtggtttcacctgctcgagagagcgccttccaggccctaatagccgtggaagaaatctgggcataagctccccaatggtagtttgtctgatcagcagaataagctccctgacccgttaacaagtcaaaagtccaatctctctgctctggagtcaaagcagctgcgtttgctcgggcctgcgcttgtgcagcttcgtgccaaagcgctctccattccatatatttgcccatactagggagagcggcttttacaaccgtttgccagtcggcaggagttagtgccatgccagcgagcctgtctaactgcaccaaggtaaaattagcattggttccgtatttacgaaccgactcggcaatttccttaatttgtaagtattctaccggagcgtggacacgcccaccctcggctccttcaaagaccggaaatgcctgttgtattttcctttgttcctctctgggaatgaatgagtctgcgcactgcctctctgcgcactgcctctctgcgcattgctgacgcactacgcagggcggggactccgcatagggcggaccttgaagccgactgccctgaggccaatcagcaaactggccttcgccagccgcttttggcttttttcttgaccaattagctggctggtaatgggctgcttcttcctcccagtctgtttcctcagaggaggattcttcacctgcttcagagctactaagagctggctccccgagcccatccagcgatgagcacaggctccttctcctagagacctccgctaattgatctttcctcttttccctttttcctctttttcttctaatctctctccaggcattcctacctaaccttaacttttcctcgggttcaagacccttggaaaggcctgtatacttattttgtgtaccatattttctctttgctcctactctctctccccgctttacttctgatagcttgtcctgaatttcatctagaatcctccctatcttaaccacttgataacatgtgaaaaggaacaaaagggcttctaacactagaaaaaattcaaggccaaacatattccactttacttctgatagactgtcttgaatttccttagaaagttcaagatcagacttacctcgtaaagctgtactcactggtactctcgttccccagctgaaaagttctgaattcatacagttgaatccttcttaacagtctgctttacgggaacctttattaccgcgacccgcagttctggttctggaatgagggatcttccttgcgccagtcccgagttttttctcgtcccggaattcggcaccaattgttattagacgcgttctcacgaccggccaggaagaacaccacagaccagaatcttctgtggcaaagctttatttcttacatcttcaggagccagggtgcaggaagcaagagagcaagaagcaagagagcaagaagcaagagagagagaaaacgaaaccccgtccctcttaaggagcattctccttcgcctcggacgtgtcactccctgattggctgcagcccatcggccgagttgacgtcacggggaaagcagagtacaagtagtcataagatacccttggcacatgcgcagattatttgtttaccacttagaacacaggatgtcagcgccatcttgtaacggcgaatgtgggggcggctcccaacagcttacaggtgtactctctatggtttatttacactgctatttcacataccccaggaaaatctgcccaaaagaggcgcttctcactaggctctcctacactaataactagttaagaaaatgctttactgactcacctacaagcaaatctcatagaagcattttctcaattgagaaccactcttctcaaatgagtagctgatctcaagttgtcataaaatgaaccaacatggatatgaatgtatataaggctagaatacatcttttagatttacaaaaatagaatattgtcaaataaaggacttgttatggatctaatgagtggaatagccttagaaccatgacattgtgaatcagggagatataacaagatggatgaaataacatttcagaagaagagcattaaattaaatcaacatgtttaaaggctaaccatataaatataattagaggtaaccatatttcagccactgttctcagttgtttatgtgtattaaattatttaatctttacaatatccctatgaagtagaatactgttttggacactaacaaacaagaaattaacttgccaaagcttacagagctaattgacagtagatctaagcttgaaaaccaaacttttatcttggcaacagccttggttgcttacttaactcaatttgctacaacccagtccttgtactggaaatgctgtttgctgaccagagatgggcagttgggactctgtgcccttcattgggatcaccttcatgtatttcaggaagtttgcactgcactaagtttatatactacctctcaaatgtccctcagttgtagtggtctctctcccaaactttcctcacttaaccccttcccccatctccacctgatccttgtattctccccataccccagtccaccaatataaaatttgtcttatcctctcccccatgatgatctaagtgccccacgtagtaccctcctctatacctagcctgtcttggttgctctccacaaagtgatggcaaggccccattgctgaagacagcatcctcacaactcattgaatattgaggtggaatgctggtatctagacagaaacttcattcctacgttgtagtagtgtatttagtatgaccaggtactctccaggatacaaaaagaaaaatgtaaactccaatccagccacaaaaatctttgatttacactctttcctgcctgcaaaatatactaggacaatggtgacccaaagcttgtgagagtaagtaactaatttttggttctagttaagtcccatactatgagatagaacccatacttgatattacctaggtgaccaagaacaaaagaccagatagcccagagacctaggttaaaactaaatattataggtctaaaaaattaacttaataaaatgacatctaaagttattcagatatacttaaacattagtgctttattcaccatcatcagaggcttcctcctgtagcagataggaacaaatacagagacccacagccagacatcacagagaacaagtgattttggaacacacagttttaaatgtaatgtttctatcaaatccctcccctcagaactcagggaaacccatgaaagaggaagcagaaagagtataataaagcagaggggatgaaggacaccaggggcaacaaggtcttctaaatcaactgagcaaagcttatataaaattacagagactgaagaagcaagcacagggtcaacatgggtctgtaccaggtactgtgcatatatgttatagctttcagtttagtgtttttataatactcttgactgtgtgaatgagtgggtcactgagaggaccttttttttgcattctttttttttggttttctttattagatattttcttcatttacatttcaaatgctatcccgagagtcccctataccctccccccgccctgctcccctacccacccactcctgtttcgtggccctggcattcccctgtactggggcatatgatcttcgcaagaccaaggacctctcctcccattgatggcccactaggccatcctctgctacatatgcagctagagacacagctctgagaggtaggtactggttagttcatattgttgttccaggaccttcttgaaggctcttttctttctattggtttgccttgtccaactttgatgtgacatttttttgttttatcttattatattttattttgctatatttggttatttcgtagaagcctgttttttttttttttaatttttttcctgagagacaaaaagggagcagatctggatgggagatgaggtgtggaggaactgggaagaatagagggaggtaaattgtgatcagggtatactgtataagaaaataatctattttaaataaaagggtaaaacatatataaaagtttaaaaaagaaaaccaagcttttaattgtgaaaacaagtgtcatctctcttttaaaaagagggtgactaagggacagatattgaatagcttgtggcactaacctgtaaaagaacccatccattttgtcaaagtattattttgttacatacttcttacccaaagtatcatccccattattctatcttaggacacttatgagatattagatactttccagacttgatgaatctgagtatgtgtgcaatgatttgtataaggcagaaactatttataagttaagttggaaatgaatgggaattcagatagaagaacgcaggaatgttgggagttattttcagcaactttggagatacagaaataagaaatgtcactgtgcattagactgaagttctaaggaactgagttatgtcatcagggaatgaacaacaactagactatctagagagcatcttatgtgctcaatggcagaattgtcattcaatgtctgagttttctagtccttccaggagataagattagaggatagatttggcatatactctgggtgaccttttaacttttctgtcttggaagatcacagatttcattgcttgaagtaaacttgatcgacaaatttccctccagccttcagtcactgtatacaacgacacaattgatttctgaaaccgtgaatggtatggttatggaaatctagatttacagattctagttaataatttgctttatcagaggacacatcctcatatgtttcccttgaacagtaagctcttctaaaacattgaagttagaattcaatttttagcactattaaaaatgtaaatttattgaggatgagtgattatggacaaaacacattgtatgaaaatctcaaaaatgtattaaaaagtcaagaaagaaagagagagaacaaaatgtaaccttgtaagtaggccatgttccagtgggtggcgctacactgatgagtttattagaagcacaaattagactcagtgtaacctaatttggacatgaagttagcaagggagtgaaggggtactagtggatcttggagatatagtgataaatatagtccaaaatatacgtatgtatgaaattctccaagaattaataaattattatataaaaaatgtaatgtagcagaaacttatataagtgagatgcccctgaattaaccgggaccatttgcctgtgtaaaattatctgaaaatttactgaattcaggataaggaagattttggtatatgactgcctttaagatactgaagcagtgctttctggagaacaaactacttttgactttaagcctctttcagttctgcaatttcagattttattcttcatggttcattgagctgaacttgtgacttaaagtggttcactgacctgagatttattgtggttttaggaaggaaacagtgaaataaaaaggcagttttgttatttttgtacaaggcccccggagccacatttcacagaacacacagtgtcaattacctctgtaacttcatatattcatctacccatccacccactcattcatctattcagccagcattgccaacattcactatgctagaatttgggatatggcagtaggcaagatagatatactttcagatactctgaagcatgtggttttgtgggaaatatagtcaggttaggtagtttctagtagagtgtgataatcagctagcctgattgaattctaggctgccatggctgcatggacaggttgtctgttatccaagctagctgcattcatagacacaaattagattagtaccctaatgctacagaagaaattaaccaaacttggtctttaaaatatgcatttattatttctctgtgtatgcaaggtcatgatttagatggatctcatgcttcagggtttcacatgacttgcaatctaagcactagctagcgttgcagtcctgtgaaggtctgactcaagaatgaccattttctaaactcacttttatgattatcagcagcacccagtttcttctggtttgggttgtgaacatcagacatcatttttttttttcctgaggccaccctcaattacaattgtcatagagctttaccataaagcaacttaatgtcttcattaatgtgaacaaatgaaagggaaagtgaatgccataaagatagatatcgtagactttggtaaactaatctagaagctcatcagctttgtcatatactgctccttagaaacaagtcaccacatccagcttcactgaaagagagcagcagcccacctcaagatatgtataccaggaagaggattttaaaaaaattatatattttctttttttacttttcaaatgttttcccctttcctagtttcccctccaaaaatcccctataccctcccctctccccctgctccccaacccacccactccttcttcctggccctggcgtttccctatactggggcatataaccttcacaggaccaagggccttcaggaagaagatctaaagaacacacccacagtgagacatgtactctaataagtccacacctgcaacaacaaagccttacctccaatagtgccactccctggccaaagcatacataaaccttgatactgaacacacatcaacaattgaccatttatataaagtttgccaatccctattttagggcacagtcttcatgtaagcattttctgccatgtttttattctagattgtggaataattaaagtgcaatgttcataggaaggggtgtaatttcaggaaaatgatgaaaaaactgcacatatcagctctgttcatatgccatctgtaaagttagtcatacagccatacctgttgttaagaaaatatgtactttaattaggttgcttagtggtcagagaacattcatggaaagaagaaaatggatactggtgtaccagtattactcttgcttttcagttaaaaagggtaacatggagaacagtaaattgacttctacaagggcacagtttggtaaaaagtgtttgctgacaaaaataattataagtacagcagtacataattgggtgagtagatataacacacacacaaatatagatatttatcttttagcataagatgcataatacaaaaatataattttattttacatgttaactttaataaataaattgaaaataattttaagagatagaaaatatggagcaggggtttgaaattctttatcatagccaagctgtatccattgtacatataaactcacagtagcttcagttccttgaataggcacaagactgaaccaatacacattcagttcttgatggggctgggatctatgggccttgtcccactcaacagagctaatgcttgttcagagctgctggaggagatgaagacactgtctttggccatgcagctgctggtgaattttcatgcttcattggatagcttgaaaccactgtctctggagcagtcctagctaagcccagtgggtcacaaaacaaaaataaaggaaggcataaaagagggatgatccttgttgggaggaagggagtgggaggaggaaaatatggttaataaaggggctactgtgagcattatgcagtttataaacatatgaaaccgtgaaagaagaaattaaatttaaaaacttttttaaaaggagatatagtgtctaggaaataaagaaataaagatatatatatatatgaccattaggataggtaatttttctcccagtggtcatactttctcttcttaaaattggcattctaatactctgacttatcatcacttttctctgtatcctagtttctgcctattcatgtttttcccctcacacatttattctgaccataatttcctcctgactccagttatattgcatgccatttcttgattgatcttttcaatctcatttctcaaggttctctttgttcactgtcttctttccactctgtcattctgctcacatttctaaaaggaagaattgtcattagagtttctgtctactcttgcaacagcttccactgggtcaggagttcctcctgtttgtatcatcagttactgaagcggatacactcatttgatgtaaaagatggctttcagaggctcttccttgaatatgggaatagaggtagacagctgacaggtcataaatgttgcctccttgaaatctaatactgtcctaggacactatgtgactctatttatctgtcataacaaaagcttgtcagtcggctcttgtttgtgaataagccaaatgtcacccagtttgggcattatatgttttcaaaaacacatttttgaaatatgagggttctgctagtgtagttattacctggaagttgcagtttgttgatgagcacaaatctgttgatggctttatctgtgctgagcaataaaaactacacatttcttatttcaaggcattgggtttatagcttctaattccagtatctacttcttcctcttcctgttttctccttggatctcttctccattgtagtcatgaaaagttactgtgcagcagatgctaaattgaacactttatgagcatttatttaatccttatgctgatgctatggaataggtcaagtgttagccttatcccacagttgctgaaagtgaataagggaaattcacccagtaccttcacccacatcacactgtagctggcaaaccccggaggctaaagttgttggcagaatcaggtgtttcctctctgaaagtttacaaaaccattaaagtatcccatgccaaaagttctgtgatagagttgtattctcttttctcttcattaactattatcaataataacccaagagttctgtatttttcagctataagtatctgtggaaaaatagtcaaactaatctattgcaattcaattttccatgttaaacatacttaatgacacattttcttggtgtcattttaacttttaacttttcctatggaatcctgaaggtgcattacctaaataagtgtgatttcagtgatataaagaaatagttattctttactgcacatttcacaatgtcttatttaatgcatatgattgattttgtcagtacatggtattcatacagccacaagtagttactaaagatgagtaaacagtattgtggccagtgatattataatttctgaagtcttgatgtaggcaggtgcttggcataattaagaaaccctaccctagataggattgtgttgtcctttatgtgagtaatattgatttttaacacttacttttaaaaaaaaaacttgaaagatcttacagtaagtctttaatgttatctcagtatgtgactcatgccagaatggccctttctgtgttggcaatggtaatatatatatacacatacatatatgctatgactaacatttggtttataaaatttgaatacacttctatttttttaaatttcattacatccttcctttctatataaattatattgtatcctccttctttaacatctggtttaaaatatatgtcatgagtggacttttaactagttccctttcttactgtgtgtcttgtatccacaattcacagagatattttatttggttcagttttattattttttagtaacgtgtcttaattgatctcatgcatgtgtattttgtcatataatatagattgcattgtctttataaagttgagaagagcctttgcatacagaaggcaagcagtaaatgatgttggcacactgcccttaaacaacacaattaaacatctgttttccataggtcaagacttatgagattaccactgaatgtagattctcttaatcaaaaaaaaaaaatgccaaagagaaggcaaagaaagcacttacaacaaaaacataaataaagtattaattaaaactaaaacactttattacttgactttatgcaggcacaccctggtggtttcaggcttacttggctatcctataattttttgtggataacaatattaaaatatttctatatattgatttcttgacaagaatttattgatattttgatatatttgattactataagatgttgtaatatagctttatagaggtgaaccacccctgttagcagttaggggacatagtggtctgtgactcatgtgtatgtatgagtaggtgtttcctttgtaacattaatcttttctgctgcgactatgatccctgcgtgaatagaaaaaatatatatgtatatgtatatattacacttgtctgaataaggaaaaataaagtcctaaaattgaggcaagggagttatcaagttccatatttgattaaactcaaattattagagggttgagaggcccacattagatataggatagaactattatagaagatcagtgacatttataggtatttgatagaaagattatggagaaatgtgctccagcctctggggttttgaggaaaatatcttgctgctgacgacagttttttttttcccacccctagtcccaagattcatccaaaaaatcatcttaactctattctgattctcagaatgtttccttattctatttgtccctagaaatcagttctgttgcagcacatttttgaaagtatagaatcatttaaattaaagtacctaatgctaccattcaaacatgaaggcataacagtcattgaactgttagtaggaccccagtttatgatatttatctataataaagtgctagactcttttgaccatttgctctcctcaattggttctctttatgagtcaatgcaacccactgccttgttccatcttccatgctcaaggcactttttctactccctctctaccacagaacatgtacccttttatttggggtaacggttttgtatgcagattgggaataatagagttaactgcttctgtgactgtttctctgaccataatgtcatcaaagagttatcttgctgtgtgttacagacaggtagtatcaaatgagctattaatagatattatatgaatgtatgactctgaattgtggcccaatgctaaaacatgtattctattcaatcattagaactaataaatggggagaataactcatttacctgaatatgcacagttattaactactagaactcgggttcaaacccatatgaggcttggccaaccttatggggaagttggaactgatttggtttcattttataacagacttttaccaaactgtcccagatatcaggcaatttactagtgacctaaatgttcagccagaaaaaaaaaaggaagacactcttaatatgaggataaggatagtagagaatttctgtagcatgtgggaagttaaattttgttccaacagtttcttgatctgaccttgtgtctttggtattatattttcttgacgaaagagataggatctccaagtctgggtaaaaagtattcctgtcagggttattgaaatttatgaagtcatgaagtaggtaggcacgtgacattattaaagaactataatgtgagctatcataatggttattttttgttaacttgatataaaatgaagtcatctaggaaaaggacgggtcaactgacaaattgcctccctcagattggcaggtaaagagagttttcttgattgatgattggcatgggagagcctagtacattgcagatgggtcttcctgggcaaatggtcctgagtagtataagaagacaggctgagcaagacactgggagtaagccagtaagcagcattgttccatagcacccatctgcttcagtttctggctctagattcctaccttgagttccttccctgggtttccttcatgacagactacaactgcaagctaaaataaaccctttcatctttaaattgttatcgttattcatcatggtgtttattatagcaaaagaaatcaagttagaatggttaggattggggcagttagctaagtcagcgcctccacataacctatgatgagcatgatgtagcagtgttatgaatgaacaactagtcatatgtaaaaatgctttcctattttgaattttcatgtatactgaaaatggcccctttattgaattctctgattgtgttttagggaaattatactgtgttcaaatgtcctgaagaatattccaaaatcatacaaaacacctaatcaatacaataaataaggagtagaaagttgggagcaaggtaatacaaacagatctatgtctagataaagatgtttaggtaacttcaatgaaatgacattatttaaatacaacatactttaatacatattaagaagttaatatgcattaaacatttattcactaattctaacttaatgaagtaacaatgtaattcccatctctactctctttctttttaatttgcatttgcataaaaatatgtgatctaatagttaattgagtcctctattaaactatgataagatagccctaggtttaaagaaaattattctcaaaaggtgccaggatatttaaatcccgccatgctctaggtaactctgtgaacttactttcctactaggacaaaatgctagcttttatagtttgtgcatacattctatggaacagcaataggcttgatgggagatgccccataacaaggaaaggaaggccataaacacatgaactaggtattattttcagtgtttcatttaattggaaagtacattttgagacatttactacttacttctactcaatatatggtgaagctgagacttagggcaaagggcttggtttagctaacagagatggttaagttcagcaggtaatttaatattgtgccatatggtgtatctataaagccagactcttaagtttcacctttgtctgtatctattttcctattagctgacaaatgttaatgggtttttttgttttgttttattttctacaactattacataaatgggagaactgaaaggaaggaaagactaattttagtcaatattgttggaagtttccattcatggtcagttggcatcattgctctaagccagtggcaaagcagaaactaagaggaagggtgtggcatattgaagattggttctaatactttgaattaatccaggcccccaaagaaagactctgcatgtctaaatactgaaggttcttgtcctcaactggtttttaattgatcaataaagagccctcagagatgctgaattggcttgattttccaccctcctgcttcggggattgctgctgatttccaatagactggttcatctagcctttcagacagatccagttaaaacttcagtcaagccctgagccttctaagcatacacagactgaataacagatgctaaagccagctttcttaagtctaaccagtttttctaattttcctaaccctttctaccctttcaaagaatttttcatcactcttattcagcaggaaatatccatagagagttgtcagcccaattcttcgggtttgggttttgggtttggtcattttgctaattatagataggttgacattttaagggataatttggaaatggtcatacttttgtacaggaaggaaatagataggatggattactaattttattcttgaaaaaaaagcattgtgtagccataatcttacattgacagaaatctttgtaattgatgcaaaattgaagttgttatttcttacattggtacagaagttatatgatatagaattaagggttttattggtataaatatgtatattgatacaaaatttgaaattaatattgttactcttagataggcattgtgcctatgcaactcatttaagaatacaaagctttgacccattccttctaatagctgccattacaaactgcttgggatgattgagtaacacaagataaggaccagatagtaaactcatggttattttgatttaattttaataaaagtgttttcaatttactcaaatagaaatggctaaggttaaggtataacagttcagatatactttacatagatagtcttcaaaaacatcagaaatccacagaatgtgacttttaatgttacttcattattaaagatatttgacagtgtgacatgtctattcctgacagctttccctactacctttcaattaagatattgaacatctttacttccaggcaaagttacttattgtgccaaggtagccactggaaaaaaattgccatattcatctatagacaaataatactgtccagggaaggataaacaatttgggataattgacagtttagttctgacatagtccttcatagttctttctttgtttctagatctgtcagatagttttgggcaggcaggcagaagacagatgctccaaaattataagaagttagggtttctccaggtagtctgctgtctctaaaatttgttttaagttttagacgctatgttttatgcttactatatactcgggtaacatttaattcattctctgatttctgacagggttgaagactatagtctcataagaaaacttaatttttttttagtattgagagataggatatagatttgaaaggatggttttcagatggtaatgcaaggtaaaatcaaaacataattcaagtatagaattataagctctttcattaggataggtggtaaagtactttatctaatttataaatatgatgtactagatgttaattgtatattatactttgtaatttatgtaattgttatggttaggctcaatttatgtgtgggagaagtgcctttttttatttggacagaaaagatgagttgttgggaattggttctgatgctttgaattaatatagcctcccaaactgggaatctgtgtgtccaaacactgacagctcttgtccccatttggtttttaatcgatcaataaagagcccatggccaatggctgtgtgggtagactgaggcaggactttgagatttgcatgggctaggaaccaggagagagtcaagaggcagagattgccatgatggggaagaagaaagagcatacctaaaggtaagaatcagggaaagtagccatgggcaacttccccaattgggactgaggtagcagagatgaaatctagattttaaaagatgcaaatttagaagtgtcagaggggagtgtttgccagtagctgaaggtttaggagtgtccagacattaagatagtcatgggatatgggatatcaaaattaacttgtgtgtgtgtgtgtgtgtgtgtgtctgtctgtctgtctgtctgtctgacaggagctgaagcagttaactaactactggtacaatggcagaggaatgctgctcatgccctggcagccaggaagcaaaatgtttttgctcagactcgtacatttccactttctttacctcttctttgtgtagggttttggagcctaagagattgtgtcacccacatttagcataacaccagcctccagtactattttgctaatcatcatttctgtaagttccctcacaggtatgactataagtatgatttactaatatcctatttgttgctgtgtccagtcaggttaataattaaaataaacccaattaaaatttactggaaaagtagacttcaatagatatacttttgttaccactaatgtttctagctatagactatgcgtatctcaacatttgaatgggcttggattttttcaactcatatttctacactgtcccttactatgcacgatcacgtgattttaccctttattttccaattagacaagtagacctagaaaaataatttaaaatactgggtctgaattaagctgtgggccaggaaacaaaagtgatgtactttaatcatgattcctaaattcaaatccatagtaaaatttgagagtgagggaaggttgattttttgttattgttgattgtttgtttctttgtttcttcatcaatgtttaggggcaatttagggatctttacagaaacaggtaggcaatgtttcacttgaagaagaagaaggatttctggtaaaattaagtattattttaataattcatttttaaattttaatattttaaattttgtttttctttcaagacaggttttctctatgtaacagacctgggtgtctgggaacttgctctgtagactaggctagtcttgatctggcagatcttagagatatgcctgcctctgcctccagagttaaacgcatgtgctaccacatctggcttaaattatcatacactatattttgatgataatcttttccttcatccaactattctcttatcccttctccctacacaatgagcccttatgttctttttctctcttaaaaaacaaaacaaaaacgtacatgccatacacatacacacacatatacacactcacagacaaaccccaagacaaaccccaagtcaatttgttttggccaaatactattggatatcaggtctactctggagtgtagttgatatacatagtttcaatcttttggagaaaattgattgtccctctcccagaagctatttattgcaaataccttcttggttagcaattggtgaattgttcccacatcctccttttacaccctgggaccttggcttgaacttgtacagatcttgtgcctctttagatagtatctatgagttcctatgtatattagcccttgtctagaaaatgttggttctttggagttattcactattcatttctatctcttacagttttctgccttttcttctatatagctgtctaatccatgaaaggaagattgtttatccctttaggactgagtgtctttcactctctacacattttttagttgtgggtatatgtgttaattactatttacagcaataaaaagtttcactgatgaagattgagtaattcactgatcatgggcataacaatatgtcattagaagtcctgatgtttctatagttatttaacagaatactagtaggttttctcttaggaccatgacttatctagtctctagttcatggcctcataaacactgtgagctatggattctagctcatagagtaggtattaataccaataaaaaatggtttgttactcctataatatttctgccacaatggtactagtgggtgtattgtgtaagcaggttgttattgtagcttatagtgttgtaactgggtgagactggttattactttttttatccagtagcgtgtatagtatcttccagtaatatataagctagtcagtaagggagatgcttctaatgaagactagatcaacttcttcatgtttatgacataagtatgtggtatctttagcagtaggatcaactatggaaggtaaccaacaatactggcaatagcctatgatgttttaggtggggagttgtatctatgggatccctttggtcaacaatgcaaaaaatgaaacccatttccatgactggagactttatttggaggcatatgatttagtcgcatagtatataaggggagtattgtctcacccttatataactccatttcaattcatttcatatatttatatatgttatcaagcttctatagtaacaggttttcatttgacttttcaaaaggccttcagtattatttgtctcctgccatacttcttcctttatcctgcccttctgccccactccttattaaatcctcatattctagtttttactttgctgctttatagcattatattcaatttccccttctttggaagattctctcctgcttccccataacttaaaagatatctaacctctgtgaatattctgaattaaaggcatatgtctttattttaaaagctgtcatcctcatataagagaaagcaagtgatgtttggttctctagatctggattacctcactcagggagattttttcctctacttcatcaattttcctgaaatttttcattagttcatttttttcttaacaactaagtaatattatattgtgtaaatgtacatttcattacccactcctcagttgacagatatttaggttatttccaatttctgaatatgaatagagcatcaataagcatgaatgtagaaagatatagagtcctctgtgtatatgcccaagaataatatagctagatcttgtgtcatatcagttttcagtttgttgaggaatgtccataataacttctataattgtgttaccagtttgcattctcatcaataaggaatatgtgttccccattctctacacccttgccagcatttactttcatttgcttttattaattttagccattaaaagtgggataatattaaatctcatatcaccctgagtgaggtaacccagtcataaaagaacacatatggtatgtactcactgataagtgaatattagccaaaaagaagctcaggatacccacaatacaactcacagaccatatgaaactcaagaagaaagaagatcccaccaaagtgcggatgctacagtactactgaatagggggaagaaaatagtctctgggaagtagaaggagagagggatctggggaaggagaaaggagggggagggaaaaggggggcagttcagatatgggaggaaatgggggagaagttccttgctgtatagaaacaactttagcttcatgagattccatttattaatttttgattttggcatctcctatcagggttctggtcaaaaagtccattcttgtgccagtgcattaaaacatatttcctactgtctcctctattaaatttagggcatatgattttataatatagtcttctttccactatacagagtaattgatagggacctgttttcatccttctacacaaaactatccagtctgagcagcactatttattaagatgttatctttaacttcagtacttaattttggcttctttgtaataaaatgggtgtctctctgtgtatggagttatgtcttagtcttcaactctaagtcccttgaccaatgcatctattcttctgttttaatgtgaatgccaagttgttcttattaatatagctctgctgcatcatttgtaatctgggattctgatacctctggcaggttttattattcaggattaattttgaaaccctgtctttttgtgtttgcatatgaagtttaagattattttttcaacttctgtgaagagctatgttgaagttttgaaggagattgtattaaaactgtaaactccattttgataaaatgattttgctcacaatatttatcctactgattcatgagcatagaagatcattctatgtttgcgtagtgtttttcccgtttctgagaatcctttactagtagtatctgtcatgatttttgtttattttgtctttcaggtaaatgtgttttttagcttaatatgtattaaacattccagtgtgaaatttaaaattgatgatcacttgaagcaaactatattttttggtaataggtctcttataaattcatcttgagaaacataaatagttgagaaagtatagggtgcagcagggattaactgagagaaagactgagcaaagatctatagagctatagacttcagcttcagctctgccagtaaccagctgtgtgtccatggacaatgtcacttgattagtctgtgccctgtttcatctgccaaaattagagggatccagctaaagtattttattcataaaagtttattattttatatacataagatgccctatatttatttaattcctcacaattaataatgattggtgcataatatcttattgagtttacctacaatgctatgtggtagctaatactgtattcgttttactgataataccaggactcaagttaaagaaattgtctgtactacttcctgctaggtaagccctttggttcacatctagttgtctttccagacaccacagctttttccacatagtaattacctgcatgtaaataatacttcccgagtgtttgaaaaatcatttgttcccttaagtcctcaaatggctctttcaattgtacttggttgttcatttgctcagcaaactaatttccagatatcaaggctggtgaagttgacttattaggactctcacattcttgaggtcttaattaatgaggcttgcttttattcttatgcagtgagccttgcctttttagtgaagaaaatgcatacacattgctggaagcttatgcagatgatgagggattgtacctttttaccttagctactaatgggatccatgtgttaattgaggtattcctatttcagttagcaacagaacggagagctgcctttgctttaatgtagattcatatatattagtgcaatatgacatcatgaatgaaggaaactacacacatagccatttagagtattttgtattccttttatggtaaatgatttagtacctccaatgacaaattgtcaaatctactggacatttaaacatatgacatatgacaaaacatagtcccttagccacttcattcccttgggtgtgagtcttcaagtgtctctttctctggggcatgacacaccagttatgctttcataatttaacaaactatgagagactttggctgatattactgaacctgtcagatttcactgcttgtaaattcaattagtctgggggaataacagccctagagaatatatcaaaattcaattagtcagcaaattgaagttgttagcctattctttggaataatccatcaaaagtaaaagggtacttgacacctacagtcaactaattaaatgcattaagtcctgatagggacaatttttagtattcaccaccctttaagtctattggccagaaaacctgatatgaaacagttccagcagtgggtgttatatcaataagactatagaatgactaattaatataaggcagatggtgtttctttgcccctttttataatttattaaaagaccctggctctctctatttcacacagtttggtaaccactttaagtatttctgtggtaattttgtaattgctcagtagatgcatctcacttattaaagtgcttttggtcccaaatgaagatatttgcaataactaaatgattagtatcttgattattaaaaaggttgttaatgtgctattggcatttctttttttcttttttttattagatattttcttcatttacatttcaaatgctatcccaaaagttccctataccctccccccaccctgctcccctacccacccactcccacttcttggccctggcattcccctgtactgaggcatttaaagtttgcaagaccaaggagcctctcttcccaatgatggctgactaggccatcttctgatacatatgcaactagagacacgagctctgggggtactggttagttcatattgtttttccacctaaagggttgctgaccccttcagctccttgggtactttttctagctcctccattgggggccctgttttccatcctatagatgactatgagcatccacttctgtatgtgtcaggtactggcatagtctcactcaagacagctatatcagggtcccttcagcaaaatcttgttggtgtattcaatgttgtctgcgtttggtggctgattatgggatagatccctgggtggggtagtctttggatggtccatcctttcattttagctccaaactttgactctgtaactccttccatgagtgttttcttccttattctaaggaggaatgaagtatccacactttggtcttcattcttcttgcttttcttaaatacttgtgtattattttttatttattttatattacatccatttgtgggggaggtgggcacacacatgacacagcatgcttgtggaaactaaaggacagtttttgggtgactgttcttttcttccaccatgtatattacttgtaagggaattatattagtggggaatgactttaccatggactacaaacattatataggtgttttcatataaagattttgttttactcatatttttgacaagacttcttagtggcttactgccattgaacagctgcaagtttccattgtagtttttatgactttgacttaaacagtaaggctgttaaacagtgatttgtttttgtttttgtttttgttgcttctttataattacttagctaacatcctccccatttgagcaactgctttctggtaatttcattccattatttcttgagggacaaattatgcaaagtctcttaattctcagacaaaggccacaacagcatcccatgaaggatgtaggtattcgtggtttttgccactcttgctgttttctgactattatgaagtcaccataccattccgcttttgcttcctcatatgtacattttctgcctacttacttcacactccatgcctctttatgttagcatcccgtcctgtcaccacacagatttttttttttttttatgtttctatttggctgttgttgggtaaccttgttcttgtgtacttgggagcgactcaccctacttttattcttgtttatacagggcagccaagccacatgttttcctcaacatttgtgtaaggccctttgtttcatcacattttttccaggatctatctctgtaataaagtgacttttttttgtattaaaggtcagtaatccataagagagagttagctagagacagcataaaaataaaattcatctattttgtatctacctgaatttgattgtaatagagatcatttttaaggtttgatctgtgggtggtcaatatacttaattataagatacaataacaaatttctcccttcatagccaatcatttgaagcagtggagtaactgagttcagaagtacaaggatatataaaccaaggaaaatggatttctatcatcgaattaaggaattggggaccactaaccttaacaccacaataagtctttgtagagcagtgggtgtgggggaataaagggagtgggagaaaatccacattctgccagagttccagtgttctgggtgggcagacatggaggactgccacaggctttccaagcagccccaggtaggtgtctggccatgggaagccatggactccagcctgtaggggttggacaaggggcagtctgaggtctctgggcctcatggaggtcagagatagcagagtctcaatcttgggcatcccagaagctgcaggacaacatggtagacctgagaacaaagtgggggccctatgggtggctcatccagccttggggctgaagagagagttgagagcagggagagagagggcactgggtggttcccaagtgggcgagagtccttggttcagtctgtggctggagcacagggaggccttctggtgggaggttagatgtggctcttttaggggaaagcctatcccatcattcaagcatggtaggccttgatgagcagagatggtctatggttttaagctttattgtagaaaggcagagagaaagagagaaggtaaaagagagagagagaggccagccatggccatgtggagagagggggaaagggagaaagaaggagggctagagatgagaataagaaaggtgggagcttaagagagagagaggaggtcccaagcagccccttttatagtgggctgggctatcttgaagttgcagggtagctgtggggaggagcatacctggatattgtcaggtaactgtgaggttggagtctagctagaatgccaggagcttgggggtttgtctgtgtgactgatagtcacagaattatggagttgggggggtctgtggtgtcaggcacctgtctctgggaatgtggctcactgttatgtcccttgtagagttttctactgggtctccggagcaagcctcactcaaccaaaacaggctgcctttcacagtcccacaagtcttaattatctactctcagttatctattaccgaatttcaaacttaagttacctttttcttagcctataacacacacctgagttgctttcctgattgatgtgtgcttgggaaatataaaataatttttatattggtctgagaaatttatttgagaagtaatatattcttaagacctcttaaaaattttaggatagatgattggatttgaattatctgttcattcagatgaaaaatatacattagacctacatgttataggaaaagccaatataatggagacttaatagtgcatctcttaaattgcatagattgaataacttcatactggcggtgtaaccacaggcaagttactcattgctcaaaaacatcgttggtgttgcttaggaagtgacttatccatgaggagctaataggaatgtctcatgtagacagatattttgaaattttaagaatgaacagttcaaaataatggcaaatacactaactgtagatttggatgacagagttaagaactatggaggatatatgtaaaattctgagaatgggaggaaaaaaaacatagtatatctcacactttgaagcaaccaaactcccctcatttttcttaaaacaaagattcagttggttatagccaatgggcatacctcctgtgtgttaatatctctcttccctttatctgtggctttctactcacccctttcctattttcattttgtgtgtgttgtctgtggggattgctttatccctttcttgtcaaagtcctatatatcatttgtatttgtctccttttgctctcctcatcactctagctttagcttctgtaatatagaatttaggtatatttaaaatgttggttctaacattaatgactttagtgtatcattgagagaatgctcaacagatagagatactttattgctaatcctaacaacttgactttaatacctggaacctacatgatgaggaagatacatggtgaaaggtctaaatgccctctcacaagttgtcctatgaccttcacacatgcacacgtgcacacacgcacacacacatgcacacatattcattctctctctcacacacacacaatttataaaaaattaaatacctctgtggattattttaattaagaatgaaaacacaatgtacagaatgggagaaaatacttaaaaattatgtatcagaataaaacctagtaatagggagtataaaggagctttattatgcaatgaaacgagaactacaaattttaaaagtgaaaagggctttgaaatggttatgacaaaaagatgaataaattcccaaaagcaacatgaaatatctgatatcaattattctgaaaatataagtcaaattaataatgacattctatttcaaacctgctaatatacctatactaaacaacaaaggtgcaatcattaagcaagtacattgacaaactcaaaccttcatattgcttgtgggaatgttcattgacacagctactttaagtagtttgacagcttcgaaaaaagttaaacataaggctggaattcacttcagtgatagagttttgagaagacaatggattctgtctatagtacagtacacaaataaaccatgaacttaaaattaccatatggcccataatttatattctaaggtatatactcagaaggacagaaaatagactttgataatcacttgtacatacatatacttaacaattattttcaataaccaaaaggtagaacttaaccacattagtgtataagtggataaacaacctatgatatattactctgatggaaaggttttggttataaaaaggtttcaggtgaaccctagaaaggtatacaataagatatagtaaacagatttgcctgaaaaaaatgttaactcattttatagtttggaccaaagagtttgtacaaaggagaaaggttgaaatgtttatttgtaagttttaaaaatggaattaaactaagctagcagtgagagaggcattatatttgttcagaaaaataagtcaacacagactgagtagccttgattccttgaaaataatatgcaccaccaagaattaccaaatactttctgttaaagacctgctagtaaatgtcttctgtgttttggactaaaggctccactataactaattcactctgttgttacagtgtgagagcaaccattgacaatatgtggatgaatgaaccctgctattccataaaactatttacaaacatcagtgactattgttcctacctacaaatgtaaatgttgcttttatttcctcagatgaggggataagaagactgccatatccaaaatgtgaaaatacatggcttgggcttagcccagagcatttctagttatcagtagggctgggcctcctagcttctagcctccttacaatctaatcttctgtaaacccagaccttcaaggcttcagttttcaatctctgtctgctaacctagcctagaatgtttcagagtcaaggacttaccactgaataagctcaccctttctagttctttctgaactctggctggttcaactcagctgttctggttcaaattcctctccaaactaactgattcaatctggcttctctcagcttctcactgaattgctttttttggacttaaactaactagcaattcatcctggcaattttatctcccaactgactcaactcccaacccacggaagaactgaactctctctctctccctgcactgttcttaaattacttttctgtgagcacagtggcatattttatctatgagtcattctgtcacatctttcatttttgttactttgttggcccttcaattagaggccattgtcttggattaaatgtatttactaaagaaggtattaaaggtgtgtactaagggcatgcctacattgtatcagtagcacacagacctagaaggtttttttggacatgatcagagcagccatgttgtcagattaaaattcctctacacccacctgcttaaaacagcatggctactttttgaataagaatggtcaaagacaattttatttttagtgaaaatctgaactgtttcaaagatatgactgtccatgatagttcagcagaaacaaagttaaggtatcaaattacttaccacttcatctcagtattcgtgtaacatcatgatgatgatgatgtatgttctgttttcatatctagccaagggttgctttgaactcctgattctccattcttaagctttggagctcagtgctagaattaaagacatgtgtcactattcccagtctctcgaattttatgtgccaattaagaatagccatgcctgacctaaagctgtactacagagcaattgtgataaaaactgcatggtactggtataacgaaagacaagtagaccaatggaacagaattgaagacccagagatgaactcacacacctatggtcacttgatctttgacaagggagctaaaaccatccagtggaaaaaagacagcattttcaacaaatggtgctggcacaactggcagttatcatgttgaagaatgcgaattgatccattcctatctccttgtactaaggtcaaatctaagtggattaaggaactccacataaaaccagagacactgaaacttatagaggagaaagtagggaaaagcctcgaagatataggtacaggggaaaagttcctgaatagaacagcaatggcttgtgcagtaagattgagaatctataaatgagacctcataaagttgcaaagcttctacaaagcaaaaacactgtcaacaagacaaaaagaccaccaacagattgggaaagtatctttacctatcctaaatcagataggggactaatatccaatatatataaggaactcaagaaggtgggctccagaaaatcaaataaccccattaaaaaatggggctcagagctgaacaaagaattctcacctgaggaataccgaatggcagagaagcacctgaaaaaatgttcaatatccttaatcatcaggaaaatgcaaatcaaaacaaccctgagattccacctcacaccagtcagaatggctaagatcaaaaattcaggtgacagcagatgctggcaaggatgtggagaaagaggaacactcctccactgttggtgggattgcaagcttgtacaaccactctggaaatcagtctggcagttcctcagaaaattgggcatagtaataacagaggatcctgcaatacctctcctgggcatatatccagaagatgtcccaaacagtaagaaggacactaggcaaatggatggacctggagggcatcatcctgagtgaggtaacccaatcacaaaggaactcacacaatatgtactcactgataagtggatattagcccagaaacttaggatacccgagatataagatacaatttgctaaacgcatgaaactcaagaacaacaaagaccaaagtgtggacactttgccccttcttagaattgggaacaaaacacccatggaaggagttacagagacaatgtttggaggtgtgacgaaaggatggactatctagagactgccatatccggggatccatcccataatcagcttccaaatgctgacaccattgcatacacctcacaccagtcagaatggctaagatcaataattcaagtgacagcagatgctggcgaggatgtggagaaagaggaacactcctccattgttggtgggagtgcaggcttgtacaaccactctggaaatcagtctggcggttcctcagaaaactggacatagtactaccggaggatccagcaatacctctcctgggcatatatccagaagatgccccaacaggtaagaaggacacatgctccactatgttcatagcagccttatttataatagccagaagctggaaagaacctagatgcccctcaacagaggaatggatacagaaaatgtggtacatctacacaatggagtactactcagctattaaaaagaatgaatttatgaaattcctagccaaatggatggacccggagggcatcatcctgagtgaggtaacacattcacaaagaaactcacacaatatgtattcactgataagtggatattagccccaaacctaggatacccaagatataagatataatttgctaaacacatgaaactcaaggagaatgaagactgaagtgtggacactatgcccctccttagatttgggaacaaaacacctatggaaggagttacagagacggagtttggagctgagatgaaaggatggaccatgtagagactgccatagccagggatccaccccataatcagcatccaaacgctgacaccattgcatacactagcaagattttattgaaaggacgcagatgtagctgtctcttgtgagactatgccggggcccagcaaacacagaagtggatgctcacagtcagctaatggatggatcatagggctcccaatggaggagctagagaaagtagccaaggagctaaagggatctgcaaccctataggtggaacaacattatgagctaaccagtaccccggagctcttgactctagctgcatatatatcataagatggcctagtcggccatcactggaaagagaggcccattggacttgcaaactttatatgccccagtacaggggaataccagggccaaaaagggggagtgggtgggcaggggagtgggggtgggtggatatgggggacttttggtatagcattggaaatgtaaatgagttaaatacctaataaaaaatggaaaaaaaatgaattaacaagtacccgggagctcttgtctttagctgcatatgtatcaaaagatggcctagtcggccatcactgcaaagagaggcccattggacttgcaaactttatatgccccagtacaggggaacaccaggactaaaaagggggagtgggtgggtaggggatgcgggggtggggatgggggacctttgggatagcattgaaaatgtaaacgaggaaaattcctaattaaaaaaaatgtaaaaaaaaaaagaaacaaatttatattgcctgctttaagacctttaggtaaaaaaataagtggaaatgtatatgatttctagatatttttaaatttgaagttcagtagcaaataagtgtagcttttttgcagctttcattatacccatctatcatgtaacaaagctcgtgttttctaatcctacaactctagtttttctgcctgccatagtctcttgtgcttaattttcaatcagtgcaattttggaatacactcctcccaactagaaaaaaaaaattaaagattgcataccaatataacagagtgaagcagatacacctatatattagtaaaaagttgataatttaacaaatgctgtgacattcagaaatatagatggtaagataaaaaatatgttcagttttgaactttttgtacatagatacaaaattttgtacacagttactcttagaaactcttatatgatataacagctctcaacgaatttaaaaacttcaactctccaatgagaactacacagaaaagagattacaactgcccggggttggtatagtattgttagggtatagacattaagaattttagttttaatggatttataggaaagaggaagtctcaggtctttgtgaagtgtaattatgaaattatggatcccaaagaatagatgaatctttggtcttatagcttttatttgaaaggataaataaagataattaaatcttacccacagagaaatggcaagaaacttgtcttttacttgacatgtacaacgaatcacagacccccatatttgcaatcctaggtttacaattcatttctgtttgggggttaattttctattaccctcaaatttaaaaagatccaatttgaacttctaccccatctttggattcttggcaaaagcaaagtcaaaatggttctgaaagtaaaaaaacagaccgtataagcagtgtttcaatgaggatttccattgttgtgaagagacaccttgaccaaggaaagtcttataaaaaacagcatttgattagggctggcttacagcttcagagattcagtctagtatcctcatggcaggaagcatggtggcatgcaggcagacacagtgctggagaaggagacaagagttctgcatttgatctgaaggcaaacaggagaagactgacttccaggcagttaggaggagggtctcaaagcccacccccaaagtcacacacttcctgcaaaatgaccacatctactctaacaaggccacaactcctaataatgcctctccctggggcaagcatattttacccaccacaagcagacactgaatttaatgctcatatatactttgcgaaaacaaacaaacaaacaaaccaaagccataaactgcaggcattagaaaaatgaaactttagaaagaaaacataaggcttgaaacaataaatgatagtgaaattgacaaatgtatgaagcaagcacagactaaccctaactggtttagtttcacataataaattgattgtggcttgaagattgtacaacattctctttcctataatcctgtagtagtaagatacttaaaagtatgatgttttggggggaatacttagatttcttgctgagacgattagtcaaagtaaatgaattcatctttgatggagccggtctatatcatccatgttatgtactctgtgctctttctgaagctctatggggtccatattttcctcagtccctttcaagtttacatagatttcaaactgaagtttgtcattatgaaatcagaagtaacattaataaataaattagtatatgtcaatgctgctgagaacacagagtaaccgaaattcccatgcagtgtcagtggaaatattcagggcctctgggagaacagttgtcagtctcttataaaaatgaacacattatctttctacaaatggcaaattgtgcatctgatcatttatccaaaagaaatggaaacacaaacttgtatgcaaatgtgcatcaaaggttatttcttatgaccttagattaaagcaacagtttctgtcagcagaaatttctgatgcatgggtgaagcatattgtgctatatttaaatgatgggatacaactcagcaacaagggaaaaagtgaacttttgacaccagctcaaaggaatcacaaggacagtatgtggaaggggagagagggggggggagggggagggagagggagagggagagggagagggagagagagagagagagagagagagagagagagagagagagatattttatatgttctgatttaattcatatgaatatctcagtatgtgtgatgactatcattcattggttgattctacatctggaattagataactaaaactggacggcaaatctatgagagatgtttttgcttaattagaagtgggaagacatattactaatctggatcttcagtaagatctagatctagatcttctgagctgggaaacccacctctagtctgggccacacttgctgaaatccttttgaaggatgtggaagaagaaagcattttctgtgtgcctgcttgcttttgtcttaatagcaagcccccactcctttactggcattagagcctacttcttcaggattccagcctccactgaagaccaactgagacattcattcagccttgtggactagacaactactggattcttgcactttctttttgtagttagctattcttgaagtagctgtatcacagcttgtaattcattgtaataagttatatatgatagataaaaataatatctataataataaatatttattatatatttattttacaatatggaaacacaaaaaacaagtatagctaaaaataagtcctatataataaaacaactgtcagaggtaaaaccatccgtgatcacaaactgtaatataaagctagaataataaaatcatcatggtattggcacaaaaaagacacagcaatcaatggaattgaacacccaaacgtatgtccacacatatatgggcacctaatttttgataaagatgccataaatacacactggagcaaaagacaacattttcaacaaatggtggttgtcaaatgggatggcagcataaggaagaatccaaataaatccatagttatcacactacacagaattcaactccaaatggatcaaagatctcaacataaaaccagatacattggacctaatagaggagaaaataaggaatatctttgaactcgttgtcacagaagactttctgaacagaaagaataccttcaaaataggcactaagattaaccattagtaagtgggacctcatgaaactgaaaagcatttccatggaaaaggacactgtcattcagacaaagtggcatcctacagaacgggaaaagattttgcacatctgatagagggctaacatcgaaaatatataaataattgaaaaaaacaatattagacatcaaggaaacaacccaattaaaatattgggtacagaattctcagaagaggaatctcaaatggctgagaaacagttaaagaaatattcaacatctgtagccatcagggaaatgcaaatcaaaactactttgaggtttcatcttacacctgtcagaatggctaagatcaataaaacagatgacggctcatgctagcaatgatgtggattaatgggaacactcatacatggctggtgtgactacaaacttgtacagccaccatggaaatcagtatggtgcttgctcaggaaggtaggaatcaatccaattcaagatctagccataccattcttggacatatactccaaggacactccatcctatgacaaggacacttgatcaactatgttcattgtagctttattcatagcagccagaagttggaaacaacaattaattgaaaatcattatcaacagatgaatggataaataaaatatggtatatttatatagtaagatgttactcgtgccattaaaaactgaaataatgaaattcatgggtaaatgtattgaaacagaaataaaaatcatcctgggtgatgtaactcagacctagaaagataattatagtatatatttacttatacatggatattagtttttaaatcagtgataaccaagctataatccatagaagtacaaatgttttgtataaagaaagagactggggtagaaagatagatcttcctaggaaagtataatagaatagatagctgtagatgggtggggagtctgagacaggaagatcaaattggaagggggaggaaagggggcataaagaagaaaagagagccagaagtaggtaaaattaaggacaatttgagttgtagtgtggaaacgtaatactgtaggatctttctaaaatatacaaaagctttctaaatgaaattgccaaataaagaggatacagaaccataactggcctactcttattaccatatgaagcttccagcattgagattgagttatatccaattgaggtgagttcctatgggaactctcaagcaacgcaggatgtttccaagactatatgttgctctttacaaactgatggcaaggaccattgctgaagacaacacctacacaactcattgaacatggagtagtcgaattgggacctacatagagcctttatccctatatgctagttagtgcctttgtagagcaaggttctctctggatgctaccaaggagagacattaacaccaacacatcaaacaattctctgttctaaaatggtgtcctgcttacaagatatgctagagtaatggtggcacaaagcttgttggagtaaccaaccaatatctgatttgatttaaggcccacttcatgagattatatcaaacctgacattacttcattgactgagaatatgaaactagatatcccagggaccttgaataataccaaattctataattctactaaaaggaacgtagcaataaattagtcctaatgagtaaccaatacagagacacacagccagagattaaacagagtaagtaacattgacacactcagtaataaatggaatatctccattaaatccctcccctcagggctcagaaaactgtggaagaagaggtagaaagtgtaagatgcagaggtcatggaggacatcaaggaaccaaggccctctaaattaagaggaatgatacaaatatgcactcagagactgaggcagtatgtccagaacctgcactggtctatatcagatagagtcctaaaggtaaaagaagtggatacatgctcttatttttaatttagaagctatttccaattgataaccatttgaaaatgaaagtttagtttccacaaatgggttctcattggggaaatggctcttatgggtaggctgcatgtccagcagtagatgggcaacagaaaacaaactcaaagatatcatcaaagggttcttgctttctaaggttgggccagggattttttaaaatttttacctttttcatatacattttaggtatatatattttccaggtcatttgcatatatattattgcttccagtttaatgtctttatggaattccagaacatgaaaatgagtgggtctttatgtctatatctattgcatatgccttttcttagactctttccctttgtttgtttttgtccaattccagcatattaggttttgtttatcttactttatgttattattatccctgcactttttttctaatgagagacagaaaggggatggattctggttgtggggaggtgtacaggaagtaggaatagtagaaggatgggaaaccataatcaatttatattatatgagacacaaaagctattttacaaaaaaaaaaatggaaaagtaaagaaaaataaaacagtactctctaagaccctgtaggttctgatggaagccagcctattcactgttacttatatgaatgactttggctaaggaagtctctgcttgccaattatatgactaatagcccttcttaggagaaagaaaaccactattaccctaatgcagagaaagaaattacagacacagtagccacacacagactagaatatattattgtcgcctacttctttaatgagaaaaaagagcatgtcattagtgtcaagtagatgctagggaaagttctctttagaaaaatgactcagtacaataatgtgacttggtggttatctttgcaagaaaacagaatttgatttaatatgattcttatgtgaaaacttcaggaaaatagtttattccacaacccatatgcagaactccctgaagacaactcccaccatgcatacactaagatttgacttgaaagttcacactatagccataagtacaaagagggcttttctccttatatataaaaagaatccaacattgttcctcaggttaccacctctgaaaaatgagacttctcattgtgattattaaaaaattctcttattttttatttcttttatttcatgtgtttctcaaataactttattaagaaataatgcatcatagaattcacacacataaagtatgtagttcagtggtttctggtttattcacaagtatgtacaatcattattataggtacttaccattttagaaatgttttattttcccacaaagaagctatgcacccttttacccaatcatttcaccttttactctcgactccaagcaatcagcattctctcaggctctaggaatattgtgtattttgtgttttcatatgaatgagatcatataatatggaaatctttgtaactggctcctttcatttactaaaaatttataattctatttgaactgtagtacacattctttcactgactgaagaataattcatcatatgaatatattatgtattgcttatctattcattttctgttggacatatggacattatgaataaagctactataaactttcatatacatgggtatatttttaaaatatattttatgtttataacttggaatgaaattattgggccatatggtcttgttttccaaagcatcttcagtatttcatatttccaccaccaaatattcccatccatctgcattctccccaaatcttgttatctatccattctattagcacttttgctttttatcctattaggtgtacaggatttgcattttaaggattctggacatatttttattcttcttgttcatgtgtgtatgagttttgaacatatatttctttagaacctttaacatatttttaaactagaattttgtctttaaaaattttatattaattaatttgttttacactccatattttatcccttccaccccaatccgccctatggactgtgccacatcccatacctcctctccacccacctgtctacacatggatgtccccaccccccactccacctgacctctttaacttcctggggcctccagtctcttgagggttaggtgcaccatcactgaatgaacacagacccaaaagttctcgactgtatatgtattggggaccacatagtagctggtgtatgctgcctgtttggtggtccaaagtttgagagatctcagtggtccagattaattgagactgctggtctttctacaggatcaccgttctcctcacttctttcatccttccctaactcagcaacaggggtcagcagcttctatccattggttgagtgcaagaatctgactctgactctttcagctgcttgttggatctttcaaagggtagtcatgataggtccctttttgtgagcactccatcacttcagtaatagtatcaggccttgggacctctccttgatctgaattctactttgggcctgtcgctggaccttcttttcctcaggcttctctccatttccatccctttagttctttcagacaggaacaattatgggtcagagatgtgactgtggggtcacaaccccatccctcacttgatgtcctgtcttcttgccggaggcaggctctttaagttccttctccctactgttgagcgtttcatctaaggtcccttcctttgagtcctgggagtctctcatctcccaggtatctctggtgcgttcttagggtccccccaaccttgtatttcctgaggttgcctgtttctgctctttctgatggccatcatggcttcagtccttttccctcacccaatatcagatcaggttccctttttcccccacttcctccaaccctgtccactttccttcccaagtccttccctccttccccacttataattgttttcttctctctcccaagtggtcctcacttgggcacttcagcttgttgagctttgtgagttctgtggaatgtatcttgggtattatttactttattattattatttttctttttggctaatatctacttattagtgagtacataccatgcatgtctttttgggtctgagttaccttactcaggatgacattttctatttccatccatttgcctgccaaacgcaggatgtccttgttcttaatagctgagtagtattcattgtgtaaatgaaccacattttctgtatccattcttctgtcatagggcatctaggttgcttccagcttctggctatcacaaataaggctgctatgaacatagtggaacacatgcccctgtggcatggtggggaatcttttgggtatatgcccaagagtggtatagctgggtcttcaggtagatctatttctaattttctgaggaacctccagattgatttccagaggggctgtactagtttgcaattccaccagcaatggaagagtgtcctccacatcctctccaaaatctgctgtcatctgaggttttgatcttagccattctgattggtgtaaagtggaatctccgggtcattttgatttgcatttctctgatactaaggactttgagtatttctttaggtgcttctcagcatccaaggttcctcagttatgagttctcagtttagttctatatcccattttttttttggactgggttttttgtttgtttgcttgtttgattgattttggtgattaaattcttgacttctttatatattttggatattagtcttctattggatgtggggttagtgacgatttttttcccaatttgtaggttgcagatttgtcttattgactatgtcctttgccttacagaagctttccagtttcatgaggtcccatttatcagttgttgatcttagagcataagccattggagctctgtttaggaaatttctccctgtgccaatgagttcaaggctctttcctactttcacttctatcagattcagtgtatctggttttatgctaagatccttgatccacttggacttgagctttatacaaggtgaataatatgggtttactttccttcttctacatacagccagccagttagaccagcaccatttattgaagattctttctttttttccattgtatatttttggcatctttgttaaagatcaagtgaccataaaaacccagaaataaaactgcacacttatgccaggcagtggtggcacacacctttaattccagcacttgggaggcagaggcaggcggatttctgagttcaaggccagcctggtctacaaagtgagttccaggacagccaggactatacagaaaaaccctgtctcaaaaaaaccaaaccaaaccaaaccataaccctcacatttatagtcacttgatttttgtctttaaaatttttaatgactaatttaagagatatgatttataattagtattattttatatgtctttttactgtgttgatgttttccttttaagcaaattaaaatatttttcattaggtacatttttttcttgttttgcctatgctttggtgctatagctaagagtttgctaagtgtgatgtcatgaagatgttttcattgtataatcttctaagcactgagtaaaccttgcatgcttaaaattgttgaccaattttactttctttttaaatgtacaacatgatgcaagcattcatactcacagttttaaaaattgtatttctatatttattgtctgtgtgtgtgtgtagatatatggagaatgtatgtatatgtcagagaacaacttgtgggggacaattctttgtttccattatatgggtcctgggtgtcaaactctgattgtcaggtttgttggcatgtggcttcttcatctctctgtctccagagtcatgttttggtatgtagacctatagtcccaatgttctttttattgtaaagctcacactttggatgatcttggcaccctttaaaaaattatctggctatacagaagagtctggatttacaaaactttgaattccactttccttgttttaggagagatcgataatcatttagctctatcttaagtttagaaaactccaggattagccaggtactgagatgctcacaatcatctattggatgactctcattgatggctgactaggccatcctctgctacatatgcagctagagacatgacctcttgggatactggttagttcatattgttgttcctcttatagggctgcagaccccttcagctccttgggtactttctctagatcgttcactgccttatctgattactctccatcatacatatttgaggcaaattcttgcaaatgaaacaagagttttccttttaaaaatgtttctttttattataaataatttattccctcatacaatgcatccccaacacaattcctaccccccctactccctcaagctctgtgcctcattccttctccctcagatccactccttctcaacctcccatcaaaaaagagcaggcctccaagagccaacaaccagacaaacaagacaaatcaaaacacaaagacaatgcaaaaagcaacaaggcaacccaacagaaggaaaggagtcccaagagcagacaaaggagtgatacaaccatgcacacagttaagaatacatgtagtcaaataatgtatcaaacatcaatcttgcccccaaacacaaatacatgaatgcagttgccaacaatcctgtaccaacacatgtggaagcatgtatatatgcacacacatacacacacatgaccccaaaaatgtataaaacaaagctaacagccacaacatgtatacagaagacctggtgtagactcctgcatgtttacagtttcagtctgtgtgaacccatatgcaccctccttatttgattcaatgggccatcttttcctggtgtcctccattccttatgatccctccaatctttctactccctcctctttctcagaattccctaagctctgaggggagagatgggatggagacctccaatttagactgtctattcacataatgtctgcctataggtctctgcatctgttcccatctgttactgaaggaagcttttctggtgatggctggacaaggtactgatctgcgagtatagcagaatttcattaggaataatttcagtgattattttctttagatcagtcatgttcgattctacccctaggtctctgggctatttagtctccagttcctggccatccaatcagtgttttggtatgggctccctcttgtggagtaggcctcaacttaaaacagacattagttgtgacttccacaagttctgttccaccattgccccagcacatcttaccagcaggacacattgtaggtcaagggctttgtaactgacttggcgtccgcaatgaagtattactcttctgtttaaaaaaaaaaaaaaaaaaaaaaaaaaaaaaaaaaaaaaaaaaaaaaaaagcaaaaggatgaaactagaaaaaaaaaatcatcctgaataaggtaacccagatacagaaagacaaacatggtattatttgcctaaatttggatattagctattaagtaaatgataatgaatctgctatccacagacccaaagaagttaggtaaagaggaggagaaagtaagcttttcagctgtgctagtccagatagccaacttgctctgtggatactctcttttctcctacaaaacaacaggattacaaggggattcccaatcaacccaggtttttgtggttactgggttctcatactttcaagcaagtgctttgtttcctgagctatttccctgactcctctattgatggaacttgtagatgtatcgttgctctgctaccacactgtcttgactatccatctcatagtaagttttaaaatcaagagctattaatcctcctactttattcctttttgtaggagttctggagtgcccacaagaatttcaggaaaaaaaatcaatttgtaaagattttgatacatgtttactttacaaatgagtttgaatagtgttgtcaacttaattttaagtctataaatccatgaatattggatgtttatacatctatttagatcagaatatctaaataaattttatgtatctatataaaacatatttatataaaaaagattttataagattttaaaacttttatagttttgtgctaatttttctttttttcattaaatttatttttgttttattttgatgttattgaaaatgtaattgtttacttaaatgcattgtagatgcttcattgataatacatagtactataattattttttacatatgtattctctatcctatactcttcagaacccattcattaattataacacattctttaatatttttatgttaactgtaatatttgtaaatagatatatgacaagaggcttacttttccctttataatatcattctgtgatttcctcttttgtcgactaatgtttgtgactagaaccttcagcacattactgaacacaagtactaaaagctgaaatgcttgccctgttgtcagctgtagtgaagatgtgtctatttctttacaattgaatagtgtggtaactgggagttttgaggacaccatttgtccaacagagggacttttatgtttctagtttttttttttttaatttactttcttaatcatgaaacacattgaatttttctaatgctttttctaagactattcagactatcatccgcgtttcgtttttataacacttaaatggaatgattccttttatgtattaaatagccctttattactgggatagattcaactgtatcatagtatataattctttttgtaagtttctaaatttggtgtgcttgtgttttctagaggttatttggtgctcactgtaccacttttatcccttcattctttggggaaatattgttattacagcaaagctcttcttaagctttttcataatcttggtttcatagagtagaattctcagttctgggccaagtagataaacagaacaatacatgattgcctctgcttcactatgctacttcattcattatctaaactcaaagctgttttaaaaatatgtttgggagcagaatcatttttaagttctacagtttttccaaagttgattatgcagcaattgtgcttatttactatgaaataaacatcttcctttttttccccatctgcaatgaagggatgaactaggtagttagttagttatcctttcagagtatattgtcataacagctggaagtaatggaattattttgcaacaatcaaatagcataacatatgttaaggttagaatctggtccatagtgaactatctctgttggtccatctgacttaaaaagtttattctctgtccctaaatattgcatactaattttcatttattttaaaacatattgtatgttattactcttggctgattcgttctatcccttctgtgttctgggtaaatatgtatggcgtatcctgcagctaacatgttccttggtcactttggcatcttctgatttgtgatgcctgccaaaagaatagaacatgattgaattggcagtcaagaggtgacagtttgttgttcagaacagaattttgcatgaacaatattagtgccaactctttcagattgtgctatcattatgccaagctcttatattcaccatctacagtaatatttttgttccctaaaataagtcaaaacttcttagcctgacacttaggacttcccatacaatggtcttcccaatatatctaaaccacttaccactattttatagcttttaaagtgtaatgtgttgaggcttgcttcctcattaccctagaggaacaccaagtcttttattccctccatacagtctgctgtctgtaagcatatttctccaccctttgttctacactcttgcaaattcttcaaagtacaattcaaatgtctgttgaccatggatttatgcttgccaaggtcagcccatcctgatcacctcagaactacagcacaactatgaccctaaatttactgtaatgacagtttccattttatttattgttttgctttgttttccattctccttctacttacatatagaggctattagcagagtagttcttgtgtgtcatgcctctttgtactcattataacacatgagaagccctcagtcaacatttatgattgattaaatgtctactctaagctccatttcattgctttaaataaccaaaagcacactaaaataactgaagtcctataatttactgaatttttcattctaatagtcaagtattacttgagataagaaaatgcaaagtattatattttttattatgataactccatgatgttgaaagcaaatatgactttttattactaaattatttatttacatgccaaatgttgccctccttcccaaattccccctcccagagtttttcatcccgtccccctccactttgcctctgagaagacgctgccccacccccacatactcattcatcttatcctcatccacctacccactcccacctcacctccccagcatccccctttcctggggcatcaagtctctacaggactagatgtacccccttccactgaggccaaataaggcactcctctgctacatatgtgcctggggccacagaccagcccatgtatgctctttggttggtggattagtctccgggagctcccaagggtcagggttgcttgatacttctgttcttcctatagagtttccacccacttcagctacttcaatcattcccctaactcttccataggggtcccagacttccatccaatggttggatgtaagtatctgcatctgtgtcactcaactgctcgtatagcttctcagaggacagtcgtgccagactcctgtctgcaagcacatcatggcactaataatagtatagggtttggtgcttacccatgggatggaccagttgggccgatcactagatggactttccttctgtctctgcccatttttgtctctgcatttcttttagacaggaacaattctgggtcaaaaattttgaagataggtgggtagccccatccctccattatctatctactggaggtggtctcttcaggttcatctccccactgttgggcattttggctaagttcatccccactgagtcctagaagcctactacatcccaggtctctgggactttctatagcccccccccaaccccttgcagctatgtatttccaatcattctcctggcctttttgtgttctctcctgtctcctcccatacctgattctgccctctcttgccccccacccccaccaaccaggggcctccctccctctgctgtcagtgactattttcttcccccttctaagtgctattaaagcatccttaattgggcctttcttcttgttaaaattcatgtgctctgtgagttgtatcatgggtattctgtacttttgggctaatatctaccataccatacatatccttttgggtctgagttaccttgctgaggatgatattttctagttctattcatttggcaactcatgatgtcctcattttaataactaaatagcattccattgtgcaaatgaaccacattttctgtattcattctttggctgaggaacatctaggttgtttccaacttctggctattacaaataaggctgttgctcggcagtggtggtgcatgcctttaatcccagcacttgggaggcagatggatatctgagttcgaggccagcctggtctacagagtgagctccaggacagccagggctgcacagagaaaccctgtctcaaataaaccaaaacaaaaatcaaaacaaacaaacaaacaaaaatccaaaaaacaaacaaaaataacaaaacagaacaaaataaaaagaccccaaaacaaaaaataacaataaggctgctatgaacatagtggagcacatgtccttatggtatggtggagcacccttagtcatcagggaaatgcaagtcaaaacaaccctgagattccaccttccaccagtcagaatggctaagatcaaaaactcaagtgacaacagatgctggcgaggatgtggagaaagtggagcagtcctccattacaaatatgacttcttaaagcattaaaatgataattttgctaaatagtttaatctctactcaaaataagcaacttctaattgagatcaaaatttggccaagagttcccttctccctgaggaatggcatcataatcatcctgcttattatacttaatgtacaaatgtgacctcaaatacagacttacaacatgaacttaaaattgtgacaaaacagaaggtggttggcagtcatggggaagatagagaaacagaattatgatcttggccaggccacagaatttataaagttttgaatgagtacaagacagtcaagtctcgaatagtaaagtgcagcacaaagctaaaagctacttgatttagagcccatatcatttccaaccagctcaagtccacagtgagcttttagttttctttcagcagatggaatgaaaccacagaaaaagaagatccttgcatgttaacaacagaataagaagaggcttgttcaaataatgtctatccaggtacaatatattataaattagaatgtacagcctttgctttgtagcagacccaatgactattgattttgatattgctgaaaaaagaagctatccatgcatagaggttttgtctggtgcaattcacaacctaattgatttgcttctaataaatcaggaaaaaatagaggaaggcaaactctactttaaataactaagaatcattacagcttattaaagtattattctagcatgaagactgaatatatcttagcacacttttccagcatataaaattgagctatctgagtataaaaatcatctttgaaggaatgagtaggtgacagttaaaatacatatttctatacaggtaatatctggtagaacaaacacttaagagacgttagtgatttttggcttacagccagtgtgatgtctatcaactctcataagaagggatgagaagttttttattattctcaggcaccaaatggaatctctgtgttcatggatatttggccttttcctcttgtcctcgacagctttgttcttggttttctacaattatcattgttcatcttgccctcccttccattccaaatgctttctcattttctttctaccagttaaagcacttttaatcctctaagtcttggcacaaattgaactttcctataaagtattggttagttcttcacactggtttcagcttcctttatctttgttagtaaaaaacatagagttcattatctatttactttgtgactaagctcagtcacattcaaagttgactgttgaaatgcattcatatctttctctgatgtttctacagttcctggaaccacaataactaacacagcaactccatgcatactgaccagattgactttagtacttggtcactgtaaaattgaaagatgtcacaagtaatcaggtggatttccttaaaaatacttccaaataaagtattagtagacacaagtttagaaagagggttggtgaatagctctttgataaagtacatgtagtaacacactggtgaaacactttagatgatgtcacttacagtcatttcaacttttctgagatctcacaaggaagcatttttaaattttaattatgctggaacaacctatataaacttagatctgtggtcacctatggcctacagtttatctaatgagaaaatatatgtaaatagatttggaattagaaggatctagcaaagagtagtgggattcaaatctaggatgagaactctggctttgatatcaaaagtgacattgcattcttttgagactgagttagcagtaacttgggacctttcagtcattccatttaagattaattacaaattggcacaatgtcggggctgcagagattactcttctacatcctatgcctgttctacaatgatcgctgatccttgggaagagggcttatgatatagatgtcccatttaaaactgggcattgcacactcgcttattcttataaccagttgtggttagtcacatctactgcaagcggaagcttgtatgattggggctcaaagatgctttaatctatgagtataatagtaaatcattaggacatggggtttaatactatgtcctccgagcagaataatagtagtaggttctctcttagggcctatgatttttctagatggagcttcttgccctcaaaaagcgagtagcttcttcaaaaagcttgaaatagatctaccacaatatttagctattctgctcttggatatagtaagatactaagtacatcttactatagagatacttgctcattcatattcattgctcctctattcacaatagccaggacagggaaatagcctagatgaccatcaactgatgaatggctaataaaaattgtgatataaattatctagctgttaagaaaaatattatgaaattcacatagaaatggatagagctggaaaatatcattctgagtgatatacaaatatacaaatattttcttctctcctatgtgaatgttagttgtaaatctatacatatgtatgtttcattgaggggctgttattaaattagcctctaactgtggactatttgtgtaatagtaccaggcctttgtgaagcacatgtctttttagtttattgtcttgaaaaatgtcaattgacttatcagttggtaagtgtagaaataacaattcattgaaagtccccggagatttctgtcttccctgtttattacactgcattagttggcacatgtatttcttagagggaaaggggttttaattatctttaaacaccaagctatgttttcctaaattctaacccagtgattcttaagtttcataaaatatgatcacctaggacccactgctgtgggatttggtttaattcagtgtagactgtgacctctatctcatggtattttttttcccctagtaattttaaatttggaaatgactcatcttactcagacatgctgatgaatcttttttaaaaaaccacatatttctgtttggagatctcactaatgagttggaacttttacatggaagaaagtgtggagttcatggaaacagtggtcctattccttcaaaagaactgtgtggatttctggtccatggaccaatgtgtagactacagacctgtttcttagaatttacatggttttcctagtacctgtaatattttatcagtaataattaaaattaataataattttatcaaaataatatacccctattgtttcaattttatcttttttacacttaataattaaatatattttaaacaaaatgcaataatatcacttctctttcctccctctaactcctcccatatcttcctctattgcctcttccagattcccccactctcaaattgatactctttttgattattattgctacatatgtatgtatatgtgtacaaatatataaacataactggcagagtactattttgttgctagtgttcttccatcaggaggcttgtccgttgtagagagtaattcttcctttcttggcagtcatccattgcctgcagttcttttgacctcatgagattttttttttttaccttctccattaaaatgtctattggtattgtctgtattcaggtcttgtttaggcaacctttcttaagcaaggcagtctcacagcagacttcctgatcttctcactcttctgccttcttttctgggatgttctctgggccaaagacagaagagctgtgttgcagaagtacatattggggctaggctcttctcgatctatttacttccaaattgtgtccatttgtattttactgtgatatttttttccttaaaaaaagcttctttgattggatatgacagctatacttatctgtgtctatgaaaataagatctaaaatgtggttaataaattaggctagtctagcaaagaagcagtactagattttcttctatgctctataacctctctaacaccagatagttggttaggtttctagtaccaggtacagtttcacttctgttgaatcagccatccaacagaagataaagagaaggtaaaaaaaaaaaaaaaatctcatgaggtcaaaagaactgcaggcaatggatgactgccaagaaaggaagaattactctctacaacggacaagcctcctgatggaagaacactagcaacaagaagctattggtctacttagaagctattggttatcaccaaaataggagtaccacattattggacctttatggacatccttggcctgctattcattgttatagctcatagttgtcccaacttagtaggaacattaattgcttcccttccttggcagtttgcatattactttctggtactacagaagttaggctgcaggagggaggctttcaggttagatatagctcaaattatcaagtcctctgccctaagtgtgtggtgtcttcagtaataaggaattaccttcaacctctaagatgtaacaaaggtctacattaatatatagtttttggatgaatttaaactatctggccaacctgaccctactccctcttctatctgtattaacctcctgactccccggttgcagcctgctccctgtttttcagtttctctttttataacattatctgtatcctgcccccaatggtcacttgtactttccggtctctgcatttactcagtgttatatattcacatcggaagatttgtaactagtaaccacagattagagagaacacgtgacagttctctttctgagtctggggtacttgagtcaatctttcaatctatgaagtgtctacaagtttattgagctgctgccacctgctaacctgtgagctaaactgctgatttccagacaacacagacaaaagttgctccaaaaaaaaaatctttctaaacaggtccacttcccccgtattctttcttttcgactacctctggtaggtggtgggttacaagaagggataaagtatttaaaaaccatcattaaatataaaattaaaaattgaaggcggttagctttcaaaatattaattctttactattaacatggggtggtgtctttctattttctaatgtccttcttcagagatttgaagttttcattatgaggtctttcacttctttgcttagtttttttttcaagatattttgttgtctttgatgctatcatacatgtgttattttccactttctagttttcaatgtatttgttggtggtgtattaaaaagctgctgattttggtaagttactttgccattttgttgaagttgtttctagaagttccctggtggatattttgggatttcatatataatatcatatcatctgcaaatagagatgattttagattttccttatctgtatcacttcccttgccatttctagccgtattgccctacatagtgcttctagcattcgattctaaacaaataggagtagagaacaggcttgtctcattactactaataatggattttttttctccatttaggataatgtcaacagacagtaggtttatcatacctagcctttattatgttgagacacattccttccagtcctactctctctgggacttttattatgaaagtatgttggattttatcaaaggactttcctgtgtctattgatattattatgtgatttttgtctaaagttcaattgtatggtttatttctttacttgcatatgttaagccatcctagtatttctgagacaaaggcaagttgatcatggtggatagtcctgcattaagtttgctagtatttttaacatgttaataagggatactggtctacagttttgtttgcatgggttattacttggttttggtttgagagtaataatggcttcatagaagaaacatgggattaatcctgctctttctatttttttattgggtatttatttcatttacatttccaatgctatcccaaaagtcccccacacgctcccccacccacccactcccacttcttggccctggcattcccctgtactgaggcatataaagtttgcacgaccaatgggcctctctttcccctgatggccgactaggccatcttctgattcatatgcagcttgagacacgagctccgggggggggggggggttattggttagttcatattgttgttccacctataggattgcagatcccttcagctccttgggtactttctctagatcctccattgggggccctgtgatctataaaatttaagaaatattggtattgtaatcctttaaaagtcttgtaaaacatgctgtgaacccatctggttctagagttttttgtttgtttgttttagtttttgtttgtgtttattatttgttcatttggccagaggggcttttattactatttcaaatctctcctttagattatttatttttagtctctttatattatttatcttattggtttcatttttatatttttatatattttttatatcttggatgaataaatatttatcctttttttttagattttacaatttatgggaatatggtttttacagaattatcttatatagtattctctactcctttgctgtctgttacagtttccctgtccatttctggttctgctactttgggttatattttctttttcttttttccttttttccttagatattttctttatttaccccctttaaccctttacttaccctttatttacccttttctttatttaccctttcctggtttccccactgaaaactcccttccctcctgcctcctcctgctcaccaacccacccactcccacttcctgaccctggcattcccatacacaggggcatagagccttcacaggaccaagggcctctcctcccattgatgacctactaggctatcctctgctacatatatggctggagccatgagtcccaccatgtgtactctttggttggtggtttagtccctgagagttctgggggtactggttagttcatattattgttcctcctatggggctgcaaaccatttcagctccttgggtactttctctagatccttcattggggaccctgtgctcagtacaatggtaggttgcaggcatctacctctgtatttgtcaggcactggtggagcctctcaggagacagatataagaagcttctctcagcaagcacttgtttgcatccacaaaagtgtctgggtttggtggttttatatgggatggatctccaggtggggaagtttctagatggtcattgcttcagtctctgctccacactttgtctctgtaacttcttccatgggcattttgttcccccttataggaaggatggaagtatccacactttggtcttcctcttgagcttcatttggttgtgaattatatcttcagtattccgagcttctggggtaatatccacttatcagtgagtccatatcatgtgtgtttttttgtgattgggttacctcactcaggatgatattttctagttccatccatttgcctaagaatttcattaattcattgtttgtaatagctgactagtactccattgtgtaaatgtaccacattggaaatcttcattctcttctatacatattatcattaggtttcctcttctccttgtgtcctgaatttcctggatattttgggttagggtgtttttccattttgcattttctttgattgttgtgtcaatgtatcttctgtgcctgggatttttctcttctatctcttgtattctgttggtgatctatgcctcctgatctctttcctaggttttctatctgcagtgttgtctccctttgtaatttctttattgtttctaattccatttttagatcctggatggttttgttcaattccattggttgtgttttcctgtaattctttaagggatttttgtgtttcctctttaagggcttctacctgtttacttgtgttctcctgtaattccttaaaggagttatttatgtccttctaaaaatcctctatcagcatcatgaggtatgattttaaatccacatcttgcttttccagtgtgttggagaatacaggacttgctgtggttggagaactgggtttggatactacctagtagtcttggtttctgttgttaagtttcttctatttgccttttgccatttaattgtccttggtgttagatgttcttgctgtctctggctggagcttgttcctcctgtgtgtctgtaagcctgtgtcagcactcctgggagactaaaagaacttgtgtacagagggctctggaatagcccgagttctggatgcagatggcgactggaaggatcctgtcccagcagctccactgatcttgcaccccatgtccttctggcccaccctgctccacacagttattggagagaaagtggctatctcatctctgagccagggagtgaaaagagtcctgagagaacaggtctctgctggcaggacccctgcacagcgagctgtggaacagcctcagccctcagttgcagatggctgaccttctatttttttctttcttttagttagttgtgcaaaggtctgccaacctttatcttttcaaagaattagttcttagattaactgattctttgcattatttcttggtttttaatttgttcattctgctttgaattttatttattttcttttgggtttatttttaggttgtttctgggtttccaaatttttaagtttcatcattaagttatttaactgtattctttctgattttaagagagacacctagtactgtaaacattcctcttatgcttttaaatttatttcagagattttgttgtgctgtgttttcatttgtatttacttccaagaatatttggatttggtcttttatttcttctttgacatctttcagtaattatttgtttaatctccatggatcacattaatagaattttgtttgattttgattttaagttttattgcaaaatggtcaaacaggatacatggaattgcttcagaattttttgtttgtttgtttgtttgtatttgttaagttcagttttatgacccactctgtagcttatattagagaaacttccatgtgctgttgagtataatatatatttggtgtgtgtgtgtgtgtgtgtgtgtgtgtgtgtgtgtgtgtgtgtttaggtgggtggggtggggcagaatattctatatctatgtgttagacccatttgatgtaagaagtcatttaattcttaggtttatgtgtttatgtttttgttcaggtcatctatctactatagaaagaggaatgttgaagtcattgtcactgagtttgtattaatctgcatttttaagtttttgcatgcttttaatggatgtgggtgcacctgagtttgttatataagtattttctatcttactgtcttttgttaattaatcccttgattagaatgagataccttacttagtctcttctgaatatttctagtttaaaatctatttgccagatattagtatggcaaaggctacttgcttcttgatcctgtttagaatattatgttccatcctttcatattaaggtgctgtgtatagttaaaactaaaatgagtttcttgcagacaacagacagattttttttcttttcttttctttttctttttgttttggaaatttttcttctatagtcttgttaaagatctgatctatgctattgtcttggttttcttctttctcatctattcttataattcaaagattttgtcttttgatggtgttccacattttctccatgttcatttcttgcaattgttaatatttcatattatttatttgtttggtctagatcttttcctttagttttcagtcctaatgtactatcatctgattcattcattttacctgtaagacttcctcctgagttttctaattaggatattgacttttttttttaattccatctttatttcaggttctgtttctcctcaatgtttctaccactttatttaattcagttttcaaaatctaaattatattccttatttcattcagctgcatatttgtattttcttggacatcactcagatatttatcttctttgaatttaataaagtctttgtgttttctttaaatccctttatttctttgataacaattaatttatgattgtccttgtaaattctatgtcattttgaggttcatttaagtaattatcattagagaacacttctgtaggactaatggatttgttgagaggcatgctttcttgcacactcacgttgtttttgttcaaatattttgagcttatatgtggatttctttggttatatgtctggtgagatatggccttctttaaatcgaggcactttagaagctgcatgactcgaggtaggctgagtaaagctgctggaaaagctgtttcattgggcctgaaaagataactaggtttgtggatttatagttgtcaacagatgccagtaagagtgtgaaaagaaaagagcttatcaccagtcaaaggtggttcatgaacaaaatgggtttaaaggccatcaattcagagctaggcctgtggttctggagaagaaaataggtggggtgaaggatgaaaatgagaacactctgggaacctaccatgcaaaggaggcctataaacaaagtgatttccaggtcttggatctagtgctaggcttatgggtatgcaaatggcagcaggtgtgtggaagaagggattccattttatatatctttgagtatttttattttggaatttctaagattgagactccttttttacacacacacacacacacacacacacacacacacacacacacacacacattatgttcttgccataaagaaacaccatgaccaaggcaactcttataaaagaaagcatttaactgggggtttgcttaccatttcagaggtttagtctattgtcagtatggcagagagcttggcagcaggcaggtatcgtgctcgagaattaacttggagctacattatattaagcagaaagagagagactgtgggcctgacatgaacttttgaaactctaaagcctactgtaagtaacacttcctctaacaagaccacaccccctaactcttctaattctttcagagttctacttcctggtgactaaggatacaagtgtatgaggttatgggggccattcttattcaaaccaccacaagtatattgtacctgtcagcatgacaattgtgcttaagagaatgaatactgcacttactgttctagtccacttgtttgatggggtgtctggcaaagtgaataaaacttgtattttattagaaaggttcaaaagaaaccatattttcaacagtctgtttcttgtagctatattttttctcctctcttgatcaataagaccactcaatacttacattaactgttgcttatctattactgcctacaagagtggcataaacattctcttttatagctgcagtcatcggggtcaggtgatactagtggtgtatttatctgtcagggaaagatatcattggatagacaatgtgtttgatttgctgaccaggatctggatactctgattttcaaggtttaaacttgctctagctgacctatcagctgaagttatataaccataatttccagcatttgaggatctcagctattagaccacaaagttgctgttatattattttatattgtatttaatatgcttatgatggtttagattcatttcccctaagtgtatttttaaaataatggtccaggccttaatggaattatgatctgtatttgagaaagtaaagcttttaaaattataaaagcccatttattctttctacatctctttcccccatttttccatttcatagcttgatttagactttgtgttctaaacctagtccattatttattgaagaaagtttacttttaattagcctcagctttatttaatctcactataatagtttgatttttatataaaatattcaatcatgctttaccatatggtgaacatcatttatacataaaagctacttgctgttatacctttggaaatcatcagaggatctcagtaagagttttccagccatctgcttctttttcaaaccctgtgtcgaagtagacttctgcagtggttattctgaggtcaataagctatagtgtccagttaaatgcccttgtgagtaaccctctagaagtaaggcctcatgaagagatcacttcaatggcttgtatatcaaagtagagtttcccattttactacattggaaaaacacttaaatctctttctatcccacatctactgtttcagcagggcatcttcctgtcagaaacccaataggtcccagtcttaccagtggggcttattatgatgtaattaatcatattgttagtcttctttacttctttttaaaaatgccaagagaatttaataaaccaaacatccctgggacatttaaatatctgtttatcaatttttagttaacagaaaatgaaatgataagaaaaataggctaatgggatatgaattatcaaccaaagttcagaagtagagacagatcatcactaatataatataatcaatggggagatgattcaatttacaaaaattcagttttggctcaaattttctaaaatatatttattgcacagggtgatagatatttgtctttggatgggctcctcattttttcaatcaagccatttagtgatctaacagctgaattatttcagtgactagaaatgtatattgagatatgaagtggacctcttgtttttaatctctattcatttaaattttatatatacatttttatttttacacacacattttacatgtttttgacagcaaagtcaaatgagatgtcaattggggaacaaagaagcaaagtttgaccactggtcagtaaaattacttaccattacaaactggtacctaaattactcagttattagaaaaaaaaaacaaaaactcaagtaccatagttcataacgtcgactctgagatttactgcaagggaaaaatcactttcatataatgaaatactgtggtagataaatagtgagtttaaacctgcaattcatccaactttgcataggtagtttgacctactgagtttatgggtaagaaatattaaaaggtaatttttacattttgtccacagttttttcattgcctctcactgcacttctctgaactaaattataacacaggataatattcacggtagatgaggagacaaagtagttttgtgacactattgcataattaaagaccgaagcaaaactgagcctgataacctcaaaatctgtttattgcaaatctaatcttggcagtgatgacttatgttcgtattattcagagagatgaaggaaaggtcaactctactttcaaaaacagtcttttcttgcttgataagcatttaggagtacttactgttatttccttggggcttttgttgaccttatgtgtgagatggattcggaagtaaatacctagggaaggggtttggtggtctaaaagatagctgtgaggtctttcatacaatcttttcacttcactaaaggtttaggatgtttatacacagacaactaaattatgcttccttggcttaattgcaataccccaagggcaaggatctcagtctttcatttgtttggaatttcctaggaatgctaggctggcttatagtaaatgtttatttaataggactgaaaaaaaaaggtaccatataatgttgggtcaggccaagcgttcagtaagcaaacagcatttatttttaaaagtcagtaaaaacttttagtgatttgagattttgattgattattataaatattccaaagtcatgtattcaagatagtgcttatcatgccagaaggtgtagctaacatttaacccaaaactgttgattcttgactgtgctagcccccaaggaagatttttcttttcattttcctagagtcatgaaagaaccattctagaagaaacacaatatattttttttgatattctaaaaaatctggcagaaaaattcacttttagatttcaatgacaactaaggaatgttgaagtaaaagcatatagtgacatcattctaaaacattctggtggtaattttcctgtctcgtgtgaacagagctaacttgcttgaaataaaccaattgaaatgcctgttattctgcttatgatttttgtagaatatagacaaacaaattattctctgcttagaattctgcttgagatcaactcaaagggctaagcaagagctggctcggctcattagagaatgtaattgaccttgaaatgcagtgatatgcctgtatttcctcttgttctaagggggtgggtatttattcgtacttcccccagtgttcctaaatttataacaacatatatttcaaagttattactgctctggtgaaataaattttgaagccacttgtttgctccagtctttcttcagctgcttctgattgtagtttcaaaatctttatttgattcatttttattattctccaatagaaggtaattgcagttggcttagagagctttttaagggatgtttttcaagctcagagtttacccccctctggttgtaagccacagtggagtaatggaggaaaagtaaacactttggcttatattgtaataattaccactttaaaatgtaaaaattatcattagttcaaagaaaattcagatgttctctggttacacagcataaaattttaggagcacaagagagttccctgtggtcatttggtacttcccaaagccttttggaagcttaatagcctttgagctttcttttcgccgaaggcagaaaaatgagagcctcgttcttgcttcattgggcttgaaaacagtgggcaaaaaaggcctctgcaaccacagcatgcaaagagattcatatatagataatgttacagacttcctttcaatggaatgtgcatccctctacctaacccccaactttcccagtggtaagataagtcatgctgaactgagggcacacatttctcagctgccacttttagattcaggacacatatttgaaagatggctggcaggtacagaaatacaggactagactagagagcagagtgaaagaatccaagcctaagtaggaagccagtgaagagcattggtttcattaaagtctaccagcaagcagataacaagctaacctaaccacagggcaagtgtgggagtcctcagtagaagctttgctgtgctgaggaccaaatgcaagcttctgaatgaaagaatgcctttcctatacacaacgggattgatgggttgatagacacggggtcaggaagcaggaaaaagtgagatggataaataagggtggataaaaacatggactgaatacattgtgaacaatttgaatgttcgtggagagaaaataaaatgattgcccttcagggtggaaatatatgacgaactgtgaatttttaatttgtcagagaatttatgaaaatatattcctagtttacttttgaaaatattttggaaaggaatagtgtgtactcaaaatatttatttttagagatttttcttggaagggattggccaaacagctaacactgacagacattttaaagcacagtgaactaattctctttggaatttccattaacagctttctgtgtgttttcaactaacgttctactcattgtttggattagatgtgaaacagagtataagcagtttatacatttgttcagtagcttactcagttatttaagaagcaaacaaacaaacatatggagggactaataactgtgccaggaacttcacagaacatttattcattcaggcaaatatttattgagcccttttatgtactattaaaagagtaaattagaatgcactgagaacataagcataatataaagatttttttctctctttaatatctttcattctttctttgcatttgaacactcattcataatgatgaaatgtagataaagaaatgtaatttgaaaatttggttggatatagatatcaactatacataaacaaatgggatcatatatcattttttcttttttaaatttgattttattggttattttatttatttacatttcaaatgttattccccttcccagttaaacctcttatcccctcccctgtccccccctgcttatatgagtgtgcttctctgcccaccccttccaacctcagcaccctagcattcccttcaggcccaaggacctctcctcccagtgatgtctaacaaggccatccatcctctgcctcatatgtgaccagcaccatgggtccctccatgtgcattctttggttggtgggccactccctgggagctccagggggcttctggcctgttgacactgttactgcctccatggagctgcaaacccccctcagctccttcagtcacttctccaactcctccatcagggaaccccaaactcagtccaatggctggctgtgagcatccacctctgtatctgtcaggctctggcacagcctctctggagacagccatatcaagttaacatcagcaagcacttcccagcatccaagctgccttggatgcaagctgcttttcctggtggtttgctgtgctgaggatcaaactcagtactttgtgcatgctggtcaagcactctgccaactaagctgcaccctacttcggaacaaacacagtttacaaatacaggcctttgacagttctcctgtttttattttatttgtattattcctttttaaaatatttttattagatattttcttcatttacatttcaaatgctatccccaaagtcccctataccctccctcccccaccctgctcccctacccactcactcccacttcttggccctggctttcccctgtactggggcatataaagtttgctagatcaagggtcctctcttcccaatgatggccaactaggccttcttctgctacatatgcagctagagacatgagttctgggaggtactgattagttcatattgttgttcctcctatagggctgcagaccccttcagctccttgggtactttctctagctcctacattgggggccctgtgttccatcctatagatgactgtgagcatccacttctgtatttgccaggcactggcaaagcctcacactagacagctatatcagggtcctttcagcaaaatcttgctggcatatgcaatagtgtctgggtttggtggctgattatgggagggagcctcgggtaggacagtctctggatggtccatccttttgtcttagccctaaactttgtctctgtaactccttccttgggtattttattccctattcttgaaagaattctcaaccaaggaataccgaagggttgagaagcacttgaaaaaatgttcaacattcttaatcaccagggaaatgcaaatcaaaacaaccctgagattccacctcacaccagtcagaatggctaggatcaaaaattcaggtgacagcagatgctggcaaggatgtggagaaagagaaacactcctccattgctggtgggattgcaagcttgtaaaaccactctggaaatcagtctggcggttcctcagaaaactggacatagtactaccggtagatccagcaatatgtctcctgggcatatacccagaagatgttccaactggtaataaggacacatgctccactatgctcatagcagccctatttataatagccagaagctggaaagaacctagatgcccctcaacagaggaatggataaagaaaatgtggtacatttgcacaatggagtactactcagcttttaaaaacaatgaatttatgaaattcttgggcaaatggatgtatctggaggatatcatcctgagtgaggtaacccaatcacaaaagaagtcacttgatatgcactcactgattaatggatattagcccagaaacctagaatacccaagatacaacttccaaaacacaagaaaatcaagaaggaagaccaactcatggatacttcatttattattccttttatgcatttacacttcaaatgatatccccattccaggttacccctccacaaactccacctccccactctccccactctcctttgccttgatgagggtgctcctccacctactcacccactcccacctcacagatctagcatccctctacactggggcatcgagcctccacaggaccaaggggctcccttcctattgataagataatcctctactacatatgcagctggagccatgggccctactatgtgtactcttgggttggtggcttagtccctcggagctctggggattctggttggttgatattattgttcttcctgtggtgttcctaaccccttcagcttcttcaatccattttctaactcttccattgtggttcctgtgctcagtctgatggatgcatgtgtccacctctgtatttgtcaggctctggcagagcctatcaggtaacagctgtatcaggctcctgtctcaagcacttcttggcatcagcaatagtgtctgggtttggtgtctatagatgagatggatctctagatggggctttctccagatggcctttccttcagtctctgctccacattttgtccttgcatttccttttgataggagaaattctggattaatatttttgagatgggtgggtggcctcatacctcaacaaaggacagtgtctatccactggttatgatctctacaggttctctctctccccttttttgggtgtattttggttaatgtcatctcttaaatctagactgtagttatggctcagaggttaaaaggtcaggttgcccttcgatagaacttaggttcaatggccagcatccacactacagctcacacagatcataactccagtcccagggtatctgatacctgcttctgccccctgaaagctttgcatagatgtggcgaacagatgtacatctagggaaaaaaaaaacagtaaaaatttaaaaattaaagtaaaactggtaaatgtatattccctgtgtatgtgtttagttatgtttacagttaacattcttgattggaaaatgataaagaattcatgtagaagcatagaatatgcaatctctctactgtcttctatggtcctcttctagaatatggtgaggctacaaatgggatataagtttcctaccttattgatcctgataccattttggtaaagctgacaatctatttggagatagtgtgattcttaagcttacttgtggttggcaaatgggctttcagctgggactattgaagctgttgctacagacccttctgactttgtaaaaaatgtttacttctgcaaaatggatttttgtaaagagaggaccatctgtagttctctcctccggagtagcaaagatcagactgggtttgtggagcagagtgttcactagtactttagttgtcctgaagtcaaacactggcagggaactcccactgaattgtaaatgtttggagtccccagagtgtggctcagtgcacctctgcaagcagtcagtcgtttttcattaagcagtgatttgattagataaaaataaaagttgcttgagcattcatttttgcatcagtgcataacaaatttatgcaaattcctgtgccactaatctgaatgcaaaatataaaagtatgattaccaagccatgtgcacctgtattgaagtttaatcaggtacaaatattaatggaaagaataaagcttttaacaaaagtcacagctgtttgaggtttgtaaaatactgcaaagagagatttagtttattaatgataaatttgatgttttcaaactaaactaaatattttaaaatagaaataccaaacaagacaactctttactgacatgggaaacacacacactcacacacacacacacacacacacacacacacacacacacacacacacacacacaataaataggcagaattccttgactagcattatagtcaacatgtgatggagctatttgtaatggataaactacatagattttcattggtaattttattcttaaggaaaagtatcatatttttaggcatggagtggatatttgtcttgtacctaacataaggtctagcatatagtaaatgctacataaatgtaaaaattatttttgtaagatttatttatttttactttatgtgcattggtcttttgactgcatgtatgtctgtgaaggtgccagatcccctggaattagagctatagacagttgtgagctgtcatgtgagtgctgagaattgaacctagatccatctggaagagtagccggctgatgctcttattcactgagccatctctccagccccttaaaattcttaattcatgttaattaattgaacaaatcatttcaaatattgtgaatgaaccatttcaagtattgaaaaaggaataatgtgccaatttctttctttctttctttttgtggactgagatgtaaaacttgtaattttatttttttaaattttttaaaatattttttattacatattttcctcaattacatttccaatgctatccaaaaagtcccccataccctcccccccacttccctacccacccattcccattttaacttaacctttgctttacattttgtggtgttaaaggaaagaataacaattactgaatgttagcagctgtgttggacatattacgtgcattcgagtaagaactcatcaagtcatcatatctcacttttacagatgaagaaactgagcctgaaataatttggaaaaatggcaataaattttatttacagtctgactcaaggatcctgacttttctgccttataaaatccatattatttcactaaattataaatagaacatggatccattttggaggccagtggtgtattgtttgataattagtatcaaatggatctaagaaactaaaattctaagtcagaattctatcaatatttttcactgaactttgaatttccacacaaggagaagataccattgtggaagatttacttaggccaaatgtattcttatgagtggtctctctctctctctctctctctctctcacacacacacacacacacacacacacacacacacacacacgcacatgtgcatgcacacacagatgcttcagaatactgaacacatgcacacatacatcctgaagatttgagtgattttctaaatgccaatgaattgtagatatgaggaatgagtcatagtcttttatctgaatgctgttctttcaaattgaacatgatctgatattcattcaggaaaaacctgagaatgaaatggaattgtttaatactacacacttttatgctgctaaacagtaataaacggacttctggtctcagctttgttcattctcagtaacagaattggctcatgatgtgggtaatttgaagacctagcttagatatggctttcaaatcttggtaggacaatccctatcaaagaaaaagaatgtgagaaaattagaaaacaaaagttttcttctcccatatctgttcatttcttttttatttgataattgattaaatttattctttgccaattttgtatatgtataagatacactctagtaattctcacctttcacccctgaactccccttattcttccaaatccctttccatgttcatgattttttgttgttttctgactctgagtttaattaaggttatctgtgtgaccatggtttagttccctagcaaatatgcaaatgaagacaatgagtctccctccccccagaatatatcggttcatcaaggtaaggccctctctcacccataaataactgactgttgaggaaactggttacacacaggaccaatgcaggtagcaccagctgctgtcagttcaggattttaatgggtacatgtttcccagaaaatggcattttatagtcctccctatcttccagatcatacattcttttttgcctcctcttccacattgtcctccttttatattgagtttcagagggaatgttataaatgtcttattcagagcagaaaccttaaatgtcgtttattcttagcgccctgagaaggtgtgtgactgcatttaccacagttcactacaaagggaggattctttcattaaagctgaaagtgccatgtgtctataggtcattagtcataattccttattcaggccagcacaatgcatgctatctggctttaaactatccctttgaggatattttttgtcttcaaacaaacaatctctaatcagactaatatatctcttttccatgtcttatgtatttttcccattttctagaatgtcacctctccattctcctccatccttcaacatacctaccttcctagacatcactttctctttcaatgtcagattcacatctcatcttctccatagacacttcatttaaaattattgtatacccaacttcctttcttcctattcttgcaacatcaccagtttcattgtctgcctccttctctgtcctttcccctttcttgttttctttgatgattacttcacatatatcttctaactagaagggtacatatttatttctcaagaaaatgtaggtcctgcttttatggaggacagtgttacatggatcagacaagaactatttgatggaacaaccattaggttgtctgaaataaacaagactgctctgaagtatatgtgaatgtaattggcttacaaaaatagtcaggaaacaacttccaagaagtgataatttagctaagatctgaaatttgagtaataattaaccagcctgtagggtagagtctgtaaaggctgtaggaaaggaatgagactgtgtctcagtgctaagccatttgctttgcatgcacaagttgaccccacctatataatcacaaataaatgaaaattaaaaagaatattgaagagtatggagtgaacttctgtggcaagaggccaagtgtgctcatataattaattttcttttggttcatgttcacttgattcaacacattgctcaatgattttgtaaataaatgccttgatgtacttatttttaccaattttttttaatacctttttttgtctttgagttcagactccagtcggctctgagaggctttgtaaagattacacacacatagacatgagtctcctgtccattatatgcctattattctttgattgaaaagtactttgacttctaaataatgttgctctggaacaattctctgcatgtaggagatacttaaagattagagacagtatggccctttgcagatgagaggaatgcaatatgatgtatattcaaaggatgtttcattataggttatacatgttagggaagaaatctacatttataaaggaccatacaaactaaactttggaatacttagtgtgattacttaggccttgaagaaaatgtgtgtgaaataaataatgaaggatcttataattagtagaattcagaaggtctttagtttattctaattccaagtaaacttttttgagtctaagtaataaaagatgaagatttggtagtatctgcatcagtgtgatagatttaaaacctgatcctaagattctataactttttataaaataaggagtgatggatttatatttcattcacttgaatatatatgatcaagagaatataggagaaatgaaaatgccagtctctggacctagcacataaatagacaactgtttctacttctttgatttaagacactaatactgtatactatttgtttttctattaggttagagttcattatcatcatggtgggaagtatggcagcaggcattgcagacatggtgctagagcagtagctgagaacttacacccttttcccttttttattcattctctcagtttcccccctctcctctcttccaagtccctccccactcctccattctcccccagataaaccacttttcaaaagagcaggcctcctagagatagcaactgagcacagaataacaagatacaataaggcacaaaccctcatgcaaggtggtcagtaaattgaaattgaaagaacatcaaaagaaatccatcaatgtgagcagttatggacccataacaggaaaggatttgatttagtgtgggtagggtgtaagattaaaaagaaactatgcaacaatataatttcggaagagtaaagttaggagttgtatgggaagataaaattaaatttagattgtagaaaaaggaatgacccaaagaccatgtcctcatcagaaatgagtcctaaggtacttgagtacctgtatctggtggtgtgtcttcttcagtataactctggaatcaaggttaacccaacaagcaactgactaagacagacacagatacatacacccagccattggactgaaatcaaggacccctctagatgaattaaggaaaggctggaagaagttgaggagggcgacaccataggaagaccagcagtctcaaataactcagagccctgagatctctcagatattgagtcaccaaccaggcagcatacatgagctggtccaaggcccccaacacatatatcacagaggtctggctgggtctggcctcagtgggagaagatgcccctaatcattgagagacttgaggcctcagagaggcctggtgtatgcgtaggaacatcctcttggagaaaggggggaggagaaattggatgaactgtggtagagtagactgggagggggacaatgactagactgtaaaaaaacttaaaataataaatactactactactactactactactactactactactactactaataataataatatagcattggcctgtctacacaatctgctttcctacaaggtctttacatactatgccaaccaccaccttgcatataccaaagatttaagtttctataagctagaaatatacgtattaattaatatgtgtttgtgagtttgaaaattcatacaatgttgaatagagttactgcacctaaaattgtatattaaatatgaaattaaagtttgaaagtaagatttatttataaatacatatgtttctccttcattgacataaagtgccattttccccatgaagttgtttattgagtgaatttgaattaatgtagttttaagtaatagttaaaggcaaaagagatctggaaaagaatcatgataagcttggaaaaagttgaatatgaatatgttcctataatcattttggtgaaatagtcatgaatgaaattttaaactgaatacggaattagactatatccctcaccaaacaacccattcttgcctcttggttttagttctaatattcattttaatagcatatatatgatattaaatatttaataacatatataataaacttatataaatagaacatggtagtttaagaatggacagtatataaatgcactagtgtagttgaaacagtttcaggtttgatggctaagattttactcatgattaacttgggccttgagacatacaatcattttatctgtcattcgttcaagaaactttagcattagcatgattaataaaatgacctgatgaaaaaaggcaaagaaagtacaacttttgaaagtgtcttagagtaattgatcctttggtgaattagataatatttatgcttttttgaggcttactcactagtatgggtactattctaaattaagaactttacagattccagacatatgccacattcattttaggtagatgatgaataacttattgatagttcattctttgtgctatctgaatcctcatttcttttaatagccatgatgtcactgagatgtcacttgggtagatgctatcaatgggcaccattcagatttttatgtgcaatgaagccaaagggcaggtgaaagcagacagggtcagactgagtcactaattctttgaagtcatctgtgtgttcccatcaggggaccttacgccaaaatagaacccaattctaacactaccacacacgggatgatttcttttcttttcttttcttttcttttcttttcttttcttttcttttcttttcttttcttttcttttcttttcctttcctttcttttcttttcttttcttttcttttcttttctcttctcttctcttctctcctctcctctcctctcctcttcttttcttttcttttcttttctttcttttttctttctgtttgaagagctgcaagaactctcacaagtcagaatcagaagaggttttaggagattggcagaggctggccttgttgctggcaagagcataatcaaaacgcagatgtttgatcaaagtggagcccaatctgcgaaaataatcctgggcagtcaatgagagagactaggaaggaggctccttcagcaaagaaatgatagaatgtgatttgagtgagtacctgcctaaaaataagtaaaccaattttagagttttaagaccttagaggaacttcagacagatatagttgttaattaatcttgagctttgtatggtatctctgtctggcactgtaactaatcttgtggcaacttgttgttattgtagtgatggttctttttggtttcttccctgttcctgctgtcttttctaaaacatacttctctttgtgcttgttgtagttttttgaaaaaccaaagagcttgaaattcatagctgttttcatcatcgcctgattatatgctctttgataaatccttcatctccccagcttcatattcctcacatacaactgaaaaaaaaaacaactagagaatattttttatctgttccatcttctttggacagagcaaactttataaattctctccctctgttctttggaaatgagaagaatgtaaaagtccttagctagaagcatcagcactttagcagtcaggtctctgagcatataattcatgggtggatcactgatcagggacagataaattcagaaaatactcattaagcacaagccatatgttaggcacgatgctaggtgccagagttgccacaatgaggaaaacacatatggttcttgccttcaaggagtttaatatatgattggcaaagcacatatattaaatactggacttatataagtaagattgttaagaagaataaagataactattgcctagtgggaaagagagcttagaacaagagcatgaatgacttctctgaagaatatactttattaagcacagtaagaaccattgcctagtgccagagagccctataccacagacatggttattaatctggttggttttgctctgattcatgactctacctttagcccccaaattctagatctccactattagtcctacataaaattcagataaaacaaatataggctttgggaaaaatatatcaatctagaaacaaaatatacaaaacttatagaattaggattcattgtcaatgcaaggataaatggcaatgtctgcttccttttctttgacctactcaagtatgagtttttaaaaattatgctctatatccctgactttttttttttttttaggaaagccctctaccctctagaactagcacagttttttttctttttcttttcttttttattagatattttcttcatttacatttcaaatgttatcccctttcctagtttcctctctgaaagtcccctatacctgccccccatcctgctccccaaaccacccactcctatttcctgaccctggcattcccctgtactgggacatatgatcttcgcaagaccaggggcctctcccatgtatggcctactaggccatcctctgctacatatgcaactaaagacacagctctggggtgtattggttagttcatattgttcctcctatagggctgcagaccccttcagcttcttgggtactttctctagcttctccattgggggccctgtgttccatccaacagatgactgtgagtatccacttctatatttgctaggcactggcatagcctcacaagagacagctatatcagggtcctgttagcaaaatcttgttggcatacacaatagtgtctgggtttggtggttgtttatgggatggatccctgggtggggcagtctctggatggtccttctttctgtctcagctccgaactttgtctctgtaaatccttccttggctattttgttccccattctaagaaggaacaaagtatccatactttagtctttttcaaagggacaccaacaggtacttattaacttaccacctctgagtgacctctgaggcagtccagtggtaagaattccatggaagataagaaaataatacccaatggatatgtgtcataatctaatcacctagccaagtaaagactgtcaaacagacctaggttggagatactctatagctgggggtgggggtatctctgaagacactatttaggacctctatctaatttcttctggttatcatattttggagatgaacataagggttattattctcattctgtcggttagcacaatgaagatagagaaggtgtgtaagagtcaaattgtgaagtcaagttcagtgttcttttagtattgtgtaagtgacatgaacccagatgcatagttagaattctccttgggtggtttcaggaggtagatctaagtttcagtactgagatttttgttttaaattgctggggaaaaaaacataatttgaaaaattaggtctggtttactaaatgcttcacagctaataggatggatataaggtaaaacgaccacactagattttactgggattgttatgtattaattctggaacagaaaggctttgttttaaataaatgcaatataacaaaataaggtatatcaaagagttattttaaataactgattctacttgtatattttagattcctttacaaaagtggattaactttctccagagaattaaggaaaatatacttagatgaagcaaatttctcctacacgttaatgctgctgctttttttgttcgtttgttttttgagacagggtttctctgtatagccctggctgtctggaactcactttgtagaccaggctggcctcgaactcagaaatctgcctgcctctgcctcctgagtgctgggattaaaggtgtgcaccacacccagcgtacagtaatgcttcttaaatgatggattgggactctccatgggagactgaatacataaatatacattttgttgggtgtatgacaatagtaaaaattttgaatacacagtggttaaaaatgaattcaaacgccaatgtgttatgaaatttaagtcttccagcctgtctaataagcttcacttagccttactcctgaaaggaaccatagccatacttttctctgtgcatacaggcacattaacagatattgtccttcacttagatttgaaagtactacatgctgtaaattgcactatttttactgtactcacaaaatggtctgcccttataggaacatactggtttaattacggaaaataaagtctttaaatatttaatatgacttaattttaatatgatatatgtcttactatataggtgtcaagttagcatgtatttatattgtaccatgttagattgtttaatttcatttattatattttattattgtttatttgcaacgggtctcactgcatagtctggctggcctggaactgtgtagacctaatctcattatgtagacctagctggccttgaggtcatagaaatgcacctgtctctgcctcctgagtactggcactaaagccatgcctggctacaatgtttagttttaaacatagctgtttggattcatgacttaataaagaaaagatgcttttaaactcattctaagaaatgatgccaatgattgacaaagatacaataaaaaaaatgaaaatcacagacaaattactctgatggatatagatgtaaaatcttcagtaaactagttgcaaattaaattcaagaatatatcaaatcctcattcttcaggaccaaattggcttcattccatagatgtagggaggatacaacataaacaaatcaatgaatgtactatataatataaataaactcaaggacagaagtcacatcttcatttaaatagatgcagaaaaggcatttgacaaaatacaacatctcctcaaaataaaatctctcaagactaggaatataagggacctgtcataatacaataaaacctatatatgacaaacctatacttaacatatactaaatgaataagttcttggagcacttcaataaagatcagaaacaagagaaaggtgcacactctctccactactatcttgatgtccttcagcattatttaaaacaaaaagcaattctgaggaaaaagaatactgctacaggcattaccacacttggcttcaagatacactatagagctctagtaataaaagcagcatagtggcacaaaaatagatatgtagatcagtgcattttcataaaggactgaggtataagaacatgtaactacaacctctcaatttttacaaaatctccttaggaaataagaacaatgatcaacaaatgggatcctgaaagggtctctggagctgtgtttaaaccgggaagtgaacttgctcaagaaataagaatggaaacctggtggagattgactctgtcaacctgggtcagatttagtagaatgtaacaacaggtggtttactcctaatatgtttaagccctgtataatttggaaaaagacttccaggtttgatacaattctcatggtaaaaagaagcacaattacattgaaactcaactcacagtgtcatttcttctaagagttctagaggtaggctagctgtactagcttaagcgcctaagggtctgaactggtcttggtcttacaggtagcacaggtgtgctatttgcacagatatttgggctatttgttaccactgttcctgctcatgggaggttatgggagcctctaggtataagggtcatttagattgctagctacctacagtcctggttgtagaaacttgatatggcctggcctaacagataaatcaccagactgttaacaacttccaattctcatttttctagatttaagaacagggttttcatctttcccattggaaagaaaatcctgtgtgattaacattcttggtttccttagtacaaggaccttcatgctactctcacaacataaccccatgaaagtaaaagcttctatatagcagaggaaactgatcaagtgaagcaacagcttacagaatggcagaaaaatctgtgttatatctatatctgaaaggtaattaatatctagaatattcaaaatacttaaaaattaaaacaagaaaacactgaaataaaacaaattgatacatagaaaagtaaaaattaaaaatatgttgagatagaatagccattatcataagtataagttatagacaggatgtcaaggaatagaaacaccactctatttttttttgaaaatgtaaattggtgtagccactatgagagtttctcaaaaagctaaaaataaatataaataccacatttttatctatatcactcttgcaatgaatgcatacactaaggattctattttctactgaaatacacttgtagattcaggttcactgttgctctattcagaatacctaagaaatggaattagcctatgcctatcaactgataaatagataatgaaaatgtagttttagataaaaaatacagagaatgtaaaaatattatactgaacaaaatagccaaggtcacaaaatacaaataccacattctttttggaaacctactgttttgtaagctaataaaaagcataagctatttttgtattttaaaaaaaaaagcttgaatagagctacattgtatggatgagtaaagttgctccttaaagctataatttattaaagatattaagtgaaaatcccagtatgggataccattctattaattgttggtcaatgaattccctgatatcccacccccccaaaaaaatgaaggccattgtcattcttctcatttctcacaagatagtaagacttccattgaatatatcattccatttggctgtagaacattgagaaatcaatcaggagcttagtcggaagtttctctgctggctaggtttcattgtgccagaaaagtcatctaccttcttatctgtccatgaatcctgtgagctataataccatcctatcaagaaagatttgattaatggtgtaatagtggcatgactgttatacaggtgaccagttgttttctgtttgaattgtagtcccactatacaaggagtaactattcttggtactataaaccatataaaaacctgggatgaaagaaattatagactgtaaaatcttttaccattgttttctaaacagacatggtatcaaactggcttctaaatattttttttctattcatatattactgtagttcttagccgttttcacagggacttttctttgaagtgggtgttggttaagacagagattcacacctagtgaatgtatgaagaatagataactattgagtgttcacctcgaaacaggacatttgtatcactccttttgtggctcatggaatactacaaagaaggacagaaataatatagaaaaaatataagagccagaggatgagcaactgtgaaacgttgtctttatgacatgatatggctattgttcacatccacacacagctgctgtatctacctgctgaaaacctgtgcaatattggactatttaatttcaattataaagatagagaggttcaagaggcaccacacctccttggggaggcagcccttagcaaataatggctaccaggagaatataaataattttctttgaaaaataaaaagccatcttttagaacagtaaatactgcttaattttacattctggtaataaaaataatcaatttttattatctggtaataaaaaatccattttcattaaagaaacaggggatttggaaaacataaaagaattaaatgtgaacagctaataattcctaataagcagagcaaagcagagctgattctagtccaaacactcccatgtgatttagacatttattcattttcaaaagcaaaacatttcttttgtacatataccaccacacactgacacaagtatgcatacagacaacaagatgagaaaatattctttgaaacaaattacatgtgacatgattggggcttgttatcatggctcataaaacagatgtttctccactgaaatacccttgaattgatgaaactggatgggatgtccccagaaagtaaagaacagaaagacctggggactgttaaactcaacaaaactatattcaactggaatagattggaacccctcaggctgactcaaaaatcacatcctttgggataagaggattaattgatcccttgtgccactctcctgtgacattctcttccctctcaggccttttgtcttttctcaagcagcaaatattcagggaacaggatatgtgctagttccacgagctactcttaaatgttaataactcacccatgggtgattttcttttttcacacatagaattttgcagaatgaacagagggcttacgagtatataaaatatatcatcatataattttgagttttaaagtttgtgtagttctttcccccccatttggacacagaaacctcaacagttctccatttgattctttccctgtccccatttggttataatgaggctttccctcctcccttctcttgtggtgactcagatgtagctaaggggaactttgctcaaacttattgggaaaagagaaaaattatttggcctgaggtcaaacagagaatattttagctaagatgcaggatgcttaatgcagttatgagtgactgaaaatggaattgcaatggaaaagatatttgcattttaagctgtagcatttgctactgagagtgctggcactttgtcataagtgtgtgcatgcatggtaagattttacagcagaaggtaggaaaattggaatcgagatttatttttacatatgtctgcctttctattaagcagtaagcttaatgatttacgtaatgatgtgatggtgtgctttatttttttttctttccctaaatatgcagacctaacactgaaagtagtatgcaaaaatcagaattgattctcccctcttctagatttttcaaggtcagagaagattctcatcaatttttattaattatggcaatttgcatcaaagtccaaacaaagaatttgattcacctttatagtctcctgccttgacatgtatacaatatatgtactcatatattcacaaaacagatgtcaatggaaaaaagttctaaattctaccctctactgttagttctagcagtatgaacttggttaaacattacaaaccaaggcatcaagttaggaatattctgcctaaaactagtcttggaattttgccttggaattttgcagaatgaacagagggcttacgagtacgagtaaatcatgagtatggtgcatcttaacagagtaaacactggcaagagatttatgcatttatttaaatctacggctttatgcatttttcttgatggaaaccacaaagaatactgaagtcaaataggcttgattcaaatctttttaaaaaaatttttaattaaatagaattctttttaaaaatatttttattaggtattttcctcatttacattttcaatgctatcccaaaggtcccccatacccaccccccaattccctacccacccactccccctttttggccctggcgttcccctgtactggggcatataaagtttgcaagtccaatgggcctctctttgcagtgatgaccgactaggccatcttttgatacatatgcagctagagtcaagagctccggggtactggttagttcatattgctgttcaacctatacagaattttatccctcttcccttccctttccacctgtaggactttagttgtttactgttttagaatctttttcttttcatgtgctcctctctttttccaggattcttgctgggatttaagagggaccaacactcctgacctgtagtaaacattctactatcctagtgccaataatcttctccctatgacatgaaaaggtttttactaaatgaatctaaccaaacgtgttagaatttacaagttagttgggtagcagttgtttcttaaacaactaaaccaggtagtttgagagtcaagaaattgtatcattcagagagtagtttagaactcttttatggtatttatgtttcttttaaaaatttattctgcatttgtatatcttgactgtagcattccctccatttactccttctctccattttcccatcacaccttgcctcttccccagaccatcttaaaactcaaacaatatataacagtctgaggggtgcttcgtcactaagtctgaggaagggaagctgcagctaaaatttgtgttcagacaaaaggcaagaagaccctacacattacaaaacaatgattgcttcattttgtaactgcaaatataaataaataaaaatctcatacctatttgctcactctgacgtgagttagccatgatgaccaggaagaagagtgtagtagtttaaggcctgaattcaaggagaagcttcctgaattcaaagcctcactctgcagcttgctacatgcatgacttcagaaaacccactgaactttgctgctccatatgtcaaatagggttgatgataattgggcaatatctatatatactataaagaggtgaaatgactgagatgactttggtaaatcaccttataaagtgtctatcatccattaactcctacatccactttcagtgacttaaaatagggaaaaatacattgaatagaattgattaaaaggctctaccttgttgcagtaaatctcctcccaaatatgccctagcaatgaaaacacaacacagttaatatgattacaagctgtgcgcctagattgggcagatctaccgctacactaccatcttccacagcttatgagacccttagaacttgcggtttctccatgtcatgtgcttctgcttctttttcctcctctgcatcctctccctcttccattttctccttcctctctcccccaccttcctctccaccttcccttttatctgcccaatttcagctctcctttattttacaaattaaggtgggaagaaggtttacaggaaatcacctgagtgttgactcattccttgttccttctcagccactcacaggaaaacggaattaatataaaatataattagccccagggctatccacaacactacctaatgtgacatgatatcgagtcctcttcctcaagctcttacaatgccatgagcctagccaaaccatcatctttaaagttaattatctaatagagagcacatatttagtgtattatgatttatatgtatatgcaaacatatatgagtgtgcatacatatgtatgtgtgaaccctctttcatttatattagaaaaccatatagatgaaaaaggtatctcagaacatgggtacaggcgggaatctaaccattttctttttaagttactgaattagcctgggtttcaaagaatactactactggtttttgtctaaggacttattattacatgagcatttcttttacttggcatgagatcaagtatatacaggaaaacacatggccataaagattaccagtttctattcttctgtgaatgggtaagcaccatcaacatttagaagcatgtacaataatttattgtaatttaaagagttgtattttagatttatctttagtttgcatgtgacattcccccaatgaaagatgtatgggaactgaccacttacagtgatgagagtgagacagtatactttctcatattgagcttcgcagctgcagtccaaataaagctgcaacaatgtctttagtagaaatgaaatgtgaagggacttaaatcaagtgtaaggaccttagagagctttattctccgtacttccctgaaaattgttgtcctatgtgtctaaagtgagagtgagaagtactttctaaacagtgcaaccagttcatggcttagtaccttgaattattccaaagtgttttcaaaatatttttaaatgttcggtgacatactggagctagtcttagtctactatctcaacgtgtgaagaatttaaatggaaaaattatagaaagcctattatctcttgaggtggttcttgtttctttctctctctcttctgcttactcatatcagatacagaattttcttaatttccattgaattttgtacatgttttctatattgtaacattatcaccattatggttaacattgtttgacacatgctatttattgtacactattttaaatacttagcatatatttattcttgacatcaacactgtattatttttctcactgatgcccagaagttaaatatgaccatgacttctgctctaggcaatggtatatctcattttccacctataggtttgcatcaagagtatatagtagtagccacactgttattaactatcaatcatataagatgtatatgagcagatgctaaaaataaactattgctctcaaaacttgattcccccccccttttgccagtcatctacgatatggtatttgtgtaactgaagatactctaggcttctaagttaggctggtcagtgcttggggtgtggaagctgttgattcagagtttggataatttggtattaagtgagtggccttcacatgaagggtttggacagagaatatttacttgacaagtgtaccttgtttttttctctccaagatttatcttcaagtttctctgatgtaagatgcattttatattttttttttctgagaacctagtacacttcaggaaactagaaccagtgtgtttctgggggccatctatcaggtggaacatcagatgctgatttctcactgactgactggcaaggctcttttactttgccattttaaagcatgagaggactccatactgtttttttttcccagtgtccctggaagttgattcacgttcttagttcaattctttaacactgcaccttggcatgatgcctttgtatagaagagatattttcttatgttcttgctttaatttagaagcaaccaaaatgatgtttctcaattaactctgaaactgaaagcacatgtgctctaggaaggtagtcggttctaatggcaacacagagtctgctattcatcattaacaacaacaaacatctaatgacaagaagcatatttaataccttttggctttctgctcatctaagctgaatgtacctgggagtgagtgaaacttaatgtaatagagggggagtatgtgaaaccacagaattttcattttggaaaccattttgtaaggattatagaacccagaacacaaataataaatatcatccaaaatatcagagtggaagactttttatgtatgagtactatatctgcatataagcctgcatacataagagggcatctgatcccattatagatggttgtaagccaccatgtgcttgctgggaattgaatgcaggtccttttgaagatcatactttggaagatggctcttaaccactgagacatctatccagcctttcaagatgcctttaatcatgcatagatgactcacatgcctgagaatcagcaccgagactataaactaagaatgttcaataagaataaggtttacagtggggtggggtttaagatgaacagttgtttctcttggccagactttgagcattttagctacaagctctttttttcctatcatctgattctcctgtctcttctgcttctggtagaagcctggctttcttagcacttaatgggggcattattactattgtcctcataggtatttggccattttatcactgtacccaggtctgaggtctgtggcttctttttagtggtgtagtttctggaggtagtacttccagatcttgatttttgaatacaatctcaagcatgactatggcaaggccaactgttcttgaggatacaacagagacactgtcttggtggaagcactgtggactatttcatttctccagtgggagggttcctcaggcagaagctccttgatcactgtcaacataccacttcagtagctctgctggttcaaagagttgtatttataagctggacctgatgatccagcagcttctctgtttctctgagactctcccagatgccctcagctgcccccagctgctcccttataagttttctcttaggcctctgcagaagtttgaactgctgttcctgtaagctgagaaatagctcaaaggatcttttctcttggttgccaaggcagctgcaggtgaccactccaccctaaaaattaatttttaacttttaaatttgttttaatttggcaaaattgtgtatacttatcatgcccataaagttttgaagtatgtacacattgtggaatgaatggattctacttattaatatacgtaccatctcaaatacctttttaaagtgaggataactgtaatttactcagtgatttttctaaatagaatatatttattaactgtattttctttgtacaaaagatctttcaattcttcctaactgaaaatagcatatgtggtaatattcctacctaactggtcttctgcatcaacatcttcattccacctgattatttctaccagaattcaggaagaatatattaaatgattctctccaataatcacaagcattccttccatgttgtctatggaaaagtttgaacttcacacattttcatgtttggttctgaagtactctttcagtcttttcaaataccatatgttcccagtcatatttacccaatatctacgctgaggtgggagtggttgcatatgggattttattgtgctggtttttgttgtcatactgaattgatgatgatgtgggttgattgtgattgtagcaagggatgactaacatcatgtattgagtgacattggagcctcaccatttaagaactattcaactaaaattaccagtagcactcttgtttatcaatgggaggaaaaacccttggtcttgcgaagatcatatgccctagtacgggggaatgccagggccaggaagcaggagtgggtgggttggggagcaggacagggggaggttatagggggctttggggatagcatttgaaatgtaaatgaagaaaatatctaataaaaaataaaaatggtagaatagacaatttaaaaaaaaccctcctgtttataaatggcaacttttaagctattattgaattattcccaggtttccagaaattatacttgttttctaagaaatgacctccttgcttctacatttggtcttcctttcttattaattcagtgttacatcttggctcagttcttattgctttactagatctccattgaatttgttcttccaatttcttacccacattactgagcatactatgttgtagtggtaacaacactaaccaagcatatgacatggtacaaatggttcttctgcaagccttatatacatctataaaatttgtgagttaaaaaaaaaaggcataggtattgtactggctagttttgtgtcaacatgacacagctggagttatcacagagaaaggagcttcagttgaggaaatgcctccatgagatacaactgtaaggcattttctcaattagtgatcacgggagaaaggctacttgtgggtgggaccatctctgggctggtagtcttggttctataagagagcaggctgagcaagccagtggaaaacaagccagtaaagaacatccctccatggcttctgcatcagctcctgctccctgacttgcttgagtttcagtcctgacttcctttggtgatgaaaggcagtgtggaagagtaagctgaataaatcctttcctccccaacttgcttcttggtcatgatgtttgtgcaggaatagaaaccctgactaagacaggtatacaaggaaaatgagaattggctctctaaaatggcatctttttgttcccagaagactttgtaagagagagggcaaaggggaaaggggtggctatctaaacaaggcaggtagaaggccctagaaaacacctagaccagtgtctgttttatggacttccagctctggggcccctcccatcccgagggaagctgcttgcaacagggggtttacttttcctttctcaaaaagatttgtctttttttcttccctgatgttcagttctttgtttttctcttagcacaagcttcagcatcccctagacaactattagcaacccctatcccaaaactgagtgtttgtttattcattcattcataaaatgaaaaggttggactatacattcccaaatattctttccactactaatttgccaggtcttttggctcatatttaattttcatcacactttaagtattgtacaatctctcagcatagcattttgcacatggaataccttaaatagttgttgatatggtcagtcaaggatagtttacacaacatatcttttgttaaaaaataacactggctatagactgtataacacattgtacttaatccaataaatgtttatatgtaggttaggaaaaagtcagtgtcccatttgctaaggtcacttaagaagacaaagaagtgctagtattggataaatattttagtgggtggttgttaataatacctcctttgtaggaatgaccatacatatttaatgaatgcaaagaacataatcatttcatttcctgaaatgtgtaaaaatacctcttacaaagtagaaataattacagaagaaaagtcacgttggtttataatcctgtaatcttaaataggctgtttgtcttaaagttagaagtttttgtaggcttcagatgtgttcaactggtacttgttttgatataatagttcccttagagattggctagaatcacaaccatgctatccagatgtgtattcacagctgtgattctacattatgatgtacaggcacaatgtaaagtacctagtttgcataatctttcccagatgcaggaatttcttaagccttcctaaagtgttgtcactaaacctgagaatcatgacttggcttctgtttaaatctcagaactgcctcagctgttaattttgtgaagtcaatcatgttaccagctgataattctctagtgtttacactttaattggaatatttgtatacttgctagggcactgtctccattttttcttttctcttagtaaataacattatctatctgattactgtgccacagttttctttttgtccaatattatcctaatatgaaatagagaagtgattatttttactggacatctggagtcatagaaatctcatttatttatttctgcctgcttttaaaataatataagcacttttcacatacaatgaccctaaatttagaaagttaatgatagcatagcagacattataacccctctctctttccatatgtgtgtatgtatgtgttccatgtaatggctagagaaactgtcatgtgaagcctaaagaagttaaagtatatgtttcatgcagaattcaaattgagaaaagtctttctctaaaacctatacatttaactatcaagctacagtgggagaatttggtttaagagaagaatgtacaaaaagaggtaaccatgaacacagtactctgatcctaacaacttgtttcaaaaacagaaacttcactttttaattttgagatttcggctgaagaaaagattcctttgctaaaaatttcaattttttttttaaagtagaagccttctttggggagactgaaatggtgaagtctgatggataggcacttaaggaaatagaaattccacatattctaggccagatacagaaaggtacatgccaaattgtttaagttacttattgtcttctgcatgaacaggcaagcatgtagccaaggtctctgaaaccattagggagagataaagatgctattggatgtggatggcaagtggtgtttccattttctttcatttttttattagatgtttctatttctttcatttttttattccttattttctttatttatatttcaattgttatctccctttcctggcttcctctccgaaagccccctatcccattcccccaccccttggtcaccaacccacccactcccacttccctgtcttggcattctcctactctggggaattgtgctttctcaggacctagggcttctcctcccattgatgtccaagaaggccatcctctgctacatatgcagttggagcaatgggtccctccatgtgtactctttggttggtggtttagtcgctgggagctctgtcatattgttgttcctcctatggggctgcgagctccttcagctccttcagtttcttcagtcctttctctagatcctcccttggggaccctgtgctcagtccaatggttggctgggagcattcacctctgcatttgtcaggcactggcagagcctctcaggagacagctctatcatgctcctgtcagcaagcacttgttggcaaccacaatagtgtctgggtttggtgactgtatatgggatagatccccaggtggggcagtctctggatggtctttccttcagtctctgctccacactttgtctctgtatctcctctacatacaataataaatgattttctcattcaaaattattggtatcattaacagttgtgtaatttaataaaagttaaggtttggaagcttaacctgtccaactaagaacaacactgagtaccttaatatacctaccatctccatgtagtaaactacattcgttacctgcatctggaaactcatgcactgtgaggactgggactcttaatggtgtaacattcccatcatcatataacaaaatggcatatgtaaaaactggcaagccaaatgatgagaagtcacttgaatttcaaaatattgactttactgacaaggccatgaagcaaaggaaactctcagtagatctaaaagtcggaggcagccccattgttactgggatcttgttctaaataatatggttatcatgaaatatggtccttggactcaacaggatgaccatattttatcccagaattcaattcagagctttcttctattgacatgagtcagtggacctggtattttctttgatgtgttatgtttcatcattttccttgtgtgaatcatgggtgatcaaggttgtattgctattcatttattattttgaagggtaagatatgtcatatatcatcagtgctttgacaatcaggagtgctgtataagatttgaattaaaagtaaagaattttaaaattgcaggtgtataataaagaagcctaaaagcaattcaatcattgctttgaaggttgtttggtctggttctatatccaggtctccatgtgttataatttgtgatgaataagaaaatgctaagtgggaataattcaaatgaatgacagacttcagtctcctctattttaggtagcaatataaattccatgatactttacaagatactcatcattgccactattatcagtaccataaatatgatcatagcaagtatactttataaagtatttcatccttgtcaggtaccaattctatcatttaattatcctaagaaccataattagctaatttcttttatgatttccactcaatggctggggaaattgaagtttaaagaaattaagcaacttttcttgaattctccagctaccatgaatggttagaaccatgaatcaaaaacagtgccgctgattctagaacctgtgccctagctattagtcttggctaaattccttcatagagaagaattcaataaaaagttcatccatttttatcatcatcaaagtgatattagacttgtgacatgcccacataactccttcaatctaaatctaaagaatatattctataaaaaggagcctgcacattttaagctgtttcttgaaactttagaaaggactggtgaggtggcttagtgggcaaaagtacttgatgagcaagtctgaactctttaacccaatccttggaacacgcataaaagtggagagaggattgaccccacagacttgtcctctgatttacacatgtatggatgtgcatgtgtacatacatacatacatacacacacacacataaccacacacacatacatacacatacccccccccacagagactattttaataaatatttttaaacagaaccttgcgatgcaaactaggtaacatgatttacacgtatggaagcttggattcaaccctgaaactcatgtaaagatgaaagcagagaactgactccacttatgacctccacgtgtatgcctggtcatatacacacttatacatatcacacacatacacacactcacctgaacacacctttatacaatgttcatagtaaaaacataaaagcccttggggaaaacacagtactcctatgattgcttctttctgcattgttttttggtttttccttatcaaaaatgctgcatttgtagggaacattgagctataagatctcctaaatttaacttttaaactcaaagtgtaatcagcatagctgcactcccacacaccttctattttaccaactttacaccccccaaaaggttgtcagcagcagagatgttgggcagaagcccagtaaggggtggccccagcgttatttatcagtttacaggttgcagaataaagtacatgtgataattgatttcctcttcatcagcctttgaggctgataactcaattagcatgtcaaatattgactacatagctctttcaaaaatcctcaaagatgtttttttttttttttattttgtattaaggtgtgagagaaatgtttgttgttccttatattttattaaaagttcctttgagtggttccaaaacaaaaagtagtattaccttaatatctgtgcttctttctttttgaaatctgtacgtttcaagaaagaatagtagtattttaaagcaggaagataaataataattttaaactcatgggcaaaataattgtgatttccctatcaccaactgaaagaggacacattcatgattgccatggttcttgtacttgatagcataaattgctgagttggggtaagggccaaagtgttgatgagggaaagtctggtccacagctgaattttgttttttgagacagtgaatttggtttggcatagtcatcagagaaaacaaatgggcacacagccttcctcatacatattagctgcataaacaaaactcaaaatatgggcacactatttctattcaacctttctcctgttttcattgctaagccacttaatgacactcattgaaatggtggctttaaccatgaaaaactgttttctttaatcataaattccttatagaaaatatagtaccaaagtcaagaaataaagctaccagttatttggttaagtagttagtagctaatgaggatactgcctttgaaaaataatctgtgtattggcagacctatttgaaagatccatctgtgctgtagtttccatactaaaacacaaaaacatgtaatacttatttagccttgaaatataaagtcagtataaacgttgcattttcttttctaaaataatatgaatactgtaccctctgttaggtattaataagttacttcttgataatggtttgaattggctagacaacccttgcctttcataagtccattatgaggacattataaaaatatcccagagtatcacgggaaagaaaattttctagcctttgaagacaaaacaataaaaatgtgggtttatgcaatcaagagaacaccttaatgggcgttcttccttctaaattcatccaattgcactataattccattccatgaatatattttgtaatgttaccatagtgaattctcagatggttttcctttgtatatattaattgggtttaattattttgctacccagaacttgctttgctttttttgaaagcccccttcatgtttttatttgcagattatacactttagctctcagcttttgtgcttgttataggttcaggatcaagccatgtaaggctttgcattctactaggcttcagtgatcaattcaagttcaggacattagacccaagtagaacaaaagagatagaatgaaacttaagtgagcacttctggtaaaaaggcttatgctcttgttaatggacatagagttatctaactgtaaattgtacctttagagttgtataatatgaaatgcattagaccaaaaactaaggccaagaatgaaaaattagagatctgatacattccttaagttatcagtatagatatatttaccttggtttatgtagtataataaattacctcctgtttaagtgcttgaggttttattttctgtcacatgtgccttaaaatacccatttgaccatccctgctaagtctgatgctttatatttaacttagtctgaaagttaaatctttgaacatatgcaggggagttggtgggtgagctaacattgacagtggacaaaaagaaaaaaaaaaactgttagggatctggacctggcataacagaatatgttgaaatgaggtacacttttcctagaacagtagtttatttcacatgtgttattctggactctcagtattcagaattaaaagacattttgacacaaaaacaagtataagagatgtatatctaatatatcttagagataacattataacagatatctgaaacttgtgatccaatgtgaatattaggccatcacatgaaagctattatgtgcaaagcaataacacaagccaagtctttagaagttcttgagttatgagttctttatctgaagcttggcactggagatatgaatatatgatggaagaaagattttacataactaaatattactcctttgttcactgaaacagaaagataaatggtttgtctatttagaaactactttattggaatatgtatttgtacctccagtgaggtgtcagtgcagcataaataatattacctaaatatattttctgtcctcatggaggataaaatctgaaatgagtcattttaatatgaatcaggggagtgagattggagcagcaaacctgacatattttgtcatgtaatcagatttttgactaatctataaaagtcaaatatgaattggatgttttataattataagcattctcagctaataaaatctgatgcttccactgtctcccatagtatagcctcttgtgttatttgctaactatcctagaaatcacataccttcttcacaacttaactgccagtcttccaattatgtacttcctttgctatttaaatgccttggtgtgtgtgtgtgtgtgtgtgtgtgtgtgtgtgtgtgtgtgtgtgtgtgtgtgtggtgtatgcacgttaagtgttaacagacttttaagtgccctaaagtaaggaaagatttgcctgggcattcactctaaattagcataaaagctaatgctcaattgtaaaataattggaaattacactttcaaaacaccttaccatcttaaagctactttccaaacgtcaagtgttaacattaatcatattatttttatttacttcagtatcagtgacctatacttatggtcattttttaagaaaatagtaatgaatcttatagttgtagatgatcaaattaacagaggccattaaagcagagggaaaattcataatgaaatttaaaaatattatacttaaatatacataaaataatcataggggtagtttgttatgattcatagagtacatgtatgtttacattttgtgatttttttcctttgtacaaacttcaaatttaataaaacaagtagtgtgattagttatatctctaagattttgattgagaagaattttttagaatgtgtagaacatctgccaattttaagtattaattttagcagattaagcattctctagtgacatgaatagcaaggaacccatggtaaagtattaaatctattgtcactaaggaaatgaagatgaaccatccctgctattataatatgctaatggggaaactggtttggattatgattaacgaaacatctgcatttaaggaagcagtttgaattttgcattttgaagggtatagaagagagtcctgctagataaagtagcaaatagcataatgcgctcaagcaagccccatacataagctatgttcccaaacttatatatcaaacaataaatgctgtggagagacaaggatatttcttagaaagtaatttgatggagcaaattaatggatactggagaatggttgggatgttttatcataattttacacgatttgtcttactgccacgagaaattggcattaggaccacatgtccctgacactttacaactcgtttatttattcctacatggattatttcattcatttaacagacatgtactttctgagcagtctgtaggcctatgctgtgggtagatgaaacaccaagagtacagagttagaaaaatccttctaatagtgcataggagaatatgacctatgctgttttgagatcatttgttaaacttttgctacaacatttaaggtatccattcagttgctcacaatgcttctgaatggtaaattgagaattagaggaatatagattgttcattgaagttgccaagtagactttggaccaccctaagttttctgtgacttactctctttctctaaaaagtagtataatactgtaatgtggtttgttctagtatccgatgggatcagctgtcctctgagcttctaaatattgttctgtcatcacctcccatttcatttttggaacactgcacttacagatacatactactgtacttggtgctacatgggatctagagatttgaactcaggtcctcaattcttgtacagcaagtgatttactcacaaagtcgttttcctggtcctatctattattactttgtgaagaacttccatagtggttatcatagctattattcacatttatatttcctcaagtagtgataagagcttttctttctttctttttttttttttacttttttgtatttgatatattctttatttacatttcaaatgttatccactttcctcctttcccctctgaaaatcccctgtcccctgtcccttccccctgctaaccaacccacccactcctgcttcctattcctctatactgggacatagaatcttcatgggaccaaggtcctctcctctcgttgatgtcccacaaggccatcctctgctacatatgtggctggagccatgggttcctccatgtgcactagcagagcctctcaggagacagctatatcaggctcctgtcagcaagcacttgttggcatccacaatagtgttttgatttggtaacaatatatgggatggatccccaagtgggacagtctctggatggtctttccatcagtttctgctccatattttgtctctgtatctcctccaatgggtattttgatcctccttctaagaagtattcacactttggtcttctgtcttcttgagctttctgtggtctgtgaattgtatcttgggtattccaaacttctggctaatatccacttatcagtgagtacataccatgtatattagtttgtgattgggttaccttattcaggatgatattttctcattccatacatttgcctaagaatttcatggattcattgtttttaatagctgagtagtattccattgtgtaaatgtaccacattttctgtatccattcctctgttgagggacatctgggttatttccagcttctggctattataaataaggctgctatgaacatagtggagcatgtgtcctcataatatgttggagaatattctgggtatatgtccaggagtgttatagctgggtactcaggtagtaatatgtccaattttctgaggaaccaccaaactgatttccagagtggttgtaccagcttgcaatcctaccagcaatggaggagtgttcctctttctccacatcctcaccagcatctgctgtcacctgaatttttgatcttagtcattctgactggtgtgaggtggactctcaggattgttttgatttgcatttccctgatgactgagaatgttgaacatttctttaagtgtctcatccatttggcattcctcgttgagaagtctttgtttagctctctaccccatttttaatagggttatttgtttctctggagtgtaacttcttgaattctttgtatatattagatagtagtcctctatcagatgtacggtttaaaaagaacttttcccaatctcttggttgtagttttgtcctactgacaatgccccttgccttacagaagtttgcaattttatgaggtcccatttgtgagtttttagtcttggggcatgagctcttggtgtcctgttcaggaattttgcacctgtgcccatgtgctcaaggctcttccccattttcttttctattagtttcagtgtgtctggttttattgtggaagtccttggtccacttggacttgagctttgtaagaggagataggaatggatcgatttgcattcttctacatgcagattgccagcaccatttgttgaaaatactgtcttttttctgctggatggttttagttcccttgtcaaagatcaagtgaccataggtgtgtgggttcatttctgggtcttcaattctattccatttatctacctgtctgtcactgtaccaataccatgcagtttttatcacaattgctctgtagtacagcttgagttcagggatggtgattcccccagaagttcttttcttgttgagaatagttttccctatcctggttttttttgttattccagatgaatttggaaattgctctttctaactctatgaagtattgtgttggatttttgatgggggagtttttctttctttctttatagtgttacttttttcttatatataatctaaaagctgtgaaagttcatttcatttacatttctataaagattagtagcaatgaatgatttttcacatgacttttggccattttgttattttattttgagaaatgtctacttaaattccgtacccatctcataagcaggtttcctcttcttagatgctagtctctataagtttctatcatattttgactattaacctcttatgagatatatgacttacaattagtttttttccattccattgaaaaccagtaatgctaattccaaagtcttgcaatccttttttgacagtattatccagctagtcagacatttcagtcttaaagcatattttacagtgtattacctattgttagtacttcctactcagcaccaactcaactgaaaagaacatcgaactttgattcagaaaaaggctttctatggaatgaagaaagcaagaaatgaagaggaagtggaaacatgggataatgttggctttcattcaaaagatctctgatctagaaggtctccaaaatgtttcaggaatattacgtatttttctttgtagaatacatttttactagccaattaaaatgaattttcctttatactagacatgtggtctgttgttatatttcctaaaactcatttcttcacaaacaaaagaaaccagatgtctttagatcaagtttcaaattattcaaaagtcttctcacaacaacaacaacaacaaaatgttcagttcttttgaagaaggagatcaagacacagatagcagctcctgaatgtccccagagttggtcattatagaatttcaccaactttcattgctttttctatggcttctctgaatctacttttcagttttcattgattccttctccttctgtctttcaggaatattgcctaaattatttgttcaaagtagtggtggcacaactgagcttaggcctgtagcttagaacttcttattgggagggcatagtaaaaagaaatggacatttacacagaccatgagaacaagagaattaaatgcaataggtaagctgtttataatgaacacagattaagtagttgtcaaatgcagctcatgtaccataacatagtcaggtaaggataaatagattaaaaatataaaaccacaagctaccactcctaaccacaatgctatcttcaattgactctgctttcaaaggcaaaatttgttcttgccagtcatttcactatgtatattaaccacatttaagtgtagtccccatgaccagcagtagatgggtagcactaaatgagctcaatggtatttttgcagactttttgtctcatatttgggtggtttttttgtattgttttttgtttttttgagcattgtttttatgttttaccggtcttctacttgtatatatggtcattattttgtgtttgtaatgagttttctctgtgtgtgtttatgtttttttttctttttaaattttaatttgtgttttgtttgttctgtttatttgtttgcctttttgctttctaaaaaagagaaagaaaagtaatggaattgggttaggtgggaggaatcatgggaggggaagctatgatcattgaaactctgagaagctcacaggtcctgctcctgctcatgcttatgtaatcacggggcacaagtcaaggtagtattcactgtgatgtgattctagcaggagaacttgccatatatgcagatctacagttaagccacttgtaaggatgtctaagaggaactgcttcttgtaaagtattctaatagtttttttagatttgtatgctgccatgtactacaagtctcactgggcaacagttttatgaattaattataatatttacattaatattatttcatttttagaccttgggagtctttccttccttctctttatatgaagcatcctttggcgtgggaaattgaaaaaaaaaaggcagtcatggttgaacaatatgtttacattctccctcagccacaaattttgtattctaataagtctcatccattgaaaaagctgatgtctaatgtggagcattttattctccaggtattttggaagctatttccttgtgctaatgacttgacatctaaatagctcagtctccctgtgtcattctcatctgcacagtctacagaagactatttggtatggacagaatcaggcttgttgtaggaaattcttttcctagtagatatgtataagatatgcacaccattagcaatctgtcaaaataaaatggagccctttgagagaagattcctaataatagaatagtacaattttattgtagctggataaattccagtttactcatataattaatttaaaacttttttctaccacattgaccaactcttcatataattgtaggtgattatttttagcacttacttttagacgaacattgtcaaaagtgtttttctatatactgtcctcataatattcctaatacattttcagctatgctttacagatgagaatatttgtgcttagcctgcttaagagattctctctcatgctagagaaatacaaggtgaagtcaaaactattctatctatatctttaatgttcattgataacactgtgtaggtatggcaccatagatattcacaagtatggtagtttatataacatatgacaacttcatttgaattttccagtcttctccagacatatctcctcattgagataacttagaaatgtaattttttccattgtcaaattccaccatgacataagaatatcatgtatttcttttaggacattcattttaagaaacacatttaaggcagacctcagttgcaactctattctagtctatgagaaagaggacagttgaaaaataaatcgggaagttaagtatttgtatttataatgatatgaaacataagatgtatatgctttacttcattcatatacctttggatagtcttacagtcacacacagtgtaaagagatgttagtaaatgttttatttccttaatttatttttgtgagattttcttatttgagtactatatgtgtatcattttgcccccttctcctttcatttcttcccgtgtctctcccactgactttgaaattcatgcctaaacaagtaattctcaactgaggaataccaaatggctgagaagcacctaaaaatatgctcaacatccttagtcatcaggaaaatgcaaatcaaaaccatcctgagattccacctcacaccagtcagaatggctaagatcaaaaactcaggtgacagcagatgctggtgaggacgtggagaaagaggaacactcctccattgatggtggggttgcaagctggtacaaccactctgtaaatcaatttggcagttcctcagaaaatttgacatagtactaccagaggctccagcaataccactcttgggcatatacccagaagatgcttcaacatttaataaggacacatgctccactagccttatttataatagccagaagctggaaagaacccagatgtctttcatcagaggaatggatacaaaaaatgtggtacatttacacaatggagtactactctgctacaaaaacaaacaaacaaacaaaaaacaaacaaacaaaaaaaacccaatggatttatggaattcttagacaaatggatgaatctggtagacaaaagaacatacatgatatgtactcactggtaagtggatattggctcagaagctcagaatacccaatatacaatttgcaaaacacatgaaactcaagaaggaagaccaaagtgtggctagtttgttccttcttagaagggggaacaaaatccccatggaagaagttgcagagacaaagtgtggagcagagactgaaggaatggccatccagagactgccctacctggagatcaatcccataaacaaccaccaaaaccagacactcttgtggataccaataagagcttgctgacagaagcctgataaagctgtctctcctgaaaggctctgccagtacctgacaaatacagaagtggatattcacaaccatccactggatggagtacagggtccccaatgaaggagctagagaaagtatccaaagagcttaaggggtttgcagccacataggaagaacaacaatatgaagtaaccagtacccctagagctcccagggactaaactactaatcaaagaaaacacatggtgggactcatgactctagcagcatatgtaccagaggatgtgttagtcagacatcaatgggaggagaggcccttggtcctgtgaagattctatgccacagtataggggaatgctagggtcaggaagcaggagtgggtaggttggtgagcagggggagagggaggagataggggattttcggagggaaaactaggggataacatttgaaatgtaaataaagaaaatatctaataaagaaaaaaattaaaaataaattcatgccttattctttagctatagttgatatacagacacatgttgtttataaatacaatgtgctgagatcacttagggttgctcatatttatttaaagttgacctcttggaattggctattctatgctaactggagaagaatcactttatctccttcagcattcatcaattgcctatagttcttttctgaggaatggatctccttatctacttcagtgtatcaattttttcatcatttatttaggacttgttgaatctagtgagagtacaatgtgcttaatgtcagagtccctctgtccaaaatttcatacgttgggtatgtaagcccatggcttacagtaacctcacatttatctcacatataaatgacttctttgtgtattcttgtagtggctattagcactgttgattcatgaggagttctttacctaacaagaaaatatacaataagttaggacctgtgtataagtataatttattatttccttctaattctttgatttttgaatggaaagttctttcatggggctagagaggtggctcagcggtaagaataattattgcttttgcaaagatctcaggtagattcccagcacacgtggaagtgtccagccgctcataaccttatttccaaaatatctagtgcattcttctggccagtctgctgggagtaggtatgcacatgatggacatatacctaggcaggctgacactcatatacacgaaataaaaataaacacacaaataaataaaaggcaagttcatccgcagtttgggtcatgtgttaatacttcttgaagaaaacattttgcaggcatcaaaaaactggatcctgtgggagaacagtgacaattaatgtaggaacagtgaaagatctttctctatatgagttctcatttgagggtagatgtgagagggtggacaggtagatgcgttatttaatcgaatatgagaagtgtggaggtggtaaacttagcaggcatttctctcattattctccagaactatggcaggaagtgttagtcattctaaaagttgcacagacctgtttgctctggaaacagatcgatgaattggactgttctttagtggagcagccatcccagttagttgccttaggtttatttcccagaacaagaaaagaaactaacttgctccttagtccaatgggacaagaacatattcttttgaacgcttcatcattacgagagcaatttcagaattcattttgatttattgcaactgagcttaactgtcaaggccacctccttaattgccaatgatcccagttgaattcttatgctgaaatgttggttgctggtggctgtttttatgaggtgtttggtgttttattttggtttgaatcagtttttattgcgcaaatattgtcagaagatgtattatctctaccagagtgtctagtgctcaatatacaggttatctccacagtgacagctctgtatcttcaatgtcagatgcactgctcccaagtcatacaagatttacacattctattatacttctattgaacagctcttaatctgctcaggagaaaacatgctacaaacagcaaattttatccctctgcatttaattggaatctctcttggaaagaatggacgattgtatagaaattccccagctatatagagcttattttgagaagatgatagaaaaacccagagtgtagctgatacatcaatattgcggtacacctgagttcttacactgctcactcactgactagtcccttctcccaaataccaataactccttggaatcttgtctgtataatccatatttcagtcactggaagggaggttttatttacagtgaaattttatgctgaagttgggtagcaaggtacatgtgaactttctggacaagtttactgcataatcttctattgattatatttcaaaggatgtgttttcagttgcagtactcctgaatttatgcagaagtaagttgtattgtaatgaggtagttcaaaatttattgagtgattttatctttcaagagatatatttaaaattaggagagaaggaggcaacattttcttctacatattgcattctgcaatagatatagtctcatattcagacagtcatttttctcattgctacttctctcttatatggtatacatctcaagtaagcagatagaggtatcttggctatttgtagtctgagtttgtacagtagatgtaataacgtctaccttaatgttgaaagggatatatgcattataaaaatattcagaatgtagttgttaatcgtggtaaaactttgaagtacaaagtagaatctaaaattatctaaaactcctcttcatttgtttttctgatcttggtttctgtctccatctattttcttactccatgtcttttctcttctttgattgttgcatctctttaagtacatcatgtgagaattttaggtcttgtctttctctggagtaagctcttactttttatgtcttattttctatctttatcagttgggtatctcttcagcatttataaatgtatttagaaatgtcttatacatgaatacagccagaacaactaaatggaaaagcagatgagaaggaaataattataggaaagagaatgataaaaaaatggcacccaatatttatgttgacagggcaatctatttattgaacaccacattaatgttcactttggtagagaaagtactctgggctttgagaattaccattctactttgaattgtaactattttagactcgtaaataaccaggtaatagttataaggttattttaaacatcaccaaacactgctttttaattatagtttctaggcatggcattccctacattcatttaacctatgttggtacttcgtgtgatatgataaggatgtcccaatacctgctttgaacaggagtattgtctattatgtttccatactttactcatcagtgtcataatctctcatttgccttcagtttcatagttttaccttccctttcttttctgtagccaattttccattagcattttagctgccagggatggtataagatatctattcccatagctcagcacttctgccttgttgaaagctgccttagcacttacctcttacctctttcaaaaagaaagaccaaccccaggaatggctgtggcaaagcaaactgctctgtagttggctcaatatctctaaggacactgtacttagtttgcagaaataaataccatgcatatctctgtgttgcatggtatgatttgtcactttggattttcaaatgatgtgttgcctcgctcagctcctcatcagagggcaatacaatttgttcccttcaaacccaccaagaagagagggcattcactttgacattttctcttcagcagcagcccagtaatactgctcttgatgtgtcaggttcttaatgaaatactttcctcttatttctttaacctacaatcagatggcctaggtcaaggttagtgtgaagtctgggctatctttctttttttctttttcccttttgacagacaacatatctactgcttgtatccaaactacagcacctctgctcaggcaaaagaaaatgtggcacaaagattggtttgggtccaaacctattgatatctcagaccttttgctattctcagagtcacttcagtaagttcccaagtggtattgtgtcaaatgtccctcttccaattaaactctattccaaaatgcttcatttccactaatgtaaataagttctaatatggaaggcacaagacatttaaaacatatcataggctgagggtaattcatattttgtgcatatactatatgggcacatattatttcttatataatcactgggaggactatagaaattaagactctgaggggtcaatttgcctacacaagttgatacacaccaaacaaagggctattcatgctctgggcagaatggcatgggatgtgaaagtaatgtgaaggcatgaaataatatcatgttctctagaatggtgcaccatttaaaacttatgaaatatttatttctgtaatttttcatttaatattttagacccctcttgacaatgattaactgtaatattgaaatcaaaagcagtagataaaggagaactactaccattattcttgtagatatcaaataggttttcttgtatcagatatttaaaatatttcttcaaatgagttgagagatgaactaatggtactaagggaacccagagaaggtacttagcccagcccaaggatctaaggaaaaggaaaataaccacagtgtccacgtgaaagggaaaaaatatttctatccattatctttcttgttgtcttcctcaccacttgttttttcatctgtacacacacacacacacacacacacacacacacacacacacacacagttacatctctcaattaaaacagattcttcctgtctttcgtgtttcctctgtgtatctctaacatgatacttatctattgtatccatgaatttatcaataacttattgagtactaaatctgtgtcagtcactgtttcacacactaggaagagactggtaaaacaaaaccaaacaaaacaacagcaacagcaacaacaacaacaacaacaacaacaacaacaaaaacttacatggattttatttcctagtgtacattaaataaacaggtaagtaatacattggcaaagtgagaacagtgataggaaagagtgttgaagagttcaattttatagaaaaggtctttataacaaaggtgagccttctcatgctgtatgatgattttgggtttccatttctggctctgccttgataccctctacttccagagtagtgaaatatgctgtgattttctttgtatgctccaacaaataaaccatggtgaacagggtttggggcaagtcatcattgaaatgtggaataaatgagcctgtcttcttatttgaggaacaagggtctggtgggatggaaggtaaaggaggggaggagctagagcataggggcactactgtaagagcagagaactttgacatttatgacctcggcgagtgagcggttattctcggtaagaattacgtgtgggagtggctgtgaggagggctagagaggaaggttaatgactagagtaatctgcatattacaactccctgctaaacctggacagctgcattctagcttaagggtacctcataacatatgagcctggcatcttatcctagatgtctgtcatccatgagctctcagtacatttcaagaaattgatattattatacaaatacagataactcaaattgatgggtcaaggttgagaaggactgtgctattatgtaagaaatgcttttcgtgtgacttttagagccaaacaagatttctgctttaagtagagaggattctcacaaaggagaaatgtgagccttcagcaaatctcagaagtaaccagaaactagcagataactacgatgaggaggggaagaatgtgagaaaatcaagacaatcatttggagaggatagaattttgcaagtagaaacataggacttaacttggatgttggagtggtttttttgttttgttttgttttgtttttaaataggacagcccaggccttatactgcttagtatatttgaaaattatggctcctcctatatgtacagtaagacttagcctgaagaatataagtccgtagttccaattctaattttctgagagacttgagccactctctggagcaagtgcctctaaaatagatgtgcctttgtggaaccagccttgatacttacctaagaaattttgaacgccgttgcatatgtgaaaacaaatcataaattggtcagagattatgtataaaatgttctatttcccaaaaagaagtctatgggcaaaatacatagtaatactttcacttggttctgagcaattaagatctataagagaatcaacaaatgggacctcataaaatggcaaagcttctgcaaggcaaaagacaccatcaataagataaaaaggccaccaacagattgggaaaggatctttacctatcctaaatcagataggggactaatatccaatatatatatatatatatatatatatatatatatatatatatatatataaatagcttgagaaggtggactccagaaaatcaaataaccccatttaaaactggggctcagagctaaacaaagaattctcacctgaggaatacagaatggctgagaagcacctgaaaaaatgttcaacatccttaatcatcagggaaatgcaaatcaaaacaaccctgagattctacctcacaccagtcagaatggctaagaacaaaaattcaggtgacagcagatgctggtgaggatgtggagaaagagaaacactcccccattgttggtggaattgcaagcttgtacaaccactctggaaatcagtctggcggttcctcagaaaattggacatagtactaccggatgatcccgcaatacttctcctggggatatatccagaagatgttccaacaggtaagaaggacacatgctccactatgttcatagcagccttatttataatagccagaagctggaaagaacccagatgcccctcaacagaggaatggatacagaaaatgtggtacatttacacaatggagtactgctcagctattaaaaagaatgaatttatgaaattcctaggcaaatggatggacctggagggcatcattctgagtcaggtaacctaatcacaaaagagctcacacaatatgtactcactgataagtggattagcccagagacttagaatacccaagatataagatacaatttgcaaaacagatgaaactcaagaagaacaaagaccaaagtgtggacacttttcaccttcttagaattgggaacaaaacaccaatggaaggagttacaaagacaaagtttggagctgagacgaaaggatagaccatctagagactgccatatctggggatccaccccataatcagcatccaaacgctgacaccattgcatacactagcaagattttgctgaaaggacccatatatagctgtctcttgtgaggttactccggggcctagcaaacacagaagtggatgcccacagtcagctattggatggatcacagagcccccaatggaggagctagagaaagtacccaaggagctgggggatctgcaaccctacaggtggaacaacaatatgaactaaccagtacccccagagctcatgtctctagctgcatatgtatcagaagatggcctagtcggccatcagtagaaagagaggcccattggttgtgcaaacattatatgcctcattacaggggaatgccagggccaagaagtgggagtgggtgggtgggggagtgggtgggggagtgtgtgggggacttttgggatagcattggaaatgtaaatgaaataaatacctaatacaaaattaataaaaattttttaaaaaatgtaattgatcatatattaaaaacttaatcttggtatgccccaggtcatctagatattagagaatgactaaagctgccttctaagtcattacttgcctacctcaactgtccaagtgcttgagtttattgagtcaccatgacaaattgactgtttgtgggtttgaagaccttctatttactctctctctctctctctctctctctctctctctctctctctctctctctctgtgtgtgtgtgtgtgtgtgtatgtttatatatagacagctgaaacttccaaacttaacaccttaacacattcttcataaataataaagagacttttgaggggctatcaattctttgctaatatcagcatcagcataattatttgtaatcttagaaaagatttaatggcccttgacatttagtgctaaatcccagtaggcaaggtagatgattactgtggtctcaatctttcttttcctctgtaagattagaataaatagttgtcctttcacattcttgttaagattaaattaaacaagacctatgagtaaacttggcatatactaggtggctcaatgaagactgacacacctctcaagctcactgtgacaacaaatattcttcaaattagaattgcaaatctcagtctatttagtgcatttttcacttgttaccccctactgatgaggcagtgttagccactagcttatattatgcacttgttacttgataatgatcaagaggatttcaaagaggaaaagaaattgatagccagactggtgatttctagattgaaatgtgcaacagtatagccagtaattcaagctacactcttctgttacttgctaaatgtctaacttgtgactacaagggagaaatatgccttgtgacttgcaatttgagtttggcatatgactcttttaatatcactttcagaatctgtgtgtaaatttcaagtcagaaaggttctgtttctagtttcaattcacttcaaacaaatggaactaagatacctaaaatgcattggcttcaagcttatctttaagtcactaatttatttggccaagggccttatgtttgcaaagccatccccttaagagctggggggaaacaagtgagtggcatgagctataaatgaattgaaaattgccttctgttccagcccagtgcaatggttcgtgctttgtaatgagccctagttggcaaggtaactcatgtcaccaggaggagctctccacagactgctccatttgtcaccgctgtctgaaggacacaatgagctggggaagctggcactctgcagaatttttatggtgctatgtttgcacattggtttctcttatcaaactataattcaataatacatacaaaatccccaatgtttaaataattagggtgttgtgacacagcctgaccaaagttagagttaatgcgggcactaagatgttaacttacccaagagagcaagcaggttaaagtaagaggaggaaaaggatggatgctgagagtctctattcgtgatggagtgtgcatctgctttgccctttgtctgggatgctttggtgtgttccatgtagcttcgtgcagtgatttttcaacttggcgtctttttattttccatgtcctcaccctccttctaaaagaggacaaaaagaataaaaggtgaccagaatcataacaagaattcagttgcagtaactgggagacagctttatggagtgagttcagctacttgcacttagaatggtgaatggttaaaagaaaaaaaaagccctcagggcatagatctgctgggaaacaaatcagcaaattaaacattttaaagaaaaacagtgttattattttctgttattagaaaagtagcatgtactcattctaacccctccaaacaacacaaaaaccataaactacagagatcacctttaggaatccccacccccacatacacacattatagcagattacagcatttgttagtattttggtttatctctttactaatctatcactctgtagtctttgcaccttggtttattttcaccaggaaatctttctagaaatgcaattcacatttaggagcttaaatattcttatactcaaattgtcctttctaacacagtattaatttacactgcagcaccaatatatgctagtttagaaagcagctgctggtcgctgctgttcattgtgcaatggccatatgctagacagacagtgttctaagccccctctgtccctctccctccaccctgcccctccctcttctctctcactctgtccttgtttctctctctctctctctctctctctctctcactcactcacacacacacacacacacacacacacacgcacacacacacacacaggcttgagtatctgagtgcatgcttggttgcattctgattatttcttttgtatgtgtgtgtggggggggggcggggtgttatggtgcaggatgttgaaccaaaagctaagcaggggcttttccactcaccttggcgccaggccctgctctgaatacttcctcctaaatagatggaattttcaaaaatctctgctagaaggggactgtgaacatgtgttttataggtgagaaaactgagctttagaaatgttacaaggccattgattaggttaagctagaattttaataaggctttagtatgggaggaaagaaatgtcctgtcctttctactcaacactcccgagcctcctctctcctcttccttctcttctggcctcaccccttcctggctgggagaaatcaaccaatgatagtgaacataaaatctattagagaggcaaagagccatggaattctaagagaaatatggaagtttatctttagtagctctaagcaggtatccttgcattatgctcataattaaacaaatatatatatatatatgtgtatatatatatatatatatatatatatatatatatttagatggacatatggatggatggatgcatacatagatacactgatacttagatacatagatacattcataggcagataaagcataacattgtctttaggctttgttagctgaactctgatagaaaggaaaacttgcacaagtagacctcctttcttttttttttttttcttttttcttttttttttttagaattaatttttttaattaggtattttcctcatttacatttccaatgatatccagaaagtccccaatacactcccccccccccaactctcctacccacccactcccactttttggccctggtgttcccctgtactggggcatataaagtttgtgtgtccaatgggcctctctttccagtgatggctgactaggccatcttttgatacatatgcagctagagtcaagagctcctgggtactggttagttcataatgttgttccacctatagggttgcagatccctttagctccttgggtactttctctagttcctccattgggggccctgtgatccatccaatagctgactgtgagcatccacttctgtgtttgctaggccccggcatagtctcacaagagacagctatatcagggtcctttcagcaaaatcttgctagtgtatgcaatggtgtcagtgtttggaagctgattatgggatggatctaagtctgattcttgctctttctacttttctcactgactaccagcaagaatactgctctttctcaaataaagtgcatctgcaactttccagtgttagactggattgtgaagataaatgtacttaagggcagtgtgtggagttgaaaatggatccttattttctgtgatacttttatgaagtagcgaagcatgtttatggataactttctgtgtgtctatatgtctttttccctttgcagcttaattttttctttttctaaaggaaggtctgtccctctgtagggacaaaatcacatttaaggacctttgagctctaagagtcccatgtctacacttttttaaaattgggtatttatctcatttacatttccaatgctatcccaaaagtcctccacacgctccccccacccccccacccactcccacttcttggccctggcattcccctgtactgaggcatataaagtttgcacgactaatgggcctctctttccagtgatggccgactaggccattttctgattcatatgcagctagagacacgagctccaggggattactggttagttcatattgttgttccacctatagggttgcagatccctttagctccttggttactttctctagctcctcctttgggggccctgtgatccatccaatagctgactgtgaggatccacttctatgtttgctaggccccggcatagtctcacaagagacagctctatctgggtcctttcagcaaaatcttgctagtgtatgcaatggtgtcagtgtttagaagctgattatgggatggatccctggatatggcagtctctagatggtccatcctttcgtcagagctccaaactttatctctttaactcctcccatgcctactcttaagacattttttgctcctgcctttgggttttactcaggattctttcttattttttaattttccattgcttctcaagagaggttaaccttagttttttactgttgctaaaaatcttctgtagaagattaaaaatatccatatggtttatgaagtatgagcaatttggtaagtctctgagatgctagaaaaggatttaccatgatgtagtttgaattttcagcataatggttttctgtcagttatgttcctcaagggattcatttcaatgataaattggggaacagaaatactgtgtgatgttcccccaatgccacatacctaattagtgcagaagacaagctagagttcttatcctttaacccctagttttgaatgggtttcccaagttctgtttgcctcaatgtaagaccataggaaggagctgggtaatgatgagacttgtgaagttgagtaagtttaaagactatggctttctatattatagataatttctgaatttggggttatgttttcctagatttcccatacacacaaataatactgaagatgatagcagtattagtgattttacctactggatcctttccttttatattagggcctgtttcaagtttacatatgtatccacatgcttaatcctcacaacatccctgggaagatttccaatattcctgctattttcatagtagaaaaccgaggcactgaaacataacataattggctcaagatcagacgactaatacagtactgagctaaaatttcagccaaagcagtttggctcgagatcctgggcttttaatccactatattcagcttacaaaagaatctgcttctcattcaatacttaccaatagcccataaaaccaaggttctatgaaaacatatgttggaatgtactattttgaaattattcccagtatgtattataaacaaggttaaaaaaatatgtctagaattctagaatagtaggagcaacatatgagataaaccctcttagaaaaagaagaatcaagagtcataagggaacatttggccccagaattatcgcagccagagtcccccaataaagagaccaaagagcagattataaacttcttggtgggctttatatctgaagttcaggggtaggggtgatatacatgtgataactcttcaccatcatatatgggctcatagcagaagatctagaatatctaagaaataattgttaaataaattattatattgatgacacagaaaaatgcgtcagggaaatctgtacacttctttgtagactacccagcagagatatttgtagttgagcatgtgctttgtgatggtgattgtttgaaatttccaagactaaacctctagacactaattacttgtttgcattctataactgcaatttgggtgagtgccacagttggatggtagaaattacagttttttttttttctagtcggaacatcttagtgacagtatttattagatccatgaaagtctactaagtaagaaagaaagtaatatgctttatttggatttaaaaaaaaacgaaaaaacaaaaacaaaaacaaaccaacaagtagacatcaatcaccttcccccactaccatattgtacagatcagggtactcagggtcagtgactaatgagaaccaactcatggattgatgacacttctatgacattgaaataaaactgcagtttcaaagttcttacgcacacacttctgttagcacgaatcaacaacaaagggatttgcctcaagagctacacctcattttctgcccaggaagccatctcagcgtttgtataattcttaatgaactatcgggcattgactagatttcatgtttgccagcgtgtttgggaaatccctaccatgtatgaatgtattgaattcttcttacaatcaaagaagcacaaagagaagaacatatcatcaggcatttctgcccaaatttcaggtaacacgaattataaatatatatggatttttacagttctgtataggaggtaccatgaaagtaaaacaacatacttaattatagaagtataggagctgtggcaagggattcacactagtgaaagtgctgctggatgtcaggggcggcaaggatcattaaggaatcatcttgcaatgacaacatactggcttttgagactagacttcagcattctcccttttctgcaactctccccttcctattcacacttctcttcacccagcactgtggttaattagataagcactgttcttatctccatggctaaatcattttcttgactctctatgccatagctactcttctgggagaaacatgtgatagggctcatactatgatgaatattttggatgcttacaccttggggagagagattttggtacatgatataatggaaatgagccagtttacttggaaaaaggctttgaaaagaataaagtatgtttttgaagtgtgtagagggatttatgctgtccttaatatcaaaattttatgctttcataaatacatgtttattttgtaagcagtacttccataaagaagggagtgattggtagtgttacatgccaaagattcccccagtgagaagactgaattcatatttcccttatgattcaaagcagtagtgaaatgtcaaccttccatacagcaatctgcatggtttagagattgacctaaccacagagacaggggataaaaattttaaagagagagagagagagagagagagagagagagagagagagagagagagagagagagaagacacattcagaaaagtggggattgggtgggtcttgccatctgtgggaataatagcctggaaactgcaagttttttttttatatataaagcaggaaagagaaggcaggttagctaatctcagtaggaggtctctgtagggaagaagtttcaggttgttctcatggaggggcaggttgcatttggtagtttcagcacacactgtcaacattcaggcaaaagaagctgcagttgatgctttttgcacacactggctttacctaaaggtcgacagcttgtcagcatccctgttcagactggggaaggctctgccattctactgaggctgacctgaaagcttcatcattcccatgggtctgaggcactggggtaattgacacaagctgtgctcctgtcaacaatatactcaggacttcatctattctcatggttctagtagagttaaagagtgggtagtctgtaattgtgtgccctttcttccatttctctacttgagttatttagaatgtatgctatctatggtaggcctttctggctctgctatgctaaatgttgctagatatggaaaagttctagggtgtgaaaacaacatggctttgctccaactagttcctcaaaatgaatctaccttagagaaaaatgtgaagtcgcttgtgaaagcagattttggcctgcttccatctttgtagcattctcaccagaagcagagtgactggggagggaaacatactttttttttttttttgtcatctcacactgtcttagatcaaggttgcacagcacatagtccagcttggcaccagagagtaaagattgtcttgttttcatcccagaacttgatttaggagcaaatcaactcagacgaacaagtcagtctcagcaacatcattgctgagcagagccgaaaagaaatcatttgtttgaggaaacaagcaaacaaacaaaacaacaccctgaagcaagaactcttcccctcccccaatttttcactccacagctgcgttttccaagctggtaaatctcagcttcctaacttagagttatgattgcctttgtccctgttgtttttttttttttttcctttcatgtagtgtacacatttttgcaattaaagaaaatgatagaatgcattattaaaaaagagagtgacattttaaggtttcaccttatagaagggtttggatagttggagctttccaggagtcagaattccctccttgtgaagcattagcctattatccatattagaatatggataagcttgtttactctaaaattcctctgaatacgtaggagacacagacacacttctcttcctgccactgggactgagtctgatcaataattttgtaaaaaaaaaaaaaaaaaaagttcctgttttgggaggaccctgttaaaacctgctccttcctaacaggaagatggcatcttcagtgcccttacaggaaaaactcctgaaaagggtgaagatctgaagttcttagctttggttcaaagatctaaaaaagataatgataactctgagtgagaaccatgctagtaaatgcgtttgattgaattcctactgttctctatgtgcttctggcttcagtcgtgcatgtccctgctgctaaaacagagctagttcttctgacatttgcaggggagaacaatagaaagggaatactgagaagaaggttccaatcccatctttgacatttgcttgataatcagtctcacctagccatccagatcaaccaaatttccctgtctttggaactagtaagataattcttggcttacaggcaatttcaattcgagttaagacaccaaatgttatgaaactcaacacaccctacgtgcaggtaaggggttacctggcaggtccaaggcaaggtgctccctgagaaatcatactatgtgacagacctggtataagggaggggtttttttttggggggggaagtgggggtgaggacctggagaaagggtagaggcagacagactcgagcagagccatgggggcagagaagcagggtggggtggagatggagggtaggcattttggggtgaaacacagagaacagaaagaaggacagagagaaaaagagagtgatctggggtgaccaccagtctttttatatgtcagtcaccagcacttggccagctgcaggtgagcaggtgatgatggaagccatcgctaggtccctgggaggagcctcgtggaatcaccagcaaacctacaataataaccacctcaattgtttcatgggcatgttgtatgaatgccctaaacatgggctttcttaaaagctttgaaaggtacaagcaaaaccaatatcaaactaaagttattgggcagagcgtgcagctgaaggtagaatgcttgtctggtttgtgcaatgctctgatttcgatctcaatcgctgcaacaaacaacaagcaaaaaaggtgttatcagtatactcatgttctttaacagtttttgcatttgcccaaaggactcaatatccttttcccaaatacttgctcagactcggctttctgagaagaaaatggcacttcaacaatttcagcattctgtctctgaaagtataagctgaaattttgagactgtcatgagtataccttttgtttgggagaggtgttccacctgtcactgtgtcagtgtaagtgtccttctaggattcattgatctggggaacagctggtcgacttaaagtgccgttttctatcatcttttgactgtggttgatggaagccagctctttatgacaccacttgttgggtgcttataatacagagccactcaactgggtgatttgaatcattttgtcccaccttactgtcacaacaaccctaccattcctttgttatcactttggagaggtggcttaaagcttctttttttgtggacataatggaaatgcctctatatacttttcaggcaatgctaactccaactaagaaaagccatctactcaattataatttaccttaatatacattgattatacttcaagcatgttttctctgtgttacatgaattaactcatgtaattttcacaatgattctatgaaggagatactaatgttaccttgtctttacagacaatagaactaagacagatgaaaggttaagttactttcttaaaattatattagtaaatctcaaactgaggtaaatggagtctaaattatttactactaattcccttgtttgacaatcttgttacaggtggattaacttttccgttaactgatgttctgcccctctttatagtcacttccagatctgctactgtgcttaaccactcttcaatttgatagttgacctacttaccttgaggtatatcagaaaaacctggagaccgtgtcaaaacttgcctagattgctggattctgatttaggaggcctgggataaagaataaggtgacctggaaatttgtaaccctaaattttcttagttccagaatcctctctacggggatattgtttgggtgttctagcatgggagttcagctgcttgtatatgcttgactaaagactgtattacagggagatcatctttttggactgactgtgtagctttgagattgattcccatggagaggtgagggagtaaggggatagccacctagccagtctgatcaacaaaatcaatgctggccttcagtggggtgtcatatgtcattaccagattaccctcatatccaaacactctacttttgagaatcttgaaagataatcttgttttctctttcagcaggactgcctttcctcatttacttaaaaattcaatattgtcattttagtctacttaaacatgcacctctcccagtgattttaaagctatatcttgatcatatgcttgagcactaatagattggcacacaggtgtgattttaagaattcacctccaattaacacccctgatggctgacagccctcctccattagcttcatcccttaaaggctttaagtgctatttaacttgattaaggaaacagaaatttgaagcatatttactgcaagaatgtttaatgcggggcaatatggtttgggaattaagtgcatacatttttaataagacagatctgagtttgaattttgacttttgctaataataagctatgcaattgcaatctaataaagttacttccctgatcaccaaccttatgagactgtatatacaaattatgtgtacacacacatgcacgtgtgtccacacacacaaacacacagtttgtatcaacataaaactaaaataccacctattgtaaaaagcatgaataatagctaacttgtattaatggtcctaaatgatattcttcatatctgtgacacatcaaaaataatttgaaaggaatctatgaggtagtgtgcacattggtgtctgaatatcaaaccaatgagtgtctgtatgttcattttaacttctgtttaagtttattccattagtagaatatgaatccattaacaaagattactaggtttttaataattgtgcaaataagtgtatatactttttagtttacatatagtttcatttttgaaatttaagaatatttgcagcatagcatgttggaaagcactgattttttttcctgaatattcagccaactagccaacaagaagaccctgaaagacttatttcagaccaattttgatgagcaatggagacagaaagtactagaatatagggtattgcttgaggagagtgtgatttgggagggctgctataatggaggccaatgtgagtatatcatgggggaagacaaaaggcaaccacagctgttgccaaaattcctcagaggatgtattgatcaggtcatcagttcatctattcttaggtgactgatggttttaagcaaacaactatcagcatgaatggtgaactcagctttccaaagggaccatagatattaattcagatagtagagcctatctccctttgggacgtgggtgcctagtgcagggaaatgcactgctgctctattctgattacattcttcagtcaaatcactccagaatgaccagcaaacggcccctgaaataggaaagaattggtggcaggagggaaatttagatttgctttgatagaataattatcttcagggacttagcctctgatcgctacttagattgtgtgaaaatattgctgaataaggcgctgagcaaattcaagttgtcattaagagaactgtagttggtatcattaaattatatccattattcagataaatgttccatggcctcttacttgcctgcctccttttctacttgagcattcagttgagattattttatgtaagaggaagagggtagatggtcttcatcttggtggaacttcatagatgctataaatatttgtaagtagggttacaattgtgtatattttctgagtgtagaactgtgtcctggagtttacattcattatgtggcacagtgtagttacagtaatagtatatgatttgggagcagtttagggttgattcaaagcagaaaggaacaattgtgttttatgtttttatttctaggaatagctgacttcagtttcatgtaattgcaactcaaccacgagctatccaagcctttctttatagtttttcttcaccatttttattttcatttccacccgcatccatataagaaccttttaaatgtatttctagaaccacttaagaaaaggctacagaaattttctcaacagatttgcaacaaatatgtactttcataatacctgcatgctatgacccagatctcagctgaatttctttgtccttccatatctacttcctataatctgttaataagggctcaatgaacattgactcattaacaatgacctaaggaaaatggcatctggaaaaaaaatccagtttcagatatttcatattatacattataaagctggatatcactgatttgtgattcatctcttttctaaataattctacttttgatataattaatacattttgtgtgactataatctacctacttaacataattattttcattgcagtacaggcccatgcaatttgaaacaactgcagctgttgtacacactatttcatgttttgattttcaatttaatatatcaatatttttcatgtttgtccacagtacacaattttattttatactcacttctatattcttcatctagttgatctagcataacttatttagccatccctattacgtacttatttaaaaataaagacaagtatgccaatttttgaatgtgtctgttttgccagcatgcatgtttgtgtaccatgtgcatgcctggtgtctgaggagtgccagaaagtttcagattccctggaactctcttacagatcgttttctatgatgataccaatatctaagaatttctgctacactttgacattcctctcatttctactcggtgtgtggtgatgaaccatctcatagaaaggatattaaccaagcgagaaccatcacacaaattgtataaagttactaaaggatgtctattatgaaatactgtctgtttacttcacattcattagacttctcattattttatacctacttcaagggtagttttcaaagatcggtggtttccagcacccacgtggcatttcacaacctctataactccagttccagggagtcttactccctatcccagccatgacacacaagtagtacacatttaggctagcaaagcactagtacacataaaagaagagcaaatacatcttttaaaagtattttcctttgctcttgactctcctcccttctttcctaccttctctctttctttcagtatttttaaaactcaggcatgtatgttcaggcttttttcttttttttaatcctctgctttcccagcctcctacatgctggaaatacaggcaaatatataaaagatcccttggaactcttataaacacctaacacctggaggtgtttataataccctcacctggaggtgagggtatgtttgataggtaggaagggttgtccactcgtgaagataataaccaataatagtctgttcttctggaggataattgtatcagattattcccccttccatttccaccttaattgtaatatgtagtctgatcaagtttttctgactggactataaaacttctctctgggaagggtattttaatttccaactattctttgcaaaactagatattgacccctttatattaagacttattcatacttagactggaaatgagtaaccttgcaaacatgcaaaagaatcagtgaaacgaggtgtgttattttgttgtctgtgttgctgctgtaataaaacaacaggaccaaaagaaacttaaggatgaaagagctgatttagtcttacagttccagaggcttagagtctatcacagtaaggaaaccatggcaacaagcagctagagcctgaaactgagagatcacatcctcaacaaacaaactgtaagtggtaaggctttaaaatttcaaggttcacaaccagtgatatacttcctccagcaagagtgtagctctctataactctcaaatcagaaccaataaatggggaacaagtactcaagtaccccagcccatgggctacattctcaaggagtatcatgaatgtgcatcttctttgactggccctaatgtagttaatgtcagctgaatacttgctgctctcaattgtaaacaaagatggcttgtatagaggtcagaagacaacctctgatgtcagttctttttctttcacattgtttgagatagggtctcttaatttttcttctgtacatgctagtttatatggtctgtatgcttcggaggtttatatttctctgtctcccgtgttactgtaagagctctggaatcacagatacatgctactgcatccaactgtacatgagttatattttacccatgaaattatctcctcagcctcaaatccttcattttcaaaaatgattacaaagacctaattaggctttaaaatggaataggctgttggaaatatgcataaagctactaactcatggggcatttgattgccttagtgcaccaatgtattctttgttgaaatggagatagagaagcagcccaaaactcattttgatggccctaaaaatacttcagaggaatgaacaaactattttacaggaggctctagcaataagtgaggaaattattatatgtttacacaatggagtactactcagctattaaaaagaatgaatttatgaaattcctaggcaaatggatggacctggagggcatcatcctgagtgaggtaacccaatcacaaaggaactcacacaatatgtactcactgataagtggatattagcccagaaacttaggatagccaagatataagatacaatttgctaaacgcatgaaactcaagaagaacgaagacctaagtgtggacactttgcccctttttagaattgggaacaaaacacccatggaaggagttacagagacaacatttggagctgtgacaaaggatggaccatctagagactgccatatctggggatccatcccataatcagcttccaaacactgacaccattacatacactagcaagattttgctgaaaggactcagatatagctgtctcttgtgagactaggccgggcctagcaaacacggaagtggatgctcacagtcagctattggatggatcacagggcccccaatggaggagctagagaaagtacccaaggagctaaagggatctgcaaccctataggtggaacaataatatgaactaaccagtaccccggagctcttgtctctagctgcatatgtatcaaaagatggcctagtcggccatcactggaaagagaagcccattggacttgcaaactttatatgccccagtacaggggaacgccagggccaaaaagtgggagtgggtgggtaggggagtggagggagggtataggggacttttgggatagcattggaaatgtaaatgaggaaaatacctaataaaaaatattaaaaaattatttggctgctctccctttgtgtcatcaagtcagtaagtatttattaagtagctactctaagacagtattcaaaatatcatgggagatagggtcatctgttaaactctttgctccttcaatcttgaattctactgaggtggtaaaacatgaaaaattagataacacagaagatgaattgttcaaggcaataataaaaaaaaggtgtcatgagatgaaacattattatttgacaaatgagtggtgcacacaaatgctccaggagttacaaggagatagacatgagaggcaggctgatataatgcctttatcccaactatacctctgcccaaaatatccatcgaatgattccttctatcactattacatttttattcaccatttaaaatatatccagtcaagtcagtttatttacaggtcaatctgaattaactctcaaaaatataattgtctgcttttatgagatcatagagttgcaaaactcaccgagtctacaaaagtatgtatacttgtttaattatatattggactcatacaccagtccatgattctcaaggataagagtgagttgatatgaatctctcttttttctttatcattttattttagagttggatatatggtataatacagtgttaaatacattatttattaaagtaaaataaatgagtgtagttgaaacaacacttgattttggagtatgaattaaaactgcctgaccttagcaactgtttatctttctgaaatatgtgtcatttcatctctttgaactaactgaaatgatttctaaagtgtttgagcttaaaatcatagtgttagataagagtagttatcagatagcctgtaactgatgttgatagtaataaaaagtcatagcaatagctaacattttttacctagctactatgtgctatgcatagaacatggcttcttactttcaactataagagtaaacctgtgtgaaatttctattattatagtcattttccagataaaccaagtctaagaaaggttgaagaattaattcaaagtcttataactttgagaacatattgagaagtggactttattgagccaataattctgagttcttaatagcagcaccagtcaacctgacgggtgcttatatatcatgagaaaacaattaaagagtgaagccaaactgaaccctctggaaattctagttcagttgatctgcggtgtggaatcagcactgtcagcttttaaaagcttcctggttgacttgagtgtgtgaatatgtttgggaactactgcgttagagtctacagtgtttgaagcttcatctgggccttgtgaagcggtaagctttacatggggaagagaatggagaacattccagataggaattgcttaaataacaaaggtgatgtattattttctgatttttttactgcttgagtacctcatacagtgtctttggatcaaagccatcccatactcccttgctttcaagtctttcgattccctcctatcgcttttcccttgcaactccacatacactgactggaacccactcaattcttttggtgctgctagtatgtgtgtgggtccatggccttctactggaacatgagaagcttctcaggggctatattcccaaaaacaaaacaaaataaaacaaaacaaccaatacaaaacaaacaaacaaacaacagattctccttcacttagcagccagtagccctctcaactagctcctcagctctgggtgggactttgtgaatctcttccccattcatgtggaattctgattggctttatcccatgcaggttttgtacagccacaggcactgcaattcttacatgaatgagccccaacacatcagtctgttgcagcagtgacacacaacctctggctcttagcatgtgtcttttctgcagtgatccctccactgtggcaaatacacactatacgtagatataccagtcaggagtaagaactccacagtcttttattctctgtgctcctctgtgagtctctgcatcattagccatctatttgtggattagttacttttctgttgttgtgataaaataccatgatcaaaagtaatatgcaaatgaaagcatttatcttgacttatggttacagaggaggaagagttctatatgtaaaaggacaagtgatcttggtgtcataattttgtatcctgccacttggccaaagtattttcaactgtagaacttttctgcattttttaatttttttaaattttctgaatttttaatgtctattttgtgtggagtgatatctataaacaagactattttgactcctttattacctgttttcattccttttatgcctatctcttttcccttttcctctacttaaaacttcaagcagtatatggaacaggagtggacagaatggacacccttgatttattcctgattttacaggaaatgcttcagtttttctctatttagcatgatttaggttgagatgtattccttgtatttctagtctttccaagactcatgttatttactatgaataaattttagattttgtcaaatactttgtctgcatctactcaggtgatcatatgattgtcttttattctatttgtgtgatagattatatttaattttacaatggtgtggcatacctacatttctatgaagttgacttgattgtgattagtaatcttttcagtgtgtttttgaattcagattctaagtactttattgagatttttttcttttgtatgtggtttcatcaatgagactgacctgtaattttattttattttttatggtatcttcatgtggtttaggtatcagtgtaatgctgatctcatatacagaatttgaaagtcttatttacttttctatttcattaaataaattgataaacatcaattttagttactcagtcgttggtaaaattctggagtgaactcatttggaccttggctttttttttttatttggatgtttgtttgtttgaaaacagggtttcactatgtagcttcagctgttctggaactcactctgtagaccaggctggccttgaactcacagagatctcccttcctctgcctcttgagtgctgggattaaagatatataccactatgcctggctttttgacggagataatgtttcaattatattgcttgtgatatagctgcttatttttagtctcttattaatttcactttggtagattatttacattaagatttcctccatccaggcatgatgatatattacctcatcagcatttgggaggcagagacaggcagatctctgtgagttcaaggcaaacctggtctacataatggttggtccagctagggttgcatagtaagacctagtccctaccttcagaaacaaaaatgaaagagaggaattaatttggtggaatataggtttttaaagtatgtctttatgatcatctggatttcattctgttgttgtaatgtctcctttctcatgcctaattttattcatttggttatcctctttctttttttttattttttacttttatcctgattttttttattaaattcatttatgtattgacttattacccaatattagctctcagccccctgtcagtaccccctcacacatgtcctcccccaattaccccttcttcttctctctgggtgtcaacatctccagcctcttggctcccgctgccaccctattccccttcatcctcctcctcaccaccaccaccaccccaccaccacccctgaacatcaaggtaatgtgggactaggcacatcctctcccactgaggccaaacaaaacagtccatttagaggcattagatccacaggcaggcaggcaggcaggcaagcagacagacaaacagacagacagacagacagacatgcacacaggtgaaaggaaaaaggccaaatgccagaggcaaaggcaaaaggcaaaagacaaaaggctcagggatagccattgctccagttgattcagggaatccacatcaacaccaagctgctcatctacatatgtgcagggggcctaggtccatgttctttggttggtcagtcagtctctgggagcccccaagggtccaggttagttgaatctgttggtcttcctgtggagtccctgccctcttcagatccctaagtctctctcccaactcttccagaagactccctgagctccatctaatgtttcagtgtgagtctctgcatttctttccattggatgctggatggagcctctcagaagacagttaagctagattcctgtctgcaagcataacagagtatcattaatagtatcagggattggcttttgcacatatgatatgtctcaatttgtggcagtcactggttgccacccccccccccccaattttctgctctatctttgtccctgcccatcttataggcaggacaaattttgagtcaaaggctttgtagttgggttattgtccttatctttccactaagagttctccctggcttcaggatccatatcccccactgctaggaatctcagctggaaacatccccttagatactatgggacctctccccatcccaattctatggcaaatcctagagattgcttctccccggttagagatcttaattctctctccctgctttccctacatttgatctcccccacacttctcccctccccatcacctcttttaccccattccctccatccatttctaatatctattttatttccccttgtgccttccttgttatttggcttctttgggtctgttgattactgcatggttaccttgtattttatggctaatatgaacttataagtgagtacatagcatgcatgtccttttgggtctgggatcactcacacatgatgatatttttttctagttgcatccatttgcctgtgaaattcatgatgcccttgtttttgaaggctgagtagtattccattgtgtagatataacccattttatcccttcttcagttgagagatgtctagattgtttccagtttctggctattatggataaaactgttatgaacatatttgagcaactctccctgtggacggtggaaaatctcttgggtatgtctaggtgtggtatagcttgttcttaagatagaagaactattcccaatcttcttagaaattgccaagttgattttcagagtgtttgtaggagtttgcactcccaccagaaatggaggaatggccgggcggtggtggcacatgcctttaatcccagcacttaggaggcagaggcaggcagatttctgagtttgaggccagcctggtctactgagtgagttctaggacagccaaggctacacagagaaaccctgccaaaaaaaaaaaaaaaaaaaaaaaaaaaaaaaaaaaaaggaaaaaaaaagaaaaaaagaaaaaagaaaaaatggaggagtattcttatgatatcctttagtcatctgtttttccctggtgaaaagtgtttatttcaacttacacttccagtgtcgcttctgtctccaaccggcagaaaagagcaatgacatggcgttcttctcaaagcagtttattcgggaacctttcaacatgcaagcaggagtctctctagcccccagtcacaatcccttatataacccctcaaccacgccccatcagcccagtccatgtaatctcagttcattagccttcgccaaatggcctgatcttgtgtcatggtgtgcctgcacagctttcacgatggacatggcttattttcgggtgtatgaggaagtcaggtgcaagtcataagacttggctgcagtcctgggcaccatcttgggactatcaccacacccgctccccatatatctcccttttttctttttttggcagagagaatgtctgtcttaggttgctccctgcggcaatgccccttaaccgtcattaggagacacacagctttggtttgatccctgtcttaggtaggtgacacgcccagggagtcttacccgtcattgactacttctctagcatgccaagccacacttgaggagactgtcctgtctccaccactgcaaaagcctgtatcattaaggcttgggttctacggtgacaaaactctacatggcaaatgcaccaaaaggccaggatgctgattaatatcagacacagggcaagtccaccaattctagcccactctttcaagcaggagacagctgtagatccagctggccagtccttaaggtactgagctatccgcaatacccgtggataaattactcacagccgcagcagtttgtaccacagaggtaagggatatggccacagccgtggctgcggtggcagaaattgctatagcagtgacaatggctgcagtaatgccaaaaatccctcttaggtctaaacaaaatcatagcataaggagcttgaacaggccaagatacaaagaaagacatcctactcacaacagctaaatgatattcagatgcattccagcacatactataataacaaatatcactactacaattaacaacattattctcataactaccattataaacaataaacacaaaaggaggccacaaacaaacaggcatagccttaaaggaagcattgtgccctccagcaagttgagatacagaggtttcaaacacactagacccattccaataaaaatgtgcattaccccatgcccctcccactagcatactcagaggagaaagatctgtgcaactaccattcacaccacacaacaaccacacatttctgagaaatattttgaatcatttgaaagcacagcaatcccctcaactgaagctgcatcggttcctgcacaggcgctatttccccatcccatggtaaaaagggtaactgcagtgaagcattagatatgaaaaaccgagggaacacttgtgccgaatgcatcaatgacatgggtttgggaaacacagataagattacccaacgtggatcttcagccatcaccatgggaagtatcctcaacaccaggaacatccacgccgtccccacgctgtccccactccactcattttggactgctctggtcaaccactcagggacccacagtggctgtcgatgatcctgaggaaacacacaaacagattctcttgcccaaaccaattgaaagcgctcgctcctctcttacctgattcagcgcctcattacctctctggagttctgcacatctttctctatcttctatacaatttctcactaacttccagaactgcaaaaccccttttggtaaaaccccctgttcctctccaaacctcaagtccccatggtgcttggtgcaacttgtcccaaaaccgggaaccttatagtctcaatctgagaacttgtcccaaaaccgggaaccttatcatctcaatccaagaacttaacttgtcccacttacctgggaacttaccagctagctgccctgactgtgatgaattctgaacgtccctgtacgggctaccacttgtcacttctgtctctgaccagcagaaaagagcaatgacacagcgttcttctcaaagcagtttattcaggaacctttcaacatgcaagcagaaatctctcgagcccccaatcgcaatcccttatataacccctcaaccatgccccatcagcccaatccctgtaatctcagttcattggccttcgtcaaatggcctgatcttgcatcatggtgtgcctgcacagctctcacgatgggcgtggcttattttcgggtatatgaggaagtcaggtgcaagtcataagacttggctgcagtcctgggcaccatcttgggactaccgccacacctgctccccacattccaggtcacaatctatcagcacaatgttaaatcctgtgggtagggagtagtagaaggctacattggagttcctcactagcttggcacatgttcacaaatggcaggagcttggagatgcaggacagggtgcgtgtgggagagacctgcagaaagactgaagtttggcatgcaggtccacagatagcagaatcttgggatttgagggaggaagggggaatgtgttttatttctgaggctggagttggtttattgtatcagagttactaagatccaagtgcaaagataagagtttttctgtgatgcaattttcacatgatttcatagtttcagaaagagatgacttctacacgggttgcttcaggctcttctatcaccatccttctgctacaagttaatgggaaactagagatagcagattctttttatcctatggagtagactgcaaacctgtaagttcctaagcagtaatttaaatttggaattggtaaatcagataatctggatgagaagcttgaatgaaaagaattacaaaaaggctcctgaaatggcctacttgtcctttgtggtataaaacttgtcatgggtttgtctttacagatcctttggaaacattaacctctgatcagtacccataacaagaagcatattttgagttctggcagccactgctactgatgtttagtttagcctcctgcagtatccctaagggtatagagaactggaatgagactttcagtaaaacggctgctgaataacttttgttcacactgactcaatgctatagaattttcagaaagggtcaccttgattaggaatattttaaagttctgcaattgcttgacgtttgtaagcctatcacttagactcagctggtaatttacttcctacagacaaattaatgttttgattgaattatccattgacttaaaaatccaattattcattttggaagtgccattttgggttttctggaaatgggttacagaagaggccagcagcagagattctcagtactctagtgaacaacatcttggcaccttggcatcttggcatgacttcttctaattggctcaactacagaggcttatggctttaaaattggaagatcaccttgggccaaatgcagacacatagaaattacttccttgtcctccattttcgactgcctgctcatatctaaacactatgacaaactgtatttgggcccagaaactatttacatctttgtagaatctgtccccagattttctgtatccatgcccttgatgaataagtactcggttgaaagaatgcattctctgaggaagaaatggtacagttctgagaagcaaaatattcttgtcaactgatgctcacacttatcctaatgcacagaaaggagagatgatctgaaaatcattaaaattatggcaccatgataattatgaggaaaagtatgaacaaaatatcagtggaaattcagaatttgagtctttcatcctctgctttgtaatgcacatgatgtatgctagatttatgagccatttatttccacctgaatatgttgggaaatttcaattaggtaatgcatgtgacatttatcatactatacacacccagtaaaattgtaaaaaatgtacattattattacactagcattttaagtcctttcatcactactacatatttttggtaactttcattaaagatgctcaccccacctaccagtgtgtgtcctacttgtccacatcactaaatcactaaaccttatccaatttctcttcagtccctttggacaatattttctatgatatggtaggtgttatttgtatctttgttaagagaaaagtgaaggatacagtgtaaagaggtcaataagcacagatttgagtaaatgaatctttcaggcaaagcatcctgacatttgagggatggttatgcatagtagtagattgtacaatttgtttccacatgaaatccttgttcttggatttccaccgtttcctctgggccatgcagctgcagagaccactacctgaatgaagggaggatttttgccaggcactttagcaattctttgttttcttcagaatttctccttgtctttcatagccattccaacaaatccagctacaagtttatcttcatggaagggacaatgaaatgatcacaattcctcatatctctaaatccctgtgagaatataagaagaaatgggggtatcttcctggagacaccgttcaataggatgagacctaggactgagttctagtccagagctctctgtactcttggtagtgctttggaataaagattgcctttactgtgaaatacaatgttgttgattttgatttagaacaaaccatatcttaaaaggagattgttcccccttggaaatctccatataaaataaagtaaaactacaaaaacaattgatataccactgtattagaagtggaaatctctcttcattcacaggctttcaccatcaatccctattgcactcataatcatttttaactttttattgtatatagcaggtttccctcatgaatgaaatgtatatacaaatcatatatgcatatgtatatatgtgcatatatgaatatcacatgtaatatatgtaatatattacatatgacatatataatatattatatgtgtgtatatgttagaatcctgtaagcactaagtatctcatttatcttatatatgtgcatgtgctcttaaaaagctggtactcttaaaagctggaacaggatgtcacagccatgaagctatactgttttgggaaactcttggaacaatgacttgaaagaaagattcttgtgtgaggcactgggatatttgttaaataatctgtttctttatagagtttttaattatcctcagtgctgtttatccccccgtaatcctttccccctccatattgctttccctctgcattcccctaaaaagtctctcccatatttttctatttcttcctttataatatttgtgtctctggaggcttaccctgacagtgatgcatgcctggggatcctggtccccaaactgagatgccttgtctggcctcaatgggagaggatatgcctagttgtgcagtgatttgaaatgccagggtggattggtacccaaagagtgcctctctgttctcacagttgaaagcaaggagtgggtaagagggaagagccatgggaggagggggggctgtgatctggatgaaaagtgaataaatgaattagtggaaaatgctatccatgtcccagcattcatatctgtagagccctttctctacctaaccctcatatggtctcctttacttttctgttttctaaggttacttagggttttatactcacatccaaacattcaaatccataaataagagtgaacatgtggtggttttctttctgggtctgggttacttcatttaccttaatatgttctagtttctacctacatatttcagttttctatataaatttgttttcttctagtgttccatagtgtatgtaccaagtttctattcttcatttcacagttgaatggcacttagtttctttccattttttgagctattgtgaattggtcaacaataaacattagtgagcaagtatctctggaataaggtgtcccctgggcatatggcacgaaatggtttagctgaatgttattgcagatctactcttagctttttaagaattcttcacactgatttccatagtggctatgtgttttcagtcccagcaaaaacaaatgagaattctcctttccccacatcatggccaccattttgtcatttgttttcttgattttagccattctgatttctgcacaatgaaatctcaatatagtttaattggcatttccataattcataaggattttgaacactttttatggtcaaaatgatatttcttatacatttctgtttcttttgtaaactctgtttagatcaatagcccattttgaattggatcatttgctttcttctgttgttttagttatgcacacacacacacacacacatacacacacacacacacacacatatatatatatatatacacacatatatatatatactgatattaatcctgtatcaaatatacgtctgagaagattcttccctactctataggcattctttttactcagttgattatttcctttgctgttcagaaacatttttagtttcatgaggtcccacttgtcaattgtttgtcttaattcctgggcaaatggagttctattcagaaagtcctttcttacacctgtatcttttagctgtctgtgttttcctatagcagtttcagtgttttgattttaaattttttatccatttggtgttagtgtttttctgcatagatatgggtttaaattaattcttttatatgtggacatccagttttccagcagcatttgttgagaatactctattctttctgcttgtatttttggcatctttgttcaatatgagatagtggttgttatttttatactcatatttaagtttcccattttttcaattgatatacttatctgttttgtgccagtatcatactgttttaattcaaatagttttgtactatagtttgaaatatgataatccctctaaacctgttcttttttcttataattgttttggctctcctgttttttttgttgttgttgttgggttttttgtttgtttttttgtttgtttgtttttgttttttgtagttctgtaagaatgttagaatattcccatttctgtggagagttttatgggaatttttttaatgtaattgtgttgaatctgtacattgttgttatgatgatcttttttgaaaatattaattctatcaatccatgaacattggaagtttttacattttctagtgtcttcattcacctcttctttttctctaatatataatatatttggtatactggctagctttatgtcaacctgatataagctagagtcattaggaggaagaatcttcaattgagaaaatgcctccatgtaagatccagttgtaaggcacttttctttattagtgactcttgggggagggcccaactcattgtgggtggtgccagctctgggtgagtgggcctgtgatctataagaaagcaagctaaacaagccataggaagcaagccagtaagaagcactcccctatgacctctgtatcagttcctgcctctagattcctgccctgtttgagttcctatactgacttcctttgatgataaacaccaatgtggatgtttgagctacataaataaaccctttcttctccaacttacttttgtgtcatggtgtttatttgcagcaatagaaaccttaaataagacacttgcttagtttcctggatatactcttcagactactgtattcccaagtgttcattattgctacctgttttgttttgttttgttttgttttgttttgttttgttttgtttgtaagaaggttttgtatcctggcatttttactcaagatgttgatcatttctagaagttttctggtggaatttttttgttatcttctatgtttaatattatatcattggcatatgagataattgaatttttcctatttgtaatcctttaatttcccttccttaatttaatgcaccaactagtgttttaaggccagtgttgaaaagccggtagagatggtgaaaaggcctattttcatatcagatttcagtgggatcagtttgagttgtctgcatttaagataatattggctgtatgtctgacatatatggcctttattgtgttatggtatattttctacactcctttcttgaaattttattatcaaggcatttagaattttataaaatgtttttctgtatctattgagatatgtgtgtcaatttatatgatgtgttacatttattgatatgttgaatcattatttcattacagtgcagattttattttgaaaacatgggggggggcacttccaattccatggggagcaaggaatagatctgtttcagctgatgtggcagctgtgttacccaacctatgcctaggaatgtgaggatggtatgggtgggttagagtcttgaacatacacaaggttagactagtgtacacactgtgtgcctgaggctaggcctcagggttaggaatagtatgtataagcatagttccaaagtagtggctctgcccaaacctttgtcccaggataagcttgaaggttttgatattatgtatgtgggataaatccagagagattcaccacactggattagcacacacaatgtataacctggactaagcctggaaattggaaatgatatagctgagctagagtctgactcagtaactaggctgaataggtacccagggtgtacaaccagggctaagcctagaggttgggaatagcatggatagcctgggatctacagaactgaccatattgaatgaacacagagaatttgtgatctggcctaaacctggagactatatatagcatatgcatgctatttttaggtatgagtctcagactggtctattgcccagtatataaaaccagaccaaacctagaagtgaggaacttcaaaggcataactctccagactgggctgagaatatagaatgtgtgacccaaactaggcctgaaggttggatgtgtcactgactggtcagtgtcaggacgtctacttagtcatcttgattgaaataacctacgctatttttaaaatactcaatcagtggtcctattttatagttaggaagttgggaactggaaggatgtgggtagaggtatgctccagcaggtagacctgactttgtatcctaagtaccaaaataaaatttggatttaatgcagccacactgtaggtggaaccagggaaacacgaaagaagaaggggaggaaggactgtagaaagtagagaggtcaaagacatcacaagaacacagcccacagaatcaactagaactacccagccatcttgactgaaaacagggctcacaagtgctcacagagactgaatcaacaatcacaggagactgtatgtgtctgacctatgtcctctgcatatatgtgttggttatatagtgttcttgtgcaagtcctaacagtgggagtggggattgtctcttactctcttgtctgctcttaggacccttttcctcctactgggttgctttgtccagcattgatatgagggtttgtgcctagtcttactgtaacattttatgatatgtttggttggtattctgggaggcctactctttttttttttaaaagggaaacagaggaggagtgggtctgggctaggacagggaaggaaggtgtggagtaggaagagttaagggagggaaaactataatgtggatataatgtaggagagaataaatttataaaatatagaaaaaagaaaataaccaggctaattaaaaagttggggtgtggtggttggtacctggaggcagtggagacaggaagattgcaggaggtgactggccagctagtccatatgtgaaacatggagatgtaggctcagagagaaatcttagcttagaaaatatggggaagaagacatagaggaaggtgtcttattttatctgtcctctacatacatatatccacaacacacacagatcatactcatgtgagctgaacagttagcaaggacatatagaccttagatttcagaaggaaaatggacaagcagaaacaacaaaaaaatatttctacctaaaatgttctacttatacacagcaaataaattggtttgggccttataacagattcatcttagaactataagttgactttatagtttatcccccaagtccaggaattctttaccttatcctaaacccattcttcttttttctccacttacattatctttctagctcttagaatcactcgaaccggccattttttcatgtttttttgcttcttaagcagaaagtgctagagatgaaaacgctaatagtcccctgtgagagtgagaaaaagtcagtgggagacaaataactttccccaaaagtatgaagaaaaccagaatctgatagtgaccaacacaaacaaaaacaagaaagaaaaggctcctgggaagaacaatgaacaacacaggtgaaactacagagtttaagaataaaggcagtttccagcaggttccatgtgatctcagcaagcgtaattgtatgtttttggtcattgttgaagccagaggagacccaattaagaaacaaagagctgctgggaaaatgaaggcattgagataatttttttcttcacaaggaccacattgaatggatggaccaaagtaattggtctctaaaactacaaagagagagagagagagagagagagagagagagagagagagagagagagagagagagagagagagatcaagccaaagggatatttttcctccacaactctatttttgtggtaggaaggagcagatgtttattaaatacaatggcaaggaggagaaggatgactaaggaaccaagccttggaggtgtttggatgtttatggatggataccatgcctgaaacagtttcttttacaaataaagggcagttagtttccattcaagcctgctagcatagaatatcagggcagtcacccatttactctctatgtttcaaggcatgaatgaggatgagacaggcaatgaatacttgggcaactaagaggctgaatgtcatttgtggcaggaatctgagacttgtgctcagatgccatctaggtgccagcgtgattcccttttctgttggttctgcagttgcagtaacaagaaatgtctcttatatccataggttaatgagtttcgggaagaaattgtttagtagaatggcaggaaggacaatgcaaacggccctttgagaaactcaaaatgtacctagaagctgtgactctcaattcaagaggcaaacatactgcttatcaaacagaaatttctaagaaaggaatctagaatgacatagtgtgctaaattgagtaattttcaggctgttattatatcccttgaaactcttcctggaggtgtgcatattgggccattgtattattagtgttcacagtatgacagtcctatatttctgttagtggcataaaatacggatttagtcatggcatataagcatcacatcataatacctggctttgagcaactaatggccctgacctttagaacttctctgtcacctagaaaaatgagggatgctctgttcatagtgatgctgtagagaccatgcttgttattcttacaaagatcaggatatgcatactgcccatgactttgtagtagaattttaatacagattcaacacaagatggttctgcttattaatgttcctttgtgaaaacaccagcacatatctcatggtagttcaacaatctgctttgttaaggcatgccaagcacagaggcgacttatagttcaagtgtgatagtaggatagttcaaaggatcatttgcctgaggaaggtactggagggtagaaacaaaattatatcctctgtccaggacttgttaggttgaagttaattttccacccttttgggcaggatcattttttgttcagaatgctgaatgaggacagaatctcaaagaggattagcacaggtcaaatgctttgcataaggagggggctgcaggatgggaaggtgctcattcacaagtgagtaaaatcacacagaaagaatgattagttctcaactcggttggagataatcattttaaaaatcttgtgttggtcaattcttcatttctcactcagctgcactaggtataaagattatagcacaacagctaaggaccatggtctattcagtgtcttcttccaaccatgacaagaatgctcagagacatgctgttagtgaactatgttgcttctcatgatatcagttgttgaattacttaaactttataaatcctatgttcatgcatacttctgtagctggcttcctgagagggactggaaaaaaactctctgaggaagtagtttgtaattcagatcccaatgatgagcagtttgtcaaaaaaggccagaatgggaaagaatgatcacatctggaaagagcatcagtaaagatacatgagaacttgaatgaatgctcatgggtaggttggaaaaggtaatattagatgctactatagagttgcaagtttcaaaagcacacagatgtaatttgtgggatttagtgtctcaaaggcacactcattgaaaggaagttcataaatttcacatattatgataaaaaaaatagccacatgatcatttgtatagtactcccagtcatgtattaattaacaaccattcacaaagtttacataaacgcctactgtataacaaatgctttgaagtatggtttacatttacctcccaggtcgatagaagttacaggtcactattccagtttagtcatgttaatcagttctcttcttccaatacagtctgtttctatttctttacagtattgttaacttaagcattacattggtttagagagcagtgcccagtatcaatgaagcctctttctgtcattctggaaaatattttctgagtgtgtccttaagctcctggtgggcaagattaggagtaagaaaggaagctgcagctgtttcttcgtgccagtgaagtagcatttgggggagcttttggcttattttcacagctgtcttctcagctagatttgacaaggagtctgtaattgtcattttgaaggtcggtggaagttgcttccttcctcttctctcttttgagacttcctttatttagatcttgttacccacgccccctgctgctgtgttccaatttcccatgtctttttattattcaattatcgcagccatcacttggagcatggctatgtgacttaggctgcttgcttgtagaaatgtgaaattagaactgtgctaaggtaggccacccctgacctgagagcgaaccgtaataggcatcccagttttatattaaaaagattacttaatgttgaaaaggatcaagcaaataaaaacaaaagaagtgattttcctgtcaggattcctctgtaaggaagtcttctccatctgctctggactccagtgatgtcacctttctctgaactgtttcgaatatttctatatgaataagaagcacacgatttatttcttgctcactcattaaaggcacttattttcaacttcttctgtgagtattagttttgttttctctggaaatggcctatgtctctgcttaggttctatcaatattagagatgagttaaaatggcaggcattgcctatggatcctgttcccctaactgagccaccttgtctggcctcagtgggagaggatgtgcccagttctgcagtgacttgatgtgccagagttgagtgatacccaataggggtgtcacctttctcagaagaaaaggggaaaggggaatgggggaggagctctgtgaaggagggaggtggaagggggctgcaattgatatgtaaaattaattaattatttaattaattaataaaatggcagatatatggtttacctattcagtgattacttggtttcatatattattacacgaagaacattatcccaaagaaagagctttacattcctgttgttgattttaagagataactagaattttttttaataatatttctacttctaagttttctttctacttggcattgtagacgtgtagatttggaaaattcatttattttgtgtatcactccacattatgcaagaatatttttgtcttgtttcttaatttggcagaatgagaaccaaaagttttcctaatgagtcactgtgtcctcttatggtccttataccctctgaaaatgcccagaaggaagagataatcataatatgataacaatagagagaaatagggatgtggtaaaaacgaaagagaaagacatcacctgggaccataaattatctatttgatctttggattgttgtgaggaaattgtaaaaaaaagggggggggcgggttgcagtctgtgaagatggaggtatcccttgctactggctgtctgtgctttagaaaccaagaagagcgattaaattgtgttttctcccatcccaaagcttgataagatcagtagtagtgaagaaagagaaagaaaagaagctactaaagtaaaacaacaaatcaaaccataaaaggatgcattggcttcttattactgttgtaacaaaatgtaataatcttgatagcttaaaagagcacatatttattatcttgcagtacaagacaccagacgtccaaaacaagtacttgagaaaacagttaagatacaggaaacactctatttctttttggagagtgtaggggataatttatttcttacttttccattgtctagagcagtggatcacaacctgtgggctatgtcccctttgggacttgcatagcagatatttacattatgatttataatagtgggaaatttgctattatgaataccaacaaaataatgttatggtttggggtcaccacaatataaggaactgtattaagagtgttgcaccattaggaagtttgagaaccactgttctagagacttctctacatttcttggcccgtggtccctttccctttttcaaagaccaacctaccatatgaggatagaccttggtgaatggcatatagacaacataagagatatgtgctaaaaaactgaatgggagccaacacacgtatgaagatgtaaaataatttgtaaagtttatggcagatggcataaaagcagagatatgctatttcaaaataattttgggatttctaatatatgtgaatacattcacacatataatttgtttgtgttagaataaaatttagtattactgttttctgtaattttagatagagtgtaagttaaagtttgtggaagttgtccttatattcaccctagtgaattgctaattgcttggtgattactttgtcctttgtttcaaaacacttagcttaattctgggacacttctgtccttccaccctttcctcatttctcttattcccagccttacccctatgtatcaaaataatgcttacagacctctgtagaaaactttgtagagtcctcttacatttatgtgcgttgtccctcaatgcttatttatttggaatacttaggaaaatgaccttttaaggactattgtatgagttttacctaactttgaggatagctatggatttcatattgccatgtattatagtgtaatcataattcatgtctgaaatctctgctttttaccctggaaattattttacacagtattttagataaacctgaaaaagaagctagaagtataaagttttccattactatctgaagaataagtgagttgttgttctactgataggtcaatattctcctcattttgcgttaagaaaggaaaatagccagtctgttggacaaagagtacttgcatctgttgcctacattattaaatagtcattacttctcatggtggcttcatctttctctgattggctgagaaagaaaagtagccttaaaaccaaacataatttataatcatccgatactaaataaaaatcttctttactcaataaatgctaaggtaatatccagtactttaagtttagtaacggtaatttagaacctgtcagggcagcaagttcaccagagtagttttataacttagtgattaaagttggaccctggaatcataaagaatttgtttgggttctaactctaatactcataacttaatgatcataaacagttatttaatcattctgagataaatttcttaatttctgatatatatacatgtatatatgtatacatacatatgtatatatatattactgaatatcataggttaattgcatttcaaatatgttcttattgaaccatttttttctaggcaagcaagcagttgtcaatccaaggaatctatgcatcaagacatactgtatattgcttttactatgttagggcatgggccttgaattcctgatcttttcaagggatgctgaattttgtcaaatgcgttttcagcatctaatgaaatgatcatgtgtttttttcctttgagtttgtttatgtagtggattacattgatgaatttccatatattgaaccatccctgcatccctgtgatgaagcctatttgatcatggtgaatgatccttttaatgtgttcttgatacatagaaagcggaagaagactgtacaccacactgggtacagcctgagcatataagagacttcaaagtctgcctacacagtgacacacacactccaacaggaccacatctactccaacaagggcacaccccctaatagtaccagtcactatgggcaagcattcaaacaaatgaattaatggaggtcattcctattcatgacaatactattaataagattgtccctattaatattgggtgtatgatggtgatgctcattttgatggagaaactgggtacaaacagataaagaaagacctgtgttttaggagttatggttaagtttgatttcttattgttgtagtgtgagatgattatgaaataataagataaattttatagtttttaattaattagttaattttttacactccatattttattcccctacacataccttccaactgttccacatcccatacctcctctccaaccctgtctccaagtgaatgtccctaacactctccccacctgatctctaaactccctgggacctctagtctcttgagggttaggtacatcatctctgaatgaacacagacctggcagtcctctactatacgtgtgttgggatcctcatatcaactagggtaggctgcctgtttggtggtccagtgtttgagagatctcagaggtccagattaattgaaactgctggtcctcctacagtgtctccattcttcttagcttctttcagcctttcctaattcaacaagagttggctgcttctgtccattggttgggtacaaatatctgcatctgactttctttcagttgcttgttgggtctttcagaggacattcatgataggcccctttttgtgagaactccatagcctcagtaatagtgtcaggccttgggatctccccttgagctggatcccactttgggccagtcactggacattcttttcctcaagctcctctccatttccatccctgtaattctttcaaacaggaacacttatgggacagtgttttgactatgggatagcaaccctgcctctcacttgatgctggagcagggttctacaagtttactctccctactgtagggcatttcatctaaggtccccctctttgagtcctgagaatctctcacctcccaggtctctagtgaattctggaaggttctcccaacctcctatctcctgaggttgcctgtttccattctttctgctggtcctcagggctaagtccttttctctcacccagtaccagatctcccccactccccagcctcgtccactttccctcccaggtccctccctccgttgccacttgtgattgttttcttctccctcccaagtaggactgaggtgtcctcagtttgttgacctttttgagttctaatgactgtattttgggtattctgtacttttttggggggagggggctactatccacttattagtgagtgtataccatgttcttttgtgactgacttacctcattcaggatgatattttctagttccatccatttgcttacaaaactcaggatgtcctcattcttaataactgagtagtattttattgtgcaaattaaccacatattctgtatccattcttctgtagtaggtcatctagattgtttccagtttctggccactatgaacatagtggaataggtgctcctgtggcatggtggggcaacttttgggtatattcccaagagtggtatagctgggtcttcaggtagctctattttcaattttctgaggaacctccagattgattccagagtggttgtaccagtttgcaatcccacgagcaatggaggagtgttcttctttctccacatcctctccaatatgtattgtcacctgaggttttgatcttagctattctgattggtataaggtggaatctcagggaaagtttgtagtttttacagtttttgtgagtctggagttctcagaattatggaccaggattatagatttgatagtagttagtatatatatttcttgaaatcattaaactgactgaactaactctacatgaaatttagatataaatggggaaagggcttaggatcaacagtaggtaaaaactgtagggaactagcaaagaagactatgtacagaaaaaagatagggtcaaagagccctgaatttcctgagtgtcaagacaacagaagagaggtttagaaaagacgtgtgattaactgtgcagggtgagacagaaacatgcaaagaattagaccattttaagaaatttggttgtggtgctagaaaaatcacttagccattaagaaaacatgctgctcttacagaggaattgacagcaattcttaacaaccctgtagctgaaatgagggactcagtgtcttctgacaaaaccccaaaataaaatttaatgtttggctgtgggtctctgtgtctgttttcatcaactgctgtgtgaagccattcagatgacagttatgcaaggttcctgcctgcaagtatagcagaatattatagtgtcagggctgggctctctctcatgtccggggctgagcaccagcttactactaacttggtgttaaactgtgatcccagcatccaacaatgagaattagtcttaatttactgtagtctgtagtgtttctgattgtcgtagcaactgtggaagaacagtaatactggtggggttggtattgaatttcaagtatttgccagtactagaaactcactagccatctctaggtactaaattagcttccttgaattttggtttccttctttgtaaagtaagaatacttgtttggatgaaaattaactagtatatttaaactgcctaacataactggttcctatttgttaaatatttattcttatgtccagactcactaatagtctcatagaaattctcttatttttaaaagtacttaatctgttttcttaaaaatagtaccatatttgtaaaatatatgagggacagaaatttcccagaacaaaaattgtaaaattacaacacatttattttaataaggtatcatagttccaattaatttctctttaattcctatgtattctgattgctaattacattaggtctcttctgaaaataattagtataacaacttgtaaatatcttgcaaagaaactgagtatatataatgcagcaaaatatatgattatacttttgcatatttgtttttaaagttttggatcaaattacttttggtataatacaattatttgtccacttgtaaggtatgactgcttctcctattcattagaagagaatcatagtctgacatttagggtatagatttttggataagcaaattgtgaagccaagatctctaacacaagaaagaaacatatatagacacatacattggcaaacacagaaaccctctaaaagcataaatttgggacccattaaatacaagcaaaatatctgtatagtaagaaaagaatgaaaataaatacccagagaaagcattatgagataaaacaatctccaaaattaccattgagttagttttgtgtatagaaaattcatattaaataatcagatatctatatgagtagaagattattctttcatatttttcctgccatttcagaaaagtgtccattatcttttgacttctgctcatttgcattttactatgtaaataaaatgctgttccattttgaatagtgaaggtaattttcagggggaaccacagggttgattttcagagtggttataccaatttgcatacttattattattatttttatagttgtatattcttttcttacaaattaattaattaattaattaattaattaattaatgtttacttattcactttatatcctgctcactgccctcctcctacaatcctttgcccttccccctcctcttctcttctgagcatgtacagtttcccctggatatcctcccatactcacatatcaagtctctgtgaggctaggtatatcctatatcactgaggtcagacattcatttcttacacagtgcatcacaactgcagttcccctcccctcccctttcccacaaactcactccccctccttttcctcttcagaaaagaacaagcctccaagaatggacaaacaggataaaacaagatacaatactggcttatttacacttacttgttcacagatgagtacacacacacacatacacacacatacacacacacaaaaatatgtacaaacacacgccttcctgattttgtatattgagaacctgcagaattcttgtgattattcatgcccttgaatattctagttgatatcccagcccccaatatgccttttctgttgatttatctctggtatggttttaatatttattgtcaggctttgtactttgactcgtcatctacattattatgaggtttcctcagttttgaattagtagggcttatcatcctgcttgcttatctcttgcttattaacagtgatgaatcacctaaaaggagacttgaaaaatagtatgttatggttgaaggatgtgttataagcacataataatataaaagtcatgttgtcttctctgagcatccattgctgaaattcagagaaaaatcaccctacaacttgggccctgttggggcaatgaaaccagtgataaatattttatacacaaaaggttcattttatagttatggagagttagtactctcattcataaccttacaaagaaacagacacttcatggaaagtaacgaacaaatgtaaaaatattgacagaattttctgtttattagtactgatagccagtcaccacagagtttgtatgcctgtcttcaaggagagtaatgtttttttttgttgatggtttattacatgataacagtttgtccagtattttctcctaagaagcggttagaaacactcaccattgaacacctattttaggcatacttttgtcatacctatgtatattcctgagacattaagcctgaaactaggattcttaggtaaatggtttattcatggaatggaaagacaacaaacaaacaaacaaacaacaaaacaaaacaaaacaaaaaaaaaaacaggagaagaagctaagtgaggacatgccatcaggagaagcagagcttgttcatacaaacatgggttagatctgtgagtgtgctttgctctgaggtaagagagggaactttgtgtccttgtgtgtgtcatccatttagtaatgggtttcattcaaagaagcttccatgaaatgtataaagaagtgacccatcttaactctcgaggtgagtatagttatgaagcagctggaatatacagaccctaggtgactagtgggtgtaacctcgccccagttaaggctgttcaggcaagattatctgctcaaaattttcttatgtcgaatcaaaatttcacgttcacatgtaggcacttcacaaatatactctaacaaaaattgttatacgtaattaaaattaggtatttatcaagatcatcatttgtatctatgtatactaaggaagacagatcaatatgctgatcagtcactatgatctggtaaattttacacttttgttggtgtgaggaatactatgtatgtaatatttgtatagtatcaagctaaggacaagatcatgtgttatacaaattgtatcagagtcagtgtgtaaagtgattagagtgatagggtaaagcctcaaagtcctaaaacatctcaagtgttggtagaaagagtggatggtgaatgctagagtgatatttggaaaatattacaaagtgcaacttgaatatcatctcttaaaactggtaaagaagagctcagcagttatacagtagagggtgtttactcataaaacaatttagtaaactcagaaaggcattagtaaatgcatatgttgggagagatcattagagactatgtggagtggctagatgaacggatttgtgagtaagaagaatgagaagagctcagcagtagagggaagcacccagctgggatggagctctaccaacaagtagtaaactctgaaactgcttctgaggcagtgtcaggccgctaaaggtctctgaacatgacaatttgcttattaaatgatgtatgtggaagaatgatctagacaacacatagaagctgatagagctctctctaatctgctcaccactaaaattgataaactgtcattgatagatgggaactcttttatttaaacctctcatgatagtggcttggatttggaaggcaggtacccagcttacatcttgtgctcgatgacccccaggtttgcaaggacagctgtgaaggtcatcaggtaatcctgactgttttctttaagtggtgagaaagaaagacccattcaaacgttctatttgcttgttgaactaaagcccagagataattattcataatcactcctaaatctgaaacgctacattgttccatgagtcaccatctaggttttaaccatgcacaaacaaaaaaagcacagcgtacttccacacaggcaatttgggaaagcattcagccaaatgttctgcctttttctgttcacttcctgagtacaaatctggattctaacagccaaggacactctccagtaatagtatattcaaataaacagcatgtgtggagcacccactttatgcatagtagggactgattacaaaagaaatcaaatacttttgcctttcagggtgttgcagtataaatagaattgtatgttttaaagacagaatatttgaaaaatgcatgagaatgtttgcaaaacaatatctaaaaggaagcaaataaaatttaaatcagggaaatcaaagggctaagaaaagtaacaaaattggagtgaagcataaagcagttacactgtgttttccttgctgaacaatatatctagttattgaggattattgctgttcatcacatttgaaaatattctttccgtcagtgaagtccctgaatgttaaagatcccatctttctagaaaagccagatgtctttgtgaacatgatgcattatatggaaaactttgagaactgcttctagaaatatagattgagtgagcgtctagccctcagagcagcaggtttgttcactccaagataaatatggacttatctctgccatggaatataaagaaaatacacatcttcttacctcacatttctcttctgagatgcagagacagattcagaaaatcttgagttagcaatccaggctggtcaatgagatgataagtgagcttggatatacctggtgcctggacagttagtcagttcctaactcaaagggcaacccattcagcaaatgcaatatgaaggaattcactacaatgggaatctgggccagaatggactacaagtcatgtctaacatagagggagaaaatcataattcaaaatgcagagagctcaatggtcagcacagcagaagttaagccaaaggtatgggaaatagttcagacttctcccaacaaagtatctctcagacttaaaagcatagctaaaagtagtacaggccttgaaatcagtctgaggacaagtctcatccctgccacttgctggttgtagtagctataataagtattctttgactctctcaagttcctgatagtgaggacagctacgatctttaacatcataggttgagttaagtaccagactcacacctaatcctcaagagacttgaggccccagggagtggggaggtctggtagggtgggagtccgggttgggacatcctcttggagatcgggcagaggggaggaggtatgggatgtggaacagtcagagggcagatgggaaggggaataatgactggactgtaaaaaaagattagagaataataaaaatatctctagctgcatatgtagcagaagatggcctagttggccatcagtggaaagagaggcccattggtcatgcaaactttatatgcctcagtacagggaaatgccagggccaagaagctggagtgggtgggtaggggagcaggacagaaggagggtatagggaactttcgggatagcatttgaaatgtataaaaagaaaatatctaataaagaataaaaaaccaaaacaaacaaacaaacaaacaaacaaaaaacaaaaagcaccagactttgtgcatggcatgtagtttgcactccatccaaggtagttttgaccactaaaattgttgttgctacttctcttcctatgctacctggccattaacataatgtgaaacagataaaaacacaatatatcattcaaaggatattgaattacataatttgttagccctttctccctatgttatgctttttaattgattagcaaactaagcactgagttttttccctggtattttcatgtgtagtttcatgttattagtcctctttctagtcctctctgtcccctcttcctctggaccccaaagtaccccaattatttttcattattttaagtcacatgagaatatacttatctttacgatactgttttgtacctaaagtttacaaaacatttgagacagaaagttttaagttgcttgctcttcagatatttattatgtgaaagcccaaagtctttaagagtcctgaaactcagtttctatctgatatgtcaatgagaaagacaaagctgtctcttgtgagactaggccggggcctagcaaacacataagtggatgctcacagtcagctattggatggatcacagggcccccaatggaggagctagagaaagtatctaaggagctaaagagatctgcaaccctgtaggtgcaacaacattatgaactaaccagtaccagagctcttgactctagctgcatatgtatcaaaagatgacctagtcgaccatcactggaaagagaggcccattggacatgcaaactttatatgccccagtacaggggaacaccagggccaaaaagtgggaatgtgtgggtaggggagtggggggagggtatgggggactttcgggatagcattggaaatgtaattgaggaaaatacgtaataaaaatatttaaattaaaaaaaggaagacaggacaaacactacaaatgctcatggtaaaaagtgcacaatagaaattagtctaatgcaatgatactctttttccacatgaccttggaaggttataaatgattaaagtggcactaaatgtttgtacttatgaactcatgtgtttatagcatatgccatctcaatgttggctaattttgtacatcattttactcctgttctgtcatgcttagtgctgatgtcttatacataagggtaatgtgcacatattctaatggattcagctcaaagtagctttgtgtgctctttgtaaaacttaccttcaaaagctaaattaatatatatgaatttggtagcttcgcaagaatagaagatttaaatagctttgattcatagacagataaaatcgtgaggaaaaggcttctgtaacactgtataaggacttataatctgtgatttaatttattttaaccagaaagtgagattgcaggataaatctgcttttaagtaggttagtaagttggaaacaaatctgttagctgtcacctttgcccctccactttattttctttgtctctaaagttagctaactttcagtctttactgtgtgtagttagcagtcttcactatttagactgagcatattcctagaacacttccaaatgtttagaatttctttatgtggtaatatatgtgcatgtgtctgtgtatatgtggtgagcatatctgtgcatacacatgtgtgtgtagaggccagaggcccgtatcaaatcattctctaccttttcatatgtatagtgtgtgtgtgtgtgtgtgtgtgtgtgtgtgtgtgtgtgtgtgtgtgtgtatgtatgtgtgtgtgtctattgagatcagaagacagtctgttaggggttcagggatttgaaaccaggtcatcatcaggctagtcttgatagcaagcttctttccctgataaacaattggaaccaccttactggccctccactccactattttttttctttttttctttccttttcttttttctttttctcttccctttttctctttctttttttctttttctttttctctttcttttcctttcctttttttttctcatagattcaactagattggctagccatcaacaccaataaatttttctgtttatgctgctcaagaacttgaattagtggggagtgccccttttgttttgacatgggtgctaggattcaaattcagatcctcatgcttttacatcaagcattttactgacacagccaatcctgactgtttagaatttcgatgttttcaagcactcctcaaaaagttcaaaataacaccggttactgtaaaaaaaaaaaaaaaaaaaaaaaaaaactcacagggaaaactattgtttcatctctgaaatctagaagcttacctgtaacacgactcctgtatagttaaaaagttggatattctggagttattgataggctaaagtaggatgatacaaatttctatagaagcttaagttcaagagagatgacttggtaaactgattgtctcacaaacatgaaaacagaagttcaaccctcatctctcatgtgaaagagctgagcatagtggtatgtgcttatgatgtcagttgttggaagatggcgataggtgcatctttgggacttatattacaatcagtctaattggtggcatgttccaggtcccagtgagagaccctatctcaaaaagtaaggtagaactgctcacagtcagctaatggatggatcacagggctcccaatggaggagctagagaaagtgcccagggagctagggggatctgcggccctgtgggtggaacggcattatgaactaaccagtaccccggagctcttgactctagctgcatatgtatcaggggatggcctagtcggccatcactggaaagagaggcccattggacacacgaactttgtatgccccagtgcaggggaatgccagggccaggggggggagtgggtgggtaggggagtgggggtgggtgggtattggggacttttggtatagcattggaaatgtaaatgagctaaatacctaataaaaaatggaaaaaaagaactctaacctccacacacatacactcatgcatctgcacacacaaatatacacacacatatacacaaatagcttttaacatgcatgcaacgaatttttaaagaatgcattcaaaacaaagtcccactgtactccattaaaactagcaaccaacagggaatgattttggaatgtaattatatttctataaagttttaagatcctctttaaaggaatttaccaatgaacagaaatgtatatgttcaattaggttaagccattgtctatttcaccttcacacatatgtttggtctcaatttggtgtgaaatatttcgaatatttttgtaaatgtattttatatgaaaaaacaaaagaaaatgcttgaatctccatataatgaatgaaatggtattccacacagagacatgaggacaagattcccccccacacacacacacacacaaaacacaggaaaatatcttcaagagccaatgacctttcatttagcctttgaataggaagagtcattctttagctagacagcttgctgggaataaataacaatgggattgcaaaaaggagcagagattaatcttttccccacatctctaaaactctgaaacagtaatatggcactaaaactatacagataatggcttgattgacctaccctactcagctcttctcccattgtgattttgtttaaatggcttttaaatttttcctaatgaggctactagggtatttgctatagtgttaaaatgttcttcttccacttcttaaatgctacgtgaaccttagtgaattccaattccttgatattacattcatgttcccatgggtgcccctacttgggatcatttatttacctgtgattctttttggtgtgggaaggctaatacaaaagggaggcaaaatagttaacggttttggctttttggaagagacatgaaagaacccaagtgagatgtaaagctctgctaattgagtgctaaaatatatacgcaagcaaagtcagaacagagaagccacatacaataaaaagagcccaaacttcagaacataattgacctatcctcaaatcccaaccacaaaatacagtgtctctgagatttatgtataggacttacttgataggatttgtatgttaacccagtgagaaatgtgttaaagtagatattatccctaaatcctaattaatgttaggtgttgtgattctcatggaccagtattatgaagctgtaatttggaggtagactcattatttggtctggattggaagggaatttattctaactggtgtagaaaggtagatgtaatgaacataatggaccttagaaaatcatagcctatcacacacctgctcagcacaacatatgtaatacaatttaatgactgtaacttcaggcatcagcctaaaactacttggaggtaatattgctttgcattgcaatttcagtgaagtagactggcagaatacagctcagttttacagtctgacctctactcattacttaaagccacagagtcttttttaatctttcgattttttttctcattgcaagctatttctaagacagacagtgtgtcatgtgataactgaatttcagattctaaaaatacatttagctctataattctagatgataaacctatttaatggggaattttcttttactgctggtttgatcaataaattaaatagattgattaagtcaagctgtcaggaccaaagactgtcactaacttagccagacacattggcccatttgtcagagagaggctggaaaagggcaaactttgtcctataattcagtaacaaatataaccaaataggtcacagcaaacactgctaccacttgcctatatctcaacacgaagtagataatgttaaaacatggggttgtttggctctacctgtatagaaatcatgagtcagctaagagatatttttctaggtatgatagtcttagtccttgaatacccaaagcctatattttggacttatcagcccagaaggcttattctccaatccctgagaattaggggcctattgttcaaatctctaggttctcaggttagaggtgtaatgctctgactttaaccactagtagccctaacacttagtaccttttttcatccttcatgtccaatagcactggagcagtagcaaacatcagcaataattacctagcagtgtagtacctgctggtgttatagttctctggtggttttggattatggacttttccagctctatggtggctagctaatgttacagatattgaacctagggtgttgaggacatttgagagttaaagctgggcgtctctgaactactccttcaatttctcctctatggcacatcatagacatttttcatttcattgcttcctctctttctcgagtgatggttttcatgagcatctcgagttcatcaaagtgtgtgttggcaacatatctagagtaagttgttgcaaactgttgtagctgtgactatgttttctgcagctatgcttaagctttggtagcaagcatagtggagtattgctttctcagggagtcaatgggctgctcacaggagctaggcatgaatgagaagaaccattggaatgctttgctgatagtcttgtacccaagtagcctgagtaccttaaaattttcagaattaaattatcttagcccttaacatcttatttttttttaaaaaaaggaaacatggaaaagagtgcctttaagaaagcaatgtcattaatattatattgatataaaagtgttttaaaaattcttttttttccattttttattaattatttagctcatttacatttccaatgctataccaaaagtcccccatacccactcacccccactcccctgcccacccactccccctttttggccctggcgttcccctgtactggggcatataaagtttgcaagtccaatgggcctctctttccatgtcagtatcctagggactggtagatagcaatcaatctattacaaactagatcaatagttctcaacctatgggtcatgactcctttggtagttgcatatcagatatctgcattatcattcataacagttaacagaattactgttatgaagtagcaataaaatatttttatggctggtggtcaccacaaattgaagaactggattaaagggtcatagcattaggaaactagagaagcactgaagtagaacatagcaatcatctcattatgatgggaggaaagttttattattttaatcagcttgcttgacatttttcctgtttttccgtgtttatttctctatctatatcagcctttgtctttatatatcatatgatgttcttcctaaattttaaaaagaataagccattcttttatttgtaactgaactgaagatatctctgacacagtatacagcaacaatgtgttaaacattatccttgctttcattaaacatatataaaaacatcattactagaaaaaaaaatttttaaaggtcatcttggggatacagatgaagctcagtgggaggtaatttgattagtatgtgtgagatgctgacttccgtgtttaatatcaaatgaaaataggtcttagtgaataatcacaactataaagtaggaagaagtttgttaaattggaatatataatcagaaaaaggtgaaacaattactaatgagtgttccagttagtcactcaaggtgccctatgttctttctaaatacattgtcccttctacccaaactgtgtccctccctccctttttatccccttccatagattttggccttcttgacatctaatggtggctttgcaaaacctggcattgacttctccctagtatttttatttttccttccagaattttattcttagccatataatctagatgcctaaaccactttaaatggtttatggaaaatactagaatctgtttctttactagatgtaagtgtaaataatgtcagaggcttatatgtccagccttctaagtgacagttttctcgaaaatggtttatagaaaattgttttatattttttaggattttatcttataaagctaaagatgatctctaataattctactaaaaacatatattcaacaatttattaacaaatatttgttaagtgttcatatatgccagacatatgtgaacacccagggcataaaataagtactcttgaaatgattttaataatcacacaaacacatgcatacaaacaaatgttctctttcatacatgcacagaacatgataagttctataatacatattataaagggaaaacatatgtaccaagaaaatacatgctcagaagaaagaaaatttgggcttaaagaatgtacagcaatttgctcaaatgtcaaggcacaatttagaaatgttttgatcctgaaatatagaaaacaagtgaaagacctatctggaaagtctgaaataaacttaaatatagaggtcttttaactcacattaaagaagggaatttggagctcaagagatggttcaccagttaagataatttcttacccatacaagggtctaggttttgttttcagcacccagagtggcttcacaactcactgctttcacaggcaaatgacacacagaagatatacagacataaatgcaggtaaacatttataagcataaaacaaaataaactaaaagaagtgaatctgatattgggtatattaatgagcaacaatttgtgagctgtagaggaattttaatccagcaacatggcttctctggcaaaggatcacatccaaagacattctgggcatgtgtgatctggctggaatactgacaaacatttagtacacatctttactccaaaacaatgaaaataaatttggtttgtagaaggaagcagccatgtttgaaagggatgtctaactgaggggcagacaaagtgataaatcagagaaagatttgacagaatgagtcagacataggatatacccaactcatcacagagtgagtcaggaatggaagacaattcagtgagttaagtttaggcaaagcagtagaattcagttgaattcagttcagtgtattttggtctagtttattcaagtacagttgaatttagtttatgcagtcagtgcaaccaagtacagttcagttcacagaattcagagacagtttttcaaagcagaacaattcatagaaaagccaatttgagttatttagcttggggagtagttttgaaccagaactgctcagttgaacaagccagctaaagttcagaaagagctagaaagggtgagcttattcagaagtaagcctctctgagatgacaatttctggtgaatacgagttagttttacaatgaactatttgccctggagaagttatcaattactattattaactaaaatttgaatgaagaaatcctaaccctctagttgttcagaattgtttggagatggaaattttagaggtgactaaagtaaaattaagtcaataaagtaggttttgaaccaaatgacctcatgtatttccacacctctgtacttagctatgaaatgaaggtatgattattcaaatgctattaggatagactataatgtatacagaagaccacataaaggtacaggaatgatccacaacataaatagagaagctcttaaaagaaataattctaatatctttgtcatagactccttttctctggagcttaaaaaataatttctaactgactaagatatgtagtatgtgacattttcttttcacaccctaacaaatgaatgcaattactagaagcattactctatattttctaagttactttttgaaaataagtataagataaattagtgaatctaccttaatatgctgagagagacagaaccaaaactttttgttcagaaaattattccaggaacagtgtagaggaatggacagctgtcactattactaaaaacagaaagattggttagtaaaatgtttgagctctttattgccctaataagtaccacagtattcttcttccttgcaagggttctacaccaattgacaaatgaacaagaaagtgagatagagataaaaacaatagccttaatatggaaaaggtggatatgtaggaggtatgtgtgggtaagaccaaatagaagttggcatgttctatacttcagactgaaactttaacagcacagtcgaggggaatataaatgtataaagaaatgataccaactcagatcactgccacccagttatctctgcaaatttctttctactgaaaacacaaagacaattcatctgccacattgaggaatgatcatttggtcatgtaaaaagcactttctttggtgagaaagttgaagagggagatactcatccctgtttattttacagtgttagagaatgatatgtttcactgttctatctgctgcataaagtagaagctagtactcaattctcttgctattattttccaccacaaaaacattcagctatggattacagaactaaatcctaagaataagttaagaaattcctctcaggctgcggtaatcttatgctctgcaaaattatttcatgtctggaatagattaactgtcaacaaaagttaggggcacatttgttaattcatgaagcacttctccagcttgtaaacaacagttgtctttttactacctagctacactaatcacaaacatttggggggaactaagacataattgtatttttgaccaaaatgatttagtttagagtatccctcagacatatttgatctcttagaagcttatatctaccgtggcatatatagttcatatttccagtttaataacttcaactaattttaaatatgaatttaaaagtgttcatttttgttgggtgcttgtttaatatgaagccatctttcatgtaaagtatatgaccatctttatcttttgggctcctaatgttttaaggaaagcttggtgtagagctatatcaattggtactctcatcttaaggcagagggagatacaagacaagcaatgagttactttccttgaattctgcatgttgtccagttaagtgactttcatttagcctccaggctatgttataaagaactttaggattcccatgttgtgctttccttttctttcagttttatagattgatcaattaacttcagaggccaagcagaaagaataagaccccctcaggctaaaaatagtcctcattcagaaagaggactattcttcgcttgctcctgagctctgaaaacttcaaggggcctcatcatgtttctggaacatatcttaatacagaaatggagaaggaacatggcaaagtaacgaaagtttcaaatagaagaaaatttcaaaacaatatcattgagagtgaaatatttggagaacttttttaaatgtttactgtgttggattcagaacatatactggcaagtcattgtatgaacagtctctcttatatataatgctatacttttagggacagttgaatgaatggatggatgaataaatgaatgatgtttcaaatgttagctatgctttttgattcagaggatgtgtaaatgaataaactccatgggaacagagttttacaattttaaagtcacaactccttagtgagctatacaatcaatttagtaggttcacatacagcaatttcaaacaactgaatgggagaaaatgaaaggtattttactacagtgtacataagcttattcctactttgctaaatctttatcttgactgtgtatataagcataaacttgattatgagtaaaatatatttttacttaatatgattcatggtctaaaatagtctgcagctactatattatggctcatgaatcagatttggctggtcacctctttttctaggtaacattttattgaaacagagaacttagaatttacaaagcctaaaatatttactccttgattctaccagaaaagttagtgttctaagtactggagacctttaggcatcgtgcacctgcttttggtggtttagctttttatcttgttaagtaaggcatgtataaaattttgatgaggttggaatagcatctgtcttacaaatcttacacctttgaacttaaaacaataattatcagtgttttaaaacttacttgtaactctgtttgaacctagagagtgttaaatactttcaaatttcatctctccattggtaaatctttacagaacatggctatattcttgggtagtcatctgacattatcaacctagtatgtagcagtgtctcttcatctgcagcaaaccttgcaactattgcccattgaaaattgcagaaactattatgctgaacttaaatcttatagatgtgcttgaaaactgtgtagctttaaaactaaaagcccttatgcaaatgtgattagaggaggtagagatccaactcaatgatacatagtatacaagaggccatgagatcaagtcccagcaccagcaaagccagaaaggtaatcgagagttcgagaataaaaatattcaccagaggaataatacagaaaagatgagagtgttgcacaagaagtaaaggattataagtatcactaaatgactctccccacctctaaatcttaactattggacttactcagcagaaagatgtttttcatatcctaattaatatttatttaagctattctttggaacttacatgcaagagctacagtaaataatgggaactacatcaaggtacattggtagagaatggaaatttagtaatgcacacacaatatataaaagtgcctatggatcaagctgaggagactgcactttgtgctatatgaaatcggaggtcataagaggtttatgaccagaagaactaaaaacattccttgaaggttgactaatgggttggacattgtcaagtatagaagaaggaatgccagatagaagataattttatttgaaaaatgataaagggcttcagagagtgcagcaagcctgtgaaccaactcatggatattgatatgaaatatatttaggaagtataaccagaatactgtggagaatggcaagagcttaaactacaagttaagtagagacctctgatagagagccttttacaccacattaaagaattcaatccttatcattaagggaaatcaaggaacaaatgacagtaagaaatcactcatcctcagtataaaaagtagattaaagttaggcaagcccagaggtattaggatccattaggagactatatccaagaggcctagctagaaagggattttagtaagactctaggtatataagtgtattaaagtcctgctctattctctgggacacaagtggaatattctagttggaagagtgagtagttcagttgtgttgcaagattagaaacatatcctagaatgttgtactgtttcctttagcaaggttctgagagtctgtgttcatgtgttcctagacatactaacacttctgctaggataaattgttctttttatttactttacttgctacttatttatgctataaagagaattaaagaaagtagctaatcccttcctcctgtttatggttccttgaaggctgctgtcagggatatttgaaacctcaacaactaaatgggggaaaaaaagattttgatagttttccccaatgggacacctgccattgtcacattatttgttgtttatttcatccctaacacagtagtgctatttttgaggtagtagatatttgcataaatccagaatctcctgtgacactgcacctttgcaattagtctttctaggggagcagactgtaatcatcgatggttgcactactttttaatttttatacaaatcaatttaattttgccaaatacaaacttctactttgcagggctaatgaatctacatggatccttcgttttaaaaatagtctccagtcaaataaggattctttttttttttttcttttcctttcttggatattttctctatttacatttcaaatgttatcccctttcctgatttaccctccagaaaccccctatcctctcctcctccctctgcctatattagggtgttacccacccacccatccacccacccactctctcctccctgctctggcattccccttcactggaacatcaagccttcacaggaccaagggcctctcttcccattgatgcctgacaagggcatcctctgctacagatgcagctggagccatgggtcactccttgtgtactctttggttggtggtttagtccctgggagctctaggggatcttgttggttagtattgttgttcttcctgttgattgcaaaccccttcagctccttcagttctttctctaactcctcaattggggactccgtgctcagtccagtggttggctgtgagcatctgcctctgtatttgtcaggatgtggcagaacttctcaggagacaggtatatcaggctcttatcagcaagcactcttagcctccaaaatagtgtctaagtttggtgactgtatatgggatggatccccaggtaaggcagtctctggatggtctttccttcagtctctgctccacactttgtatttcctcccatgagtattttgtttccccttctaagaaggactgacgaagtctaatctttctcaccaagacaggaaatgggatctgatgttttcttaccattctgccataacactgatgttttaaggtttttatgaatgattttttttctgaatatgtggttaacttacttaaatattcacctcctttagtttcaaatactaattgttgtagagaatagtgtaaactttccttggtctccattttaatgttgtggaaagctattataaggaattttaaaacatcaaatccttatatgtctgttaaatagaagaatatctttgcatatctttagtgtttctcaatcatatctctaataaacagctacaaatacatttttatatttttggttttaattttaattgtaaattataatttcatacatttggggtcatagtaagaattatttgaataatgtagaatgattaaatcaggataattaatatgtccatcatctcacaaacttttggtgagagtctaaaagcatatatttttcaccattttgaaatgtgaagatattgttattatccatggccactctgctattataaatatgttttagcaacatttttcttaaaaatattttctctagtagtcagtataagaatagtgactatttattgaattcttataatacaactgacactgggcacattctttaatatacattgtcttatttcaaccttacaacaccataaggggattatccttaaagtttgctttgtttgaaaaggcaataaaattattattatttctcttgtgaagaaatataatggagcagttgctaaattgtcttgtggctttatatttaactataaatttaattagactataacatcccctccttcaaagtggtacagttcaataagttcttaccatctgactacctcatgaaggggatgaactatcagcatgaacattggtagagttatttaaaactatagcacctttaaaaatatcttcctactatattctgtatactttggaaattattttgtctataatttttgtcttgatataatttcaattgattttattgaaactgttagatcctgtccttctaagagagaaaaattgccttcaagaaaaatttaagcccttttattcatttatttacttttgttatttctaaattatctgttgtaaggaaacacactatttgccttatgtagcactttctatgtctgtctgtctgtctgtctgtctgtctgtctgtctgtctatctatctatctatctatctgtgacagcagtccagagtccagaattctcgctcaagataattttattctaactgtaagattaacccaattatatttctagctactttctcaacttttcctaagaatctggaagacattttcaaattttttaacatggagaaaaaaagtcaaactaagtattcacataaattcctaaatgttcataatagaaactagtgtggttgaagatatttttagagtttaaaaagattcactgaaagaggaggtctcttcataattatctgaatatgtcagactaatttgtcaaaggtaatgtttgcttagaaatatactatatttaagttttctactaaagaaattttcttttataattaagatgccttttcaaatattttcactcataaaaaataagctacagtcagcatttccatttatccaaatgggatattttcaacttttataagtctggggcataaatgtagaagtttatccaagcttaatcttttgtatactcaattcgaccatctacaaagtagagagatagtcttattgacatttaaatattttccatgtctgatattatttatctttaccatgcgtgaggtggtttagtataacctttttattatcaaagaaaaaaatatgtgatcatagacccttatttttctgatgtgcctaattttagagtctactgagtaagaaaggagtttgtgtaaataacaaattcctaaaggcctgggaaggattctgaaagagacacatagaggtgattagaatataaacataggcatcttagatgttgatgaagtattgatgtagaacattccttctctccttgttaatgcaggtcataatcagaacttcctgactcctgacaattaacatcttgatatgatagtagtgtgtgctttaaagtattttaaaatattctgtgatggtgagttttataatttcaactagataagaaattccttaatgtcaaggatcatggtttggtttggtttggtttgtcttccttgtagaacagctttctaaagtattcatggtgtgtttaggtcattgttgaactttacctgaggtcaggaagtcctgcataagctctatgtacttctcacctagatggtagataaagcacaaggagaaactgtatcactacaaatgataggatgttggtaataagagtagtaagctacagttgtaggtgatctttaaagcttcacaaagtatgaaggagctgtactgcacatatacatttttaggggattgaactctaacttactacaggttataaacatgaataggttcgagatttctgggaactacaacttaaatcatttcaaagttttcctttactaaaacaaattttcaattttattaaagcaaggacatgtctagagtcacagaataaagctcacaggagtggatctctaaaattgtaacttcatcagctgcatgataactgtgctttaggcctttgttggggtcatatgtttggttgggcaaggcactatactgtagtagcttatatgaagtccacaaccagaagttgaatagcttctaaaatgtctacactggttgggttgcagtactaaagataatttactacttcacctccccttgaactatgtaacaataaagccaataaagagatataaatactagtctgaaactagtgaatataagaactgagacagaggaatcgctgaaaacaagaagattcttataacccatgtcctagtcaaatcttccacaggaagtatgctcacatattcaaagaaaattaaatctcacataaaaattgtaaagcatatgagaaacttcaacactaagaaaactactccaaaagaccaacagatggaagaatacatatgcaagcaaccagagacagtaaagcaatgtaaaagcaactacaaagtaaaaataaatttatatatgtatgtatgtatgtatagatacacacatatgtaatacgtgttatatatatatatatatatatatatatatatatatgagaaaaaaagagtagtccccaacttatggtttttcatattttttacacctttatgataatgcaaaggtgatatgcagaatagaaacctatctttgagcttatttttcttggctagtaagagccatctgttctttatttgcaatgttgggaagtgacagcatgctttagcttacaaacagccatatgatcccaaaggtaaatacccgatatattcactaaattctataagacgtctaataatccgttaccagtatggcttttgattgtgtggaattgtatgcaaatgtaagtattttaagcatatttagtgtaggcttgactaagttctgatatttgttggacttggaacatcaagcacattattttcttagaatgtttttaatttagtatgtgcctagcaaaacataacccatttgcaagtcaagtcataaacacatatatacgtacatatatatgcatatataaaatatgcattttatatataaaacaacatagcatttgatttgtttacataaagagcaatatgaatttattcataataattctaacaactcaaatctagaatcatattagagcccttttctgggttgtagaaaaaaatttcaagagaattattttgggttctttcttcataaagtacatttgtcctctttatgaggcctctactctcactacctaattaccatttcctctaagaaagtcatgttcaaatactatcacagcggaggttagtatttcaacatatgaattaggagttatatacattctgtctattgcagtcttcaaatgtaaataggattttgcctcatagtagctgtggtgattaatctcaattgtcaatttgattggatttaaaaaaaaaaaagcaggacattagactttggggccatgtctgtgagagggaatttccagaaaaaaccaaaccaaaacaaaacaaaacagaaaaatagaagatctaccttgaatgtggccatcaacttaccaagggttgaggcactggattgaataaaaacagctaagtgtccatgttccttaccatctgccccctgatgtggagactcttcactataataagctccaatgtcctgtcttctctgctaggaatgattcactcttcgcccttaatatgggattcaacatgaatcgtttcttctgtagattagttcttgtcagatgtttcatcatgacaatgaaaaaaagaaaccaatatggatatttactatcttcttattgacataaaactattgttttttttttcaagctggaaattgaacccagggctttatacattctaggcaagtactctacccctgaaacagatccttattctgatttcccatttttattaggattatattcaggtttgctataaatctgttccatatcttctttactctggaattgataccataaaggagcaggccttgtatgctcattgactgacattttcatttgagaggggagaagagcagcagagtgaggaagtccttgatggctctgaaaagtcatagaaagcagaatgcattacctccttattcttgtatttatgtctaggcatgatgaagatgtagataagtatacaacattcctgaagaatcagaaaatgaaaaattcttacaaaggatattagtcttgactgtggcaactaaaaataattgattatccaatgattccctgctttgtttatagaagccttataagacttatatatattttcccctatatatttgaatattcttaccaacaaatgatttactgatatatttaggactatatctaatattttcctgttatctggacctaaatatgtagacatgaatgtcatttctttatacttccagttcaaaatctttcctggggaaatagaaaatttataggaagaattggaggagggcaaactattatcagaatatattgtatgaaaaatatctattttcaataaaaataaaccttttcctatctggggatggtgaggaagcactctagtttcaagaatgagaaaggtagaattatatcttgggactgggagacagagaccacattggaagtaaggagaccatttctaaaatggttctttcccagtctccatcatgtctgtctatagaacatgaaagttatattttaattctttagaaacaccttcccttaaaacttaaaatgtgcctggaatcatgggtagagaaaatggggtgaaacatgtttttctttcctcatcaggaaaatcattcaataaccttgctatgaatgccaggacagggtggtttcaacaggaacagtcatcttctagctacaaatcaggtccattccttggactggatattgatgctgccaggagagaggaaagtgaataaaaggaaaaggcatgttcatttcaagctccatttagaaatgcactagaaaaatcaatggctggtaaatagaaaatcggcaaaattggcaggaagaatttttatattcaagctcagaagggtccagaatataaatctacacactgaccagataataaccaaataaaataatgatgatagtcaaaaggcacttgacaagaattttttcccctcaatgctttagtgtactaaggggtgactttatcagattcactgacccaagtgtctgtcattggaaatttagagattaaacttttgaatatactttgtcattaggcttttcctatagcatcattgactgtaaaggaccaaggaatatagcaatgattaactgaaaactttaatgatgatttttaagaaagcttgattcttatacataagtacactgcagctgacttcagacacaccagaagagggcgtcagatctcattacaggtgtttgtgagccaccatgtggtttccgggatttgaactcaggaccttcggaagagcagtcagtgctcttacctgctaagccatctgaccagatgcctgagtgtaggggaatcaagggcagtgagctgggaatggatgagtgggtggaggaacaccctcatagaagcagggggaggtaggatgtgatagggtgtttcagggagggagggaaaccggataaggagataacatttgaaatgtaaataaagaaaatatccaataaaaaagaaagaaagcttgattctagtgatctacactcaaggggtctgtgttcatcaggcttaaatgtaacttcctttgataaatataacatcattgccatgtgttgttcagttatatgtcttataagtatggcactgttctgagattaccctgacctattacaaaacaagttattttccaacactgtggtattaaaatagggaatttctgattcttatcctagggcactgttgtgctgacccaaagtatattttgctctctgaagtgtacactgacaatttctaactccataatattcatcaaactcccaggaaaatttataacttgaaagccactaagatgttaccctctttagtattattctttaaatttgcttgtgtttattagtttataattttgtcaggtattgttcaatgctagacttacagaatctagttttgcttcatataagatgctcacaatttagtgggagagaaagtgaatatctagacaattaaaatactatggaaaacatgaaaaatatgatgtcaaacaccaagaagtaagcacaaggccctttatgaatgctgagttatgcatgtttcccataaaccagagagtatgcttttcccagaaatgattcatatctttatgttatttttccattccctgtagttcttggcttcctatgtccttgaactccagttcccttgaaaatatgtattatatattttctattaatataagtatatatatgtatatatactacttataatattataacataagatactataatttaatatataatataatttaattacaatatacacaatataaacaatatacaaaatacaaaatgcaatatgcaatattatataatatattatattaaatatatcaaataatatatcacataccatatatagcatatatcatatgtcacataacatttaatatatcatatatgacctaatgcatcatatatggtatgtgatacataatatatagcatgcaataaaatatgtaacatatcatatatataatataaatatatcatatataatatgtaatatataatatatgatatgcagcatatcatatattatatattacatattgtatatgatttatgctatatattacatattgcatataatgtattatgcaccatacatatgatatccatatataatatgtgtgatatataatatgcaatatatcacatatgatatatcatatatgatatatgatatatgatatataatatataacatatcacatatgatatattatctatcacatattacatggtatgtgatatgtgacatatgatatataatatatcatatatgtcatataatatatgctatatactacgatatattatatataatatatgatatataatgtatgatatacatgtataaattttcttttttatctttcagacctttactcaataagaccttttttcaaaattgcacctgcctgcttcttctcccttaccacctccacatacagaagtacatataatctagtttcattttaattttctacctcctgcagattactgtctcaccctcacctagtatgatacttatttattttactatgttctccaagttcttgctagaatgtgcattctctgaaggcatgagtcatgtatatgttctttgggattgagctataccctttgacagtacatcatagtatttcatctcattactgttgaatgatgagtgccaatgattcaagttagcattcaaacttctgtacttgaactctattttccagtgtctatgcttttgatgcaggttacaatggctctgccatccttaaattttgctgtgttggtactctatggccacatgtcagaaccttgaacatttgtagcaacatactcatgagctgataccttgattaagcagatttggactctggatgcacttagcacacagaatagactttgggaatcactgccatggttcatacaaatactttacacagatttctgctttagtgagtatcttaatttcacagccatgataattttacactgtacatttgttcttgtttgttatctttaaaagtcagaaagctttctatgtagcatgatagattttactgatttttaacagttaacgttatagtaatgtcaggtttcaaacttacatataaaaatttgattagttctaagagaaagtatgaaaaggtgacaatttaaaaggtcctcagatattttttttccagaaaggaagtaaaaattagtgaatctgcatgtatacaaaatggagttgccattatatatggtacctttgttttcatcattttgaatatttatttattcactttacatcttgataacagcctcctctctcctcacttcccagccctaccattacaaatctatccccccattacttcctcaccttttcctcaggaaagagaagtcccccttgggtaccaccccatgtagtccaaacaggtctaggcacaacctctctcactaagatgcaactaggcagtccaagtaagagggaaggggatccaatggcagggaataaagaagatagctcccaccccacttgttaggggacccacaggaagatttgctagaaatgtgtatggggcataggtccagctcctgcatgttccctaattagtggcccaggctccgtgagccttaacagccccagattagttgacactgtgggtcttcttgtagtatatttgaccccactgacttgttcaatcctaccccctacccttcgacaagactccctgagctctgcctgatgtttgattgtgggtctctgcatctgcctccatccgctgctggatgaagcctctcagaagacagttgtgctaggctcctgtctgcaagcatagtggagtatcattaatagtgctctatcacttgggatgtgtctcaagtttgggcagtcattgtatggctgttccctcagtctctgcaccacatttttctctgcaaattttgtatgcaagacaaattttggttgaaggttttgtgggtaggttaatgtctgtctccctcctatggaagtcctgccctctacaggaggttttcactttagtctctatatggtggaaatctaagctagcattactcccatacattcgctgttatactttctttttttttaactctctttttttaattaggtattttcctcgtttacatttccaatgctatcccaaaagtcccccatacacccccccccaattctctacccacccactccccctttttggccctggcgttcccctgtactggggcatataaagtttgcaagtccaaagggcctctctttccagtgatggctgactaggccatcttttgatacatatgcagctagagacaagagctccgggctactggttagttcatattgttgttccacatatagggttgcagttccctttagctccttgggtactttctctagctcctccattgggggccgtgtgacccatccaatagctgactgtgagcatccacctctgtgtttgctaggctctggcatagtctcacaagagacagctatatctgggtccttacagcaaaatcttgttagtgtatgcaatggtgtcagcatttggaagctgattatgggatggatccctggatatggcaatcactagatggtccatcctttcgtcacagctccaaattttgtctctgtaacgccttccatgggtgttttgttcccatttctaggaaggggcaaagtgtctacactttggtcttcgttcttcttgagtttcatgcgtttagcaaattgtatcttatatcttgtgtatcctaagtttctgggctaatatccacttatcagtgagtacatattgtgtgagttcctttgtgattgggttacctcactcaggatgatgccctccaggtccatccatttgcctaggaatttcataaatttattctttttaatagctgagtagtactccattgtgtaaatgtaccacattttctgtatccattcccctgttgaggggcatctgggttctttccagcttctggctattataaataaggctgctatgaacatagttgagcttgtcccatgcctgaatctagtcaccagagcagccctcatactcacaatatccgttctcattcccaatcttctctcaagacccctatccccataccacctcccctccatacctaacaattctctctttctatccaccttcctccactggggaccctgactaaataatggaggtggtctcttcaggttccatatccccactgttggagatttcaactaaggctatccatactgagttctgggagtctcctcattccagatctctgggaccttctagaggttgcccccacccacaacctccaccacacagcagctgcatatttccattcattctcctggcactatggacttctctcctgtctacccccatacctgatcctgtcccctttgcccctcttacttctctcccactcaggtccctccctaccccagcatcccatcatgaatttttactgccttctaaatgggaattaagcatcctcacttgggcccttcttctcatttagcttcttagagtctgtagcgtgtatcatggctattctgtacattttggctaatatccacttatcatgagtacacaccatgcatgtccttttggatctgggttatgtcactcagtatgatattttctagttccatccatttgcctgcaaatgtcatgatgtccttatttttaacagctgagtagtattccattgtaaacattttctgtatccattcttctgttgaggagcatctgggtttcttccattttctgggtgttatgactaaggctactctgaacatactggaacatgccttcttctgatattgtggagcatcttcagggtatatgcccaggagtagtagagctgagtcttcaggtagaactattttcaattttctgaggaactgccagattgatttccagagtgattataacagtttgcaatcccaccagcattggaagagtgtcctccttctccatatcctcctcagcatgtgctgtcttctgttttttgtttgtttgtttgtttgtttgttttttaatcttagtcattctgattggtataaggtggaatctcaggatgattttgacttgcatttccctactgaccaagcagattgaacatttaagtggctcttggccatctgagattgctctgttaagaaatctctgtttagctatgtaccacattttttaatttggttatttgagtgtttgtggactttctggtatttctgttattgacatccagctttaatccatcctggtttgataggatatagggcataatttcaattcttataaggctatttgtcaccaattatatggtcaatattggaaaagcttccatgaggttctgaaaagaaggaatattattttatgttttaatgaattgttttataggtacctgttaggtccatttgattcataatgcctgtcaattggtgagagttgggtgttgaaatctcccattattaatgtgtgggctttgatgcgtgagttaagctttagcaatgtttctttttacaaatgtatgtgccttgtgtttgaggcacagatgttcaggattgagatatcatctcggtagaattttttctctttgatgagaataaagtattcttccttgtctcttgattaattttagttaaaagtctattttattagacattagaatggtaactccagcttgcttcttgggtctgttttcttggaaaactcttttccagtcctttactctgaggtaaagtctatctttatggctgaggtgagatttttgtatgtagcagaatgatgaatcctgttttcacatacattctgttatcctatgtctttttattggtaaatgagtccattattcttgagagatatcaatgaccagtggttgttagtttctgttactttgatgttggtagtgatagtgtgtgtgtgtcagtgtgttgttgttgttgttgttgttttcttcttgctggtatggagttacttatttcctgtgttttctttggtataattatctttcttgggttggagttttccttctagtattttctgtagggctggatttgtggatagatattgttttaatttgattttgcctttgttctgtagatttagtgttttgattgttatgtgatgggaggattttcttttctggacaactctaattggtgttctgtaagcttcttgtatgtctataggcatctctttctttaggttgagaaagttttcttctatgattttgttgagaatattttctggtccttgaaactgggactcttcacctttctctattcctactattcttagggttaggtcttttcatgttagcccagatgtcctggatgttttgtgtcaggaattctttagatttaacattttctttgactgatgtatccatgtctcctattgtatcttctatgcctgagattctctcttctgcctcctgtattctgttaatgatgtttgcattggttgttcctattctcttccctaggctttctactaccaatattccctcagtttgtgatttctttattgctttcatctcaattttcaggccttgaacagtctcattgatttccttcgcctgtttcattgtatttgtctgtatttctttgagggatgtatttgtttcctctttaaagtcctctgggagctgccagagactaagccaccaaccaaagaggcatacatgggctggtccaaggccctggcaaatatgtaggagaggactgtcttatctgacctcagtaggagaggatgcacctaatcctgtagagacttgatgactccgggaaggtgagtttggggtgagggcagatggaggagaaaacaacccctcagaggcaaagaagaggggaacgggtgaagaactctgggagcactggaggggggcagcatttgagaagtaaacaaatcatttaattaattatattaaaaagggcttctaactgtttgattgtattttcatgtgtttctttaagggatttgttcatttcctctttaaagtcctctatcatcattataagattggatttaaggtcattttcttctgctgtggtgtgttaggctatgaaaagttaacaggatagctgtgctcagaaggtatcacatggccctggtttttgttgattgtgttccttcctgtgtctttagccctctggttgtccctggatgctcctgttatagcaggtcttgggagagggggcaacctcaatgatcatggtgtagcaggccactggtgggtatccttgaactggacaatggaactcagtgggtggtctaagtatttcaggagttgggtgtgaccttggagacatgctgggaaggggattgagggtggaggaagcaggcaaagaggtaggcagacagtgaaggtataggcagacagcaggccattcagagcagctaggagtgccccacaggcaggcatggaaatggatgcaggaagggaatctaacctgcatggttcaggataagtaggtctgataaaggtggacaatgtggtactatacagtagagccccaggggatagcatgctgctctggaagctgagcatcattttcccaagttttaattccagctatgtttttttcttaagagttttggatattaccttttggaaaagattaaaatcagcatttttgaagaatttacagatgcagctaatcaagggaactcagaacctttccaggaatcaaatacaagtaaggtcaacaataatgacatcaaacgtgaacaaaggccttcaccaactttcatcacttgaggtcactgttcatacaggtcatttgtaagtgtgtgaggatgtgtgtgtgtgtggatgctatacccagatatacaggacgtaaaataagtctaggatatgaatatataacattgtttaatgtaagaaagaacaaaaaataaactcatcaaaaagtagtaggtatgtgtcaaactagaaaaaaattaaataagctttgtgaaaaattatgaatgatgttgcaaaacatgaacattttatggtagcatgccattggctagtgcttgagataaatcctaagggactgtggactaagatagctttgggtttcttctgtagatgtctgtctatcgagtgaatttactcaacccttactgattttgtagcacatattttatgtgcattctgagtgtattatatagaggtgtggtacctagcttctaatccttggtgctgattatggaacattgaatctttcagaaatattagttttgtttcactccacttctttttttttccattttttattaggtatttagctcatttacatttccaatgctataccaaaattcccccatacccacccacccccactcccctacctacccactccccctttttggccctgtcattcccctgtactggggcatataaagtttaagtgtccaatgggcctctctttccagtgatggccaactaggccatcttttgatacatatgcagctagagtcaagagctccgtggtactggttagttcataatgttgttccacctatagggttgcagatccctttagctccttgggtactttctctagctcctccattgggagccctgtgatccatccattagctgactgtgagcatccacttctgtgtttgctaggcctcggcatagtctcacaagagatagctacatctgggtcctttcaataaaatcttgctagggtatgcaatggtgtcagcgtttggatgctgattatggggtggatccctggatatggcagtctctacatggtccatcctttcgtcacagctccaaactttgtctctgtaactccttccatgggtgttttgttcccacttctaaggaggggaatagtgtccacacttcagtcttcatttttcttgagtttcatgtgtttaggaaattgtatcttatatcttgggaatcctaggttttgggctaatatccacttatcagtgagtacatattgtgtgagttcctttgtgaatgtgttacctcactcaggatgatgccccccaggtccatccatttggctaggaatttcataaattcattctttttaatagctgagtagtactccactgtgtagatgtaccacattttctgtatccattcctctgttgaggggcatctgggttctttccagcttctggctgaagccacctacctgaatccccaatttggcttcctactactacttcacaatttcttgctgtgacctttctatgattttcttacttccttaatggtgtataaaatgataatggcaactatgatctgtccagaacattccctctagctgatactgtcctccatactttatataatacaatataatttaattttccccaaaacgaaagtgcaacacattgttttattatatattttacaaagataaaagaaagacctgatggcatagcataggcctgtaatcccagctgctctggtgtctaaggtaagaggattaaaaattcaaagtttgctacagagtgagttcagtgttatcctgaacaacttggctagagtgtctcaaactggaaataaaaggctggccctatagcttagtagtagggtacttggctaatgtgtgaagtcctgagttcaatccgcacaaaagaaatacaatgactgataaacaataacattaaataggttactcagcctcatttgaattcttttcactatgcttctatgagaactgtggtttccataaaggcacatagtatgtgatatacaattctaactgtacattggttctaaatatgttgttctatacatatagataattaagaatagctaacctcatgaacacatcaggcagtttatgtctttctaagtacccaaacaacattcttacagtgaacttttaaaatggaaaaacattttcttttcacttgaagattcttgttccctatctaaagggcagacacatctgggaatcaaattataaaaatgtaagtggacactgtggaagtgtatttcatccactcctagttattaataaaatcttataatgcgagcaagtttaaaaacatatggggtctgagagatagttcaaccattaaaggctaggctcacaaccaaaaattaaaagtatatgtggcagtgggtatcagctattggtaccagtaaagctgtgatgttgtaatgatagagaaagtcgttaaagttaagaaacaaatcacctatgtgttgatttccaaatatgccaattccataattattacaagtttttaaatgacataatatagattaagatgtgtacatgaaattatgtgatttattacacggaagaacaggcttttattttagatgtagtactttatttcattgtttatattgaatgctatttactaaataattggaaaaataagcaattaccagttaagattttaaagtgtggcattgctttatgggcatttagctctagagtggtaaaaactcttctttgccttatcattatataattttacccataaggttacaaaataacacaaatgtattaatttataaaattaaacaatgtagatatacaaaaaaacaaagataaacaaaagaaagatctgttccatagaaattgatggaacttcctcttttgcattttcttcccaacattttgaagtaattcaggtatgaatttgtgacaacaacttgttttattcatagctcttccatttttattatacttacagggttattttagattgattaattaattttgctgcataaacttaatatttgttttgaaatatgatctataccattagatttttgctctaaatacatttcttccagatacattaaatcatccacatctgatgtaaatggtggcacttattcaggaaaacttggttagtgtactttgtaaaggtatcctgctgattgtagcctactctaacataagaggttagctaccaagaagggtttgttgttgttgttcttgttgttgctttcctggtgagtaggttataatttatattttttgtgtcatagtctcagataaatgtgggtccatttttgttgaggtttgaggaaactagaagtttttaattatgagcagtcacaatttggagtgaacaatctaagcccgaactgaatagcacccaaggaatgctttccaggtagcagaagagaagggccaacattgcagtcaattaggataatgtgaaaaatgtaggggtgtgcatgtggagtgggttgattgcttggtaatcaaactatagtactgttcatttttccctgctgagttcatgaactcttgtttgcaatattgtctttccttttcatctgctagtcttatggtaattgcagccagctataaaagtatgcttgccatttgctcttaccaattggctttctacgcaaaaaaaaaaaaaaaaaagaaaaaaagaaaaaaaaaagaaaaagaaaaaaaaatcagggaggaaaccctttgaattgaagacatacagtattagctcagtaagctggtcagagtatctcctggcaaactgtacaacgaggcttctatagtgcagctcagctagagactggtacctttgtcaacacttacaactccagggagcatttcaaatattgggtggttcttcacactgtagacctcctaggaatcaaatagcactcctttgtcacttttcagaggaacttaaggtctgtatatagcctcagcactgttcactacatccattactttccaggaaaatttaatttcacctaatatctacttgttcctttcatcaactacatttaccttagatgaataggaacacacaactgcatggcaaattatgcacagaagaaactgatgacttgactttgtaaaataattttttccgtagtatggatgggtctatataaggaaagtagagtgtctttcaatcaaaaaaaaattcttccacagaactgtatctttttattttcacaactcaaaagccccatgaaattgtcgattaataaacttcttggttccaaggtttaatttacaagttgttaatgatattaatacattactgtatttagtgacatcaacttctattgtattcttaaagtttcatttttttcctcatcttactcagttgttataatttttagtacaactcatttgcactgaggtgttataaaatcgggataaagaagttgtaacttcaactcattcaactctcaccaaattcattttgtttacaataacccccttgaaaactgagtattattaagagtaaaaagtgttaaattcatagatattttgagctcagtgagagaatgtttttaactgagtgaaaatgaaggtatatttttttctttaccttaatgttggggtgtttgtggggttttgtttgtctctttgttttgttctgttgtgtttgtgaaagggcataagagtcatcatttctcttcattgatatgttgctggatttaattcagtaacaggggaagtcattcctcatatttatctgtaaattgcattgagtctagttgaagtcacattaggaagtaatgatttatatgctttctaattatttatctgcttatataagcatagtctcatttcaggtgtgttattgaatcaatgcagttatgcatggaacaaagaaaaataattttcatgggtagaactttgtttttcagcaatctgatatttttatgcaagtccaactccataatataggtatatgcagacaccacagtggtgatttatcacaggatttaaatagaatctggagagggtatggaaaatgtgtatctacggaaaagtggctgttttcctgaatataaactcttaagaagttaaaccaaatagttaaggtatcttctatttcaaaatttgaaacatgctataacctgaggaatcactagttgtatgttcccttccctatgtgaaaatattggaatgagaagggtagatagctgatgcacactcagaaaaatctgtggaatggacaggagaaggtagcgagtactcttctgaagacatccccctaaatacttccttaaactgaagcttacacaaagtgataaataactggccttaaaaaaaaaaaagaatgcagtaaatctttacttcttaaatgtcagttctctgaaagtccaggatttaacactataggaaaatgttacaccatatttaaagtaacacttggtttgcaggtatgtatgaactttctgtagaatatttgttttcttgaaaacaacatttcatattttaatagcacgttatagtttacaagaggtaaattcacttagagaaacacgtggatataatacacaaatactggggaaatacaaaaataatattttaaaaagtgaggctctgttttggtgtatttttagagtagtgtaagaagaagaataagaatggaatagatatgcattggtatgaagaatattagaaaaacaaatttgatgaggtgattttcttcttgtaaaaaatctacccattttcagttacttttaattaattattttattattttaaattacaaatgttcgcccttccagagttcatcatcccatcccctttgtgtctgagagagtccccccacccccagcaaccccactccttagtgcatcaagtctctacaggattaggcacatcctctcccatggaggccagacaaggcagtctctgctacatatgtgccaggggccatagaccagcagctgaagtaaagggcaatagtgataaaaaaaacaaaaacaaacaaacaaacaaaaaaattcatggtattggtacagaaacagacaggtcaatcaatggaatagaattgaagaccccaaaataaagtgacacacctatggacacttgatctttgacagagaagccaaaaccatacagtggaaaaaagaaagcaccttcaacaaatggtgctgatcaaactggcagtctgcctgtagaaggatagaaattgatccattttcagttattaatctagaaattatttagttgctttttggaacatatgaagttaatgcttttgaatagccaaccctcctaaagtatagatttttaaaccatatctttatgcttatatagattgactaggtccaggtaatcagcggtcaatttcaaatgcataaatgtattttccaataactgggattataataattggaggatttttttagggcttgttgtcgtgataccccatcatcacacctgtatctaaagctgaaactgggataagaaaagtagttatggaatgcctgggcatttttttcaatgtggacactctaaatgtatcccacaactaagaaatgacagctgccagtcttaatttcttggcttacaatctggcagagaatcatttcctgatattctgttagtcaaaaatggtcacagaattgggcaaaatttgaagaacagcttaaatatctccattggagaggaatatgtggccaactgtaatcaactgtgaatcatttctcgtgacaggatgcttcttgtgtttatcttgttgaaataacaaagataaaatgcaaaacccatagaaacaacagaatatacatatgcaaattgaatagtacgtttttgaaaaacaacaccattcatgatgcccttgatatgacactttaccttccactcaaagtctgattctatttatctgttctaggactgcttgatatttaaagaattttttgtaaagtgaaacttccataaaggtattgaacacacaaaggataaatattatattctctctcatactttgcatgttttctgaaagaaatatcaagtctctctcaagacttaactgaactacttggaagccttgagtacaacctcctattcttgatttttggatataaaaactgttgagtatattggttgtattagtaggtaatagcaaagaaaatcctgaaggaaattggtggcccaaatttgaagtttttatccttgactgccgtgcaagttaatttggatggtgaaactcaacgttgtgtgcctgtatacctgtgtagacaggtatcaagtagagtaaaatgataggagggtgacattaataaacactggcaagaccaatacagatctagtaaaacaaaacagactcatggtaaatggggattaaattttattttaatggactaatctaagcatcatacttcatgtagtatgtagtatgaactaataactccacggtttgcccagaacagtaccagtatatgcttttttttctcagcataattattaatcatgtccccattcactctcagaaatttccttatttgaatgatcacaaacatggtcactttatttctatatgaatttgaaattatcacggcattaattaaacaccttgctgcttgtgctgctacacaatccattaattatgctaaaaagagcaaagaacctgccctttggggacattatgttaaagagacacagtactattctgagcacatatataagagatcaaaggcattaaaaaacagtaaccaaaagactaaattagacatgccatgttttgtggaaacattcattttcagggtggaagatatgggagaactcaggttgagaaaatgcagaaaaaatgagaagaaagaaaattttgttttttctagccaggtagtggtgacacaagcctttaatccaagcatttgggaagcagaaggtggcagaactgtatgacattcaaagccagcctagactacagagtgagttctaagaaagccaaggctgcataaagaaaccctgtctcaagaaaggagaaagggagtgggagaaggacatgatgagacatggacatagagacagacagagatacacagagacacaaagagatgtcttgatatttctagaatggctttctaaaaagagccatttgtgatttttttttttaatttttatctcagaagtaaaagggaagttggcttgatgcctatataatacataattattgtctatccagtgtactggtgaaaactacttacaaatcaggcctaagcctgggtatggtggatgcgaatgaccctgaaaggctcattgtttgaagagttggtctccaattggtagaactatgtaagaaggattaagaggtgtggccttgttggagaagctgtgtccctcagtgcaccaagctttgaattttcaaaagactcatgccattcctagtgttctctttctgcttcctacttactcactgaacaagatgtgaacccccagttattcctgccactatgtttttgatccaccattgtgaactctagctctctttcttgccttttcctgctgtgaggacaccaacagtattgtgctttatccagcattgttgattatctttgcctggttagatcagaactccccccccccccccggcccggagatgacataaaacataaattagagaatcaagtcttaattgagtataccaataaataaaagaaagacagaaaagcgtccaaaggtactaatcatgtgttactgaggaaaatgaaattcttagtagaccagaggattaaaatcagtgaagacatcaagagttctccaattttatatctgctccagaagttagtttggttttctactatcagcatgcattgctacacaggaaagttaaaagtctccttaacacttggaaagccagccattctctgacacccttgcctgatcatgagatccctttcctacctggggtgggttgccttgcccaggtttgatatgaggatttgtgcccagtcttatttcatcttcttatgtcatgttcagttgatgtgaataagagttctgttcgtttctcaagggaaagaaaggaacagtagatctgagggagatgagtactgggggaagtgcagggagaagaaactgtaatggggggtatagtgtatgagagaagaacaaataaaaagaaaagaatttcaaaaaataaaagccagacatttatctagtaatctaatccctgtcagttgtcttgtatgtatatcatgacattgtacaaatgaaaaaattattttgaggtatgtcttagtcagggtttctattgctgcacaaacatgatgaccaagaagcaagttggggaggaaagggtttattcggcttacacttccacattgctgttcatcaccaaggaagtcaggactggaacttaaacaggtcaggaagcaggagctgatgcagaggccatggagggatattctttactggcttgcttcccctggcttgctcagcctgctatcttatagaaccaagactaccagcccagagatggtcccacccacaaggggccctttccccttgatcactaattgagaaaatgccttacagttggatctcatggaggcatttcctcaactgaagctcctttctctgtgataactccagctgtgtcaagttgacacaaaactagccagtacagggtctcatataatacaaggtgtatgagcgttttttctatatgtgtacttgtatatctcatgtatgtgcctggtgttcagggaggtcataagaagttgcagtaccccctagaattggagtaagtagtcattgtaaatcatcatgtgagtgtaggttattgaactaaagtcctctggaagatcagtggtggatagtcttaaccactgagtcatctttccatctccttaaaatacacatgtttttcttttttatatattctttccttttatttaatctttttattttttcccactccagattttattcacttcatggttggtccaccctctgactgttccccatcccattcctcctccctaccccctgtctccacaaggatgtccctctcctcacccccccccccaccagacctctccactccctggggtctccaatctcttgagggttaggtttttctttacaaactttcaagacctgtttcaaatcatactcttgacctctttcttttaatttttaggttaaacattttcctctgtttgttttttttcctatacacactccatttataactgtggaaaatacattgaaaaaatggtactcttctattagcactgtagtaaaataatttcctttatttttttgctgtcaattcatttttactgacttgttctgtcagctaaagttgatcaataagattatacttatttatcacaaacgttgtgtgtgttttcttcccttcagcaggaatatcagtataaataccaagcaatcaagcttaaatagcttaagtagtagtgttgcttttccaattgcttgtcattacatgggatgttatggttgcagctgactatagaaccctacctgtgatgtacattttacatttgcaatcagcctattacagatgaactgtgaaaattggagagtgcttttgatgataattagaagatgttttacttgaagtatgtaaggcccttgagagagcttgaattacttgtctgtaattttgttatcagctataatgctatttatttaacttgaagtttattgctcctgaatacattttcctatgtctttctattgagtggcacacatgctatattctctagaacagtttatcttgaataccattgtaaaatttacttttcttacaagtaaaatttgacttttctacagttttcaagcttcacagatttctcttcctagagggaaggattcttaagtgataaatgaaattacttctggaattttaaattaagagtgtgaatcgaagcccaaaccacagactctctttgatcctatctctttcttctgagtacttgacccagcattgcagtgtagaatgactgtcaatctgcacaggatgcagacattttctctgtcataagaatgttatgcttttgcgcttttccttttctctcttcctctggattacatgttttctttccttgttttttttttaatatagtctttcatatttattcaatgtaagtttttttcattcctagaataaaaaaaatctgtctagaatgcattcttattctccaaaatttaccccaatttttatactttcttgactagaagttccaatttatattttactatgttcattaataattatataagtactgtagtccaaatgtatcttttatcatctttcagcttgtgtgacatatttgctaaacctctgtgttggaacagaacttcatataattgtatcttgctctgcttgagattacaaataggagaattacaacctgaaattgtaaccacaaagctacttcagtatggctacaatttttattaagagcaataatgcacaatttaatctcagtctttaacaaacttatcaggtttctaagtgcttattgatatggcacaatcagcggaagcttgtttcttcatttgttatgtggaaattacctttatgtttcattatatctaatataccacttgttgtaagataagctacattatagaccataaagggaaatattgcttgtaaaatgctgtcataagagcttgcccatcacaagaatttttatttagtgcttgttgagaaagctctttaatcattaagaatatgattttgcttatcacactgccctttaaattacctagaatatagcattaaaatatcaatgtgcattgcaacaaattttctgaatcctttcctcatggtcatacttctggaacagagtgcaatactagccaggcctgatagtaaactctttgacaaatgctgacttcctaatattgctgttttagttgcttttctgttgctgggataaaataccatgaccaaaagcaaattacaagagagtttattttgacttatgtttcctgagagagaagaatctgtcatgtcaaggaggcattagcaacaggcatgcatggtgcaggaccagagatttgagagctgagacatctcatcctcagtctgaactcaggcacaaaacaaagaaagtgaactggatactagagatgatataaaccttcaaaacccacacctagtgtgtacttcctccaggaaggctgctcctcccacaacctctcaaaacaatgtcacccacttgagaccaagtgttcaaatgcctaagtttattgggcatatttcttatcacaaatgggagcattgctgagaagcctgaagcctaaatttcttcacccataaaatagggaagataatttctacttaatgttcttatttaaaccagttatgagtatgcaagtgatatgtaaatattattagtctgtcatatgtgctagtgtatatttagcttcctagaccttaccttactattttaataacttagttttctttgaaatatctattttgtttgcctccaaatttgtgtctagaaataatagataaaggtttgggaattcattgtggtttatactttgttttttgaaattaatatttgattttatggcagtatattatttaatatatatttatttaagatatatcagctataagtagcatctctatacagtggaggtgattttttttgtttgttttattacttggaattctctgggtaatttataaatgtctggtgatctcccaaactacatttattgtcgccacccctgtaaaattttcatttgcttccttaaactaaattacatttacatttttagactaaaagccgcttttcttatcaagtaagatgaaaagatttttatgaagaatagcaagaaataagaaaaaataagtgtaagataacaaagactttaagcaaacgtcattagatttaactgtagatgtaatggttgaatttgttgattaaatttatcgttttacaacggctttggattatgtcttccataatccaaaggtttctatatttattggttactagaaatacaaaaataaagaaaacatgattctttccacaaagaatctttctcccctttctttacagatgagaactctggggtagaaagatttaaagtgaatttgcccaaagctacacagtagataacagaaatgagactctaacctattttcttccaattaaattcaataagaagtaattgagaatctaattataatggattctgccaaagcctaccatatctgatgtttccttcattccaagaaagaaatgtaaactgtaaatggaacgttgccactttaacgccttgacttctgatggaagaatgtgaacatcactgttcatagtatataaaagcaaacatagtaaactttggcgactaaatagtaactaatattattagtaactacccttgcttgggccagacttggtgtttaggttaccttgcattgagagattcagaggattaaaattcaagctttgaaagagactgtcataaagaagattgtttctattgcataaatggattatttctagttacatatggattcactgtagggtgcctctgaaaaggttgttccttcatacttttaagtttgttatgatcagtctcaaggaaaatggattccaaacatttccttgtgaaaactgctttctgtagtaagcccttcacttattcatatatttcttcattcaacaatattacccagtgttaatgacccacaatttatttgaatgagcattttctagttttcaggttgattgggtatcagtttcttcatcctaagcaacagttattacaaagttcattctaaaaactggagacatttttgtacctgaaacttggtagtcacattggtagccctgtcttagtggatctcctgaagaaaagtgaacactgaatcaagcctctggcagtaactgcttttgtgttgtttgctgcctgtgtaaactcctacgaataaacatcagcatgcttcagttttcatatccataaaaggggagcaatgggttgcctgctacagagtctttgtgagtactaaccaagataatgtgtcatgtactaatcatattatagggatttaacaaatgtggttcccgcccatccccataggattcaggttctactgatagtttttttttttaatattttttattacgtatttccctcaattacatttccaatgctatcctaaaagtcccccataccctccccccccccacttccctacccacccattcccactttttggccctggcattcccctgtactggggcatataaagtttgcatgtccaatgggcctctcttcccagtgatggccgactaggccatcttttgatacctttgctctgtaatatggtcattgacatctatggttcttgagaatatacatacatatatacatatatgcatatatataattttagatgcaggatgaagatatacttatactacacagtcctaggagctatatcaacctgcatcttctgatgtgaatattatagcctcttgttttctcaaaggagatctctgaggccaaaagaaaattgaactctgtgttcctagccacctctgaactttggcacaatagaaactgagaagatacaaaaaaattcttagacagcaaagtactttttgacacagtagattaaacaataatggaaaaagttctgagatgttgcttttcacaaattactgcagttaacctccaaattacatcaaccgaaacgacttctttttcttcttctttttctttttctttttctttttctttttctttttctttttctttttctttttctttttctttttctctttaaactctgtcacagattgaatgggagtaagaaaatatatttatctaggtttgtaggaatttctatgctttgaatactattgtagacagtgaaacccatttaaccttgaaaactgtatctggatctaaaaagaaaactgctctccaatgtctagttactttataaactattgaaaatctattcaactttaagccaaacatactgttcatttatgtcatttcacgtgcttactgtgagttgtatagttaataagtaatatttttaaaatgatatttttcaaatatgccctacttttctttgtatatattaatgaaatattactgatgttatagataacaggtttctgtttggccaatgtaaataaatagaagactaaatatttaaaaattaaaaaaacatgtaaaaatgaagacagtaaattagacacacacttatttaaaatggctaaagagactaatacttaaaatagcatcatcaataaacattgaaatgctttgattctattgaattaacagtggcaaatgaaatattgcttagaaaatgtattgctctattaaaaccacaccttcttcgactgtccagggacattaattttgaggatatttaatatttcaaatttcttatttcattgtaaatttgctactaacaaatctctaaaggggagtcaaatttgtaaaatgttaaacaattgcattaaaaataatgtcatccaatgtcataggctaagtaagaaagtccctgggttatcactttagtaaacacttggatgcattttgttctatcattctctacagtttagttatcatccaacattgggaacttttctttaagcattcatcaatggaaatgaagtatagaaatagctagaaattatgacaatgagatctagtcaactattgtgatactctgctctaggtcaaatgtaaaactgaaatttggaacattctaggttataactttcatccataattttgatagttgtttccaagaaagagaagactttgggtcacaaagtagctcaaacctggctgagtatttttatcttctgttttcaagtttttctcttcatacaaagtaccatatggctactatagattcactgaggtgaaaaaaaaaagtttgtttctaaagagttctgctttatactaactcaacaatacttctgtaagcctattttgaatttttaaatctcttctttatctgcagccagcacagtacacatggatacatacagcctgataaagtgaaatgttaaggtttcaatgtccttttagcttcttaataattacttaactatccttacactcactgcactcttcatagcttacccatatacatatgtaatttatgaactccctacatacaaagaaataatggggatgacttgggtggtgccattaaactgatatattttcaagtagttcttaaattactttctgtgaagcctttttcaaggctgaatcatgaaccttgttgaaacagagaaagcaaaaagaggaaaggaaggccatgcaagtaatattaggaataataaaaaatcaatataatgatagatagaaatagagatttgaaaatttagaagacaatatggtttgagtatatgccaataaaatggaaaacattagtgaaatagatatattaataaaatatataatttatcaaatttgtctcaagaaaaattataaaaacctaataaaccagtaggcttaagtatattgaagtggttacaaaaatcactcctccacataagactcgaagcctaggtgattaggtaattttactggcaaaatttccccaactttcaaggattaaatgatcctaattatattaacagttttgaaaaaagagaaaggctactcaattaattttatgagaccagtataacctttatcataaaaccaggagaggaaaggacataatcagaaaagagaagtacaggtcagttttacttgtgaatgtagatggtatatctagagtaaataccataatatctaactttctttctgtctgtctgtattcctctcttttttctctcttctttctttctctcttccctccttttctccctccctccatctttcccttcctccctccctccttccctccctcttctttctttctttctttctttctttctttctttctttctttctttctttctttcctttcctttctttctttctttctttccttccttctttctttcttttccttccttccttccttccttccttccttccttccttccttccttccttccttcctccctccctccctccctccctccctccctccctctctctctcactttctttctttctttcttcctatctttctttcttcttttatcctactccttcctctgtctcttttgttctctctctgtctctgtctctgtatgtgcctctctgtctctctatatctctctatgtgtcactatctctctgtctgtctcttttctccctccgtccctccctcccttcttccctctctccctttttcccttccttccccccttcctccctctctccaggactgggaattgaaccaacaaattctctgcccttgcctttaaaaaattcctttttagccagggtctcagtaagttactcaggatagcttttaagtcaatctgagccaggcagatttggacatgcaatcttcttgcctgaatcccctgagttctttggattacagcccttagctaccactcctgggtaccaagtcatcttgacaactacactttacttaaaatctttctctttgctactgcaataggtcacaccaccactctctcactgcaacagacttcttagtcatctctgcgatcttgctgtgaccctgcaaatataaacaaaatgatttggttccctttgagaaaaccccaaagactttccatgatatctaggataaagcacttaggtcatataatttagaagccactgtgccatctaaaacatgtctgtctcagaaattctgcatttttctgttttttgctccttaaatacatttcctccaacaacttgcataagcaatccccattagatcactagggactctccctccagtgtcccctcagagactcattctctgttccctgtgtttttcttctcctttcttcttgcatttgcatctgcttcgcattcttttcttcacctttgttgttttcttcattttcaaatgtctcccaaattctagtggtctttcacatccactagaatgtaaactgcctgagaggacccatatgtgtttgtgataatccctactacttaaaaagaagcctagcagacttttgatgcatactgaatgtataattctagtctaacactttacttctcacatagtagaaaactgaagcccctagacaaaatccttctatacttggaaatagagatctttttctacagtccagggttttttgtgctatgtgacattcccttacccatatggaggtttgtgattctagttcaaaagacaaaccttacctcttccttgtacactggtctgagtattaaattatgagaaagatgatgaaccatacctctgagaaatcaacatgataaagagagttagatatggatactgtgttactttctagatttccaggtgccatgtttcatttcagagacatcttcctttgcatgtaggaaaacacatttattactgtgagtacatctattaggaagtgtggtaaagtatgatgaggttaagaatgctgatctgatgacattaacttatcccaaataagtcttgagtctactagtttatcaaagctttgctattttccatcaagaaaagtagtgtcacagaaaaacataaggagaaaggtcatacagcagaggtgagtgtttgcctgggcagatgtgatacattttataagcacatggggcaaatatcatatgtctgtattttttttccagtgcagatacaaagggaatggtagagattgttttttccatcaaggattatgcataaacacaaggctgagcagtaaaaagtgtgactctctgggagatccagaatcctacaaagtcactgtatggtaatgttaatcttattgtgcaacaggatgtctatgcaatataatgttgctatatccactcttcttttattgtgacaagattcgttgtggattgatgtatcattaaaagtagtttgttttgtttgaattcttgctgaaagtcattgaccataggcaatggggtttttctaagtcttcagaataattcttcagagataataaggttcacagttgcctttgattttctaagcagaaacagcagcgttgggatctcctttgtctcctttcagaagtaggaaaaggactggtgtcctgctactgtggaatatttcacaagtttcatcaaagatttagaatgtgagcttctttgtggctcatcatttttcggcctctgaacaaagtgaaggagctgtgattcgttttgttttccctggactgtctgttgcctggcagctgccatgggagagaggctgattaagtctggatttgatttgtgcaggaaattttacgcaacagtaagaaagtctcacgaaacatacttagctttttcaggtctctacctcttcaaaaccaaattaaaggtaatggatactgtttgtccacggcatttgtgctaacctaccagtgtctgatggcaacttcagaggttattctcaattttccaaataccatccatgtccacaggaatttatgcttcgctatcaatcagctgtaaagccgaaccttacatttgtaacatgcaaaacactaaccacgtgtcctttctaaaaaatgtattgggaaagaaaatatgtactagaatattaagcttcttataataagaactatagggagtttaaaaatagtttttggctgctagaagtagaaatttggttcagagtgataattttgtttgcatttgcttatttcagaatgtttccttgagcagttgatgcaggcaaatgaaatatacaatcaattttatttcaaaatggaacctatggtcctataaataggggatgcaatagaatcatctggggagatggttaaaagtggacctttagtccttgttcctatcctgctttgttcttttctgaagttagggctcattattttcatttttctttctttcttttttttttttagatattaaattggtatttttattttttaatttattttatttttattaggtatttatttcagttacatttccaatgctatcccaaaagtccctcacacgctcccccacccactcccccaccctcccactcccacttcttggccctggcattcccctgtactggggaatataaagcttgcatgaccaatgggtcttctttcccctgatggccgactaggccatcttttgatacatatgcagctagagacacgagctctgggggtactggttagttcatattgttgttccacctatagggttgcagatcctcccagctccttggttattttctctagctcctccattgggggccctgtgatccatccaatagctgactgtgagcatccacttctgtgtttgctaggcaccagcacagtctcacaagagacagctatatctgggtcctttcagcaaaatcttgctagtgtatgcaatggtgtcagtgtttggaagcagattatgtgatggatccctggatatggcagtctctagatggtctatcctttcgtctcagctccaaactttgtctctgtaactccttcaatgggtgttttgttcccaattctaagaaggggcaaagtgtccacactttggtctttgttcttcttaagtttcatctgttttgcaaattgtatcttatatcttgggtattctaagtttctgggctaatatccacttatcaatgagtacatattgtgtgcgttcttttgtgattgggttaccacactcaagatgatgccctccaggtccatccatttgcctaggaatgtcataaattcattgtttttaattgctgagtagtactccattgtgtaaatgtaccacattttctgtatccattcctctgttgaggggcatctgggttcttcccagcttctggctattataaatgaggttgctatgaacatagtggagcatgtgtccttcttaccagttggaacatcttctggatatatgcccaggagaggcactgcaggatactctggtagtactgttcaattttctgaggaaccgccagactgatttccagagtagttgtacacatttgcaatcccaccaacaacggaggagtgttcctccttctccacatcctcaccagcatctgctgtcacctgattttttaacttagccattctgactggtgtgaggtggaatctcagggttgtttggatttgtatttccctgatgattaaggatgctgaacattttttcaggtgcttctcagccatttggtattcctcaggtgagaattctttgtttagctctgagccccatttttaatggggttattttattttctggagtccactctcttgagttctttatatatattggatattagtcccccatctgatttagaataggtaaagatcctttcccactctgttggtagcctttttgtcttattgacagtgtcttctgccttgcagaagctttttaattttatgaggtcccatttgtagattctcgatcttatagcacaagtcattgctgttctgtttaggaatttttcccctgtgcccatatctttgaggcttttccctactttctcctctataattttcagtctctggttttatgtggagttccttaatccacttagatttgacctttgtacaaggagataggaatggatcaatttgcattcttctacatgataaccaccagttgtgccagcaccatttgttgaagatgctgtcttttttttccactggatggtttttgctcccttgtcaaatatcaagtgaccataggtgtgtgggttcatttctgggtcttcaattctattccattggtctacttgtctgtcactataccagtaccatgcagtttttatcacaattgctctatcgtacagctttaggtcaggcatggtgattccactggaggttttttttatccttgataacacaagcctgatgaagcatctctgataaacaatacagtttaaaaaatggcagttacaataatacttggaacataccctcatatccaggctggatggttgctattcctgggatccctgctcttttctgaagggaaacaggagaaggggatctaggggatagagcaggtgggggaggtactgagaggtgaataggaagactaagtgcagttgggatataatgcatgaaagaagaataaagaaaacagagaaataaaagaaaaaccttagcagttgcagaattcagttcttgaaagcaaggttgataagaaagggtggagtggtggcatggagattgccacctaatgtctgtcatttcttcatttgaatgtcaatgttgcttttagaataaaaatgtcaattgttcattaagagaaggctactgagtcaggcttgttggtgcacatgtgtaattacagcaccagggaaccttaaacacaaagattcctatgagtttgatgccagtctaggtacatggtggcacgcaagctcaaaaactgaaaacatccatcatcaaaccatcagtaaaagacagctggatagattgtgtcccagccagtcaacttgtaaaatgagtttatgagtgatgtaaagagcatgtaaaagatgtccattcaacattattcactgagcaaaatcatttcttcaacatgcatagtgattgcttttttaaacattattcttattatatataagtaaatatacaaaataagcacagacagtgaaataaaccgtgtgagattatcagataatttcacactccatttcttccttgtgtttttatctttatcaatgaatatttgatataaaggtaaacaccatgtatctaccttttgttacttagtaaaattttcaccatcttagcggaagaaacatcttttatgttatcctagattatcttagcaccctagatgctaatgttatttaaataaagatgaggctgtcttttatacagtaatactactttaccaaagggaagtctgtagaagatggtgtatataaattgaataggataattgaatgcctattatgatgacagagatgaaaaccaattaattttggccttccttccattcattgaaaatgattgctctctgctattttgtatgtatatttaaatatttttcattgcaacttgaaattatcatgtttaaacataaaaagtttaaagatacagatagtgatctagcttgctgaactgcaacatcactggagcccttaaactgcctgaggcaactgaacacttggtgtgtgctaagtataagtgtaaagcatgttttcttccaaagcaaagaatgtaaaatatcccaatggtagtcacattttcaatgtaaaatagtattttgcgtatggtggattaaaagttctcttttttttcttcatttatatagagttttgctgttcggaattgaagcaagagccttgtccatgctaatcacactttaaactactgagctgcattctcagccccatcccacaatttcaaggcacacatacagcttccataatttgtttattaaatagtgacaggtttggaagagataatgggcttttgcaggaaactgagtccagttgcttagcgcaagaccttatttgattctcagagtgcagcatctaaaccagcagcatcattatcatgtaacaccttcttaggaatccaaacccagatgtaatgggtcaaagtcctgcaaacaggactcatctgtctgtatttttatgacactcttggtctttctggcacaaactgaactatgagaacatctgaatggaaaaccctcaagcaaatttaaagcagggtaatgggttaactaataatatgtaagtgtatggttattaatcaagtatgataagtcactgctcctgctttaaaaaacatgaacttgggcccacacctgcacagaataaagcaaagtttctcctgtctctgccagtatgcaaatgtactagtgtctttatgtaacataggatctataatggagagaaaatgtggtatttgtctttttgattctggcttatgtggtttaatttgatgatctttagttacatcaaagacaacatgatttagtaactctttatggctgcataatgctccactgtctacacacaaagtatgctctgaatgcatacatctgttgatggttacctttcttgtaaagagtgaagcaaaatagggatgtgcaactctctctattacatattgacttacagtcttttttggtgtctatttagggatgatatagatgtgtcatgtagttgttctattatgggctttttttaatggatattttatttatttacatttcaaatgttattccctttccagatttcccctctgcaaccccttatcccatccctccttaccctgcttctatgagggtgctcttctacccacttactcatcttgcctcaccacccaagcattcctctacactggggcatcaagccttcacaggacctagggcttcccctccattgatttcagataaggccccttcagctccttcagctccttcattccttcccctcactcttccattggggttgctatactcagttctatagttggctacgagaatacgcctctgtattggtcagagtctggcagagtctcttaggacacagctgtatcaggatcctgtcagcaagcacttgttgacatccacaattgtgtctgggtttggtgtctgcatgtagaatggatccctaggtggggctgtctctggatggcctttcctttagcctctactctactctttgtccctgtactttaaacaggagtaattcaggttaaaattttggagttgggtgggaggctccatccctcaactgggggtgtgggggcatgcctaacctctgcatttagtctcaacaggttctccctcctccttgtgggatgttccagctattgtcatccccatggggtcctggacacttcttgttttcctggcttctggacttttctggttgctactcccagttcccataccccattgctatactcctctgttcaatttcctgaccctctgtacatctcttccatctcctctcatacctgatacttcctctctcttttccctcctcttttcttcctcccaatttcctcccaccctctacttccctttattattttgttcccccttctaagtaggactgaagcatccactctttggtcttccttccttttaagcttcatgtggtctgtgagttgtattgtgagtattccatgctctttgcctaatacctacttatcaatgagtggatagcatttgtgttcttttgtgactgaattacctcactcaggatcatactttctagaaccatccatttgcctgtgaatttcatgaagtcattgtttttaatagtactccattgtgtaaatgtaccacattttctgtatctattcctctgttgagggacatctgggttgtttccagcttctggctattataaatatggctgctaaggggagggggaggggataagggacttttggaggggaaactaggaaaggggataacatttgaaatgtaaataaagaaaatatctaataatttttaatgtaaaaataatatggctatgatgaacatagtggagcaagtgtcattgttatatgttggaacatctttttggtatatgcccaggagtggtatagctgtgtcttcagttagtactttgtccaattttctgaggaaccaccaaactgatttccagagtgatggtatcggcttgcagtcccaccagcaatggaggagtgttcctctttctccacatcctcaccagcatctgctgagttttttgatcttagccattctgactggtgtgaggtagaatctcagggttgttttgatttgcatttccctgatgactaaggatgttgaacatttctttaggtgcttgtcatccattcaagtttcctcagttgagaattctctgtttaggtcgttccccatttttagtagggttattttttcctctggagtctaacttcttgagttctttatatatattggatattagccctttattggatgtaggattgggaaagatgttttcccaatctattggttgctgttttgccctatctttgtaggagcagaatctgtaggggagcagttcccaggtagtaattatcatagtgacattttcagcattcattgaccagggaggctttgcatgtatatgcaactctggtgtccttgatgtgaccatgcccatctacataacatacatacattcaggacttcatctactccccacagctaaggatgctggaagtttttcttatgtcttttggccacaggtactttctcttttatgaactgtctgttaatttcattaacccatgtattaattgggtttctaactagtctgacatttagacttttgagttatttgtatattctaattattaacgctgtcaggtgttgagctagcattttgtttcgctcattctataagttgtctcttactcaattgtttgctttgttgtgcagaagcttttgaatgccatagagcttatacaggtctattgtttcctaagctactggagcacttttcagaaatttattcccaatgtatatcttgactttttttccctatactttccttaaacagttttgggctttcccctcctattaggttgcatagtccattgtgaacatatttgtgtatgacttgagagagactaagtttccctcttctctatcattccctctatccagaatgtcatctcctttgaattatggttttattgtccattctgttttaccttcaaatagtataataaagttgctgggaagtggtgatgcatgcctttattcccagtaccctgaaggcagaagcagtcaaatctctatttgaagttggacttgtctgcagattgggtttccaatacattgagtacacaaaagtctaaattatgatcttctctaaatattgtaacattaaactaaaaattagcatggtattttagattgatatttaatagagagaatgattggttttcatatttagaattttatgagtttcacttcctttttctatatattttgtaacaccttcccccaaaattgaatcaagatatttatgtcatcttcaaggaacttaagaatacacagaatattatagaacaacatagtgtagctgaataattggaatctctaatttttacttctcagataatttcttaagaaaatagctgatgttttggggacatatggcctttggctttttttttctaaataagtgactctatgaagtgaaagaaaatccacaatggtagctgattttctttatttcattttgtaaacgaggaagtttgaagtaaattgctttgatggtaactcttttgcagccatttaacctgaaatatactagagttaaggaagaccgaacaaaatatatcttgtcattgaagaattaatggtaacttgatattatagaaaggaggacaactgttgaggttaaattgtattagtagtaattacataactgctaaagcttcatacttgacagaaagcagctagaaaacatgtgaagaacacaagacttttaaaaaattcagaatgtaattccagtgactgaatgagagtgtgattaattcataaaatcaggagatatggtcctggatacatgttatttctctgagtctgccgattctctttctactccaactctcaaatcacaaatagcacatcaaatacagtattgaatttgggaaggagctgggactaaattgtcaagaaaactcaatatactaatcaaatgtaaatctattcattctgcaaacttttattgagttactattctaataggtatttagttaagccaggtgtttagtgtgaaaatcagttccattcctcagttttctgaactcatgcatgagtgaagtattcagtgcaaacagtgatacaatatgatgagaccagaatttttaaaatagctaaggggtggcaaaaaaaagttcagaaatcagcatagacggatcttgaagacttaacagaagggaaatccctttaattagagggaaatcccttaaattagaagatgaaacatatgtaaaactgagaaaagacatttgatagaaaatggagtaaactataccaatagaaaatgatatatcttgctagtgtatgcaatggtgtcagcgtttggatgctgattatggggtggatccctggatatggcagtctctacatggtccatcctttcatctcacctccaaactttgtctctgtaactccttccaagggtgttttgttcccacttctaaggaggggaatagtgtccacacttcagtcttcatttttcttgagtttcatgtgtttaggaaattgtatcttatatcttgagtatcctaggttttgggctaatatccacttatcagtgagtacatattgtgtgagttcctttgtgaatgtgttacctcactcaggatgatgccctccaggtccatccatttggctaagaatttcataaattcattctttttaatagctgagtagtactccattgtgtagatgtaccacattttctgtatccattcctctgttgaggggcatctgggttctttccggcttctggctattataaataaggctgctatgaacatagtggagcatgtgtcctccttaccagttggggcatcttctggatatatgcccaggagaggtattgctggatcctccggtagtactatgtccaattttctgaggaaccgccagactgatttccagagtggttgtacaagcctgcaatcccaccaacaatggaggagtgttcctctttctccacatccacgccagcatctgctgtcacctaaatggccatcactggaaagagaggcccattggacacgcaaactttatatgccccagtacaggggaacaccagggccaaaaagggggagtgggtgggtaggggagtgggggtgggtggctatgggggacttttggtatagcattggaaatgtaaatgagctaaatacctaataaaacatgaaaaagaaaaaaaaaagaaaatgatatatcaatatcagaaccctactactacttctccatagctgatacacagggcttaggtcaatgaatggtgtatgtttctattacttcatgtgaaaccatctgatacagttgttttaaaagacacaagtgtgtcatatcacaatttctacaggaaggcaggaatctaggtgtgacctaattgaactttctgtttctatttttaaaaaggtaaaataaaactgtaggctggaatgaattttctctatggttttagaattcatggtagtttgatcttctggaccagcaattacaagtctcaagctattcaattctttcacttcagggaaggctgtagtccctgcttaaagggtttacctaatcaagctaagcccatctatggtaataactcttttaagtcaaggttaggagccctacatataactacaaaattctttacattgtccatgtaatgtaacacaattattagaagtgctgtttcatcaccttcagtatatttcatttgtaaagagggttagacagtctacttatttgaccatgtttgggaatcaaaccgaggaaatataataagtgggtcacttagggagtcactgtagggttttctgccataagtagcaggaaagtctaacagaaaaaccagaaacaataaagggtaattgcaacatactctgtcatacctcattgaatagatgaagtgtattttcaaagagatagagaacatgcatttgggaggaaaaattgataggcaatgggaaaggaaatagaaagaaatgggttagtttcatgtataaatgtatgaaattcacaagtaataatttttaggtttctgtttattcagtgataatttcatacatgtatgcatttcgatttttaatatatatctagttagggggaagctggtagattatgttaaccaaagaaataacagcacctttgcataaagcaagaggtaactaaatacataatgatttcttgtccttcttttggttaatggttgctcaggtacctactacattgtcctccccatgctctttcagtcttacagtgatgctactgggagcaaagcccaatacttctgttttttacattgctaggtgggccaatagcaataaagatgaatgcagtgttcaccatcttgtgatataattctgtccagaattgtagccccatcacttatgttttgtggttgttgttgttttggtttggtttgtttttttttgttttttgtttgtttgtttgtttggttggtttggtttagtgaccctgttgcactattaagctaagttttcaaagtcatgtgcagcttctgtagccttgcagtctgaggtaagctgctctgtcagagccagaagaaacaagcaaccatggaattttgaaagtttgccaagacaatgaaccaactgttttaagacagtgtcttagctgttctcccattttgacttatattccaaaggtgatgacattttgctttagtagagccattgttgtcttcatggaacagtattgattagtcagtcatctatgaaaaaaaatctagtaggccattttaccacttcctaaaggcaggagaactcatcttgatgataaaaacatgaaatgaaagtgttctgacatgtatacaggagaacattgtatagcctgctgcaataccagatcaaacaacagatcttagaatgcaagatttttcagagcgtaagctttttatcaacagtatgcatgccagactcagtcctttccccactattgaggtggctgtacattctgagagtggcctcagtgacatccagttttgaccttgccatacaacattattgctaaaaggaagcaaaccaaagtccagggacaattttggtaaaactctggagagtgcaagagagccactgcaagtaacttcctctgtgactgttcacctaatattggacctccctaagaactttccagaaaaaaaatgtgaatgaagtttctgagatggctcagagggtaaaggtgattactgccagtcatgaatacttgactttctatgcttccatgtggtgaaagggagaacgtctcccacaggtcttcctctgacttctacacatacagtagaagatacattaaataaatgaatgaatgtaataatatgaacaactttcaattacactttagcatagcttgaacttttaaaagcatgttttgttctatttacagcaatacactttacatactaaatagcacttgaatagaatgatgatttgacataattttaaacagaagaaaaagaaaatttgtctcctatgtgtaattcctatttcactaatcgtcaatacaattaaaaagcaagcccatgaaggagaggagagtgagcgaactgggaggactggagaaaggggaaactgcagttgggatgtactgtgacaaaatagaaaaaaacatataacatatactggattcattctctctctctctctctctctctctctctctctctctctctctctctctctctctctctctgagacagggtttcactgtatagccctggctgtcctgaagctcactctgtagaccaggatggcctcgaactcagaaatccacctgcttctgcctcccgagtgcattaaagttgtacgccaccaccacccagctggattctcttgaaatgaaaaaaaaaaggttcttgctatttcaacacacagaaagatgaacttgtgtatctaccatggggacaaaaaaaaaaaaaaagaaacaaacaaaaacataggtcctagcttttgtaggtcatatggtatactcatatttcgaagatctgctcattatgagtctcctttggttataatgttgtatataaggataatactttcttttactaatatgcctatattagtataagtttgtaaataaaacagtataaagtaaaactaaatatactactactagtgtgtgccttctgaagttctattaaggacataggtcttgagtgaaggatgtaacttaagggatgtacaaaataacattttgctaatttaccttattgaatttatgctagtttatgttacaattgcaaatgctcagttaaaaatattattttttctctgtcaagtagtagctttctgagttaaaattacttagacttaatgaaattgcataacactatagggattgagttcttttgcctaaaaaaatagaaaataaactgaatacaagcatttaataatattcattctctcattccaacctctgctcttcccttataccttgccattttttcatgttgtcttttatgtactaattcagaaggcatgaaatattgtgtagacactccagtagcattaagaacgtgtgactttcatttaccctgagtcaattgccaagttcagcatcgcttgatgcttacctgaagattgctccagtaatacaacatcttgtaaactgtctaatatcaattgacacaactgtcatctgttaaaagccaatcaactagaaagaacccttacagggttaagtacttagatattagctgaactataccaaatgtatgaagaacacctgagtggattgggtgggtctcttctcaaaagacagaagtggggagaagtaagagcatatagatatcttttaagagcttaagagttaggaaaataaactcatagtgaagtattatcacttaaaatcttagcactgaaaggtgtccagctacacaagttttaatagtcacagaaaaaatagcaatctgttttctacttatgagaaaaggtttgctcaaatctctcaatgtttcttaacttttcaattgagctaagtaacacattttgatataagaaaaaattgaaacctacttattaaacattaaactcagaagtactgaaataaattaacaggatagaattgtttacaatgtgcaaacactctccaaaagtgtagacagtgtatttttcaggagaaagatactttgatgatgatgatgatgatgtgtgtgtgtgtgtgtgtgtgagtgtatgtgtgtgtgcattatagacaaatgatctgcctgaactacattctcagtctaaaggttttgtttgtttgtttgtttgtttgtttatttatttcaatactctgtaattcaaagttgttctcgaactcacgtcaatcctcttacttcaagttttcatgtgctggattcggggcctagcaaacacaaaagtggatgctcacagtcagctattggatggatcacagggcccccaatggaggagctagagaaagtacccaaggagctaaagggatctgcaatcctataggtggaacaacaatatgaactaaccagtacccccctggagctcgtgtctctagctgcatatgaatcagaaaatggcctagtcggccatcagtggaaagagaggcccattagtcgtgcaaactttatatgcctcagtacaggggaacaacagggccaagaagtgggagtgggtgggtggaggagtgggtgggggagcgtgtgggggacttttgggatagcattggaaatgtaaatgaactaaacacccaattaaaaaaaacaaacaaacaaaaaaacaggtatgaatccatatgccaagaagaaagtcactttttaattagaagtaaaataaaaaactaaggaactgtcaccatgctgaagttattcaaacagaaaagaatgattttggcaatatatatgaaggaaagtttataacaaagtgtcacaaaatcacaaagaaaaggaagaatggcccaagtgtttgtgatgtttacaatatctggaaagcattaaagtactagcagcaagtagaatctcaaagccaagagcatatgctgagccacaaaatactaattaatatatcctaacatgagagtgaaaaaaaaatctgaagtcaatagaactaaatggtaacagcatgtaacagaggactgaaactcatttgacaaatattggtggcattaaactcaaacatatcagcaatcacagtgcggagaacaagctactcacaggcaatactgatgactatgaaactgatttttttttaattatttgggtttttaatttcttttttgttaaaattgtattggcatatattcattgtacaaactgaaggatttcataaagacatatcctttcaagtatactatgtgctttataaagttggatactttaaaaaaaaaaaaacaacccacatactctctagaagaaacaaagcttaaataggaagagatgtaaagattgaaaataaaggcctgaaattttgagttatgccactagtaactggaaaatgtggatagctatattaatgccaaatgaaatcagctctcaggtttttccattacaattaaaagaggtcaccttcgtagtaataaacaggcataaagaaaagtcacagaattgaagccacagcaggatgttagcataactttttcagtaacttgagagacaccagtactaattgacaggtagtaatttatattcacaataagaatccacaaatacacacatgagaattttcagtttataagagcctcagacaacttatactctgagagttaagtgaggtaaactgagaaaattctcatgagttcaatgtcacatgtggcaaaaacatctttttccatagaggcatataaaggatactttaaacatttatttgagtaacagcagcaagtagtaatctgaagtacaaagtacggtaaaaaaatatttttggttagctacaactcttgtatagttttaatgtaagtgtaagctgatataattactttggagtaaaatctgagaagttctgaatttgagtcagctgtatgtctcatgcctgaatagttttcttcctgggcaaaagaaaaaagactatattattatatttcaaaaacagacatgtccatagcatcttaaatcatagtgataaaatgttgataaataataaaaaataaagcactgtatattagtattaatatagtactacatagtagcaaaaagagcaaacttatatataacaaaaatggtgacttttgcaggtagacaatacagagcacaaaatgaagggcacaaaaatggattacaagacctttgaactagaccaacttaacatttgatagtagaaagcaagatggtggttagcttagagaatggtctaagaaatgactacaaggaaccactctagaatgcggatagtattctatatttttttgctgctatgtagtattgctatatactcatatgtgttcctttatcagttctttgagagttcattcagtgtgatttgatgatgttcaattcccctcccccaaacctttctagatccaccctctttctcctccaatcaactttgtgtcttttttccccatcaagatcaatttatgctgcccaaatatgtttggatgtgtggccgtccaccggagtgtgctctatttaccaaaagttatactcttagaggatgctgactctccatctcccatcagctaacgattgtcaatagctacattactggggttaggattgtgtgctctgttccctgggattttagtgtgactttagcttattatccatttctttttccctatccaaatatatgtctaccatctgtttgtctgttatccatagagctgcatatttaagatatatatatatatatgtgtgtgtgtgtgtgtgtgtgtgtattcatatatatgtgtgtatatatatagtatatatatgtgtatatgtgtgtatgtatgtatatagatagatagatagatagatagatagatagatgatagatagatagatagatagatagatagataggttggtaggtaggtaggtaggtagatagatagatagatagatagataataaaagttaaccacagaacaatcccagcaaaataaggaaggaagataagtacagaaaaaacaatggaaagagagaaaataaaatgtttgaatatgtgtagtcacatggctaagttttatgacttggataaagtgacttcctgaacaggatgaagtttcacgttcttgagtgacagatggcaatatgggaactcagtgtgcctggattgtttgctttcagaggaactcattcttgcttataagttgcattttttccctatgtagtctattttctccatgtggagtctttagtctctagctttatgttagtaaccctacacatctaattgaattttctgaactgtggggttattttaatcctctttaaatcatgtgcagaagctctgtcagtctttatgttgaatgttctggaattgctttaaaattgcagtgactttgaagtaaaatcatggaaaacaaaaaacgtgtcaactttgctatgctagaatattgaaatgtcagtaaaagaactggattgacatactttgaaaaaaataccttcagggtctaaaacggtctttgttaatgttattatgtgggaaaaagcatattacctgatgatgcagaacacccgagagccctgagaaaactaattagctatttcctactttattgaaagaaagaaaaataaaatacactgaaaaccaccaactctaatctttagtcttcagggaaaatgatgaatttctcatttgacttctgatgttgtaacatatgagagcaaactaattctttgcaaaaagaagtccccttagggtagatatggccttgacacaaaaatagaactgaaaacaccctagtaggtcttgcctgtggatttattattattattattattattattattattattattattattatcattattattattatcattattataatatctttcaaattgacttttgtttcttatagaagtcaagtcaagtgactaccaagcaagaattgagtaacttcatctgcaggcaaaaccagctctgtcctcaggtcccaggcttataggaggtatctcattatccccagaggaaatgcctaagcagcctccctttgcaatagcctatgcctatctagtaataagaaattaaatactactacctactgatagcccactaaatccagttagtgctgcccatatgtgcatgggtatgaagctatccactagaacatgggaaacctgccagtgcctatgatttttctctcctcctgcagctatccactgccactagctccacagtgagggtttatacctggagatcatctgccatctgtgccaaagttttgtgggattgatactgcatagaacttgtggcggtatccatagctggtgtatagtcttgattacaatcaccatgccatgtccacaatacagagttccatgcactcttcctcgtcctccatctcttatgttaactttacttcctatttcatagagttctccagttctttgtggatggggatgatatgctgtgctttttaggcctaagcactgagtctcttgttcttgcattgtgcccaattctgcatctctccattgctttctgccaagtgcaaaaaaaaaaaaaaaaaagcttttctgaccaatgttgagagcagctgggatctatgggtataaacaaatatttagaaggcaatttgataacatgaccatttagcaagatattaatagcaagttctaccctagggcctgatgttctcaactatgaattttgcccagcgttagaatactgaacatgaaattcaaattcctttctatggagcaggactcaaatccaaccaaaatgtacttagttacccaataaaaattgtatcacaattgtaccagtaggtatatattgcctggtagcctgataggtcagcgttataatctttcgcgcactcgactggccaggaagaacgacgctgcaacaggatccttctgcacacgtttattgggagagcttgattgtagaggcgaaaagacttcgagcccagaactggtgctgcttttataggcctcggaggggcgtgtctcacacccggattggttatgcactaagcctcatttgcatgttcctcatctgattggctactctctcagtaccttacagaacctcattatcatacctcatttgcatgtctcacatctgattggttatactctcagtaccttacagaacctcattatcatacctcatttgcatgtctcacatctgattggttatactctcagtaccttacagaacctcattatcatgcctgggccaggcagtgtctttgcaaaaaactttactgcatatgtacacattggttgtttgtccaatcttatgcgtggtggccagcagtagtcagtgccactcagcaacggcacatgtggcttcccacattataatatgcagggtctgagactgagtgagaccactgatgtcctttcttcttctgtgactccaatagcagctttcaatagtgccattataatatgtaaatagttgtatttagttctagttctattgctgtgattaaaaaaaataaccaaaagcagcttggaaaggaaatggtttattatatcttacagcccatcatcaagggaaggcaggacaggagttcaagggggaatatggaagcaggaactgaagaaaagactcacaagacattcaccctgctttcatatacaattccaagtctacctgccagtgatagcactaccctgcctccatatgatggtcccaactacatccatcattaatcaacaaaatgcactacagagctgcccacaggcagtctgatgaaggcattttctcaagtgaggttcctttttctatctggattcagttaccagaagcaatgtaacagttcacaaccatctataactctaattccaggggaatcaatcaccatccctgatctcctcaggcactgaatgcatacttacatgcattcaagtaaaccctcacatacatagggtatttgattatttttttaagttccgaatttaagctatgtttgaatctgtaacaatgtttattttgtaacaaaaggcatgaatttaaagatatacatatatatacatatacatatatgtatatatatatatatgtatatgtatatatatgtatacatatacacattcagtttgtcttatatttgaatcccttctttttttcttttgacatcaaaactctgcaaacactaccattaatgctttcttattggttaaatgctctgttacagaaattacttttgtttccttattatgttttgtataacacttcaagtttatcaaccaggctatgctatgattagcctattattacatttttagggaccgttacacatgatgatgttagcactcagggctgtgtttgattatttacaggcaccagagtcaatcccctagtgtgtaatggaaacaaatggcagcttgtccaccagaaaacctatgtcagttctccaattgttggcaggaacaatggcaaacagtatccagatcaatacttgatttgattcattgtgagtattggtggatcagtacatcctttagtctctatcttagagatgatgttggggtagtgtgcctagtagaagatttgaggaaacatttcagctttactcctccatgctgagggatgcatgttgtttttctttcaggttgaaactctgtcacattttgagaaactagttgtcccaacaaaactgttttccctcttcttttcggtactagaatgagactctaaggagtaagcaaagctgaggtttcttgaaataattccaaagctttctaactctcagaacttaactatccatggaaataactactggctaaagatacacttacatgggctagtaattgggaacaatttggagggaaggaatttaagcaggtactacatgatgttaatctgaagaatagggggagcctgtgttgtgtggatatttgaagcaaagacagaaaaacaaatggaagtgtccttgtttgcatttgtgaggtgggcaagtggtgacaatggaggatgaagtgacttaccaacagcttggccagatccatgatgattatatacactaaatttatttatgggaaagaatttctttaaaaaattaaattaaattaactggtcttagattcacatgtgcttcatccctgctcccccctcccttcaggaagcagggatctttatctaaaaggagtgagataatttgcagccacaattttcctggaaaaacatatgtgaaccatgcttaacccttgacttatgtgtaacatcaagtttaaaatttcaaaactcaatgcatcttgtttgcctaactccttgggcttgataagggaattctgatttagcaaatgcaaggccagtatacttcatggcatccgtgatattttctttaggattatgaaaatatgagccctagcaagaaactcattttatctttcatgcttatgacactatttctcttgacacacgaagctccttttgtataaagtactaagctcaggaggagcctctgtagccccttcaactggggtactttcaactgtacctattctgtaacatcagtattaagtggcccagttgggcctcttttaacattactcccagagcacacaacctgccaatatcagcatgcatcctccagaattcacaagtgccacatgtgaaacccaggctttattacagtgtttattgctgtcattgcgttatcatttattatttatatgactcaattccgggtaattttgtacattctctggcaggcagtttcaccagcatgtgtgtttggggcagctattcattcatccattttgacaaccacacctgacaccttcatgtatgcccagtaaaaatttcaggttccagatttgtatggtgttcctatgcataaagttgtttgctgtgatacatatttcatgtaaatgtcactttttcaaatgtttcaaggagtctatagtgaaaccatatgccttgcagaaatgatgtccttttaggtctgaatccaaacatagcttgtgaatgaccgctcacatgttctaaatcagcttgtaagcttttacactttttttctgaaatgttttctttagggcttgtaaacttttttttttttacaatgttattgtttactagctgtacctctgtgttcttttttacattaactacaactaccctaccatctttatgttgctctttcatcacattctgctaagctactatgtgtgtgtgtgtgtgtgtgtgtgtgtgtgttgagtttggagctacctgtcaacagaaattcctgtaagttagaattgtgttatgatcaaagcacttatgacatcagttatattcagtttttgaacataggaaagatgatatcaccgattttatataagattatatagccttctttgtgtaacttgaacggtgttgcctctgttcctctgttgttactatcattgcatgatggttactttttatgaaccatttactgtgtggcagggactgatacccagtaatacttactatagcccttctaagtagattctattatcgtttgtctattacatgaacagagctcagaagcaggagagtaaatgactcaagtgtatataatcattaagttgttaaggataccagaatcttgcccatagtcatcagcattcacatttctaaacattcatcagcattcacatttctgaacatttagactgtgctctcttcatatagtggacacattcactgtacaattacaatgagccaagcccagcaccaccaccaatcattagttcagtcattattttatcactgtttggaaactgctgtgatgcttacatttcttttatacaaaaagaagctaataggggaaaatatctgttgccttaaaagtcattcaactaataagtagcagaggcaggtatttaactcatatcattaataatcatgccatactgtgccagtaaaggagtaaggattagtgggcaaaaaccaaaccaaaacaaaaaaaataaactgagtttctacaagcactaaaaagaaaacaaacaaacaaacaaacaaacaaacaccctatgcattcaattcttcagcctgtgggatatatgaagtgaagtggaagatcctagaatatatcatcaacatcaataaattgtctagctatctttgcaattaggaattgtgagaattcttaaaaagtttaaaaaaaggcatgtttttcttacctaagaagttttgttcaccaaagaatgccacactacattcttaggaacagaagagatggaataggatgtatcatgaacccctcagaaaagtgactatcattcaagggcaaaagcaacctaacaaaggaaagtgtaaaactcaggcttatagagtataatagcctccaattcccctatcatccccttcttctgccaaaagagtcaatggctggctagaatctgaatttttctgttttgtggaatacagattggtacacacacacacacacacacacacacacaaacacaaacatttttgatcaaaatgaagtaagaatgatcattttaaaatatatgctttagttcaaggaaagatgaccaagccaggctggactggcagtgggaaatatgatggccttaaggctgtagggagacacgtggcatttctattgagaagttcactgaaacataggaaaatagtcaaagatagatttttcttttaaatctagtttaagagttttgtcatggttaactttaatttggggcattagttttctttatgtgaaccaacaaaatatcaaaaagaaatggaatgattttcttttctgtattagtgtttcagttgggaaattcttgcttcttcacccactgacgttatcagggatttacaatgtgctgccaggcttctcttggaagcttcttctactggcaaatcctgctaacttttgaaaaatggcatttgtctggcagtgcctcacacaactactcttaaatttctactaaaacacctatgaagacatataaaaaagatgcaaatctgcaacagtgttaatatctcaggctttatgtcacataattactagaatgatagagaacttccaggagttaaaatctacatagatcaagagagcaactatactgttatgctaagagcctgggaagtcggcatcaacaaattttcaaactaaattttgtaaattcactttccatctggattaaaaaaaaaaaaacataagactccacacttagcaaaacacaaaatagtcgtcttatgacctagaaggtgggtttgtttgtttttgtttgtttgtttttaacatgactacaaggtcggactatatccaatccaatattgtatttacttttttgtgtactttagaccttggacactcagaaacaataagaacaaaagacaaacaagttctatcatgacaaactttgccttaagtaggaacagtgaaaataaaaaccagcagaagcacataagaattacatattccaggtattctagcattgtgtattttattagttcacattatcaccaaagcaggtgttggcatcaggatatgatctaatcttagttcaaaataggtatattagatgaagtaaaaatagacattgataacagaccacaatgttataaatatccaagtgttgtgtacctatacatctgagaatagcatatctctactagccaatttgcatttggcctggggcagttattctctcttaactattggctaacatatgagattaagacagaccatttgaaatagtcaatgacagaagaaagaaaagcacaatgtgatgactatggagaaaagaaagcttgtaaacttgctaaagacaaaactaatctacaaactcagcaaaagaaaacattcctggtatgagagttttacagagacagaaaaagagatatttcaaatctcgggctgaattataaggtggcatagtttttacaaagaagcacagtgtaaaagggcagatcgtcataacctttagtgaggtcatggactgttaaaaagtgatgaaacttctgcgttctttccttatataaaattataaatacacatattttcacattcagtttctgaagtttcccatatcctctgaagcttgcatgggaagttagtttaagagcctgtcctgccataaaagaacagacaaagatgacaagaccatgcaattggactcttaaaaattagagatcatcaatatagcagaagattacaaaacaaaaaccaagcaaaacaagacaagacaagacaagacaagacaagacaagacaagacaagacaactgttatgcctagttcatgagtctcccaagagaccaccagggaccacaactctcaatgcaagcacacaagtgtctattcaagcttgagtttgggctacaaaccttcctgatgcaagaggataggtgagtgacccccagctctaggtgaaggaggtttataaggggaataaaagtgagggtatctaagccttggcattacacgagagggcaaaggaatgttggtctctttcccagagccaaagggtagatagaggccatatcactccaaggacaacagacagttcttttctagacagcagctttaaaatagagtttggaggacaaggtagaatctgtcctgcttccaatggaggtggggggggggagggtatgggggacttttgggatagcattggaaatgtaaatgaggaaaatacctaatttaaaaaaaaagaaaaagaaaagtatgcagaagaaaaaatcaaaaagaaagaaagaaagaaagaaagaaagaaagaaagaaagaaagaaagaaaggaaggaaggaaggaaggaaggaaggaaggaaggaaagaaagaaagaaagaaagaaagaaagaaagaaagaaagaaagaaagaaagaaagaaagaaagaaaggtcaaaaaaaaaaaaaaaaaagaatctgtcctgctggttttttgcctcttcattggccatgtctttctaagggcaaattaacttagaacaaagtgttaagaacaaaatggaatttattctgctacctcagtcccttcacaacaacaacaacaaaaccactcttacaagatttttgctgacaggaccctgatatagctgtctctcgtgaggttgtgccagtgcctggaaaatacagaagtggactctcacggtcatctattggatggaacacaggatccccaatggagaagctagaaaaagtatccaaggagctgaagggatctgcaactctataggaggaacaacaatatgaactaaccagtaatccccagaattgtatctctagttgcatatgtaggagaggatggcctagtcggccatcaatgggagaagaggcccttggtcttgtgaagatcatatgccccagtagagggaatgccagggccaggaagcaggagtgggtgggttggggagcagagtgatgggagggtataggggacttttgggatagcatttgaaatgtaaatgaagaaaatatctaatttaaaacaaaacagtgtaacactttagcaagacatttatattttgaacagaacttcctgaataccaaattgacagtgttgaatgtcaaattaggaaggagctggagagctggcttagtgttttagagtactagatgacattgttgataaccaagatccaattcccagcacccatatggctgtttacaactgtagctctagttccaggaggtctgacaccttcttctggcttctacaggcactgaatgcacatgaaacacagacatgcatgtaggcaaaacattaaaaaatcaaatcagtaagaacttcatatatattagaaagatggtatttttctttcttttgtattaattatttatttacatttcaaatgttatcccccttcccactcccccctccacgaactccccccaaccatttccttctcccttgactctaagagggtgctcccttacccccacccacccactctcacctcacccctctagcatcccccttctctggagcatcaagcctccacaggaccaagaacaaaatttcccactgaggccagacaaggcacatatatggcgggggccatgaaccagcccatatatgctttttggttggtggcttagtccctggggtctgtttagttgatgttgttcttcctgtggagttgcaatccccatcagctcctttagtccttttcctaactcttccattggggtcccaagctcagttcaatggttagctataagtatctgcctctgtctcagtcaggtgctggtagagcttctcagaggacagccactccaggctcctggctgcaagcacaacaaggtattagcaatagtgttgtggtttggtgcctgcacatggaatggatctcatgctgagcagtctctggatggcctttcctttcgatctttgctccatttttgtccctgcctttcctttagacaggaacaattctgagtcaaaaattttgagatgggttggtggccccatccctcaattaggggccatgtctatgtattggatgtggtctcttcaggttccatccacccactgttggccattttgactaaggtcatccctattgagtcttgggagcctcttatatccctggtgtctggaactttctagaggttttccctatcccccacctcacactgatgcatatttctattcattctcctggccctctgggcttctttcctgtctcctcctccatacctgaacctgcccccatttattttctcaccctctcctatcccttccatatccatccctcactccctctgtctcctgtgattattttgttctcctttctaagtggaattgaagcatctacacatggatcttccttcttgtaatgcttcctaatgtattgtgagttgtatcatgggaattctgaaacttttggctaatatccacttatcagtgagtacataccatgtctgaattttgatcatttctttaagcactcttggccattcagattcctctgttgagaatgctatttagtgttcatggataagaaggaatgacattgtaaaaaaaatggccaatttaccaaaagcaatctacagattcaatgcaattcccatcaaaatgacaacacaattctttatggaccttgaaagaaaattctgagcttcatatggaaaaacaaaaaacccaggatagctaaaacaatcctgtataataaaagaatttctggatgtttcaccctccctaatctcaagctgtactacaaagcaatgataaaacaaacaaacaaacaaacaaacaaaaaacaacaaaaacacttcatggtattggcataaaaacagacagatgaattaatggaatggaatagaatcacaacccagaaataaatccaaacacacctatggacgatgtagtcaaaactatacagtgggaaaaagaaagcatctgcaaaaaatagtgctggtcgaattggatgtctgtatgtagaagaatgcaagtagacccatatatataaccctgcacaaaattcaagtccaagtagatgaaagtcctcaacataaaatcagatacactaaatctagtagatgagaaagtggggaactgccttgaacccattgttccaggaaacaaattcccaaacagaacacaaatagctcagggactgcaaagcttctgaaaggcaaaggacactgttaataggacaaaatggcagcctacagaatggaaaaatatcttcaccatccctacatctgtcagagggctaatatccaaaatatataaagaactcagaaaattagaaaggtgatcttaaaaagcactgaaaagagtaaaggcaggatccataaatgagataataagcctaaaggatggagagctactctaataacttaaatcctcccaagaaagacataactatgaaagcataataaggtacatataatggtaattatgagatgacttaaattgaatcatcactatctgagccaaattggtgaatcaagagaagggagtggcacattttcccaagtttctttttaattttaggtgccattgaaaaatgccatctatgcatgacatatttgcttaacaatgaatagtgtcatccaacaagaatttaaataatagtaaatagaagcagaaaattacttaatttactgatctcataaagtagatattagaatagtggtaaatgaaagacaaaggaagcttagatattggtgattaggcataaaaggggcaagctcactttttacattgttgtggctatttttgctctgtttaatcctcttagtcatagccatataaaagttttctttaatcataaatattaagcaaaaataataaaaataaaaacttagttatgatgatgctttccagaaaggctataataattttactcctcttctaaatcaacccttaaatttctaacaccagtttctcctttcataagaaaagtccatttgaactggtaaacttctcttgcctagcacatcaactgcagcatttacctcaaaaggcaggcaataatattccttctctgtaggttcataggaccctttatacttttttcatgttattttacagttgtaacccaaatgaatcttcatatataaaatcaaaggaaatctttgttttaaaatgtataaaacttttcaatagtattgatcaataatgccacatagttttgtgacatccaaaaaatggtaataaaactttgtacaataaaatttaaatgttcttctagagagaatatatgacttctagtcaagactttgcttcaaacatgtgcaatttaacatatcatctgctttcacccataaatatactctttgctaatcattttcactcaaagcctgtgccacacttgcaaagccaaaatgtttttccctttcatttgttctgttctttcttaggacacccagaatggactggatatcttccaagactaaaaggaaacatgatctcacaggatctcagttcttggaaattttgtcagtgtgtatgtaactattgtgacagggcaaggatacagtctagtgtgagcataacattctcaattaggctagccttggcatgctttcctcgagatttttttaaaaacatttcagtgcatattcagaactgaaatcttgagctctcactcttaccaggctaacctacttctgttcttctacacttgttctcgctagaactccaattcctctagatggtgttccaatgtatttgttgaaaacatattgtacactgagtagaatgagtggagttgctttacatctgaagatattaaccctttcctcctcctttctgcatgtaccatcagtacctattctcctgttctttcctatctttaacacttttctgcattttttcttcctctttattccttgtcatgtcatctccccctttttaatttaattttttttatctcttcactttatatcctgctcactgccctctcccagtcacccctcccacaatcctttccccatccccccatcctgttttcctgtcaatgggttggaggcctcctgggtatcctccccaccctgccacatcaagtttctgtggggctaggagtatcttctacctttgaggccatacaaggcagtccagcttgtagaacatatcccacatacaggaaacagttttggggggtagttcccattccagtttttctggatccacatgaagacaaagctgcatatctgctaaatatttgcacggagaaccagatccaggtctctccagccctgtcttcccctttcttactcagtaagatgaagctaaatatcaggcagaaggatatctttcaaactgcaggttatgacccgtcagtgagttgtaaaatcaattcagaaggttgaatccagcacttctaaaatgacataaaatacaatctgtcacagcacatcccttatagtaagacaattacattttcatgaaacaaacataggagtatacaaggtcctatctaaaacatattttatcctgtggggtcaagtcaaaggaaatgagaactatttctataaaacacattttaggatataagacattgattcagagctgctttaaggggtctaacagctagacaactaccctgggttccaatctgtatgcaaagaaacatttctcaggaatgaaaacatccctgggactaccagatgatggagaaaattgcatctgttggagagttccataagaatagtaatacatgtgaggaaggtggctacatctgtagatagggttagatttcatagaacagcagttaatgaaactcagctctgcctccactgagccttcctttcatgttctccctcgatctgcacacagtgtttattggttcaatattcaatggaccaatatttaaagaaggaacaggtatttaaagaaatttggcttgaaggggaatcaaagcattagcctgctgaatttgtgcaaatgctttggcttgagtccatatagattttaggtctagagacaaagtgttctttcttgtaaaaattatatttagggttgataaaatggctaagcagataaaagagacagctaccaacactgaacagctgagtttgaagctaggacaccacatgatggaaagagggaaccaactcttacaagttgccctctgagttccacaaacacactgtagtgtgtatgtgtgtacatgtgtacaagcatgtgggcccatgtatgagcacacacacacacattacctaaataaatattctaagaatttaaatgagcaggaattcatcagttttagtagtgtaccatgtagcataatggagataactctttattcatgtggaaattcattgcaggtacagcaaacaattgagtagcattttctccaaagaagtgctctagtaataggattcattcacagtcactctcttaccgagcttctagagtctactccattttacctatatatgagtaaggagaaagattaaaaatcacacctgcttacgcaatctcccgtcaggaatctatctaaacatcgttttgcattccattgggaagaactgattacttggacctgtccccatccttagggacagagaatttaactgctggatgcctcccaataggaccactgcagattgatggaggtacatgaatattcggttaacatgtggcggctgttatagctattctaagttcctgccatctttaaaaggtctcaacactgagcatgatggcatacacctttaaacccagcactcaggaagcaaagtctttgtgagatcaaggctagcctggtcaatgtagcaagtgccaggccagctaggcctacatatggtgaccctgtctccaaaaccaaaaagggtctctcgaaattgggaagcctgtcactgctgcacttaccatctgtatgaagctcttttgtatcacagaagcattttcttgattactggtgcatatatactctctggggtaaaaatagactgccttacttttcagtcttgctaaggtagtcatttagacatctttgcatttagctggatatcatttttagttaaaaatgaatgtagttggcaagcatgaagtgtataaaggtagtaaattctaaatcatagacagctacctcatttattcagctgctggtttccatttggttgaccagacagaacactgcattatgtgatttgtgatatccggatgcagtagaatggctttaacttttgattaaacagaaagcttgaaatggtttaaacagtaagccagaaatactgaaaacactacaatctggtttaaacagtcatctgaatgaattgaatagaaacatatttatttgggaaaggaagtagttggtatgaaattatccttgcaatttcaattaagcttctgagtgtctaaacaattcataattgagaataataattgttgacaaatgcagtattacttttctagcattcttgcttaagattcatctggtcctgttacttctgtctctctcttcttttctgataatccacacaaaccatagaaatataaacttctttaatagcaattagtgttttcttcaagaattttcttgccagtatgactgtggcaaatcatgttgcctatatgatatgcataacaattcaaagtaatgaattcaagagaggtgctaggttacagttgataaagtgactttgctttactggcgcatttttaacttacctgacaagtctccctccctccctttgttttgctttccatactagttaagtgagtagtgagtaggttaattaaatgctaatactaaattatctcacatatacagaaggagaaaaaaaacaaacaaaacagaaataagatctccattgttcagtaaatgccacggtagagggctggacatcatgacattttattggaggcacaggagtctttgtataatgtgaccatctaaatgtagattgttttcaaataaacggccgatgaaaacagaagaaattgttatatgaaaaaggcagtgctttatcttacaaaattgataagcatgaatttaaacagtagatcaagattaccatgtattttccatcgaaataacagtcccaggagacatttcacaaataagtgttctagaggcaaagaaactaagaagaaccaacaaactgagaaactgttgaatcttctctcatagataatcacaattaattttagcattttaaggagtttgggaaaatattcacttagcaactgtatttggtttatgaaattggtctgatcaccctggaaatactataatttctccaacttttctttttaaaaaagacctatcccataaacagccatgaaatgcagacactattgaatatgccagcaagattttgctgacaggaccctgatatagctgtttcttgtgaggctatgccagtgcctggcaaatacagaagtcaatgctcacagtcagctattggatgaaacacagggcccccaatgaaggaactagagaaagtacccaagagctgaaggggtctgcagccctatagaaggaacaacaatatgaactaaccagtacccccagagctcatatctctaactgcatatgtagcagaggatggcctagttggccatcactgggaggagaggccgttggttttgcaaagactatatgccccagtacaggggaatgccaggggccaggtagtgggagtgggtgggttggggagcagggcagggggataatatttgaaatgtaaatgaagaaaatatctaataaaaaaagatggcacctctatacaagtgaaagagcaaactcagggatatctctcatgagattttctactctgatactatttaattatcattcatttcacaatagtatggttttgaaatctcttgccttgtctttgaagtgtttgtttttaaaagtagttttcagtctaaaagagagcacaatattatatatgtacaattgacacaaattaatcttgctattaagaattgaatttcagaactgagatttaaataactcttacattgtagttgtcacccacagagtctcattagtttaaaatttacagctaatttatgaagacagaactgtctctctagaacaaacttaactagtctgtcagttacagagtatctagtgggaaacgctagtttaaggttccttccctgggcattatttttagttatctcattaatttattatgtgatcttaggattattgtttaattttgatggccttgagtcgagtttttaaagtgtgaaaatcaacaaattattatttttctgtatatatgtcagaggagacattagctaattaatgtgttttagaaatactttcaattagaacttattaaatgtagtaattattcctgtctgaaaatattgactgaagcgtttttgccatgtcatatgaccaaaatatctgaacagtaaagatttccccatggtccagccaatggaacttatgaggcatgcatttttgtaaagattttggaaaatataacaaaatagacacaaaacacggaataatagattatcaaatccaccattttacccaacattcttaataattctaaaattgttttctgctcattggaattggatataggcaaaacttatgttggaaatctaaaccttaggggaatatatatttataaataattctccattaattttagcagatttgtgtatgcacccttttaaatgctctcaatgacaacactgaagcttaatgtttgttaatgtcttgaggatcaaaatagtcagagttcatcgtttatggtccaattacaataactatatgcattgaaaacatcttagttcagtattagttatgggtgagtggcaatctggtccaaactatacttaagcttttaagatttattattattttgaattatgtgttcatatgtgcatgtgagtatcggtgcccatagaagccagcagagtgggatctcccagaacatagaattacaggcctttcggaggcacttgatggggttgctgagcctctaactgatattctctgaagagcaatatatgtttttaaccaatgaaccatctctatagtctcctatatttaagcttcttaaaaaataatttcaaataagttgctttctcattttgttcattttagtttggaatcagatggataaacacttttccctactttgtatgatcttaaagtcatgagtcctattcatttgtggtataaaaatgacttgatagtaagatgtatccagatttgttaactaaatgagaaaatgcactatatagttgcctatcacttgctacaattctacatctagaggtcagaagataactatctgtgaaaataaagatagctaaactgagtaaaatcagaatgaagaacagaagttttgagactgtttatggtttttttcctctttcttcaaataaagagcacaggtctattagcaagtggtaatggttattggttttcagtatttgaagttgtagttactgagaacaagcgatagtgccaacaactgaactccttttggggaattataagtcaacccattcaatggaggtggctattatttattttctgtttttgacattcagttctacaaacatttactctgagcagtctgccacagtggttaagagcttgacaatcaaatagatgctggcttgttttcacataccacactgctgtactgggtgacagggaggatattagtcaacttcaactttggttgtttcaattgtatctttgggttctcagattcagcactgtagagcataatcagaattctctaagaaaaggtgtgtgtgtgtgtgtgtgtgtgtgtgtgtgtgtgtgtgtgctaagggggagcatcatggtaatccctcaataaacggaaactgttaatccaagctatgtgcataactcttatgcttctatatgtggcttgtacatactataccacacacacgcacacgcacacgcacatgcacacacacactacctggaaataaggtttaaaatacactataaaagaatttaagttaagacatggttaaagttctatgccccagtatagagaaatgccagggccagaaatgggagtgggtgggttggagagcagtgggagggggaagggaaaggggatagagatttttggaggggaaactaaaaaagtggataacatttgaaatgtaaataaagaaaatatctaataaaaaataaaaacaagaaacgtggttgtaatgcagctggctccacaaataatatgctccaattaaccacaatcctaatttaagatggggcctatattggttatagttttgcagtataatatatcgtgtatacaaaatacatattgatgaaattagttatgttattaacatttttagggtaaatcagcattttaaaaaatgatgtttgctttgttctaaagtgactcagatgaaaaaaaaataaaattaaggtgttaaagaacagataagtttttgaggctcaaaattcctatatgaaaaacttacagaaagccaaaagtttatagtccaaacagctagaggggttattggctaatccctgaatattattctgcagtccagacacatccttcagcatgctgtcaagtgtatagtaaatcataagaacttcatgtaatttacttttgtgcaactcacatttactttaacaatagaaacagcacaggatattattctgccatcatagcactgtaaatcatacattatagttctcagactcaaatgattttagagtgtcatttgcaagccaataagttaaaggatatggcatgtgtctgtactgtgtgggagtgaacaaaatatatgtttccatatcatctactcacctctagtattcatgggctgactgatttaaatgggtatatttagaaggatgccaagtccttctgttgtgaaacttagaaaatgcagtttgtcaattttgtatttcattcagaaatagctctctgacaactagcaatagcttgctaaattctgtccaaagcttaaggtttcccaagattcctctgaatcagaaagtaattcataaagtctagtatttgtgtgagagatatattttgatctattcttccatagtacatcacttctgaataggtattaagtttgattgtaaataatacacctggcttacttgggcagcttataaagggattcttaagacaaaaacaacaacaacaaaaaacccagaaaacaaaaacaaaaacaaacaccaccaccaccaccatcaacaacaaatcttttcaatatctttaagacatacatagctcatttcacatagctactgcattgatcactcgctttcattacttgttctgtgcgtgcctgagaaattatggagacaagaacatcttaacctttctctcaaaaaatgttacagtttagttgaagagattaacacatgcacacatactcatattctttatgagaaatactctggcctaaggaattataggggctgtaaattcagaagtctaggtatcaaacaaacacatttgtaaatagaatgggaacatgcatttgatcagataatgtctgaaatgtacatgacacatagtgtattataatgtttatatttataagccatattttggcatctactggagtacctaggatgtgtgctatctattccagattgaaaaaacaaaaacaaaagcaaaaacattattctgcttcctctgttcaaagaaattcatgcactcaggctcagaaagaacagtaagaaatccgttctctctgctacaaaaagctggagtcaagctaacaggcttagtataaggggaacacagaatcaaaaaatagaatgtcctagacaggacagtcagattcatttaaatgaattgaaatgtttttctcttatataggatataacaatcttacattgtcaaacatattccttacattgctgatgaagttcacttactccaagtaacagctaagcacaccaacctggaggagtccactacatgtttttatagcaaaatgtgaagtctctttcatttttctttcactttctcacttttggggggggaatgacatcaataggaaaatgaaacaataggactgagtggagcaggagccagacaggctgtattccagactggcaaaattacactatagaattaattcagttgcacagctctctttaaaaatcacatgggtaaactaatttcccgagggaaactgtattaccttaaaatcactccataaaggagcatgtgcttcatgtagaagacactgaccctagaggaaacaagacccactatgacttttctttgagacatggtctcatgtggctcaggctggccttcaagttactatgtacccaaatgtgactgtttggactccatctcccaaatgctaagaacaaaggcatttaccattttgcctaagtttttcttactgtggtgtgtgtgtgcgtgtgtgtgtgtgcgtgtgtgtgtgtgtgtgtgtgtgtgtgtgtgtgtgtggtttgtgcatgtagtgtgtattttcatgtttcattgaggtagttgaaagtaggtcagcaggtacacttacatgtgaaggctagaagacaatctcagctgtcattccttaggtaccacccacctcttaaatacagacaaggaagtaaccagagaagaactcaccaagtattctggaagggccagctgagtgagttcagagatgcacttattctacctctcctgcactggagttataattgtacactataacatgtgggctttctacatggcttcagggaatcaaacctgagtcctcactattgcttgaaaacacttcactgactcatttgcttccccacccatcatgaggtgattttgtttgttatttttatttgttgttgttgttttttttaattaggtattttcttcatttacacttcaagtcccccataccctccccccaacccccctacccacccactcccacttcttggacctggcattcccctgtactgaggcatataaagtttgcacgaccaatgggcctctctttccactgatggccaactagtccatcttctgatacttatgcaactagagacatgagctccggggggtactggttagttcatattgttgttccacctatagggttgcagctccctttagctccttgggtactttctctagctcctccattgggggccctgttatccatccaatagctgactgtgagtatccacttatgtgtttgctaggccccagcatagtctcacaagagacagctatatcagggtcctttcagcaaaatcttgctagtgtatgcaatggtgtcagcgtttggaggctgactatgggatggatccccagatatggcagtctctagatggtccatccttttgtctcagctccaaactgtgtctctggaactccttccatgggtgttttgttcccaattctaagaaggggcagagtgtccacactttggtcgctgttcttcttgagtttcatgtgtttcacaaattgtatcttatatcttgggtattctaagtatatgggctaatagccacttatcagtgagtatatatcatgtgagttcttttgtgattgagttacctcactcaggatgatgccttccaggtccatccatttgcctaggaatttcataaattcattctttttaatagctgagtagtactccattgtgtaaatgtaccacattttctgtatccattcctctgtggaggggcatctgggttcttcctagcttctggctattataaacaaggctgctatgaacatagtggagcatgtgtccttcttaccagttggaacatcttctggatatatgcccaggagaggtattgctggatcctccggtagtactatgtccaattttctgaggaactgccagactgatttccagagtggttgtacaagcttgcaattccaccaacaatggaggagtgttcctctttctccacgtcctcgccagcatctgctgtcacctgaattttgatcttagccattctgactggagtgaggtggaatctcagggttgttttgattttatttccctgatgattaaggatgttgaacattttttcaggtgcttctcagccattaggtattcctcaggtgagaattctttgtttagctctgagccccattttttaatggggttatttgattttctggaatctaccttcttgagttctttataatattggatattagtcccctatctgatttaggataggtaaagatcctttcccaatctgttggtggcctttttgtcttattgacagtgtcttttgccttacagaagctttgcaattttatgaggtcccatttgtcaattctcaatcttacagcacaagccatttctgttctattcaggaattttcctgtgtgattcttaattgttggttttactatgctcccaaatcaaaaataagtaacaaggacaaatactttttatattctttctgccactattcacaaaactagttattctaactatatagaaatcattgtaatatatagactttggatctggttaattttggtgtgagattttttttgttttatttgcaagtttttttataatatttaattcaaaaaaatttaaaaatgatttttaaatcagcacatgctacttgaaaatctacttgatgatatgtgacaaaatatagtcatacacaaaacagacatggcttctgtcttcagaacttctagtatgacaggtcagatattagaaaaaaaatgattacaggcttggtgagtgctattgttcccagctaatatgtgagaggtcattggagctacccagatgctgattatgggtacccaaggagaagctcttcaaggccatgtttgggactgctttggcttcacttgatgtttagcaagagcaaatagtgacattaaaatgatgaaacaatagttgttatgttgtgatactcatggggcctcagacgatgggccagtgaacactccagatgttaaaagacttagatagacttaggaagtctgccttcttcagtcattgactgcaggtagaattgaagcttctagttcgaccaaggtatcaggaatcctcagtcttagacaacagaaagaattgaagcttttggtctggactcactgagcccttttcatatagaatatttaacatctctgttcaatccttccattgaccagtgtctgcaattccccttctctggctccttactttttagccttcctcagcattagcattctcttgccttttctttatgtctgcatcccctcttcctgctctgactattttcaaactgttcacccatttcttctttagctgtcaggtaattaaactgcctcaccactttgacagttcaggataccaactgcccagctcctgctgacatttccattctactgcatctgctgttgcctcttgcctgctgcttctgatgcttcctatttttgtataagcggctcagtccatcctattgaaaggagataagaaaaagacaactccatagaaggaatgttgaactccagagaaggaagcacaagaaaatgcctcccagtagacccattaatacatgctgggcagtctgttaaaatagacaaggaaggaatgtttgggacatgcatagccatgtgttttgtacagatcctagccttctgttttggattaaccacagctttgtcacttgagcagaaatcacagccaggaaggttaatatttgcacatcacggtacaccaatttacaggcaaatgaccactctatctgctgggccacaggggaagtatttcttctctggcctgagttgtggcaatagttgcaggaccatctagaggttatcaagacttgtgataacaaaacacctggtaaaaaacacttacggctgcattggctgatgctgtgctttcaggagccagggcaatcagcagcagtcatggtgtgctgttctcaagtcatcagtgagtgtcctagatgattggtattaacataaggataagctgccaggttgactgacaacccttatgctcaaggttgccagggaagcatggagaatttaacaccttttatttagggagcctatttatgccaccccacaactactttgtttatatacaggaaaatggacattagaaggagtgctaacctgggcaacagaagacacataccaccactgatcctaggagtaattttaatagtacttttactgggattagcacctgcacatgcccaggaagaactgaatgaaggctgctgtctgtctcattttgaaagaaaagatctcagggttatgggagtttaagtggagttcctaataccatgttagagcagataggagtccaagggagggaatgtggggagacacagctaaaaaaacgtacagacgagaatccccaggctttactttttatattgctgaaattgcttcccagtatacaggacaacggcttcaggtgatgtgaacggagtcagcagcagtcgcgagatgactggttttctttatatgcaagcatctcttttctaggctggggtgtctcaaccctatattccttgcaagataatagaaagccatttcagcttagcatgaaattctccaattcctgtaacactgtagctttatataagattaacccttctccatctgttatgacttctatactacactcagacactgtacaatgtctttgaccttcttccttttagtttcagaaacttcactcacagcaaaaaaaaaaaaaaaaaaaaaaaaaaaaaaaaacacacacacacacacacacacacacaaagagttagatttgatttgatacacttttacagtttatttgttgagagatttctgcaggaataatgccttgtcagtgaagtgagttttccctattttgtaacaaatacccaagaatagcaaagtcatttgaaaatggggacgggggactgcaaaatctagcagcatttgctctgaaacatatttataatgatccaaactgtctttctgtggtgaaatggggcgtataataaagaactggtaccaggcatgggcgttcccacctgtaatcctagtaattgggaagctgagaagagtgaagtcttaccagcttggagctgtactatactacatagtgatttcagacaagccttgtgtacaatgtgagaccccttctcaaaagtaaagaaaacaaaacaaataataaacaaaataacagtgcttgcaaaatatctgagtagggtgcttgggagaggaatacgagggagggaatgtggggagacagagctaaaactaaggcccagggagggagtagtatggaaacttaatacagtagaagcttccaaaagtataagcatatatgaagactctctaggctgggcagtggtggcgcacacctttaatcccagcacttggaaggcagaggcaggcggatttctgagttcaaggccagcctagtctacaaagtgagttccaggacagccagagctattcagagaaaccctgtctcaaaaaaacaaaacaaaacaaaacaaaacaaacaaacaaacaaacaaacaaaaaagactctctaaataaaatcaccaaataatggggagacagagtctcaactggccatatcttgtcactaagtgaaacttccagtcctggaattgggttacatctaattgagttgttggccaaaaggatcccattgaaaccaccaaatatcctatgctgttgccaagactttaggttgctctccccacactgaagacaagaccttattgttcaagacaacacctacacgactcattgtacacagagaagtcactatggtacctacctagaggctttacctttatatgctaatgttcctggtattagaaggtactctgcatgctaccaaaggtaaatggaaacaccaacctagcctttgatctacagtggtgtgctgccagtaatgtaaggtgaagcaatggtggcacaaagcttgtgtgaatcaccaacccatatctcattagacttaaggctcattcctctagatggaaccttttatcagctgcctgtggcacccaggagagttggccctgcacttttccttggtagcacaatagagctagccctggtgatgagcgagggggagccagccttgcccctggtagactgcagcactcaggagagcaggccccataccttacctgggcaatacaacagagctggacctggtgacttgggagaaggcactttccctgtgggcatgagagctgaacaaccagggcagtgctggagagctgaccttggttgtgtgggtgaaggacagctggtgagctgatcaactcagctaccacccacgcatagatccagtgctttgaattggcctactccaatggctaccccatctatcaacagctggggcccttggacatcaacacatcaacatgatcccaagtggcagcccagaccagggacatctctatggcctttcgtgttaagagccatggacagcaacacagactccccgctgttgcagggccatggattcagacacagtcctcagtgtcagcatcaatcaggagctcaccatggcctcggggagcagggcaggctactcagatcaggttgttctttactaaccttgacttaccagctctgtctctcatcattgtgcacactctggtttggttctctttcttttcctctctccactacttatttgctcatcttagtagcaccaatgtgtcttctgccctatgctgagaaagaaaccactcttaagggtaggccataggctcagcagtaaatggccaacagaaaatgaatgtcattttagagggtttttttttctcataaaaattctaatttttatttatatacatatatatgtatatacatatatattccttctatgtgtattttagcctacacatcctttgcacatatattatggccttcagttttatatttttaagggatccctgatatgcaaacaagtgtgcctctgtgtatgtatatatatttatttactgtacctgttcttgggctttattccttctgtttttatatttgttagttttgtcctattccaatgtataagttttgttttaccttattttattttatcttattattatcccttataagcctgcccgtaatgagacagaaagggggtggatctggatgggaagggaggtggagagaaactgggaggagaagagagaggagaaactgtaattaggatacattatatgagaaaataatttattttcaataaaagaggggaagagcaaagcaaaataaaatcagtatgttacatgacagtccataaaacaggctttgcattaagtgatttgttaactttaggataatacaagttttttggttttttggtttttttttttttttttggttgctgttgttcttttttttttttcctatttatgggatcactttattagatattttctttatttacatttaaaatgctatccctaaagttccctataccctcccttcaccctgctcccctacccacccactcccatttcttggccctggcattcccctgtactggggcataaaaagtttgctagaccaaggggcttctttttccgatgatggtcgactaggccatcttctgctacatatgcagctagagacatgagctcaatataagtattttcaatacaccaaggataattaaaccacgagaggtttgtaaagcaaagaaacaaacaaacaaagctgtctgagtagatacagatatatataagcaagcctgatggtccatgttcaatctccagatcccacaaggtagcatgagaggactcggtgtgctctgatctctacacacacacacacacacacacacacacacacacacacacacagagagagagagagagagagagagagagagagagagagagagagagagagagattaataaatataaacaaagaaaacccaagtgaaaaagatccataattttttcctttgttccatatgaattctgcagaaaatgtgataagttggattctcaatgtattcaagaggtctcagtgccagcaagagagctcttcatgaaaaggctattgctgccaagcctgatgacctgctttttgttccctggatctacatggtagagaagagaatggactctctggagctgtcctctggtcctcctcacaggccatggcttgcacatgcccaatttctaaaagattaaataaataaatagatagatagatagatagatagatagatagatagatagatagatagatagatagataagtaaataggtagataggtaggtagatagatagatagatagatagatagatagatagatagatagatagatagatgtgatttttaaaggacaactatgagtacactgtactgtgacccaactgaaaagcatagtggagagattctatcaataagccaccactacctttctccacccaccttgtcccttaacccttgttcaatttgcagtttttctgcttctcagcaatataaaaagaattttcaaacaatagaaagaatactttgtatgtcaagtgtccatgattcccttttctaggtacagatggtactgtcctcacctgctgtgacattagttacaatagcaagtgggcaattcctagttagccctactattacaacaggaaacaagtcctactgtgcaatgtaccatgttactaagatggcatattctatggatcagatggattcaatgcattttcactttgcagtagattgatttggctataactctgttgtgaatctgaggaatgttgttttttgtttgtttgtttgtttgtttcaattctgactgactttgtaggtagaaggtgcccagaaatatgttgaatgaaggaaggcagtctataatctaacagttacagcagcatactgacaataatgctaggtaactcttgaggactcactttcactacttagagaagaaaatggtcaagtgaaattatgtggctttcttcattgctttaggcaatttacagaggtagcattgggaagaatttggtgaccaaggtattcccacttccacatgtgcccctctgcctcctgttttgaagtacagtggctccgctttgctgttctcgtttatacatttgatttcatttgaccagagattcacagagtttaaaattgtaaatcagtgggattttgaggtggcagtttcagagaggaaattgagaagcgggataattatttgaaatgtaaataaacaaaataaccaataaaaatttttaaaatagtaaatcattgtcctacatggtttttaaggagtcagattcgtgggcttgcttcaggtgtcctgatacacagaaatctcaggttatggataaaaaaaaaaaaaaaaaaaaacctagttaatgtggaaagaggcagcttacccagaaggtgcttaaaaatcccctgaagctctaaaggaaaatcattttctcttcatcatgcatatttcctcctgctgagttaagatatgatggtactggaaagtgaactgtcccccaaggtgtactgagagatatttcacaagaatgaggtaggaggagctaagaggctatgcctaaaatggtgtatgttaatgagcagatgcttcagggctgtcactcactgatgttttggaattgtactaagaactaagtgagtctccaggcctagaattctaaatgcaaagtgcctaggaatgagggagaagagacctttgggaaaaattctaagattagagcagaatctggtttgtgtttgtttgttttattttgttttgttggtggtgggttttttttgttgttgttgttttttgttttttggggtttttgttgttttttttggggggggggttgttgttgttgtttgtttttgccttttggttacatcaggaaaggtaggcccattctgtaaaaataccaagcaaggcgtgatgtgatttttggcacataaacctgggaagtgagctgacatgtgaaaggagtaactgtattactatttccaagtacccttgccacctaatgataaaaatgtccctttaaggtattttaataactatatttcaagacccatggagtcatctcacttatttttatttctgaggtttcttcaaataaagtcttagaatcaaggatcttggtttatacttttaaaattttttacatttatatcatttagttttctcctcctctgctcctcctcctcttcttctcttttaaatcaggatcttagtatgtaactctgactgtcctggagcttatactgcccatttagaccaggctggcttcaaactcacagagatttacccgcctctgtgtgctgggattaatgttgtatcagtatactcggcttccccttcagttttctatgctttcattagaaaatattatattttagtatttctttaggtataaccatggcaaggcatgtagcctgtgcaatcctttaggtttgcactctgcttctgcctggaactctttttttggaggtatgtgggtaggagaaacaaggtcttactttgtagcccagcctggtctaaaagttattatgtggtccaggctcatcttgaactcacagcaatcttcatgccacagcttcccaatggctgggatgtaaacatgagccaccaaacatggaggtttgtaaagcactgggccgtttgttttatagtggtatccacaaaatatgtagtcagtccttgtcattaatatacatttatcccaattttactaagctgcattgtctacgtacataatgagtagaaagagagtagtgtgattctttttggatgttaggcatctggagtttgtcatcagacctaagtactaggttagactagctagaaattgagagggcctagtattaggcattggagctttggcatttcactccctgaggcctaaatatagtgctttctcaattgctgtctaagtaattcatgtttgtcatatgagaattgtttctaagttgcatcctatgagatcttttgtaaacttggtcacagaggcaggacagatatagctctggattataaagatttattgctgtcaccagattaaaaaaaaaaaataaccctctagcagcagcattctgccatactggagtgctatacgcaatagagactgataagtgaatgctggcacatgccttgggctctcccttaggagagatgctgagacattattgagattatttattgttattgtttggaacatcgggggtttgatatcttagttaacatttcagttctctgggcatcagaagaaagaaatctcaggcttagcaaacgagaagtaaacactaagctgacaagcatggcagattaaatctgttgcacttagaggtaaggacatcaatttacacatctttgacagaatgtattcttttactgatttactgtgagaacatggggtctttattctcatgggagtcatcttcaaattaacaggagataggtgctggatgtatgtgagcactctgtgactgaacgaagttgtcagacaaatgatcttgttagtcactagcaacagcttgactggtacctcttctgaccaaatgaagaaccatctctttctttgtgaactattttttaaaaatttcaaagaaaacctaatttgactcatcagactggagaggcgtgactgtgtttgtccttgttccttgcagcttacattgatccatcggaaaatggcctattgatgtattttaaattttctttttaagatttattttatatttatttgtgtgtatctatgtgtatgtgtatcatgtacatacagaggtctaaagaaggctctggatcccatggggctagacttgtaggcaactgtaagctgatcgagcataaatgctgggaatcaaactctaattctttgcaatagaggtaagtgcccttaactgctaagccacttcagcagacatgtctttgtatttcaaagctggctcttaacatttaatacagatgaagttagtgtgccagtcttctagtagcacgagttcttggtattcacagactggtaatggctcattatagtttctgaaatgagtcttgttctaagatgggtcacccagtttgcagtatcttattcaggcagacctttagagttagtggtttctgctgagagaggtgaaagctgagatatattttttgaagacatttttaaagggctgccaagcacaaattggactgcatgtgtttagaatgagagagagagagagagagagagagagagagagagagagagagagagagagagagaacacaaaattgggaaggtaagaaattaggggtaaatctcagaggtgctggctgaggagcagggtaaatataataaaaaaatattgtataaaattctctaagaattaataaaatattgtcctggagaaattaaagggctgccaggaagaatgggtcctttgccaatattatatgggttcttttgaattagtgcctaaataatttcttttgcatttgagaataccagctagagaacagctcctataaatactgctgaccgaccacatatgtgggtgtagcagtagctatgtgtaaaaacagataccagccatctgtactagctacttttctcattgctgtaccagacaagaagcaaattaatgtgaaagagtttattttggcttacagttcacatggacacagtccatcatgatggaaaaggttgagcttcagactgatagttatattgtatgtataggcaggaagcagaaagagttatatgctgatacaaaactggctttttttcctttgtattcagtctgggtaaatcttggaaattcaagtaacctaatctaggaactcctttaagggctttcttagaggttagtttcctgtgtagttctaggacttgtcaagttgacaattgatattaatcagtatgccatgtgccttataatgtcacaaatgataacttgctacaattcggagaaacccatattgtgtcttacttgtattgctatcttccaccagggacctcttttctggccctcctcattctccaaatctttcttctgtaaatctttttggaactactatctgaataaaaccttccttaaatattttctttcaagcttaccatccagtctttggaattcatattgttgccattttctgtgtctctctcttaaatgtagcacccagaagatcacaagagaagagcactaggaatgtgggtgatggggagtgaacagcttggaaaataagggctgactaattgcagcatgtgaatcaaaactttaatggtaatatcacatcttccttctaattcttcccccagctccttctcttctcatagtcattccccctcttcgcattctaccttccttctccttcttctaagtacctaattacagttttgcaagacagattacagacagcatggtgtgatattcacacctggaatttccactgattttatgcaattcaactttgagtgccactttgccttgcattcccatagcaacaccacataacagaaggagagaggggaaaaaaaaaaaccttgaaggctcagcaactgcagttcctgaaccttgtacattatgactctgtttctgaaaggaagacacaaatgaatgtggtatcacttcatatgttgactgcttgtatttgaaaaaaaatgttgaaaggatgttacactacaggaataggaaaattttgtgtttaactgacaaaggagaggatatagaaaggtttgtttaagtatcttggtgattgtagtctaagacttaaagaaaaatcatagaaactagggtacctcttactcatgcttccacttacagtgttctctcactggctgatctataggcttacaagaaaaaaagcagaaaaaatgccagaggtcaaacattgctgccttagagtctgatcacatttgtgtgtttaggttggccttttgggtcctgggcccttggctgattttttttttttaatatcttatttgaccaaagacaaaaatttgccattcagattttagagttgctggaaatcttaattccatccactttgtgacttgatgttgctgtttcttttggtcattccctattgtacatactgactctgttggcacgatatgtttccttttaccttgtgtggtatttttcaaaattcctgatagcctcatttccactgatctacctttgactcatcctagaggttttttgctcacaaatttaggtaaattagctcctactccacatctcttccagaactctccataccatcactttgtttgttttctcacggaacatactatgacctgagatttccttctgtgtttgtgtgttgattctctccacttgtcctgttgctgtaatgtagcagtagcctctccgctttatgttcagcagtttcatgggctcccagcacaaacctgctgggtagattaattaattaactaactaattaattaattcagaaagtgcttattgaacactcttaggtgcttaccacatgacaactcattttggaaaataaataccactggccccttggaaagtttactgacagaaatatcagactttgaaaggctaatgagtactgtattcttgttttctgtcatggtggtcctcataggagttgtaggagagagctatttctggcttcatgggcaaagatatttcaaaaatgctccccagagctgaagggtttagcttggcttgcttcggctgtgtttctaggcaccaacctttctcctaatgtaatggtggacaattaagttctaaaaacattggcatggttatgtttatctttaaccaaggcccctaaatgattttgaaaataattcagtatacttgggaaactgacaatatgcactgaaaatatgctttgtggacaataaaggagtttgtgggtttactttgtttattaggtagtcttttaaaatataaggaatgaaagggtttcttttactggcaaaaaataatttactaccttaataaagaaaatgactcctcatgtcattttctgttgctgagtaatagtccttgcaaatactaggtgttattttaattgtcattaatggcctttattaaccatctaggtttctttattccctggaaggtgttaacagtaatctctttttacatgtctgtctgtcagaatcaaagtgtccatgggtgttgatggaaggtagctcttaatgaccacttagaaaatattgtactaaatctcgtaatactaaacaatttcacacatagtatttcagccaagatataaatgttttccaggttttagtatggtatgtgttgaactttactttttaaaagttatgaaaatacattatcttcacactattgtgattataaacaaattagaatattcttagggcaatagttagcacatttgctcttccaaccaagatgttttgccataaatttaattactcatatgcaattgcatgtcttatggaaataatatctgcataataggagatcgtttccttcaggaatgctgagcatgtctagcatgtttcagaaaagcattctgacatcttggtgtttctcatggacaataatggggtcaatatcctcacctgccaacctaaattagaaatcgcccactagatcttgttgaacccttagggctagtaaatatattccaagctcctgaacccaaataacgtattagcagtgttctttactttctttgggccagtctgtatatgtcttgaaataaatgacaatcttaaatttgaaatctaaattagaacacaaaagaaaaagaaaaagaaaacttcttcatttttttttattttttcgagcattcctttacattaatctactacttttgactgattctttgaattttgtttttcatttttattggatattttatgtatttatatttcaaatgttatctcctttcctggcttcccctccagaacccccctatcccattccccctcccagtgcttctatgacgctgcccctcccatctactcattcccacctcaccaccctggcattcacctatatataattggggaattgagccttcacaggaacaagggcttctcctcccattgatgcctgacaaggctatcctctgctacatatgcgtcccccacccccaatgcgtacttggttgatggtttagtccctagaagctctggggggggggggtctagttggttgatattgctgtttttcttatggagttgcaaaccccttcagcttcttcagtcctttccctaactcctccattggggtccctgtgctcagtccaatggttggctagctgcaagcactctcctctgtatttgtcaggctctggcagagcctctcaggagacagctatatcaggctcctgtcagcaaacacttcttggcatccacaatagtgtctgggtttggtggttgcatatgggatgggttcccaggtggggcagtctctggatggcctttccttcagtctctgctctgctctttgtccccatatttcctttagacaggagcccttctggataaagaatttggagatgagtgggtggccctatcccctaacaggtggccttgcctagtctctggatatggtctctacaggttctccctcccctttgttgggcatttcagctaatctcatccctgttgggtcctgggagactcttgctctcctggcatctgggaattgctggtggctcccctctgttccccatcctccattgctacatacctctgttcaaattcctgatccgctgtatatcattctggtctcctctcacacttgatcctgcccccttttccccctcccccccctctttctcctaagaccctcccaccctctacctcctgtgagtattttgtttacccttctaagaaggactgaagcattcacattttgatcttccttcttcttgagcttcatatagtctgtgaattatatcttgggtattccaagcttttggtctaatatccacttatcggtgagtgcacatgtgtgttcttttgtgacaggtttacctcactcaggaaaatattttctagttccatccatttgtataagaatttcataaattcattatttttaatagctgagtagtactccattgtataaattcaccacattttctgtacccattctcctgttgaaggacatctatgttctttctagcttctggctattataaatatggctgctatgaacatagtggagcatgtatccttgttatatgttggaacatctcttggatatatgcccattgaattttgttttaagctgattttaaataagacagtaaagaatgcctatataaacaacaaaatataaatataaatatatattaggaatacaagattatttgtacatatgttacaacagtaaattgtacatgagtgtgtgtgtgtgtgtgtgtgtgtgtgtgtgtgtgtgtgtgatacatttacaggtatttttgattgtccgtgagttctgatcatgagtacatgttacttaaaatttatctactgattcagtgtaagtttgaaaatatgtcagtaacatctcctaagatgtactctccattgatttttcatgaatttcagcaaaactttagacaaaagatttagaaagtcaacctcatttggctttccctcagaaatagagctgatgatttatttgacagatgaaatcaccagaattccacacagtatattattccatgaattctgttcttatatattcaagaaaaattaaatctctactcactttttcagcagaataagtattaaaaacatctagaagtgccttagtttaagcaacatagccaactacatgcctaagaaatccttattataaaatatctaacaatactgaaaggcatgtagcatgcttacagagagtagaaaagaaactcaaggaggaatcaacaacatgaatggaagtgaaaagacaatttaaaaatattatattgtatttttaggagaaccaaatgtgtttttaagaaatgaaaaattcagtaggttaaatctagctggagattaagaataaagagaagattcatgagctagagaaaaaatctgagcatattgtcagaatgtgttacatagagacagatgtaaaatagattgaaaacatggaggacagaatggcaggaagttttatatgtgtaattaaaattccaaaagtaaagtaagaaaaaaatatatcaaggagaaaatggctaaatcttcagagccatgagaaattatatatgtacatatatgcatacacacatacacatatattgtttcacaaaaagaaatcagcaattatgcacagaagaataaacttaaaaacattaaaaataatttaatctttccatctacaaattatgtaatgaggaaaaaagctattttggggacaagaatggtccatagaaagtactaagtaaaataacagaatgtcagcagtcacaaaaacatagactgttttaagaaatagacaacacatggcagcttgtgtgttgagaaaaaaaaaaaacactagacacagtgtgagagctgactaagtatggtgtgacctttagaaaccttaaaactaattcccagtgacacaccacttctcagcttctcaaggccacacctcttccaaacaagttcttgccactgggaaccaatcattcaaatgtgtaagcctatgtaggcaccaccacagctgacatggtaaatacatagcagattagactcgattcaccagatactgttttcaatctctcctatgagaagctttgtatggcacgattaataaatttaacttattgaaaaatcttatgtcgagtatttagggaatatctatcatgaactgtttattaaaattctcacataattagttgcccataaaccagttatcaatatttctcatataatatattcagtacaaattatacttttataaccagtagcatcaaatttgaaaattgtttaaaagacatagagaattctgtaaaaaataaaaagtgtgcatataaataaatacttattgtttacaaattcatagaacattgaaaagtatttacagagaggaaatgtatgtgcctctctttactttttaaacaaaataaaatacaataaagtaaaaaaaaatcatcatactgaagtcaaataagacaaaccaacagaaagcaaagagccccaagagaaagcacaagaatcagagacccattcattcacatactcagtagtcccatagaaatactaagctaatagcaataaaatatacacagagggcctgatatctgtgcttactgatttagtctctgaaagctcataggagatttgctacatgctaaggtgttttagagggccttgttctcctagtgttctttatctcttctatcacccctactcctttagtctcctctatggggttccctgaaccctgaggggaggaatgtgatggaacaaggtctcagagaagaaatcttaatgtaaaaacttatgaaagcaggaaaaatgctttaaaaattttatggtattaaaatataacattaacaacaaaagttaaattgtctgaggagatggctcagagttgaatatttgtcttgcagagaacctgggatcaattcccagaacccacctggtggcctcacaaccacatatatctctagtttcagaaaatctttgtctgtctgtctctgtctgtctgtctttcccctctctttcttacacatacacacaaacacacacatacacaaatagaacacatatatacataaagacaaagtactcatacgtaaataatacattctaaagtataagtctcaataaaacaaaatataattaattttctaaatgtccagaatagtagaagaaaaatgagcatgaagaaaatataacatgggtacagaattaatgaagcaaaaaatgcaaccgagaaagttgagagtgtaaaatttgatttttctgataaaggctaataaaatgaaataacctttcataatatatattagaaaccatgcaggtgagaatgagaacccaaatgagcaatactacacatttacaattaggctatgatgagacattaattaacaagaaaatatgtaaaggcaaccttccagaatacatgaaaatttaaagaaggtccaaattttgaaaaaataattttaggtgtgagggagaatggatacctgaggataaaatatggagttggagttactcttttggcttttgactctgtttaaatttaaactgaatacttcatctagtccacaaacccttataatccataataattaatcacaaactggttatatccctatattctagaaacaaacccttgaaaaaatgaaaaaaatgagtttattgaggtctaactctaaagattaaggtatataaaacaattataactgatttttaagatattatttaaggaaatataagattttatcaagatttagataaatgggggctggtgagatggctcagtgggtaagagcacccgactgctcttccaaaggtccgaagttcaaatcccagcaaccacatggtcgctcacaaccacccgtaatgagatctgatgccctcttctggagtgtctgaagacagctacagtgtacttacatataataaataaaaaaatctttaaaaaaaaagatttagataaatgcagataagtaaagcgtattatgatacccttactgtgctatatatagcaagtatctctactttatgtgtatattcagtctaattccaaacaagaccacgaaggtatttgtttgctttaactcaatcacaaaggaactcacacaatatgtacgcactgataagtgaatattagcccagaaacttagaatacccaagatataagatacaatctgcaaaacacatgaagctcgggaagaatgaagaccaaggtgtggatactttgcccctttttggaattaggagcaaggcacccatgtaaggagctacagagaccatctagaggctgccatacccggagatccatcccatagtcaggttccaaacgctgacaccattgcatacactagcaagattttgctgaaaggaccctgatatagctgtctcttgtgagactatgctggggcctagcaaacacagaagtggatgttcacagtcagctattggatggatcacagggcccccaatggaggagctagagaaagtaccaaggagctaaagggatctgcaaccctataggtggaacaacaatatgaactaaccagtaccccctggagctcgtgtctctaactgcatatgtatcagaagatggcctggtcggccatcagtggaaagaaaggcccattggtcttgcagattttatatgcctcagtacaggggaacgccagggccaagaggtgggagggggtgggtgggggagtaggtgtgggagggtgtgggggacttttgggatagcattggaaatgtaaatgaaataaatacccaataatactaatactaatactactactaataataataataataataataataataataataataaaagaaacagaagcatagtccaaaatccagaagaataggggactcagcatagtccattaaatcccatgttgatgatcatgggatatcagaaagctttatgccttacagatatcaaaatttattaataaatatatggtaattattataactattttatataaaagtaaaatactagaatagagatcttagagaagtcctttacataaaggaaaatttaatacaaagggtgaacatttaaacctaggtagctcaataaacaacaaattattagttatgcacatgtaaaggagtgtttgcaatttcagaacatattttaacatgtagttattgtttttaaaagaaaagggtaaaactattttcaataatataaagagagcaggttatatacactcaggatcaaacataatattttaagttttaagaaaaataaaatactgaaatgactaatttattcccctgtgttaaacacttctcataaaaatgccatttgaaaacattcaaagggacatcaagagacacaaaatcaactaataatcactatttattatgtaatgaaaaatattcctactaatcaacaggaagagtacaccattcaaaaggaattcagggcaatcatgaataagtagtttatgtaacaggaaacctgaataaatacagggaaaaatgttgaccctgacttgtaattagagacataaaggttacatcaaaaatgacatgtaattttcttacccactgcattaatagaaattcactgtatggctatattgaattttcatgaaaatgtatgtaagcatcaattgatggagcttataaggaggcagtttatctatgtgcaggaaagtagacatgggcatgtcctataattctatttgtaagtatattccctagagaaatccttctataattattctaaaatagttgtagaagatttggaagaattttgtagtttctaagaaaatttcaagatagtttttttttgtttgtttgtttgtttaaggcaggatctcactatatataccaaactggcctggaactcacagagagcagcttttctctactaggattcaatgtggggccatcatgttcatctaggagaaaaatatttaagtgatgcatttgtcagactgggtaatatatacacaaattttggtataatcagaaaaaataccaaataataaaagtaaatgaggtggaaatcaatgaagtaacatgtaataatgaaaaaaatcaaggtgatgaataaatgtagaatataattccatttctaaacattttgaaagtggcaaaacaaaaaattgcatgttttatacttctatgaatctacatatttttaaaatgggtcaagagaataaaaacattgaaatctttaaaaattttatttgccacattgttagaatagaattcagaattcaatagtggaagaatacacttcactgtattcaactatgttggttatgtttctcagctgggtggtatttcgtgggtggtaattatattaatatatctccttgaagttctaaaatatttcataacacattagaaaataactcaccatgatctctctgctctatataagattttcctcctacacctctgcttttcttattgatcctatcaattcacaactcgcctacctttgaaacctcagcagtagcatctttcattttcattgccttccatagccaatcagttgacagcatggtggcatttctgctcaactgtttccttctcctattgctcttcataactcttgtgatcattgtgatcattacattaactgtgtcactgaccttgctgtatctcgccagtggttctcagccttgcctgaacactggaattacatacaggactttgaagggagaaacctgaacccctacccacttagtacatggagctgttactcacatggaatgatatgaattaaattataaaaaaattttagaagtaaatttggaccatgacctaagaaagttaagtgaagatcttaaaatgtaaatgacctaagacacagatctaaaatccttgtaggaaaaaaaaaattgataagtaccactctataaatattgaatcttcacagaaaaaaaaataaaatgaaagggaaatatcattaggttaatatctttttgtcttaggaatcaatacaagattgtttactataaaatagtttaagaaaatctttaagagaaacataagtggcttaaaattttggaaaacacacttgattacattcatgaaaaacaatagactaaaataagagacacatactaaattttgcttatcagcatcactaacaataaacctcctaacatggtttgaagctattactagaaaattttgtatgcagtagttctaaacctggggcagtttggtcacaaaggggacattagtcaatgtctacagacaattttgattatcccagatgtggtctatgccactagaatctattgagtagaaccaaggaattctaccaagcatcctaaaaatgtacagtgctgatgtccacaacacttatcttacccaggtttcaattgtcctatgacaaaataatgctgtcatagataaacaatacacacaggtaggtgttcaggggtattctttactacatcttttataagtgaaatcctggggataggggtaactatggcaaccaatagatatgtgcctgaaagtgttggacacatccatggtgtgcttctgcattatagaatgaataagataggtagataataatagaaaatcatttatgacttatgtcaagaaaaattagtatacaggacagtttatgcagcatattcccatttgtgaaaaaggaaagtcatacctgaatatttccatgcatcacatacatttatgtaataatgtgcaggaattgtatggttaaggataattaccaccagtccagatgcaaactcatttttattgcattctcttatgtaaaatttaaaatgttgtgttattaaggtgttaatttcttattatttaagaaacctatgttgagattattcttctgacttgtttcccacgctatttctttattataaaataaagtgataaccaggagtaccactgcagataaataggaccaatgtacatttttttgtacctcctacttgtgaaatctttaaaatttctgcaaggtatgtgttatctcaaagactacattttaatattttacatgtgatgcatcaattttatgagtacatgaaacacttcttaacacgtttgctgtctttgtttcttgacatgttactactgaaaccctacacttcagttatccatgaggctgaaatatatccattatctccattctttgaaaggaacatgatacaaagtagaaaaactcattaagttgtttcttcctgtatacttcatcacttgtcttgttatcacacaataaggccaaatttagtatgaagttcagagttcttgattatgttagccattgtgtattctacaaaaaacaaaaacaaaaacaaaaacctttcattagatcttaacttagatggagatataagaaactattgaatttctgtcattcattatctttcctagaggctttgtagattctgcattcacgacatcattttattgttgttttgaagttagaatttgatttatcactggagctttaatttatttactttgtggttctaatatccaacttgtacatcaatatgctcctctcacaatttagcattgaaaataaatggggtgcaatttggtacttatgtagtattatattcaccgattatatctagctgaagcatgtattctattccattgctaaattataatcactccttcaacagtgttgctgttcttcacttaccaaataagttgggagtcaatgagcttactttctacagtactctgatgagttattttcctactttaaaacaaagtaactttggaatttaagataatattgggatgatagtttatcatttacaaactctatgtaaacataagaaaatgtgctatggctaattatagtgtccagactaagagctttcagtctcttccagaataatttatggacataaagttaatcacacttgggagaatttcaaaacatttaattaagaaaaatatgaaaagtgcttttgagaaaacatggcccatagcaataccattaccctcactgttaaagtggctgcttgtttgctcatctgttcctatctgtatattgctagacaccatgtgaggtagccaaaaatatagagtaaaaatggccctttgccttcaagatatctctgtagacattaattaatgtagaaaaataactatgtttttgtgattcagacaagtatcagagaaacagactcaaatgtcctggggacattaaagcagatcagatggagtggtaggtagagtttgaaggatgattatgttactatttcaaacacaggggtacagaataatgctcatcactagttagattccataactaaatgaaggttaaaagcatattcatgtattgtgaataataactcaacctaaaatttgtgctatacaaatcttcttttgcagtgttggggaatgaatttagagcctcacatattctagatatgtgcctaatcaccaaattttgttcacctcaaacttatatcttaatatatgatcatttgaatgcttattgttttgtaatggaaataatcagagaaaatgaagagcagtgatgtcttacaatttttaagttttggtttagaactaacttgaaacactatatctaaagccagctactactagtaaaaaaataaaagaaaaaagacaatgaaaagatattacaaacagtatctgagtattgatgaaaactcaacaatattgtgtaaagtatgctattataaggcaaatatgttttacttatgttggtaaaagataggaataaatgactttttaacttctgattctatgtttattaaagaatcagtaatagtttatttcattctagaatacttttagatcataaccaagagctgaggctctcagaccaatttccattgtgaaaagaaatattaaaacaaccccactgatgtggaatggttgaaacaatgcctagctggtaaagaatcattacacatgctgggaatatataggtgcttttgtctgacatgtgactgtactgaaaaaaaaatgtcagtttgtaaataattcctcttgtcagaaagataccatccatatggttttcccagaatttagtgtgtgtcataatagagaaaatgaaggaactttgggcttgtcaatagaatgacaggtaatatcaaacatttttctttaagaaacatttttcagaacaagtgaagcatttaatgaatgcctttgaagctatcaaatatttgattttctttttccaaagacacggatacattgcattgacagattatttcattgtgtagacctgtctttcactgttggcattttaccttagaaactcatgacttacaaaatgaaatgaaatacttgtggaatattctaatgccaatattgtacattcaaactggtctgttcattttttattacttgatgtcatgtcatttgcctttagctcttttgttcacaatatttttattcactcttggcatttgtacttcaaggttctgctgaaattctgtctgctctataaagcttttcctgactcttgtctttttgttccttccttcttctgataatctctgtagtgctaagcactcaatatgtaatcttccatacagtggtctctagattcgtatgttgatatcctttgccatcatagttaatgctgcaggactggaagctgttttgaacctgttgaattaaaaatgatctttacctgagccattggtatgctgttcaggaaaatttcccctgtgccgacatgtttgaggctctttcccactttctcttctattagtttcagtgtatctggttttatgtagaggtccttgatccacttggacttgttgtacaaggggataagaatggataagtttgaattcttctacatgagactactccacctaaggatccaccacatctgcagacaccaaacccaaatagtattgctgaagccaagaagcacttcctgacaggagcctggtatagctgtctcctgagaggctctgccagagtctgaccaatacagatgctcatagccagccattggactgagcaaggtgaacccaatggtggagttagcagaaggactgaagaagctgaaggggtttgaaaccccataggaagaacaacaatatcaaccaaccagagcccacctccagagctcccagggattaagccaaccaaagagtacacatggagggacctatggttccagctgcatatgtagcagaggatggccttgtcttacatcaatgggaggggaggcctttggtcctgtggagactggattcccaggagtggggaattgggggagaaccctcatagaagcaaggggagggggatgggatatgggatttgtggaggggaaaccaggaagaggtataacatttgaaatggaaataaaaatataaccaattaaaataaaataaagacttacaaaaaattatgatgatctttaaagacccagttgtgggctgaggtgagaatgcgttagcttaacttaacacaacttaacttacatagcccagagtcctagtaccagaataggataataataataataataataataataataataataataaaattaagacttacagaaggctaaaatgagacctcatattaattgcacagcccagtatatgacacatggtagctacccaataaacattagctattgtcattatatgttattagacgcgttctcacgaccggccaggaaagacgcaacagaccagaatcttctgcggcaaagctttattcttacatcttcaggagccagggtgcaggaagcaagagagcaagaagcaagagagagagaaaacgaaaccccgtccctcttaaggagcattctccttcgcctcggacgtgtcactccctgattggctgcagcccatcggccgagttgacgtcacggggaaggcagagcacaagtagtcataagatacccttggcacatgcgcagattatttgtttaccacttagaacacagctgtcagcgccatcttgtaacggcgaatgtgggcgcggctcccaacatctccccctatccttttaataagagcaaataggccacccatattaatgagagtggagatagaggtcaaatccccagtgtgtaggtaaaggagccatgtacaggattagctcttaggcttacaggcttttacccagagcaaccctgacctgctcccgtgtcgttttgcctgggggaagggaactaggacactgaaccttcatgaaagatgacatgtctccctagaataggctcatatatgccgcagagcctttccattgcagtgcttagccttgcaactctctcgggctgctgaagcacactcactctatcccgtgcaatgagtctagcctcatgggatataagagctgagtggccagcgacctattgcctaagcatagatatatcatatatcagggggagctccatgttctagtcctgcaagcgcctgggcaataaccaccttgtctctcctagtttaggccttaagcttacagaccaatcaaagaagcaacactaatccacagcaaagtgtatctccaaataatattaatcccacccattttttaaagaaagaaaatgctgaggagatccaattgggtaatcttttggtcagggacaggtccaagcgcgtggagttgacctgaagtctcaattcccgaaggatctgttcaaattcagccatccaattctgtaacatatactgaaaaagactttttgacaaattagctgtcctagtaaatttaacatactgaatggaaataacacacaatcccggaaacttttgttcacatccctgctgagttatttgtcataatacatttagttgtatctggacaagatctatgagttgattaaccagcatgagacctccctgtatcttgacattagctgaggcctgttcatctatgactgtagtcactgaggctgacaaagtgttaatggtgtcagtcatctggacccgtccagacagagccaaggctgtctgaatcaaggctaaacccagttcctagttagtggtaaaaaagcaggagaatacttgagcattatacatcaccgtcattgggagtggaaatgtcgacattatcccccaacgctgctctctctttattattgacgccctggacatcaccaagacgagggacattagtattcccttggtcagtctggatttttcgggtgagtctttctggtacccaaaatgggttgtcttcattctgtgggaaaacacagatagctcccctggatcttatcaaaataggatccgggccataccatttattatcaaggacatttttccatttaaccatctcattgggcctatctggctctgaacaatgacgttcagccgcagtatggccatgaacatcaatatttaaaaaattgagtgtaaagagtgccaaagacaccgacactcttggtgctcggggtaaaatctcttcaattcccctcttctgttttataagataggctttgagggtgcgatgcgcacgctcaacaataccctgtccttgagggttgtatggaagtccagtcaggtgggttacgtccatctgacggcagaactgttggaatttttgagacgtataagctggtccattatcagtcttaaggagtctgggtttcccccaagcactccatgcctcaaggcaatgttgaatcacatgtgaggctttttctccggttaacggagaagcaaacaaatgaatgagatgactctgtggtgggccatgctttgggccaccaatgtgtagagattatacttttatctgctccggtatcaaggatgccttcaaactcttttccattaatcttaaggcggagcttaggtctatcatttaaagatacaaccaaataggcagaatcatttcctgaggagcccattttctttatctcaggtcctgcagatttctccctggtattatcagggaggagcagcagctgagctatcctatctcctttactaatagaaaaaacgcctttagggcttgagcacaggacctgtatttcaggggaatgttgacaatccataactccagggtggactactaagccctgcaaggtgagtgaaccccggccgagaataaggcccatggttcccgggggcaaggatggtataggctccactggcaccggctgaatactcatttgaggcattaataggaagtcggaggcggcacgcaggtccacccttgtgggtcttcctgggtcgcctctctgactgcttcctgggtcctgacaaaccggttcccatatctttgagggccctgggaccgagggcccgatgacccgttttttggcacatcagttgattgactatcaggtgggggaaggactctgccctttatatccctcacagagcgacactggtcagctctatgataacccttgccacacttagagcaaagagtgagagtccccccctgtttatctggagctctgcaatctttcttaaaatgcccaggctttccgcaattaaaacatgtcctctgatcatttctgctcatggagcggttctgagattggaggatggcggccgctaagcctgcattggtgagaggtcccccaagctctcgacagaccctgagccagtcttgtaagcctttgttctttcttggggctatggccgctcggcactcctttgtggcttgctcatagattagctgttctatcagaggcgcggcttgctctgaatctccaaaaatacgctctgctgcctctgtcattctggccacaaaatctgagaaggattcctgaggtccctggattatctttgttaactgaccagtggtttcacctgctcgagagagcgccttccaggccctaatagccgtggaagaaatctgggcataagctccccaatggtagtttgtctgatcagcagaataagctccctgacccgttaacaagtcaaaagtccaatctctctgctctggagtcaaagcagctgcgtttgctcgggcctgcgcttgtgcagcttcgtgccaaagcgctctccattccatatatttgcccatactagggagagcggcttttacaaccgtttgccagtcagcaggagttagtgccatgctggcgagcctgtctaactgcaccaaggtaaaattagcattggttccgtatttacggaccgactcggcaatttctttaatttgtaagtattctaccggagcgtggacacgcccaccctcggctccttcaaagaccggaaatgcctgttgtattttcctttgttcctctctgggaatgaatgagtctgcgcactgcctctctgcgcactgcctctctgcgcattgctgacgcactacgcagggcggggactccgcatagggcggaccttgaagccgactgccctgaggttgaacagtacgctggctttcgccagccgcttttggcttttttcttgaccaattagctggctggtaatgggctgcttcttcctcccagtctgtttcctcagaggaggattcttcacctgcttcagaactactaagagctggctccctgagctcatctagtgacgagtatctcctagagacctccgctaattgatctttcttcttttccctttttcctctttttcttctaatctctctccaggtattcctacctaaccttaacttttcctcgggttcaagacccttggaaaggcctgtatacttattttgtgtaccatattttctctttgctcctactctctctccccgctttacttctgatagcttgtcctgaatttcatctagaatcctccctatcttaaccacttgataacatgtgaaaaggaacaaaagggctcctaacaccagaaaaaattcaaggccaaacatattccactttacttctgatagactgtcttgaatttcgttagaaagttcaagatcagacttacctcgtaaagctgtactcactggtactctcgttccccagctgaaaagttctgaattcatacagttgaatccttcttaacagtctgctttacgggaacctttattaccgcgacccgcagttctggttctggaatgagggatcttccttgcgccagtcccgagttttttctcgtcccggaattcggcaccaattgttattagacgcgttctcacgaccggccaggaaagacgcaacagaccagaatcttctgcggcaaagctttattcttacatcttcaggagccagggtgcaggaagcaagagagcaagaagcaagagagagagaaaacgaaaccccgtccctcttaaggagcattctccttcgcctcggacgtgtcactccctgattggctgcagcccatcggccgagttgacgtcacggggaaggcagagcacaagtagtcataagatacccttggcacatgcgcagattatttgtttaccacttagaacacagctgtcagcgccatcttgtaacggcgaatgtgggcgcggctcccaacaattatacactatacaaatacttaataatgactacctgattaaacatttatattttaagataaaatacttatttctatgctgcaaagactcaaaccatgaccacagatgcaaagcaaatggctaaaaaaaaaaaaaaaaaaggaaatacaaggtacttcccctacatgtacatgatgagtagtttgttagacttatctaagcaaataattgctggtttgggtatgttgctatccaatgccattataccaaattttccagagaatcaccactgagaataaaaaaattgaagactacagttgggcctatgaagtatttagctagaattgctacttaccttagtaaaacaagcattttcaaatgatttctgactttatcatctgattctctggcttgattagattgcttgagattatgtgtttaggagtttcaaagtcttttaatcgtgcccttatttcttttaagtgttttatacatggaccggtatttcctctccttattctcctgctggcggaaatttcctaattataacaaagcattaagcaggggcattaaatacaccttgcctcagctttacagacacagctaatattaacggaagagattttgtttagtaaagtgtagagacctggttcacatattttcccatatggtggtctattcttcattacagcttacattaggaggatagaaaacatgctctattttgaaatggtacatacagcattcaattgtcccagtccatgtacaaatatcttattcagtaattatggtgattcaaggggatggccaattcagcacagaaaatcatgctcctgggacatgagtcaaaacagtttgtgaaaaggccagagggtaacacaggtcttttgagactgtgagtcactatgatatgtgcttctgacagcacacagcctaatagcagtgacttgtttagaatatatatcctgattgccttcaaaaggctttgagttaagtcaagcaaaatgacatacagatgaaaatttggggattcaaataaagacaagtctgttaatgttttattgttctccaatatgaaattgttccttatataaaaccatgaagattttcccctcttgttttgtacattgtctctgaaattgcatcccctgtctgctcttattgcacagaaagatgccccctccattgtagcttcatcatgaacatggagcctggggaccagagtggcccccactgaatcatactgagtagctctcggaggctttgtgacagctcttacaaatgggtctgacgtgagtgtgcgcgtctctgtgaatcattcattacctgcatgatgtgtctctccccaggcaataggcataatagcacaaccccctcagtaaagcgtgtctgataaattttgcagactgttaatggaaaattttcagagttattctttctaaatgttttcgtttatcttgccaaccaaaagcttagtacaaacacatttgccagcagccatgaagcacggagaccaagctctgtttttaaagtgtctagaaagtgatttgctttaagtctccaagaacaaaaaggttaaagtgtacacagtgttggctctactgtctttcccctgactactagccatcttctgcaatatggagagttttcttccaggggtacatgccttagcaaaattgtatggccacaatcatcaactcagcattttcttgtcatctttcagtccttataaactccttttgaattgacagctgccaccaacatgtctttgtagcaatttataggtgagcctaactgatcaaggtgaaatttgttactttctcattaagcactataaaattgcaagcagattatagttaagagcaaatgcctttttgtgtctcaagaaattagttttatctatttcgtttgcttgtgttttgagacaagtttactctgtgtagccttggttgtcctggaactcactctgtagaccaggctggccatgaactcacagagatacacctgcttctgtttcaaaagtgctaggattaaaggcatgcactattactgcctggctacacgttatatcttagtagtagttgtttacaacaaactgcttctgtatatgtcaaatacattttattttactataatatgattgatagaaagacaccaatatataggttttaccatttttattgacatgtaatacatatgtaatctcatttgtgttgagctttgattgcctgaaaagatagtgtcactactttgtataaagtcatatcccactttctgtcaatgaagcctgctttttttttagtttataaaaatctattctaatatttttgtgagaattaaaatcataaatgaaggctgaaatggctctacaggtaagagtgcttgctgtcatgcctaatgagctgaatttgagacttgcacacacatgatataaggaaagaagtcgcatctataagttgtactctgaatccataagaacagagtggcactgcacaagggcatacatatggacacacatacgtgcatacacacagtcatatactaactaaatacacacacacacacacacacacacacacacacacacacacacacacacataaaacaaaataaaaaattctttccagaaatactagagtatgttttgtgatcttttgataactataaatcctgaagtcacttgttaaggaaaataattctttttgtcaaattattattttatttagtcatagagtctaggcctttccattctggtgtacaaatatacaaattacaagataatgaacctgcttgtactatttgtgttatgtttaaggtgacaaagagacttaatctaaagctaagcatgttagggttcctgtaacaaattgtatgctcagcatttttattactttattttcttttttcttgtatgccatgaaagacagctgtcacttatgaatacatcattacagccatcatgacacagtgggaagctggacaaaataagttctttcctcctcatgtgctagatagttttatgtcaacttgacacaagctaaagtcatctgggaggaaggaattccagttgagaaatgtctccttaagatcaggctgtgagccagcctgcagggcattttcttcattaatgattgatggaggagggcccagcccatcctgggtgatggcagtcctgagctgtataagaaagcagtctgagcaagccagtaagcagcgtaaagtcctgtggggcccaagccattaggaaataaaggggtgggagagacccatgtcccaccagagctctgggagactggacgggcagacgcaggcgactgctgtgggaccccacagaaccatcagaacgagcaggctgggtgtaggacaatgttaggccactggaacccgctccatgtggtgggggaagcacagactcgggtgattctcagtctcagacatcccagactccgctggatgtggcagaagagctgagaatgaagtgggggccctgggggtagctcagtcagccctggggtcaaagttagaaggggcagggggagaaggcactgggtggttcctacacagataagaatccctggtccagtttggtggctggaaatgctgggaggccttcctgtggtgattagatgctgctctttagagaaaggcctattccatttctctagctctgcaggtcttgagaagcagagagggcccatggtttttgagctttattgtagagggggagagggggagaggagagaggagagaggggagagaggagagggaagaggggaagggggagggggagaaaggagggagcgggggagggggaggagggacgagaggggggaggggagagggaggagagggagagggaggagagggagagggacagagagagaagaaacaagaggggggccatggccacatggagagagggaagaagggaagtgaagagagagtccagacagcctatgtcctgctggccatagaattacggagctggggccttgtgtcagaagcctatgtctgggagcatgtaaaatgggccttatgtcccttgcaaattaatctgctgggtctccggggtttaaacctagcttgaccagaaaacaggcttcctttcacggtcccacatcatccctccatgacttctgcattagctcctacctccaggtccttgccctgcttgaattctttttttttttttcttatagaatgcggttcttttaattttagaaaatgttttcatcatacgtattttgtctccattgcacaattgtttgagttagggtaaacatttttaaaatatttttttttccattttttattaggtatttagctcatttacatttccaatgctataccaaaagtcccccttacccacccacccccactcccctacccacccactccccccctttggccctggcgttcccctgtaccggggcacacaaagtctgcgtgtccaatgggcctctctttccagtgatggccgactaggccatcttttgatacatatgcagctagagtcaagagctcaggggtactggttagttcataatgttgttccacctatagggttgaagatccctttagctccttgggtactttctctagctcctccattgggagccctgtgatccatccattagctgactgtgagcatccacttctgtgtttgctaggccccggcatagtctcacaagagacagctacatctgggtcctttcgataaaatctttctagtatatgcaatggtgtcagcgtttggatgctgattatggggtggatccctggatatggcagtctctacatggtccatcctttcatcacagctccaaactttgtttctgtaactccttccatgggtgttttgttcccacttctaaggaggggcatagtgtccacacttcagtcttcatttttcttgagtttcatgtgtttaggaaattgtatcttatatcgtgggtatcttaggttttgggctagtatccacttatcagtgagtacatattgtgtgagttcctttgtgattgtgttacctcactcaggatgatgctctccaggtccatccatttggctaggaatttcataaattcattctttttaatagctgagtagtactccattgtgtagatgtaccacattttctgtatttttattaggtatttttctcatttacatttccaatgctatcccaaaagtcccacataccctcccccaactcccctacccacccactcccactttttggccctggcattcccctgtactggggcatataaagtttgcaagtccaatgggcctctctttccagagatggccgattaggccatcttttgatacatatgcagctagagtcaagagctccggggtactggttagttcataatgttgttctacctatagggttacagatccctttagctccttaggtactttctctagctcctccattgggggccctgtgatccatccaatagctgactgtgagcatccacttctgtgtttgctaggccctggcatagtctcacaagagagagctatatctgggtcctttcagtaaccactaccactttgaaaggtgaaatgttgtatggaactttgaatgaaaaaaaaacccatctcttcctgagctgccttctttatggtattctatcatagcaatagtaaccctaagagaccccagaaaagggaaccgacgttttgtaagtatagtatataataatgatggacatatagtggagtgcatacctggaggcctgatggcaaatcagacacaatatttttgccattcttactctaatttacgtattgaatattctaacaatagtgctagtgcaggggcaatatttcttgtaagtgtatacttacagtaccagaaaaagatgaatgagtataaatggcccttggactgtatctctctgataaggcatgcccttctactcttgtataatatttcttgatgtacaacattggacacatttgaatattggaaggggtagtagatagataaccaaattttctcatcacaaaatcattacctatttgaatactatgcctctctttgaaatagaaaccttataagttttagcatctactcagatcatttcagcccattttaactcattatgttgtgatactacttctacatcattatttcttcatctcttattttatcatatgtaatataatatttcactgccatacatttctctaatcttgtgtcttctttttacctttaaatcattgagcattgccaaaattctatctcttgttcaagttataaatagtatattttctgtgtcttggtgtgtgtgtatctgaagttagaaaaaattttgctcttaattttcagttgtgttgtcccttatcacatttattttctgctaagaactaagctgttgcaagtcatggataataactactaaattttaaattctttataactaaaatgtattccactgtctgggaaaaaagtagcattgtacatctcttcattcataataggaagttttaatgactactctatataaggaacatcacaaaatatgaaaaacctgaggtcgtgtctttgtatagttcatatagtttgaaaatcatcagaaagctttaatggtattttacttatttgtgtcatgaaaacaaaattctattacatttaataaatcattcctctacctctccctccccattagggtgtaattggagattcacttttcctaacattgatggcattctttgagagaaaggcagagagaagagagagggagagaaggggagagagagacagagagagagaaggtgagagagagagagagagagagagagagagagagagagagagagagagagagagaagaggagaggagaggagagaggggggagagatagagagagggagacctgtgttcttgattttttttttctgttagaggcataagagagagaaagtgattgataatgtgctattttttgtcatatactaactcttgcaaaagaaggttaagatgatgggggaattataaaaatgtaacaggtggaaggactcaaaaatcactaaaacatcaatggcccaagaggaaagggagacctttaaagcatattgcaaattattattccataaagcaaacgtattatttgataccttcttggaggtcagtagcggttgaaagacctgtattgaagaattatgtctaaaggtcagcagctgttttatagcagatgcaacttactccagagtatatttaagcacatttttaatagaaattgtgattagcaccaggatgatagtgtatctctatagaattctaggatctcctaaaggagaaatatttggccttatcaaccctaataaagttcatggaaaacaccatctggtgaatgaaggtacagaaattgacctggaattcagtttagtagcgatgtaacacattttgtacttatctagcaccttagtttccatgtattccaacaaaaagatcaggaggcagaaattagtacagaaaaaaaatgacttatttacacattagcctaaggaggaagatctaataatatacatgagcatgcatgcgttcgtgcgtgcacacgctggcacacacacacacacacacacacacacacacacacacacacaaatgtacatatgtgtgtgtctgtgtatatatacacagaatatatatatatatattacatatatatatgtaatacactgtatatatatgaaagagaaggcaggatatatgtgaattttaatttcataatatatccctctgtttattttcttgtggtgctatggatagtacccagcaacttgtaagagctaggctagggctcttccactgtgttacattgccagcctaatacataaacttagccataagagagaataactggttctttcttaaaagacatataacccatcccagtctgtatggagctatgcttgtttggttcaaatccagacccaggaaaaatgaggtaggcaatctctatgtcttaagtcttttacaaaataaaaagtcttaagggttttataggaaagtgaatgtgagacacagcatgctagggttgattcgttatccctgtgtccattatatattcctttgatcagagacttcatttgaagatcagattctagctcagctcttgtatgcctgtcaatcacaataatcttacaggtgaaaaaaaatggtatcctaaggaagagggagacccatgtacctcttctcctccatccttatcatcttccctccctcctgtctttcatccttttcttctttttcctcccccttccctctcactgtaactcagactagcccttaacttggaacaactgttccctctgagtctccctccttggttgctaggatcacaggaatgagccaccacacagggcaaaagtcactccttacagttaaaatactttctctttggcagggacttcagtatgggatcactgtacagtaaggaatgttatgagagaagcttcattccggatcatatgaaatgatattaatgaataacagcacttttatgccttcttgccccttctctataagttctggttaatgggtatgctactggtgaccctattcaatggcttatggttggtttactgaattttaatatatcattacatgtaaattaataagaaagctagacaatggaagatttcatgttgcatatggtttggaataggttatccggaggtcaaaaagggttacatgataacatcaagcagagattcagaagaggggtctatactatcaaaaagagcaaggttttaggataaaactacaacaggaaattgatatagtaactagaatataatcaggaggccaatgaaactttgaaataattacagcatgtcagagactgcattccaaaagctgggataccaaaagggatggagggggtgtctgaggattgccctccttaaggaaatgtaactagagcattcactttttttttttttttactttacagcctattagaaagtttaaaagaatatgtgccactggaccctcaaatgattttcttcctttcattataccagttaagccaactatttttaagcatctactttgagtcagacactgcaataggctccaaaaaataaagaaatgtataaaacagggtccctgtgtgccaggaactcaaagtatagtgggaaagacaactaggaaaatctacaattatgaaagtggtgacgattatggggaaatgcttagtaggaactaaggaaggacaagagaagaacacgtgcattttatatggctgtgtgttgtttttcatgtataagcaaattttcagaaaaataacttctactaaggtactgaatgacacaagaagccacaggtagtaaggcagtttagctaaactgatgatgaagagcaaaagatagtgagagataatggtagaaaggtgagcaaaggtcagattgtgaaaggtctttgtagattgtggttgaatctagatgttatattggaaattgcagtgaaccaataaaggatataaaacatcatattacatagtcagacttgcatattggggggaaataatcaaactgtcagttatgtggtggtatagtagaggaaatggtggcactcaaggagtagagaagagatacacagtgaggcatactatactcacttacaggctagatacaccaatataaatagcacagccacgtttatattcttttattatgtctccagattttaagttttgtttgttttagtttctaaaaataaagaacatttgccaaaaagtgatgtttgaaagacatgtcaatttcatatccatccatatattttgcaagtgcttaaccacagctaggggagtaccaagatgcaggcacaattttgctgtcagttggaggatggcatcatgtaagaagctaaccttgaaaataagactttgatcttgatttctcacactaaccctttcaaatttgtttaaggttctgtcggggacattcacagactaaacaaaatattgctcaacaattagatggtctgaggaagaacagatacaactgaacttcaggttttagatttttcagtttgctttgtattagagtccctagccacatcagtaccagactctcctctagaaagaacatcacacttcagagttatctttttgaatagtggcttgacatttgctgcagtttggaaatcaaacaactgactactttgacattgtgaatgaagtacattgtgaatagagagaaaagttccctcttatgtgtgcatattttattggctaatgctcactgaccaaaactgtgttcaacagagagagatgggaaattgatttttataggaatcgacaagtaaagcatacataaattaggaattgagaaatcataaaatattccttatttaggcatctttatgtctgaatgtgacattaactgggtctggtgatattgttgaattgagcctcctgttaatgtattttaagtttagctgttaatgttgacactccctatgaatgtcaacaatttgcctgcaatgtaataaaaacatctgatgtgtttatgcatatctagtcagtattgttctcaacaagaaagcatagtattcctgaagccaattgctggtctgaatggtaaaggacaatatagccaataaatctttggttgtttactattattaaaaagagatgagcaaagttaaattttgtttggttttaactcaagccttgatcattgtagtttaattgcatgctcttttgtgctgtagctgcttttcattttaacattgtatttactgaaactttaaaggaagtatggataaagtgaagttctttcattcccaagtcaacatttattgaattatacacagtgaaaggaaccatactaaccacttttatagagcatatttaatgaatgcttgttgaagggccctgtgagacagcataattcacatataaggaactgaagttcatgaaacattaattaatatgcctaagacctcacagctattgtatcagagagccatgataggaattgaggcactatcagtacagagacctgactcttagccaccatgctacacagttttatgcaaaggtatcttcagttggtttcaaggctgtcccattaaagagttagtaccaaaaggaactcttgtttcagaggcacagttttatgctcattaacgttctcaatctcatatgatcctgtgatctaatgttcactcctagtaataaaatcacatatccacagtcttgctcatcaatattcatatttgctttattcataatagcccaaattggaagtgatccaaatttttgtcaacagtaaattgtgctatatttatacaacagactgctattcaatgaaaacaaattgttgatacatataacatgatgaatttcataagcataatgatgattgaatgaagttgcataaaaatatatagtataggaatcaatttatatgtaattcacacataagcaaatgtaaactgtgatgcaaaaatcaaaacaatggtaataacctgaaaaaggctgattataagtggtacaaaataacttttttaggtaagagaatatgattgtgacatggtgtacatgggtcaaccaatgaaccatatgcttatgatccatttattttaatcattataaattataaaccataatagaaggtaaaattagggactagggagaaatttaaaaattaaaattaagtaccagtgaaggtgcttggtaatgaggcagaagacctgagtttgatccccttggacccacatggtagaatccaggaactttctctcaccagttattctctgaccccttcacatgcacacaaaattaaaaagaatttttttaaatgactaaaagaataaaagcacaatttgtccctcaaaatagtgttcacatagttttcaggggttaaaaaatatctaattcattaccagaccagccatccagaataatggggatctattttgagtagacaggaatggactttaaagatacacagtggagttgatggattgtacctagctaggcacctctaagtgttttagccaagaggacattattacaaagggggtattggaacccaagcctatctctagaaaatgattggtaagttctgtacagaaggctcacaggtttttacctttgataataccaccaggaaactgacaggaggtgtgaccagtaaacccctctcagctaggatgtcacacttacatgctctagagggcactgcagagatttggagtttgcttgcttctttgactcatggttaaaagggaactatagaaataggctgaaaggcacttaatgctactggcaattattctatgttatttggagtttcattattctaaaaaaaaatcaataaagatgctttttttatctgctaaaacaaaaaccaaacaccctagccattcacatggattgtatcctcattgcttattcctcttcacagaggccttccttgggcatcttacataaaatattcatttcctagttctttctatatttaaatttttaattgatgtattattagcatgaatatgtgaagtgtgtgtgtgcgtgcacgtgccagtatacatgaggaggtcagagagacgccaaatctctttcctactttactaaggcattgtctctcttgctgtttctaccatgctacctactctaggctggctttttctttttcttttttttctttctttcttgtttttttttattagatattttctttatatacattccaaatgctatcctgaaagttccctataccctcccccaaccctgctcccctacccacccactcccacttcctggccctggtggatttttcttgagcttctgcttggcatcacatagtaggagtgttgacattataaatgcctatcattgcaccagcttaaaaaacaaaaacaaaagaaaacaacaacaacaacaacaaaaacaggattcttgggaataaactcaggccatcatggttgcatggcaactgcttctaccagatgaaagatctcaccaaatatcccttctataatttttatccagaatggtatccctaaagtcccaggtatgtacttagtccacagcttgggactattggaaagtggacagcaaagcggtgaatatgccatagaagagaattgtgagatcccagtcccacttttgcctttatctttttagttccagccacacagagtagcattgcactatcatgaatcctggctgtgatgttctgcttctccgtggagtcaaatagttattaactaaaactgctgagaccgtgaacccaaattcttcctctttataaattgagtatctctccaattgctatggatagacaccatgaccacagcaactcttataaaggcaaacatttaattagggatggcttataggttcagaggttcagtccattttcaaggtaggaatcatggtactgtccaggcaggcatgttactggaggagcccaaagttctacatcttgatcagaaggcagctagaagactgatttccaggaaggtaggaggatggtctcaaagcccaagcccacagtgacacacttcctctaacaaggccacaactcctaatagtgccactatctaggtcaagcatattaaaaacaccacatgggaattgttctcattaccagaagactgattaataaacataagtccccttaacttggtttattgtttttcatagaccttatattttttcgcatcagtattagtctatctaattaatgtttgtctttgttaatttgtacaaacttagagacttaacccctttagttcatctttatcgtttgctgcttagacaagtttctggtacatggaaagccatcaataaatatttcttaaaatattaagatatgacgatcaaaataaacggagtagttactttgaataaaaaatattaatgattgtaactagagagatggcttaatcagtaaaatgcttaccatgcaaccttgaagactgaggtctatctctaggacccatggggaattgtctgacctggtagcatgtgctgaggaagtgaagataggtagatccctggagctagcattccagctagccagcctgctctgctaggtagagcaaggccaacaagagacctcagatcaaagaaaacagtggttagaacctaatgtctgacacctgaagttgacctttgacatccaaatacttacagatacacacatgtgcatacctatttgtacatatctatgtacctacatgcacctgaatatgcacatacttttttacacatacacacacacacacacgagagagagagagagagagagagagagagagagagagagagagagagagagagagagagagctgcttattagttacttgtctgttgctgtggtataatactatgaccaaagcaattgataaaaggaagagtttatttttggcttatgattttagaatgataggagtccatcttggcagagaagcatggcaacaagtgacaggcatagaagcaggagcaggaagctaagagctcacatcttgagccacaaatacaaaacattatgggctgaaagtagggtgaagtaaaagctctcagagcctatccccagggatgcaaattctccagaaagtctctacctcccaaagtttccatggcctctccaaacatctccattaaatggggagcaactgtaaaatatgggagcttatgggggatatttctctttccaacaaccacatctgcatacacacacacacacacacacacacacacacacacacacacacacactcacacacacacacaaataatgactattagtgaacatgccaaagagagaaaggaaaaataaaaattggacaattgaaatgtatcctggtgagagaagagactgcattttacatggaataagactatatttgtgcctagaattgctgtattatactgggaaatactggacatttttctcaccaaaatgtgaacatgataactaataaagcaatgaatgatcaaaacagagtaaataaaggcctggcaatcaggatggatttagcttccttctagttgtttctttctgccatctgggccatgaagttcaaatagtctcaggagtaaaggcatatgcttcaatttatctttatgatagaagcagaaaggggcgcctttccctgtgttgacatttgtctgagctagtctcctttcattctgaaagagatcaatcctgcatgtgatagaggattatcctctttgctacccataagctgcctttgatccctcttatctccctttctgaaagggtcacaccatttcaccatgtctctagcaacttacagcattgcaaacaaggcaatattttaaatacagctattcccccaatctctcatatattttaatgttttaatgccttgaatgttctcagattttcagaaatggaagctctgaatgtcatgcttctaatttagaaaatagaagggaaagaaatgttatcactgaaaaacatggtgttatgttttagcttttgttctgctcttatgaagtcactccccaaatccaacaggttcgattatttatttatttatttatttatttatttatttatttatttatgtatttatgtaacaatcaggatatatagtcactgtggaagtatattatagtttaggcttactaggtctaatggaaatgtgagtaagttccttttaatttgattcaacacctaattacctcatactgcatggaagattctgtgctaaagaagttaaaagattatatacagggtctggagagatgcctcagcagttgagaatataattactgttgcaggggaccccagtttgatttccaccacccatttgagcagcatgtaactacctgtaattccagccccagggcactcaacgctttcttttgatctttcttgttacctgcactttgtgtacactcacaagcacacacgtacacataattaaaagcagtaaaataaatccttttctaaaatcctctaaagcctatgtctgtatggagaatacagactgtaaatgtgtttgttaccagaaattagagatctaaagactaataagaatggaggcaagtggggcatcaaaagtacatggattgggagatgcttccatgaagaggaaatatttaagttgaaacttacagtgtacatttaaggtatccatgatgctttcaacttttgacattaggtgatcatcttctctatttctgccatgcatgctagccttatggtcatagcaaagccatcagcttgttccatatggaattaacaaaaagattgaccagtgtagaaagaattttatgctctgagtaaatttatttgaccaaatatttacaaagtatattctatgtcctgtaatgttcttactcatgggaatatactagttacgaaaacaaacagagccttttgtattaaagaatattttatgtctaataaggaggatgaaaataattaagaaaaaatactaggtactgattatcattgaaaataaaaactaggatatttcttttttatttagttgtgtgttatgtaagctgagggatgaattacaagaaagtaaaacaagtgaaaaatatcccaggatattttaattttaagggtggatgacttaaggcgtaaaggactttataaactggaggttaggataaaccactaagatggattgttggaaaaaaatgaagggattggaaggtaatgatacaaacaaatatgtgtggttttgtgaacctccagattttactctaatagtgaagaagatttcttagcaattaattgtctagtatggcagcaagttttaggtgtggttattaacaacttagattataactggaacaaaatgagctgtaactagacatggtataaaacaacagaatgtaagaaaattttagtgaattacatgcctattgcatgtggtcttgggggttattgatttcatgggaggtaaaaggctgtttgagatggagctctgcattaatgcagcttttatgagttgtaacacatggtgaaatgggacttttcattggtagattttcctttgagacacccatgctcttgccattaatctctagccatgctcctgtacagatcacaacagatgcactaattcactgagcttatctggatcagattgttgatttggtctatcaatgccttatgtgtggcaaatagacatttatttatgtctccccaggaaaatccatgcacaacagatcagaattggagtataaatttaagatccataagcatatagataaaatactatctgtgagaatagtccaatgatagaagaaagatcattagtgacagaatcatcatatcctctatcaaaatgttattgaataagggctggggaggtaccttgtggagaagcagtgagtgtttactgtgcaagcatgactatttgagttcagatctccagtgtacacttaaaaagtgcatatgaccacatgcacttgttatcctagtgctgaaggaggatggagacagaaaaaatattgaggtttgctggccacatagtctagctgaaatacagagctttaggttcagcaagaggctctgtcttgtggaaagaatatggagaggatttaaaaaaaaacacgtgatgtcttcttctgcctgatgtcagtatgagcacaagcattcacatcttcacaataatgtgtacacatatgcatatcacacacacactagtaactgagtgattgggattggtggaatctggtgatctatattaaaagaggaaaggtaatatgtaagacaaaaaaacagaaatcattagaataaggaggaagtgttcaacttagttatgctcttcagtaataaagtgaggcagagaaggtattattttattcatgactgttatggtttgaaactgaaatgcctatcagagtcctgtgtattcaatgtctagaccccagctagtagggctactttaggaggtgttgaaacacattttgctaggtgggagtgacctggaaaatgtgggtgactgggtgtacatctttgatggttatacctcattttcctcttgctgcatgctgacaagcataaagtgactagatacttcctgccacatgctacttctgtgatattctgctttacaacaagccaagaatcaacaaaaacagtgactatagatagaagctttgaaaatcatgaccccaaaacaaatcttttctatcttatatcaagtattttatctcactattactgtggtgaccattgattttagtgaagtgaagtcagcccaagcctcacagagtaagactagaggaaagtgtaaatgagcagatacaatgaacatgatgactctttcaagatacttccttaggagaagaggggtgtcttagtcattgttgtggtaaattgaccctataaccaaggcaaatcagagaagaaagaatttagctgggtgtttgcttacagttccagagatttatttctttatcataatgtcagggacaacggtggcattcaggcaggttctggagcaatagttgaaagctttatatccttatctgtagagagagagagagagagagagagagagagagagagagagagagaaccttgaccatgtgtgggcttttgaaaccccaaagccctttcccagtgacccacttccaaaccctaaagctgattcccagtggcacacttcttccaaaaatatcacacatgttccaacaaggccatacctcctaatccttctaatctttttaaacagttctactccctgatgactaagcattcaattgtataagcctttggggatcattcttattcaaaacaccacaaagagaagtggaaaattagctgaagaaaaatagggcataagggagattcctttgattatatgttatatgttataaaattgataggtatattagagcttttgcaaaggatctgggttcagttcccaacacatagatggttcctcacaattatctgtaattctgattccagagaattctatgccttttctgactccctcaggctcttgcatacatatgatgtacatacatacatacatacatacatatatacacacacatacacacacatgtacataaaattaaacattttttaaaactttattttatctttgttttttatactcctgttttattttatttccctcctggtccaccctctgactgttccctattccatacctcctccccacccccctgtttccatgaggatgtccccaatcctccacccccaccccactaaacctctaaactccctgggtccttcagtctcttgagggctaggtgcattttctctgactgaacccagacctgacagtcctctgctgtattttaataggatactataatcttttaaataataaggaaattattcaaaagaaaggaaagagtacagtggagaaaaaaagacaattaaggaatgatgttgaaaaatctagacagaactttaattagaacaggaacacactagctagtgaaacagtagaagcagtggaagatactgagtatgtgtgacaatagattatctggttggtttggggactgagagctatgagttgagggtagggtgcaagggaaaggaaatgagctattgcagctgattttgaagagcatataagttgtaaaatatctttgaaaagttaaaaagtaaatgtatcaaaatatttctgggcaatactgtatgctatttcagatttgggttcatgaatttaagcccaacatacagagttgtatggtttcttccaacaacggcctgaaactaacagaaaaagctaaaagaggctgttcttcagactttctttttttttttttttctttccattttttattaggtatttagctcatttacatttccaatgctataccaaaagtcccccatacccacccacccccactcccctacccgcccactccccctttttggccctggcattcccctgttctggggcatataaagtttgtgtgtccaatgggcctctctttccaatgatggccgactatagaagctaagagtctgatcccagctttgctttcattctagtgtgcattttgaactaaaggtgtcataatgccaaatgtcatttcttcctgtagtttaaggtaaacatttaatttaatgcttttttttcaatttcctacttaatgttctgacatttagttttctacttcagcattatttcctccctcccccttacatcatctctcttttcacctttatatatttccatcacatttttaccaggtatctggttcttttcagtagctcttcctggctttgacttgtccatcttttctccagttccactttcattttcatcacaaagcttcttgtggattcagtgcctaccacatcatgtattaggatgcattttattctcattacctttttcccatggaatatgttcccagcaaggttttcaatactcttaacatttatttatttatttatttatttatttatttatttattctctttttcctttatttaatttattttaaaaaatattttcttcaagtacattaaacttcaaagcagtatgcttactgctagtatggaactgtatataataaaactattttctattttttatatctaaatactttttctctttaagtgagaatttcatacataaaatgtgttttgatcaaatccacaccattcgcactactttacctggtgaatcaggtaagtttcagggacttcggaagctattttgagttttttgcttcctgtcttaatgaactttcctgtagtattttacctctccttagaacatcctgttgtttcacacacccctgtaaaaagaactcaagaaggtggacttcagaaagtcaaataaccccattaaaaaatggggctcatagtactaccggaggatccagcaatacctctcctgggcatatatccagaagatgccccaactggtaagaaggacacatgctccactatgttcatagcagccttatttataatagccagaagctggaaagaacccagatgcccctcaacagaggaatggatacagaaaatgtggtacatttacacaatggagtactactcagctattaaaaagaatgaatttatgaaataactagccaaatggatggacctggagggcatcatcctgagtgaggtaacacattcacaaaggaactcacacaatatgtactcactgataagtggatattagccccaaacctaggatacccaagatataagatacaatttcctaaacacatgaaactcaagaagaatgaagactgaagtgtggacactatgtccctccttagaagtgggaacaaaacacccatggaaggagttacagagacaaagtttggagctgagatgaaagaatggaccatgtagagactgccatatccagggatccaccccataatcagcatccaaacgctgacaccattgcatacactagcaagattttatcaaaaggacccagatgtagctgtctcttgtgagactaagccggggcctagcaaacacagaaatggatgctcacagtcagctaatggatggatcacagggctcccaatggaggagctagagaaagtacccaaggagctaaagggatctgcaaccctataggtggaacaacattatgaactaaccagtaccccggagctcttgactctagctgcatatgtatcaaaagatggcaaactttatatgccccagtacaggggaacgccagggccaaaaagggggagtgggtgggtaggggagtggggatgggtgggtatgggggacttttggtatagcattggaaatgtaaatgagctaaatacctaataaaaatggaaaaaaaagttaatctatgaggaatgtgctgcaccatacacctcatttcatcccttccatctccttccctatcccttcaccaaggttccatttcaattttatgtgctttaaaaaaaaaaaaaacatactaactgggccaaaaatgggtgattaattaggtaatggctctagggcagaatctgatactgttttttaactaaatggacccagtattgcaattgttatctttactgatatttctaagcctgtaaaatgaaccaattcaaaccagattagaatatgttaaaggcaggtttatttggaagttactctcagacaggcaagttcaaaggccccaaggaccaaggaccaaagcaaggggaaaggagggaagtaggaggggaatgagaaagagagaaaaggaatggccaaacacacactgttgtgttttagaaaaagataagaaagaaggaatatgtttggtggaggcatagtatggtgttggggaaagaggtcctctgtaggcccatactgaggctttccttcccccctgaggtggtatagtatagagtagagtttattcagggcatggggatggaagttgagagaaagacatagaaagagagagacagagacagagagtgccagagagaggggggtgagtagaggccagccatgactatgcagagagagtggggaggggaataggggggggggtaaggagtaagagcaagaggaggagagaagggagtatgagcaagagagtgaggagggaacaactagatcccttttagtgagtcaggcactactggccgttgccaggtaactgtggggcagagcctaaatgaaatgccaacacagagagagagagagacagcgagacacagagagacaggagagagagagagggagagagagagagagagagagagagagagagagagagagagagagaagaaagaagagagggagagagagaagaggaagtggaggaagaagaagaagtagaatgagagagacagaaagaatgcacaaaatgcctggcttatatagggaggagcttctgggggaagggcggaggcttgaaggttcagggttgcagaaggggtatgacaggttgtgactgagtcctgctggaaggagctggaggccagatctgcttccatatgcaaaatatgcacctctctcccttgttccaaaaccaaacttttactcccaaccccagttaaagaagtttctttctccgttatatgtcaattaatttagagacctgaaactggttgacgggcaaaaaaaataagggactggaatgcttagttctagtgggatagctaaatttatcttgcatgaaggctctgacctcatcctggaagaagggataaaaagattgtaagatccagagggagtacacatccatggtgaaacagcatttgctcacacatgtgaattcacagtggctgaaactgcatgtacaagacttacacaagatcaggccaaacaaaatcagcacaaatgggaaagggctcatagagttccatccttagctgagaacatattggccattgatggctgcaggggagggaggaagataggttttctaaacaccttctgtttagcaagtggaaaatagaaaagtattatcagaccgttggaacagtgtaagaataggtacaaatgggccagtaagtggtggcacacgcctttaatcccagaacgtgggaggcagaggcaggcagatttctgagtttgagaagttccaggacagccagggctacacagagaaaccctgtcttgaaaaaaaaaaaaaaaaaggtacaaatggaaatctatttcgaaatttcttaacatcatgttgtgaacctcagcttagaattttctggaagtctccaagtacccattatactatcatttgtcccccaaatcactgtttggatcaatgtttacatcatactaatagtaaaaaatgataggataggggctggagagttggctgaattaaaaaatactacttgctattgaagaggaccagagtttagttctcagcatctatgctgggtgacacacactatggtaaccccagttcctggctatccagcttccttttctggcttccagggatatacacatgatgtatatatgtcatacatgtgtggatattcccattcatgtgtgcatagtcacacatgtacataaaataagttataaatatattttaaattacatggtaatttagtcattgatcctggctcttttctaaagaaactctttcatataatcactacctgtactgattgaagaaagtaaataattaaacttgaattaataaatcatttgaaatcttttcaataagatctaatctgtagtatttttaaacattataagtattgcagattacactaaatgaagtttgttgttgaccacagttatgttgttctcagtgtgttatacaagttctatagaactgcaagcagatcataattaaagtataattattaacaataagaattgtaaggagactcactactctaactttaacccataaatgagtcattttagccggtgaggttttttcaaaaatctggttcctgataagagaaaataaaaagatgtctcttgattttccttagtcaccaaatgcttgccatgttttcttttgtactttttgtgcttcctgtgttttaccagacactctcatactgtcaagtgatcagctgcttcagggtgacactaacaatcaacattgtttccctattgaagtgtcttgttactttatactgaattttcttgctgccacttgtctatgtgattagactccctagcattaccttcggctgtgatacaagcagaatagttgtagaatttaggtgactatctagtgtacagtgatttagacacaccctctctgatcttacctatacactgccaatttagtcggttttagtagacactttgctgtggttaaatataaacagttgtaaaggaactgagatctttcattttattcactaaaaaaaatacatatcaggatgagaaagatggtctttggggaatatcatgcttcatcattatgatacgaccaccttatctctatttgaaggttactacacaaacatttctgaccaagagaaaataaaattaataacacccaaatcaaacagataatagaaattaaatcagtacttcataaaagacaagccaaaacaaaggtattttataagtgattcttagaagaataaactgaatgggtatattgggtaccattttacctaatttttttgttttaatatttgaaagttttgaacttgtctgcagtatattgtgaacactttcaggtgtcaactgactattgttctaactgtggggacttaatagatagatgcatccagtaatggaggtgacaagggcatggtaaggactttcttattacatagcaagtagtaaacgtgggagagaaagcaaaagcaattcagagagtcaagtttgcatatcaaaagagtaaacgatgatgtgaaaggtaagggtattcctgaagtgagcagaagtcagaagccagttacattggtaattgggaacaaagtgaaagcaaaagaggtaaaaataaaagtgatgcatttctgcagaacgaatttaggaagattgcagcaagagctgtgtgaaattgaatgagtgcaagcaggaaacagcagagaatagaaatgcaaagcattaaagatccttcaatagagtcctaaggattctgtctgtcatccaccaataaaaaataataggagctaaagaggccttctatgtctgaagtgctatacgcaaaaagcatgcaggacaaaagcagagatattcaaggaataaaacatcaagtttacagggagacagggaatgatcacagcacaagtttgagtgtaaagtaaagataagcctgacaaagaaggagaatgaaaagaagagcagccgtatgtaaggtgccttgaaagcccatccatttcacaattttgcttttctgaatgatagacacaaactccacttaaataatgccttttgtgatctgcaagttgtgccttacataatttgaaatttctccttgatctgggagtaaagtcttagaaacccttttgaagttgggaggaattcaatagtttaaattttgtaaaagctgctctgtgaattctctgggtggggggaaacaatcacaaactttatttttggagtggtgtctatcttgtttacatgtaatactttccttcccagaatgcagactgtcaatagctcttatatcaaactctgcaatactcctcccacaacccctgcacactaatgtaattatgtatgaacattgtaccaaagggacaattttttcctgatgagattctgtgaattaaaaccttaataaaagcacagtattctaaagaaagaaagaaaaatgcattgaaaaaaatgaaatcttttctttttctttttttttattaattttcttgagactgggtttctctgtgtagccctggctgtcctggaactcactctgtagacgaggctggcctcgaactcagaaatccacctgcctgcctctgcctcccgagtgctgggattaaaggtgtgtgccaccaagccaggaaatatgttcttaatcttaatggtatagattaagaacacattttcatagcctaggaccagaggccccatcaaaatatttcatccgtaatgttgtgatcctttctttgtgggaagtttaaggtttttgcatgtcacagaaagtcattaaaattagtgataaaaccgagtgtgtaattaagatgaaggttttggtcacaatgactctcatttttcacaattgtcatggcatttatatatactagatttgcttttataaccatgttgaataggaaaaatcaactaagatatacttaaagtcccacttctttggtgcctttcaattcaatagactacacacctgttctaaagtcattgctcagcatggtctttattttttattattctatgatgctgtcagtagctattgaaagtgaatgaaatctgatcatcaaatagctgacagtaattgtgatagaaatatggaacacttaattatcacacaaagtatagatgctgaattttattgttgtttcaaatgtttccaaacatatcaaaggcatcagaatttcttcttctgtatttgactttacaagaactacaccttgtattatttgtatcctccaaacttcactttgcaatttgatcactctcatggtagtattaggaattggagcccttaagtatcagaagaaatctattgcactcaaggactaggccataacttctccttttcctggaactaaattagtgaacatgagaatatgttgatgtaaattcaggccacctttatgttttgtctttcaggtgtgctcacttgacctttcttatcttgttatgtaatagcactcgtcaaaatgccttatgtctttggatttctcagcttccagaactatgagctacataaatgtcttttcttttgaaactgccttaactccaatgcttttaatagcaacagaaaatggaccaaggcacaatcaagcaagtacttgtagtgttttaacagtttttatcatatttgttttgtgatctgtctctctgtcttctctctctctctctctctctctctctctctctctctctctctcacacacacacacacacacacacacacacacacaaaaccatgcacttcaaaaatttttaatgttatttcatttttgtaccaggttataatttctttcactactttgaaacatctttgctttaattatttaacagctacattacacacacgtgaatagtgagtttttcactcttattatcttctcttaaaccccttcttgtcccactgaaactttacttcttttgaaacatgtccccctactacttttaaatctccctccctccctccctccctccctccctccctccctccctccctccctccctccctccctctcctctttatctgtctccctccctctttctcccccacaccaaccatgggggagggcaccccactgagtttttaaagcaactaataactgatatgattaggggagggcaaggtaccctctcacccccatgatcgaatgttgataacttcttgtataggttattgcagcttttctgggagcaagttttagtcattcttcttaccatactgatgattcataggttttttttccctctccacctttttcattgccctcccagtatcctcacaaattctctctctttttttttttaatttcgagacagggttactctgtgtagctctggttgtcccagaactctctctgtagaccaggctggcttcaaactcagaaatctgtgcctcctaagtgctggaattaaaggcatgtgccaccactgcccagctacaaattttcattcttattcaggtttcttctcttctactcagagaaacgataattagatatagcaaataatgttttttgagtactttctatgtggtaacgactagtcaaagagttgttcggtgttcttctaatccacctgtctttatgtgcactttttatttcaaagtttttaaaaagctataaaattgtaatttaagaaaaagaaataatcaggtatgtcaagagacattgagatgattcagtgagtaaaagcacttgctgcgcaagctttgacttaagtttgaaccccagaattcacataaaaaggcaggtgatatattgcacatttgttattcttttaaattattttttttttacattccaatcattgccccacttggttacccgacccatagttcctcatcccatttctactctgcctttctaccagagggtgtttcccctcagcctctctcttccctggggcctcaagtctctcaagtattaagcacatctcccagtgaggccagaccaggctgacatctgctatatatgtgccaggggacttgagccagcccttgtatgtttctggttgttggctcagactctgggaaatccttggggtctgggttagtggagtctgctggtcttcctatggggttgccctcctcttctgcttcttcaatctttcccctaactcttccataggggtccttgactttagtccaatggttgggtctaagtatctgcttctgtctcagtcagctgctggtagagacactcagaggacagtcatgctaggcttccatctgtaagcatatcatagcattagtaatagtgtcaggccttggtgtccctcctatgagatggatactaagttgagctggtcattagattccctttccctcagtctcttctccatttttgtccctacagttctttaagacagaaacaattctgggtcagggattttgactgtgggttagtaaccctgtccctccacttgaggccttgtctgtctactggaggtaaactcttcaagtaccctctccccaatgttgggcattttggctaaagtcaaatgagtcctgagagtctctcaccttccaggtctctggtactttttagtgggttgcttccacttcttaccttccaaggctgcttatttctatcagttctcttggccctctgggctactctctgcccctcccccatatctgattctgttccccttttcccctcccctctcccacccaggtccctccctccctctgcctcccataattatttccttcccacttctaagtaggattgaagcatcctttgggtctttctgcttcttatacttcttaaggtctgtaggttgcatcttagatattctgtactttttggctaatatccacttatcagtgagtatatactatgcatctccttttgcatcagaattacctcactcaggatgatattttctagatccacccatttgcctgaaaaattcattttgtcaccatttttaatagctgaatagtatttcattgtgcaaatgaaccacattttctgtatccattcttcagttgagggacatctagattgtttacagcttctggctatctcaaataaggctgctatgaacacgatagagcacttgtcctgtggtatggtggggcatttttgggtatatgactatattagttagtgttttactgctgtgaacagaaaccatgaccaagtcaagtcttataaaaaacaacatttaattggggctggcttacagattcagaggttcagtccattaccatggcagcatccaggcaggcatggtgcaggaggagctgagagttctaagtcttcatccaaaggctactagtggaagactgacttccaggcaacttgggtgaggatcttatgcccacacccacagtgacacactcactccaacaaggtcatacctattccaacaaggccacacctccaaatggtgccactccctggtccaagaatatacaaaccatcacaatgaccaagagtggaaagtcttcagattgaactatttgaactttctgaggaaccaccaaactgtattccagagtgtgtgtaccagcttgcaatcccatcagcaatggaggaatgttcctctttctccacatcctcattggcatttgttgtcccttgagtttttgatcataaccattctgattggtgtgaggtagaactcagagtcgttttgatttgcgtttctttgatgactaaggatgtttaaacatttcgttaggtgcttcttggcctttcgagattcttctgttgtaaattttctttttttttttctttccattttttattaggtatttagctcctttacatttccaatgctatatcaaaagtcccccatacccacccacccccactcccctacccacccactccccctttttggccctggcgttcccctgtactggggcatataaagtttgcgtgtccaatgggcctctcttttcagtgatggccgactaggccatcttttgatacatatgcagctagagtcaagagctccggggtactggttagttcataatgttgttccacctatagggttgcagatccctttagctccttgggtactttctctagctcctccattgggagccctgtgatccatccattagctgactgtgagcatccacttctgtgtttgctaggccctggcatagtctcacaagagacagctacatctgggtccttttgataaaatcttgctagtatatgcaatggtgtcagcgtttggatgctgattatggggtggatccctggatatggcagtctctacatggtccatcctttcatctcagctccaaactttgtctttgtaactccttccatgggtgttttgttcccaattctatttagctctgtaacccatttttaattgggttatttggggttttttggaggttaccttcttgagttctttatatattttgaatattagccctctgtcagatgtagggctagtgaataattttccccaatctgtaggttgccaatttgtcctatttacagtgttttttttttttttccttaaagaagcttttcagtttcatgaggtcccatttattaattgttgatcttaaagcctgagtcattgttgttttgttcaggaaatttctccccatgccaataagtttgagcctcttttctactttctcttctataagattcagtatatctcattttatgctgaggtccttggatttgggctttgcacaaggtaataaatatggatctattttcattctcctacacacagagtggcagactagcataatttattgaagatgttttcttttttccagtgtatgtttttgacttctttgtcaaagatcaagtgtccataggtgaatgggtttatttctgagtctttgattccattccattgatcgacctgtttgtctctgtattgataccatgaagttttgttttggttttgagtttgttttgttttgttttgtttttcactattgctctgtaataaagcttgaggtcaaggatggtgattcccatggaagtttttttattgttgagaattgttttggttatcctgggttttttgtttttccatatgaagttgagaattgctctttccatgtttgatgggaattgtgttgaatctgtagattgcttttggtaagatggccattttcactgttaatactaccaatccatgagcatgggagatctttccatctcctgaggtcttcttcagtttcttttttcataggtttgaatttttttggtagaacatgattttaatatttccaactgttaatgttcaagaaacagaatagttattttaagatatactttgttgttatgtctccctttttatttctgattttattaatttggatactgtctctgtgccctctgtctagtctggctaaaagttcatcaatcttgttggttttctcaaagaaccaattctggttttgttggttctttgtatagttctttttgtttctacttggttgatttcagcccggagattgataatttcctgccttctactcctctcaggcctacttggttttttttgtttttgtttttgttttttgttgttgtttttgttgttgttgttgttgttgctgctgttctaaagctttcaagtgtgctgttaaactgatagtgtatgctctcttcagtttctttatggaggcactcagagctgagttttcctgttagcactgctttcattgtgtcccataagtttgggtaggttgtacctttgttttcattaaattctaaaaagactttaatttctttctttatttcatccttgaccaagtgatcattgatgagagcattgtatatcttccatatatatatgtgggcttcctgttgtttttcttgatatttaagaccagccttagtccctggtgatatgatagggtacatgggattatgtcagtcttcttgtatctgttgaggcctgttttgtgaccaattatatgttcaacttttgggaatgtactgtgaggtgctgagaagaaggtatattcttttacttttggatgaaatgttttataaatatctgttagatccattttgttagtttcactgtgtctctttttagtttctgtttccatgatctatccattgctgagattggggtgttgaagtctcccataattattgtgaggggtgtgatatgttttttgagctttagtaaagtttcttttatgaatgtggatggccctggcatttggagaatagatggtcacaattgagagttcatctttgtagatttttcctttgaccagtatgaagtagccttccatatatatatatatattggtcacttttggttgggagatgattttattcaatattggaatgactactctagcttgtgtcttaggaccacctgcttggaaattcattttccaaacttttactctgagatagtatctgcctttgtcactgaggtgtatttcctgtattcagaaaaatgctgggtcctgtttatctatcaagcctgttagtctatttcttttggggggaattgagtccattgatgttaagagataataaagagccatgtgtggtggcacacgtctttaatcccagcactcgggaggcagaggcaggagtatttctaagtttgaggccagcctggtcttcaaagtgagttccaggacagccaggactatacagaaaaaaccctgtcttggaaaaccaaaaaaaaaaaaaaaaaaccaataaaagatatattaaggaaaatgattgttatttcctgttatttttgttgttagaggtgggaattatggttttttgtgtgtgtttatcttctttttggtttgttaaaagaaaattattttcttgctttttctagggtgtagtttccctccttgtgttggagttttccaattattatcctttgagggctgaatttatggaaaatattgtgtaaatttggttttgtcatggttttctcttggtttcttcgtctatggtaattgagagttttgctgggtatagtagcctgggctggcatttgtgttctctaagggtctgtatgacatctgcccaggatcttctactttcatagtctctggtgagaaatctggtgtaattctgacaggtctgcctttatatgttacttgacctttttttccccttactgcttttaatattctttctttgtttagtgcatttggtattttgattattatgggatgggaagaatttcttttttggtccagtctatttggagttctataggtttcttgtaagttcatgggcatctctttctttatgttagggaagtttacttctactattttgttgaagatatttactggccctttgagttgggaatctttgctctcttctatacctattacccttaggttttgtcttctcattgcagatttcctggatgttttggattaggtgcattttgcattttctttgactgttgtgtcaatgttttctgtggtatcttctgcacctgatgttctctcttatatctcttatattctgttgattatgcttacatctatgactcctgatctcttttcttttctaggttttctatctccagggttgtccccctttgtgacttctttactgtttctatttccatttttagatcttggatggttttgttcatttcctttgcctgattacttgtgttttcctgtaattctttaagggatgtttgtgttttctctttaagggcttgtagctgtttacctgtgctctcctatatttctttaagggagttatttatgtcctacttaaagtcttctatcaccaaaatgagaagtgatttttagatctgaatcttgcttttctggtgtaatggtttatcaaggacttgctattgtggaagaattagattctgatgatgccacataaccttggtttctgttccttatgttcttatgcttgcctcccaccatctgattatctctagtgctacctgcccttgatatctgactggatcctgtccttcctgtgatcctggttgtgtcagaactcctcagagctcagctgtctctgtgattctgtgattctgtgatcccgtgatcttgagatgtatgtcagagctcctaggagtcaagctgcttctggaactcttagatactggtgtgacaaagctcctaggatcctgagatcctgtggacctggcatgttagagcaccagggagtggagcttcctctgggtgttatggtattggagtttgctcccaaggtctgcccagagcactggctcagactggaaggaacctgtgccaatgttcgtgtggagttcctgggtgcctgagtcctgatagtcccagttatttctggtgttggggcagatgttgtgtcctcctcacctctgaacctatgatcctgggcatattagagcgcttgggattggagcttcctctgggtattgtgggactttctgcagagttcgcataaaaggtctgctcaaggaattgatcccgtctgaaaggacctttaatgtcttaacatttgatgccagatattttttaaaataattgaacaaccaccaaaagaaattaattaatggtattcttcagctcttacctggagggaatgcttacaaataaatgttaactagtaaatccaggtatgcttgtaatcccaatactttacaggctaaaacaggagcatcattggttcaaggacaagatcaggttcagaggttcagtccataatcatcaaggcaggaacatgtcagcatccaggtagacagggtacaggaggagttgagagttctacatcctcatctgaaggttgcaagcagaatattccccaagtttgaatttcttttttttccccttatagcttttaatattctttttttgctctgcacatttagtgttttgattattatgtgatgagagggttttcttttcgggtccaatctatttggtgtcctgtaggcttcttgtacatttatggccatctctttcttcaggttagaatagttttcttctatgattttgttgaagatgtttactggccctgtgagctgggattcttcacactcttctattcttattcttggggtcaatcttttcattttgtccttagtttcctgggtattttggtttaggagctttggaagactttgtgttttctttgactgaaatgtcaatatcttctatggtatcctctatgcctgagattctctcttctatctcttgaattctgttgctgatgcttacatctgtagctcctgatctcttttccaagttgtccatattcagggttgcctccctttatgttttctttattgtttctatttccacctttagtttttggactgttttgttcaattccttcacatgcttgattgtatctggaggttcctcagaaaattggaaataaatctacctgaagacccagctataccattcttgggaatatacacaaaagatggcccagcatgctacagggacactagttccactatgttcatagcagccttatttgtgatagccagaagctgtaaacaacccagatgccccacgacagaagaatggatacagaatatgtgattcatttacacaatggaatactactcagctattaagaatgaggacagctgggtgtggtggcacatgcctttaatcccagcactccggaggcagaggcaggcacatttctgagtttgagggcagcctgttttacaaagtgagttccaggacagctagggctatacagagatatcctgtcttgaaaaaccaaaaccaaaaccaaaaaaaagagggcatcctgacttttgcaggcaaatggatggaactagacgatatcatcctgagtgaggtaactcagatacaaattgatatgcatggtatgtactcactaataagtggatattagcaaaaaaaaaacccaacaacaacaacaaaaaacacaaaaactaaacaaacaaacaaacaaaaagaaagaaagaaaacagagaatacacaagatacagtccacagaactcaaaaggctcaacaagcttaagtgcccaagtgaggatgcctcagtcctatttgggagagagaagaaagcaatcataagtgaggagggaggaaaggacttgggagggaaagtggattgggggaggattctgatctgatattgggtgagggaaaaggactgaagccctgagggcctgcagagaaaatgtatttctttaagtggtttatttgtttcttttttaagggcttctacttgtttgcctgtgttttcctctattcctttacgggagttctttatatcctccttaaaggcctcttcatgagatgggattttaggtcattgtcttgcttttcagatgtgttagggtatccagggcttgttgtggtaagagaactgggttctgatgatgccaaattgcattgggttctgacacttatgatcttgatttgcctctggctatctggttatccagttattaactgacctggttgcctctgactggaatcagcctcctgagaggcaggtagagttctgtgacctgagttagaggtggtctccttggaggcaagtagtgttgtctctggtcgtgatgggcttcctatttctctggtttgagcagacctcttgtgtccctggttactgtgtaccttctgtgcctttggatactgtgggccttctgggaggcttgaaggctctattgtttgggcaggtatcaggcagctgatttggtctgggtggggaagtgggctggaaggaaggttgagctcaggggtttggaggtaggtctcatatcagctcagatgtctgggtctcccagatggtatgggtatttggatgtgattctcacctgtgtctttggttcctgaggacctcctgaggagaaagcaggatacagcattaggcaggtatcaggcccctgatttcatattgcacatttgtaaccccagcattctttttgtgagtttgtaaagaaaatatcttggaagcctgtgaaccaaggtagcgtggaatatataatgtaggaacagaaagtacatgagagtccatgtcatcaaacaagggcaaagagaaaacctgctcccaaaatgttttacttcaacttctaccatggtacacatgtaccatagtacaacatgttcatagagacacagagagacatacagatacatactctttctccctctctctttcagatagatacataggtggtaaacacataaagtcattagtttaaaaataagatgcactttcagaaaaatctattgaataccagaaagggaaactaatacaatttctaggtgaatgtcttgatcacctattcccagcacaaatatctttcctagtgaggcattctaatgcctcaaggcattggggagggcagttatatgtagatctagatttgaaaagatgaatgtctagaataaacagatttaaaactagaggaaatatcagtcatgagaggcccattttgaaagcttcatttcagttatagttttaaaagtgaatgtcactaatatgaacaattatttttaatgtatttttacaattcaggaagtaaatgttgaggttttatggtgcaccagaagcaagagttgaggtaaccacattttgaatgtgtgataaaaagtaagtgccttgctttctgattttagcaatataatttcattcttattaggatcttacccatctttaacattgaaaagtgaactaaggctaaaaaaatttgaggagcatgtgcagtttaagtttcagatatataattttattttcattaaattatgtccacatggaatgttaaaaatcactgaaggatgaaaatctgaggagaccctaaatctaatttctcctccttttaataatgttcctgtagtacctctagtccctggatattactcagatttgctttgaaatgggattcatcctcctcctgtttcacatgttgagaaggttcatgtgcagagtgtgagatgatagtatcgaaattcaatttacacatttagtactatgttaaaatgtgttggcccctcaatgaggtgagggaggaaagtcgctttgtttaatgttaatggaaaaacatcacctgtgaaatagtctcagaatgtgaaattaagtcacccatgtatgttgtatgcttactccctcggtgcttcttcctccttcctcagtataatttccttttgggttctacttaaaaactattgaaatactacattgtgcaaagctgtatccagacctgagcatgaaaaactatttgtgttgtcttgcggaaattcacttgtaaattattgactttctagctagactggaaactgaataagaagacagcggttttactttaggtagcttcttacattgccttacactagataatgctaaataaagttttaatgagtttaatgtgaatctgattactgtagttaatcattaactcagactattcaatgaagcacattatatataaatgtattaaagtgtcacagtgaaacactttgttgtgtacaattagtatatgctaatagaaaagctgttttaaaatatcctctggttttctgtaaacatgtctttgtctatgttccattgaccaataccatgaaaatcacttggaattaacaactgcaggatctcaagccccattgcagactcagtcaacacagtgtgaatttgagtaagatgtagctgttatttgatgcatattattgtattttgtactttactaatccccctttaaacacttgttctttcttttatcttttgtttgcttgtttccctcttaattctatagattgggctacacttgtgaattgttaatcataaataagagacattaagttcttcataactagcacctaataatctagatttttctctgttagctttatcaaaagcatagggatgcttcatagccctttcagcatatgttctctaatctgacatcatatatcatttctcccaaatatcaggaattacaatattattgtctttaagaaatgaacagaattttgccacagaaatagtccttccagacatatgtatgcacatttatacatttatatgcatatgtatgtataaatatatatggggtctttatcttcctttaatgtggatttttgctatcttgtcactctaaaaaactgtacttcaaaatttaatgaaatcacattgtgtattaccatcatttgttaatgcatttatcagcaataattaatgcttctcatttcaagaagaatttccatcttattggacatttgtgtcattattactttttgaactttgaccagaacttaagatggtttttatgacttcaggcctatattattattattcaggcctcaatgagtacccgagggcaaacatcctaccaaaattctcatcacttggcaaataaactctgcgtgcgtgtgtgtgtgtgtgtgtgtgtgtgtgtgtgtgtgtgtgaaattaaaaattcatagatgataaaacaatgccagatgtttcttataaccttaaaatgtgtgtttgattaaactaattagtgagtttcctttatataactgtcagaagataactgtgttgttctgacatttcaagaaagatatgtatgattagttgtagcattctaaaccccatggaaggaatcagatgctaaattactctatgtgtctgagaataaatcgcacagcattactaatgagttaaccggttattagatatttaagttcacagtaaccctgaggtgcactgtcttcaacattgagccaagaataattatttttgagattaaaactttttgctaccactgttgtttttaccaccataaaactaggaaaactaaagtctttgtccctttcctataggagaaaaatggctttgtatagcttggagtaatgtatttagaaccaggatccacaaatattactgctcaatctacctatgattctgtgcccttatctagtctatcataaatctagttaatccaatgacagtcccttgtcaagttgacatctgcaagttaaaagcagtctggctggcaaatacctttattattctgtattttaattcggtatctaactttcacccacaccagaaatttctgtctttaattctccaatagttgaaaggcatagttagatgctgaaacaaatataaagctgggtgaagagtatataaacacaaactaagtcaaataacttgtatttaattacagaaaatactgctacaaaagtcccatgcctagtgagaaatgttcagtatttattaaactatcattcagactttgtaggaaattagaaagaatagctattccacaggatcagaatcaggacaagactatataaggtatactctataaatttggccacattcaaacatggcaatagctttgggtgaagagtccagtcataaaatgtgtcaatgctgagcataataccatacatagtagagctctactcctattttttttttttttgttttttgttttttgttgttgttggttggttgattttgtttttgtttttgtttgtctgtttggttggtttttttgtttgttttgtttttgaacatcagaacaaccccaacattcggtggtaacttcattttccataaaggaggaatagtatctttcctaggcccacagattcatttattagcaattgctttccaaagaagacattttgtagatactctttactgaaccactgtgcctttctaaatgtagttttctctagctctgatgcccacttatactaaagtaactatatttcctcctgtggaaaatatagtttgtatatggaagagatagctcctatctatactataaataataacatcaggaatggtcaaatactttctcttcttccataacttctgcctgtcaactagcacataaaattcaatgatctgaaacttaatgaattattctctagtataccaaaactccttccacattgactatactcattcatcagtgatagctcagtgtgagtgaagtgcctgggccaattttataaaggaatgaagatgcaaaaacaatgagtctaatgtctctagtgcaggtatgtggaactacaatatagactctaaaataaaatacatcaatagcatgtttcacgattttgcttcagatagagctgatcccaaagcaaacagtgtttacatcatacgtgaaaagaaataacacgggtcaccgacacggagtgtggacaataaaatctggtaccattctactagatggcctatgttgtacagatgagacagaagctattgcctatgctttcaagccagagacattatcaattatatctatggcagtgacagttttgagtaataagagctagccaatatgggttgactttcagcttctttccttacagtcataaaatgataaaaaaaatctagttttttaaaaaattttatcatactgctatagattgtctatactgcctaaatatcaataggacatgtgatgtttcacgtaggcaaatgggttggggagcagggggagtgggaggggataggagggtttctgaggggaaaccaggaaaggggaataacatttgaaatgcaaataaagaaaatatctaataaaaaaataaaaaaaaatactggtgactaatacagagtacacataatgctgttagaatacagtcatcacaacccaaaggcttgtgacatttgttctttttatgtgacatgcacaaattaacccataacagagagaggagagagacaggatgcttcatactagttcatgaaatgatatagaatcccctgacaaagaagagtacacagtagattttatacaacataggcattggggcctcctactctcctaagctcttagctaaaagatcatattcagttagcctatgattaatgtaatcatgttctggagaataggtcaatgcacatcttatgggagatatacattaaatatcttcgtgctaatttatagaacttgtcagggtaaggaagcagggctatttccttcctgtctttcacaaacacacacacacacacacacacacacacacacacacacacacacatacacatatgcaatatggaaccaggagacttcaacaaacggtaagatggatgtaggttaaagtacttacattaagcagacaaaattcagatttgggcatcttttattgttgtttctctaattcctagtcatttcatttttttcttttttcttggatattttctttatttacatttcaaatgttaccccctttccaagtttcctatgccctcccggaaactctctatcctatccttcttccccctgcttctctgagggtattcctacacccacctacccacccactcccacctcccctccctctattcccctacactgagacatctatcaagccttcataggaccaaggacctctcatcccactgatgcttgacacagccatcctttgctacatgtgcagctggaggcatgtgtactcctttgtttatggtttagtccctgggagttctgggtggtctggttggttgatattactgttcttactatggggttgcaaaccccttcaactccttcagtcctttctcttactcctctaattcctaatcatttgtacgttcaaatattttataagaaatgtgtcattatagtttaaacactgatgctaaaatccattaaccaagatgcccagtcaaaagattgaccaagtcagatcaacagtggaacatttctcagatgtgattttggacacttactttcaaataatcatcttataatctctcagttattgagatgcacactagtctgagggctggggttcttgtcatcttcagtctgttgctgaaatgtaacttgaaggaatggaattcaataagatattataagtaagttgtaagttaaggaaataatgcatgtgtaaggggctctcttggcttgagacagagtccctgacattgtgcccgatgtcctgtgaccacagaaaagaatagttcgttggagtagggagcagatgtcctgacaaggtgtcataaaggtgtaaggaattcatattaaaagaagccttttagagatatagactctactttctgctcagcagagacaccacgcacatttgactctacaatagcaaccttctgttctatatagtatgagagactttgttttttggtattgataagaaaactagagagaggattgctttcttttttggttttctttctttgaaatacccaccatcttcttgtttttcacattaaaaatcatcattgttcaaagcccaactaaagccatatctcctttacaaaattttccaagatgactttttttatatattgattgctgtctctctattgtctcatagcatgctattaatgtgtcagtacatatagctttgttttaaaaattggtacatgtatttgttttatctcctcaattagattgtaagcaacttatacacagagcatagctgtcttgactaatttgatattacataaggaaccttgcatagtaagccatatacactggatatttctatcacctgcatgagaatgctagactgttggttgctcttaaatctcatctaggaattgagtgtcttccaagatgatgttctataagaaatgttgggagcatatctgtgaagaaatggcaaactcaaatcataagacagaagtttaaaaaagaaagcttgttgctgctttaataaatttatactcattggtttaaaaatgtaagaatttcatttgcacagaaaaggagataacctcaagacaaaaggaaatatttaacccagcaattacacctttaaggttctgacttgtttcataagagaaaatagcttttgcaagtatcagaaagtgaagtcttataaaccaagggacataaaagccttcaatgtacagttaaagtattgctaaaaggggatttcaaataagatgggtggcataacagagtatattattataagtatactaaaacatactattatagcaaatgtggagggagtcagagctgagcaaatggaagaaacaaatgagaggcaatgagggaagcaaatagaatacatctgttaatgaaggtaacacgaagaaaaacaggaactaaagccccaggccaaaggaagacactacataaaagaagatttgaaggaactggctgagacctgaacatttcatatgttccaacaaataatgaccactcagatctacaagtaagaaaaacactccttatctatacttaagctagttctacagtatgatgcaaagggttagtaagagatgtgtctgggccaaatgcatgctccttcccccaatcctatacctggcatcctggacattaaagtcagtctttgggtaatggcttttcatttcaaggagccatttctttaaaggacaatttaaattgactgggagatttaaaatacatacagctttctatcagccctaagactttcacagaagattagcctttcaaagtacttttagatgtttctgccctgtccatcttcactcacatcttcttatcccctcctttactgcttacagtctagtcataaatgaaagcatcatgttcccttgctacccagagtctttgtgtgtgtttcctttgctatgcatcttcttttccttttataccaatgtcactttgcagcccttctgtaaactttccttgcagtgctttcttttgccattgtaacttattttaagattgctgatgtatttggctcagtatatgtcttctactctatactaccgttttgtggtcctaacccaagtgatacttataccataatcgttcacacacacacacacacacacacacacacacacacacacacactgataagattatactctacttaaactttgggctctagtgtgttggaattacttggcttagaaaattttctctaaagttgcctacctgtgtctcagttttatcacttaaaagctagagataacaatagtaactaatagcatcatggagagattgaaataaaataatgtattcatggaaggaacttcatggactgaaatattttaggcttccaggaatgtggaaacacaaaagaattgagaagaaaatgtgtgctatttgaggctcctgcactgactcacattttattcctaagaagttaatcaagagccctgatttctctattttcaataaacaccataaaaatatgggtttcttctgttccccgtgtagccattgattttaagcgcagggagtaacctagaatgagattgaagcctctccatgtggtatgactatgaattgccaggtgttgctgtggccctctgaggaataggcaatcattttagtcacaattgttacatttcttaagggcttacatttattctatgtccaggcactaggccaactgttttatttatagctccttatttttagtcatgtataagtcagggctggttggttactggccaggcatgcagagagagatttcaagtatggaattgagtagtctgagaatggatggctctattctctgcgtgtgcttcatggtcttgactaataattttttttctgtttccttacattcccttattgacagtctatatgcttatcctttgttcaaaatattaggaagataactgtaccttcatccattgtgtgaaatcttatgcatttcctgaaaacgagttcacagggaaagctataaaaatggaagcactagctgtataaaaaaacaaccataagtcccttctcattgaagtggggttactgataaggtataattagtagtagcaaatatattagcaattagaaagtcagaagaatcaagacatgaacaatagaccatctgttatgagagaaatatccaaccctcaaaatcagtaggtaatagatgctctgttcttgaaacataataaatagttaaagaataacaaaggaatgtcttactccctgctaaaaatactcttgggaattcccccaagtcagccacacactaatagtaaaagttcctatttttttaaaaattgaactagaaataaaaactggtaacaattttcgtctagccttatcctcatgttcagagactccccttcaaatgtaattgtggactttaagtgtactttttttgtgtaaagcaatttgtggttaggattcaagtaaactttgaaaagaaaatctttctaactcactcaaggcactcttaaggaggatagttggtttgcctacagaatgcagcagatcaaatagcatctgaatacacaggacaaacatgcagttaaataaaaaaaaaaccctgagtgtgagcagttctgctttttttcactcatatgtgtgtctaagcccatgaaaatttatctccttctctatacattggaagagtagtttctgatttacaatgcccttgtgtattttataggaattaatgcaaacagttcagttaatgctgctgctacttctgttgctataacaaaaaattccatgacagaatggctgagggaattaaccttgagtgaccatcaggtactattacccaatgggaccagattgttctgcatctataaaatgagtattgataagatgagaaattcatgtggaaggatcaataacacaaacagttaagccaggtaaaatccagtgtctaccaggtagaaaacaaccaagcaatgctaagcattactgcattttagcacaatttccagaacccacactctctgtgggtgttagctcttattgttactcttgggttaggaaatctaacccctggttaggaacaattatcaagggctacctcaatattgactagtattttggtattttagtatattatcactgctggtggacttgagaagtgactaacaaggtggaaagaaatgaatgaaaagaaatggcaaccctcttgtgtaatgtgaattctctataagagcctgaggacttagtgttttatatgtgaatatatgtgcttgttggcttttgtcaacacaaatctaggtatatctgggaaaaaggaatactagttaagaaaatagctcattaatattggcctatagaccaatctgtagggcgttttttctgattggtgattgacatagaatgtcccatatctctgtgggcagtgccattcctaggaagatggtcctgcataatataagagaacatactgaaaaagccatggagaacaagccagtaaataatgaacctccacagcctctgcagctattcctactcccaggtccctaccctggctttcttttataatagactgtgatgtagaagtgtaagtaaaataaactatttccttaccaagttgcttatggtcatgatttattacaggaatagaagtcctatctaagacactagacattcatttaaatgtgttaaattcatgcttttacatattgatttattttcaaattattatgattattggaacattgtcagcaagattgtaaagacaaaaaggcacactttgaaaataaattggtgtgctgtttctcattgatcctaatctaattgccatactcatcttgggtactagccttaaattatcttcaaaatacttatgtgaacaatccagaaatctcttgaggtagcctcaagttacagtgttggtttgcacgccatttagtacaaggtccagaccccagtaagtctgaaatttaccaggaccgtatgctactgtggactatggtgcgtgcaaagggccaatcacattttatgcttcctatgtcatttgtatccttcacaaactttaggttaatttttaccttccataagaaacatttcttaaacatatgtaattaattgagagtggtaacacacacctttaataacaacacttgagaagcagaggcaagtgaatctctgtgagttctaagccggccttgtctacaaagtgagtttcaggacagggctgcataatttcaaaaaatcaaacctaaccaaacaagaaaccttatataattaggtgccaaatctcatatagcttatatggattttttttattttaccagatagatttgaagtgtgcatagagtccaaggttatgaaaactcttgttaacataagggattgagtgagccataaggtgaagatacttgaaaaaaaatgtgactgtttctgaataaattatttattattctgctataagaaaatgtgaagaacaggattctgatttttactctacacagagtctaagttttaagtgccttgtttctaaatgattcttcctgacacatcctctcactccaccttgatgaggagcttagcaaaaacacaaaggaaatgaaaagttgaaatcataccccagaatactgaggaaataaagaaaggtcttttatgggcagaacaagatacttagcttttggctttgatttatcagcgttctctcatctcatgggtgataaccatttgcctctaaatagaacatgagagattggacattttccccagtatttgcttcagatgtagtgttcttgctccagtttaatgattccttcgagacctttcaaagttttctatttgaacttgagctatctagcatgagatagatacaatacacagctatatgccatggaggaaactgtttagttcgcaagtgaattttcaggataggtccaagatttgtgagatgctttcacattccatctctacagttcaagatcaaaggatgctaaggcagttaaaccttgatactgatacctgctccaaactgaaatacacagacagaaatgtgtgtgtgtgtgtgtgtgtgtgtgtgtgtatgtatgcctatgtaatatatgaatgaatgtgccctattctctttaaaatgaaaacaaatgaggtactagagcagtggttctcagtccttctaacactacaacccctttaatagtttctcatgctgtgtgaaccccaaccatacaattatccttcaaaactgtaactttgctactgttatatataataatgcaaatatctcatgagcagaatatctgataggcatctcctgtaaaagagttgttcaacctccaaaagagtcaaaatccacaggttgagagccaggcagtaaatgaaggagaaatggtcatagagaagttttgctaatgacttaagaaaactatttgcagctatccaattgtgtgtgtgtgtgtgtgtgtgtgtgtgtgtgtgtgtgtgtgtgtggtgtgtgtgtgtgtgtgtgtatgtgtatgtgagagagtttgtggtgtatgtacaaatgtgtacacaggtacacatgcccttgtgatagtgaaaaggccagagaaggacttttcggtgtcctttaacctgatacgagacaggctaccccactgaacctgggactattttggtagccagcaagcccttgctttcctccgatttctcaccctttggctaaaagtcctttaccggtgcgactaatcaatatcttcctctcttcccaaaatccccaaaacaaacatagacattattctgccagaacagttaatctggtttccttgtagaaagtaggtgagggggttgcttgaagggctgtaggcagtcctgcctcgatgggctacatctgaaaagctctacccaagaggaatgagggcttcccatgtagccccacagtgtccctcacctcctctctatgtaggctgtaatgtgtcaacaaacctatttgggatatctttggcaagcaagtggtgatgatgcagatgaactccttaagatggcagttgcttggttcaggacacagttattcatgacagtactcccaaatgggcttggcttatagatgtatgtgaccaatgtgactttccaagtgagttctaggaatatgaactcaggtcctgtggcttgtagagcaaacactcttacccccctcatctcctcagcccctaccctatcccagcatgtacaagtgtaccctacttaactctaaacccttggcagagagagcctagattttatttgttctgtatcactttccctaatctttcctggcatataaatgttgcataaatattgtttctttaaaaaagtttgttgtctaaaccgtttgaattcttccttcacattcacactcccacctctaaaactcagaatgtagctgatctacttccccagtgctaggattagggctatgcactattatgcctggtctttatacagtgttaaggattaatcttagaagtattcatgcatgagaggcaagcactttaacaactaagctacattcttcagtaacattctttattctgtttaaatgtagtattaccagtattcttccctgaacacatttataattgtaccatcctgttctgggacctcaacttagtctattttcctgcctatctgttatcacttcctgaaattctatatgattaattcttattttgtttattgtctatgttctttgatgtaatttactcttcataataacagggacattgtctatatttctccactgaattctcaatagtcagaacgctgtcaaatcaaacacaataaaataaaaacaagcatttgttgaaatatacacaaaagatcaaggaacgttctcgaaaatattttcatcctaagacttattgttacattgaattccataaatatcacatatattcaaaagataatattaaatataaaccctctctgggaaagaaactgtctttttcttcttgatgtctttgctctgagtagtcaagaaagtggtaagaggaattgaaaaagagcaagcattgaataaaaactgttcttggcaatatcaggttgttttcatcttattatggaccagtgagttttataaatgcttgctcactccaagaaaatggcattatttgaataaattcactagttacaaccttcagcccctttaaagaggtttttctcattttaattattttctgaaatattttcaaggacagtgacttcttggtgatgatggataatgcagttgaagagcttgtatgttgttcacaattaactggaactgttaaatgagcctcttcgtgtatttgtcagttactagatttctttaaaaataagaatcaaaggacagagaaatatttcaaaacctaaaggatgtcatttgcattttcagtgtataccctgcatctaacaggttactcaaccaaaacattcctgcctgtcaaattcagtctcttttaacacttttctcaggcaaacagcttgcccaagttactttaaagcagtctaataatggataataaggaggaattagtcaaatcttacctttaattgggagctgaaaacagttcttttaacttgtaagtgatcataatatgattatgaatgtgacactttgtatttcaaagtctaccctcagggttaaactatgagcaccaggaggaacagatagagaaagatttttggctcttctaaaattagaataggagaagggttgatggcgtggcttggtggataaggacacctgctgtcaagagtggtcacttgagttcaattccctggacccacatggtagaaggagagaaatggctcccacaagtttccttctactctctacatgtgggccaaatcatgagtgtgcaactcctcacacacaataaagaaatgggggggtgcggtaaaagtagcacaagaaaaaataataatctagtgctcgacactgatgtcaagagaggtcgattagataaacaactgtgaaaatcagattacaactgagaacttctgttagacgtgcccaaacaagcactggctggtggtaaggatgtgcacctgaatcagacagtgcttggtttcttttctctgtttctgtggagtcaggggatttcagtccaaggcactacctgcttaaacattctaaaaccaaagaagagcggaaacctttggcaggaactagaagcttttctaacactgtctgacttcaccataactcacagcttatacaaagagtgtttggttctgtcttagagttttactgctgtgaagagaaaccatgaccaaggcaattcttataaggacagcattcaattggggctggcttacaggttcagaggttcagtcaatcatcatcaaggtgggaacatggcagcatctaggcaggcatggtgcaagaggagcagagagttctacatcttcatatgaaggctgctaacagaatattgacttctaggcagctaggatgagggtcttaaagcccacacccacagtgacacacctactccaacagagccacgtctaccccaacagggtcaccccttctaatagtaccattctctaggccaaacatatacaaaccataacaggtaatcttaagtaaagcaacatagtatatttatgttgaagaaactggacttaggaatatgacaaggtatcttcattacttcccatctttcctatttctgaaagttgagtgcagttgtttctcttcacacttttcctttgctgttcttcagtagcagtgatgctgctgagctggggggaaggtagtgtgttaaaatatattttctgcagctactgatggaaagtcaggctctttttcccctactttccctgtggtgagatttgaaaattaatttgcactgttttccgctgtgtattatagggagattatagacaaaacgtcttttaagacatttcattttgttcctgcttagaactattatcagttacatacactctttagtcttttgtctttatttaggatcaaagaagaagagagatgagtcttagaggctttttaaatagttctctttgtttattatcataggagagtgccaaacttcttaatttatggccacataaatcctataatatggttttattaaaaagctcataatattaattactgggcaaccatgtagtcaaggataattttcattattttttcttttgtaaaacacaattgaatttgaaaatatttctactgcctctcagtaactaggctgctaaaattcttctccaacactaagctgaacagaccttaacttcaccctcagaacatttctatgctggcactaaatgtcatatcaaaaactcataggattgctggagaaaatgattctacttcttcttagatttttttaaaaaacttttatgaatatgagtattttacaccatatatgttcctggtgcttgcagaatccagaagcagatatcggactctttggaattggaattagagatgattgtgagttataatgtgggtgcagggaattgaatccccagtcctctgcaagggtagtcaatactcttaacttctgagtcatctctccagcttatttctatttctaaaatcatctcactgctgcagcataccttctttttcctctgaagtacttgaataaaaacaaaagaacaattcacatttgtctcaacatgtatgtgtgtgtgtatgtatgtatatatgtgtatatgtgtgtatatatatgtatatgtataaaaacataacaaaatggtgttgatgaattattttcccagtaacatcattcataaatagcactatttcttacagttcctgccttttcagaaatccattcacctttacattcattcttcttatccaatgaaacattttataactgaaatgatgctaaattaaaaaatgcaactgtttctgtagtccagatgggaagacaaaaccagctgatttgtttaaggaaacacattaacaagcatttcagttataaaagataaggtctaagctgagggtagaggttgaaacgaatatgagttaaattaatcttctcaatatgtgaacaaattttgaagttttcccaggcaagcaaaaggacaagagctagaacaaatccatgggaagttgttcatgagagaatggcctccagaagcatggcagctaaccagtactgtaatggaaccttagcaggaactgatgtcagagagtcagtttttacaagcagttaattcctctgtgcagtaatcccttccctagaaaagcagcctttagtgaaaaggccattatgtgcaggaataatcttagtgataccttgaggattcgtcctgagcagttgtagctacacttagagtgagcgaatagaaaaaaagaaccgttatctataatggttccaggactgccatatgctgcaaaatgggattcagaattcaggggagtaaaaatggtcaagaaataaaagcaatattaaggaattgccaaataaaaatttaattacataacagttaggacctgagtactttaatatagatgttaaaagaaaagggtggtctgcacccctgagctgaggctgatccacagcctgctgtgcacaggtcccaacaggagagacctgttctcccagaagtgttttcactcccgggcttgtaggtgagatagccattttctctccaataactgtgtggagcatggccagtcaggagcacatggaacacaagatcagtggagcagctgcgatgggatccttctagccatgatctgcactcagaggttgggctgttccagagccctttgtgcacaagttctgccagggaagagctgatctctcaggagtgctgacacaggcttacagacccacaggagtaacaagctccagcaagagaaagcaagaaaatcaaacaccagggataacaggatggtgaaaggcaaatgcaagaaacagacaccaaggctacttggcaccatcagaagccagttctcccacaatgaactgtcctggattccccaacaaacaggaaaagcaaggtatagatttaaaatcacatctcatgatgctaatagaggatattaagaaggacataactcccttaaaaatagaggagaacacaggtaaaaaggtagaagcccttaaagaggaacacaaaaacccttaaagaattacaggaaaaaacaaccaaacaggtaaaggaattgaacaaaaacatccaggatctaaaaatggaaattgaaacaataaagaaatcataaagggagaaaaatctggagatagaaaacctaggaaagcagtcaggagtcatatatatgagcaccaccaacagaacaaaagaaatagaagacagaatttcaggcacagaagataagatagacacaaccgtcaaagaaaatgcaaaatgcaaaaagatcctaacttaaaacttacaggaattccaggacacaatgagaagaccaaatctaaggataataggtatagaagagagcaaagattcacaaattaaagggtcagtaagtatcttccacaaaactgtagaagaaaacttccctaacataaagaaagatatgcccatgaacatacaagaagcctatagaactcagcaacaatctttttttgtcaatatctcttaatattaatagactcaaaacacatattgcactgcacacaataatagtgggagacttcaacactcactttcagcaatggacagatcatagaaaaagaaactaaacagagacatagtgaaactaacagaagttatgaaacaaatggatttaacagatatctgtagaacattttatcctaaaacaaaagaatataccttcttctcagaatttcatgatactttgtacaaaattgaccgtataatccgtcacaaaacaggcctccacatatacaagaacactggaataatcccatgcatccaatcagatcaccaaggaataaggctgatcttcaataacaacattaatagaaagccacagttgacatggaagctgaacaacactctactcagtgataactttgtcaaggaagaaatgaagaattcatttaagactttttagagtttaatggaaatgaacctacaacatacccaaacttatggaacacaatgaaagcagtcctaagaggaaaacacagacctctgagtgcctccaaaaagaaactagagagagcatacattagcagctttacagcacatctgaaagctctagaataaaaagaagtaaattcacccaagagaatagacagcaggaaatagtcacaaataatataaaataccttggtgtgactctaactaaggaagtgaaatatctgtatgcaaagaacttcaagtctctgaagaaagaaattgaagatctcagaagatggaaagatctcccatgctcatggattagcaggattaatatagtaaacatggccatcttgctgaaagtaatatacagattcaatgcaatccccatcaaaattccagctcaattcttcacagagttagaaagagtaatttgcaaattcatctggaataacaaaaaacctaggataacgaaaactcttctcaacaataaaagaacttctggtggaatcaccatcctggacctcaagctgtactacagaacaattgtgataaaacaaaacaaaacaaaacaaaaactgcatggtattggtacaatgacagacaggtagatcaatggaatagaattgaaaacccagaagtgagctcacacacctatagtcacttgatctttgacaaagcagctaaaaccatccagtggaaaaaagagcattttccccaaatggtgctggcacaactggtgcttatcatgtagaagagtgcaaatcgatccattcctatctccttgtactaaggtcaaatctaagtagattaaggacctccacataaaaccagatacactgaaactaatagaagagaaagtggggaaaagccttgagcacatgggcacaggggaaatttttctgaatagagcactaatagtttatgctctaagatcaagaactgacaaacaagatctcataaaactgccttttctgtaaggcaaaaaacactgtcaaaaggacaaaatggcaaccaacagatctttactaatcctacatccgatagagggctaatatccaatatatacaaagaactcaagaagttagactccagagaaccaaataaccttattcaaaaatggggtacagagctaaacaaagaattttcaactgaggaacacggaatggctaagaagcacctaaagaaatggtcagtatcctcagtcatcagggaaatgcaaatcaaaacaaccctgagatttcacctcacaccagtcagaatggctaagatcaaatactcaggtgacagatgctggcaaggttgtggagaaagaggaacactcctccatttctgttgggattgcaagctgataaaaccactctggaaatcagtttcatggttcctcagaaaattagacatagtactgagtacccactaataccactcctggatataccccgattatccaccaacatataacaaagacacatggtccaatatgttcatcacatccttatttataatatccagaaactggaaagaacccagatgtccctcaacagtggaatggatacagaaaatgtggtacatttacacaatagagtactactcagctcttaaaagcgacgaatttatgaaattcttaggcaaatggatggagctagaaaatatcatcctgagtgaggtaactcaattccaaagaacatacatggtatgcactcagtgatacgtggatattagcccaaggcttggaataccgaagatacaatttacaaatcacatgaaactcaagacaaaggaagaccaaaatgtagatactttgatccttcttatgagggggaacaaaatacctatggaagaagttacagagacaaagtatggagcagagactgaaggaatgactatccagagcctgccccacctggagatccagcccatatacaatcaccaaacccagacacttttgtggatgccaacaattgcttgctgacagaagcctgatacatactgtctcctgagaggcttcaccagtgcctgacaaatataggggtggatgcttacagccttctattggactgagcaaagggtccccaatgaaggaactagagaaagaacccaaggagctgaaatggtttgcagccccataagaggaataacaaagtgaaatatccagtaaccccagagctcccagggactaaaccaccaactaaagagtacacacggtgggactcatgtctctggcttcatatgtagcaaaggatggcctagtcagtcatcagtgggaggagaggcgcttggtcctgtgaaggctctaggccctggtgtaggggaatcctagggctgggaagcaggagtaggtaggttggtatgcaggggtaggggagagggaagagggggttttcagaggggaaaccaggaaaagtttacatttgaaaagtaaataaagaaaatctctaataaaaatatgaaaaattaaaaatgaaaatgaaaaattaaaaaggaaaagaaaaagaaaaagaaaaggggaagtcccacagactagcaaggcaggggagattcattgttacgaatgtgagggagcgtaggcagatccacagtcccaggacaggacatttatgaatacttatgcatttagattttatgtattgtccatgtatgtactggtacttggtcagttttactaattttaaataaacttggtcaagattggtttgttttgaggtatcattatgtgtaacttgagtaacttgatttatattttaagctaattaactctatcagtctttttctgttggagactttgatgtattttttcttgtgtttgtcttcatttccagttcatgattttaaaactattatttcatgttatattccttcttaaaaactgcacatactagtatgtcctgaagtgtacctagtcatctataggaagacaattgtatttaaaaagtatgaattactgtaattcataatcttctatgagcagattctttgttcctaacagcaaagtaatagctctaagtcccacagaaatatttagctttattgaatctacctttatttgactattaaacacaaaaactcaaagtgttctatgttatctaatttattctcacaatataatacaaagagtgttttagtcaaaggggcagacatcatttaactctatttgtgtttaatggatctttacatagggaaagcttttaccaaaaacaatttgtgaccttctactgcattccacagaaccagtcttacaaagtatttttacaatggtctaattgaataatacaatttgtttatttaaatatgagatttttcttaagcctatgtttcatataacttgtatggttccctccatatagcataactgccatagcaaatcatgaggcagtccagtgtcactctcttattcccaacatgggctcctggaatgtatgcaaatgtaaatctagtccatgtcccttcactaatgttatttaaaaggacaatacaaaatgttctagttatttagctaagattccaaagcaacttatcagaggttcagaccatgatttttttccctcagtcttcacttctattatgtgtggaccaatttccaatattctggagtttctaaattaatcactaatacccacaacaatgtgcacatatttatatatacacacaagccaaactaaagccgcatttggaaaaaagaaagatatcattatcttttgagaaaatgttctaaaatcaaaaatgtctcaatttttttgaaaactcaataagtccatattttcataaaatatattgtaaaatatttgcctgctagttctttacatgttcagaacttgcagattcatgaagtacccaaaattttgaggatgtgacaaactatactacctagatattgcaaatctaaacttttataatttattccccaaaaaagtccatgaattttgagctattgcagctgagcataataaaaaaagaatacagaaaaaaagcccatgaatgtctgcctgaaaagaattttgctcggaatcactttattttatcattgcaacatagaactgtcaaatacaatggagaaactccatcttagctcacaagtcaattttgcacatgcttccagaaagtctattcctctcccttttagcatgcaaaaatttgctaatgtatattgtttaagcatctcctagaggacagaagcagcagggaaaattaacaagaacagaaaataggcaagtagagtgtaatcaagaggatggagtgggagcttagtgggataatgattatcaactagatataaaaattgactgttggatttgaaaagacaatataatgatgtcacctgagaggagcctgcaaggaaactgaaaaggaatttggtagtaattaggcagcatgagctaagctttgggcgggagcttcggggggttgccaggacaaatgggcattcacaaagtaaatgactcttggagaagacagaataaaagctggagagttacatgagatgagcaattcagactgaggagtatggactagatgcagacggtcattacatggcaggctgactatcaagccaccaaggcaaccatattcattaagaaccttctacaaggatattagcagaccaagaacacattggaatcttcatactagccctctaagggcttagctcttttctgaatctggatccatgttttgctgtcctttctgttgttgaggcttaagagatcaggacactatcaaaggtcacccataacatttatgtcctgaatctcattttcaatttcttttcctttaaacagaacattccagttggcagtgaaacgtgcttcattgtcttctgtgatattacctttaccacggcaaagctcagtgaaagaggtgtcatactcactgacttaacgttcatacttttaagttgctttaagtagagtcagaagtaaaacagaaaaatgatattcactttataaatataattttccaaaatattgtattgtcctgatagtaaagaccaaggtatatttgtacatgtgtgtgtgtgaatgtgtatatgttatttgtgctttttttccttctttttaaaagtctgctttgtttgtttactttacctgtttgttttctaaagagaaagaaaaagaattggtggagttggatgggtggagaggtggggagggccagggagaagttgggggagtggaaactgatcacaatattgtatgaaaaataattttcaataaaatacatatgtacttataaaaaagaatagagtgaaaacattaaaataagctttaaggacacataaaatggggcatggaattaagtttttctaaattctaaaactgtaattatgctagatgtcttggcacatgcctataatctcagaatttgggaggctgaggtaggaggaatatgattcatgccatcttaggatatataatgaaaatgtatgtcaaaaaataaaggaaggcaggaaaccagtagtcaagatctgaacagtaacataactccccaagtataaacatattagaaagaaatgtattaaattgatttaaatgtagtctatatagtccaacaatggctcttttcacactgagaggctgagaagccagaaactggtctgtccatgatcaagatgcttcagcattctcaatctgacactgaagacctggaagattgctgtaaagccactataatgttcagtccagatcagaagtagaagaagatatgttctgatgtcaacaaaagatgagaacaaaagtgaaggtggcagcagtatctctggtaaatgaaactgtcagagaagtgcgaaggtaagcaagcagggggaaaaaagcctttttttcccttagatatcctcatatatgctccccaaagcgccacccacattgagggtaggaatacagagaacttgacaggaacacctccacgatgagcttgagaatgagtgacagcaatttagagatgaattagttattggtacatagcaaactaagtaagtgaaaagaatgagccacctaatgaactgccaaaagttaaaagaaaatcataaaagaagggagttgtaatcataatcaactggatagctcagcaataaataatggaacaatcacaagaacatcatttatgaacttttctaacccaatgtggtctggccatgagggaagggagaattttagcaaagctaaagcttcataataaggagtcagcagtcactaccaaaagttaatataaaagctaacaatgtaactatgtaattaatataactagagctaaataccagaagaataagagttgaatgtcgtttgtttgaggggagctggtatcactaagaacttggataagatggattggagaacagccattcccatcataagtcaagaagtgaaattaaatgtgtaagaaatatgcattgatgatttagattaaaaattaatttcaaattgttgcttgggggtgtgtctcagcgatagagcagttgcccaacacacataagtctctgaattcaatcaacaatatcactgaaataattaaatttaattagtcaaacttgatcttgcctactttatcaatgaataattattaaaaaaaataatgatgccttccatcgagggctttgaacttgctctctttcactatgtcaaatactttttgggaacagggcatatgaagacttctagatcctgttagatattctaataaatagtactcaaactacccatgcagataacttaaaatgtagctaaattttactttggtgaattttgtttctgtcacagatatgtggctagttttgctttactttgtgtttcaccagacttgcatatatgtaccaaatctgaaaactatacattgaaaaccatgacttaatacaaccaaaaattaatagcttacatgggcagtattacctaacttgtcaagaaatgctttgtatcacttatgtgagtcacactctagcttcttacattgactgtgtacttcctgatgtgaatttctgcatagatcataacttttattttattatccttgcttgtctttatatgtctgattacctaccactttaaagattatttatttatttaatgtgcctaagtgttttgcctgtatgtaggtctgtgtgcagatttctgatcccttggaactggagttacagacagctgtgagctgccatgtgagaactgaacgcaggtcctctagaagagcagctgatgctctcaaccactgagccatctctccaatcctctggataccattacttatgattatcagtaactcttaaatttgaactctatattgaagcagagaaatgattccctcaatgagaattcattccacatactcaggaaaaataggcaaaataaaacaaaacttaaaaaaaaatactgtgcatccagcattggctaatgactgactaattcctcccaaagaggtatcagtcttgaacagaaaattttagtaacttttgtagaccccaggcttatatattctacataggctgtcatacctgttttcaggcccttttgccaagttatactttttaaaatgtaaacagagacaggggcctgcaagtctggccattttttgtatgggagatttacataaatattgtcaaaattatttttaagtcccaggaacaccacaaagactaaacaatgagaacccggatcccctctggaatatgacggcccagtcttttcagttcaccaaaaaacatccagagctgagttgactaaatcatgctggttgtgctatgagataagactgccatactcttagggcatagctgatttaaaactttacccaaactgggaacttcaattagccccaatgagtatagatgacaacaaggtaaagctaggttgaccttacaggccatagagggtcaagactcctatatagagacagttcctggggcctatagccatctttgtaactggacttacaagataaatacaaacaatggtatctacctattgccacccatcaatgcctggtgggtatgcactacatggctcaccccattcatctatgagactatactacatcagaacaaatgattctgtgtacttgtccagttaatacctatggttatctatcacactaaagaacaagttctaaattttcttgatataatttaaggtttaacccccaccccacccccaggaaccaattttggctttaactctggtggttctaacaggattggatgtggcctacatagaaatggggtagcttccttagtgttataaaacaaacattaggatgggctaagagaggccatagatactgatataaagatattttaaaaaagagtctcccttctccagtattctctggacttcctggcaaaggtggtactgcaaaataagaggggactggctctcctgttcatgcaaccaagaagtctatgtactgctttaaaaaaaatgttatttttatactgcccactcctgaatagtcaaaaaaaaaaaaaaagactgacaaagaagaaaaacagagagacagagagacagagagacagagacagagaccagacacaaggctggttcaaattatggttcaacagctccccttatatctaccttgcttggctccctgcccattttacttttgtttcttacctttggcccctacattctgaacaaattagtccaatttataatagaaagacttgggactatccaagtaatagtgataaatagtcactaccagtccctctataacaaagcctatgagcttcaaaaagtcccatgattgggccttaagcaagataagaggtcaaatcttttaaattcagactccatgttagagaatctgacctaagtttgaactcaggtaaactaacaggcttatatctagcattagtttccaaattactcccccaccccaccccacccccgaaacaaaaccagaacctagctccagtctctaggttcacccccaactagtcctgtgtctccaggttacacccccaacaaggccagcatctccaggttattacccaacagatctatgcccccaggttaccagcctaccccctgcctaatgaccaccaatgcagaaaaaactaaaacttaagttaacgatttgattcctagcacaggcaattatagtaaaagccatagtagctttccaattagatgttcgtatatttataccctgcttgcagcttactataaagccttgccctgatagatattcagggctcatttctccaccaaaaactgtcctgtgtgttggtggtgatctgaggggcccatgatagctcagatagaataaagaacctgctgaaagttgcactggatctactcctatctgtttggttttattttgtgggggtggggggtcaggatcactagcatttccctgacactagagagtcatctgtgcttatgcatatgaatggtatagctggatcatacattacttttagctttttgaggagcctctacattgatttacctagtatcttcataaggttgcattcctactaacaacaaatgagggctcttctttgctcacaccctcaccagtatctgttgtcattagttttcttgatcttagccattgtggctggagtaagaaaaagtgtcaaaatagttttaaatttgtattctcttgttggctaaggatgttgaaatactttaaaatatgttttagcacacttgtgtatctttttatgaagataccaagattctttcttattctgtaagttttgtattaataataattagtagtatacagtactgtcagatacaagctgtagcatttcagggacactcactggcatcacatggtgttgccacttgcacaatgcaaagtgaatattggtgttctcattgaaggctgcactgtggttgaacattgctagaaactactcagattcactataatatttgattttgaattaatttctgatctctgtgcattcagaaactgtttattgttaccaattttcgggtcatctccattcatatgactactgcaaggtagtatcctagatttatgaaagtgctctagcatattttatccattttttttattgttgtcttttggagtcccggttgaggtttaataataataagacatggagacatctgtatagtttaaagctgttggcagtcagccaacctccaaacttaaccagacttttctgccattgcatctctctacatggctcttgctgctttacctccctgcactgtccctttctgctatactcctgcctgcttctctcttcctcccctctgtctgtcctggtctcagctgtcagctcttatttctacaacaatttctacattcctaattcattcagtctgaagcagtcagcagcagacaacacccatctctttgatgccttttgacattaaaggctacaggaacttcactgtggctgtttgcttcttaatatgctaatcttagagaaccatctttcaagaaggtgaggaagcgacaaatactctgccagcccttggctctgccagcacagcaattaacatttgaaaatacagtggcacctatatagccctttgattcaatgtgtgcttgtgtgtaggcgtgggggtcggggtgtaggttatcccaacagctttttcttggtcctttctctatattgctccctttatcttttcaagagttaaaaaaatcgttttgaaattacttttgttatccctcctgtaggagtaccaacataagcagttattactggaaattttgttgtgttttgctttgttatgttttttttttctttttgagagagagaggtctcatgtagccttgactgttcttaaattggttacattgctgaggctgactttgaactcctgataattttgcctcccctaaaacctcagtgttaggagtacaggtgtctaccactgcaccaggttatcctgtgcattctccatctccctcaccctgctttgttcacttcatttagcagacagaatgtttcacatgaattttatctttccttcttactgtattcctgaatatctggagatttgcagtacagtttcttccacatgcaaggaaacatgccatatccagaccaatctcacgctccaggacctaacagaattcgcctatctaaatttcaagtcagcttggtctatggtttctgctatataattggagctacggccttaatatagtggtaatgttcaatcttgcttaatgtaattctgctcctgagggacagctattatactactactgcttcccttactctccaatgtagtatatgtgtgtgtttgtgtgtgtgtgtgtgcgtgcgcgcgtgggtgcatatgtgtatacaacatggcaaataatagatggcaggggagtaagagagacagacagcactatttttggtccttttcacttcttgccaagtatatgattttgcataaatcccttatgtaaaaaatcctttttcaggtgatagacttaatttgtatgttgagattttcatagtggaatatagtgcatatctaatagatgaaatttattattattttaatgaggcgtcatagctttgataacttgtgtctccttcaggcttctgttttgtatttccaataatttctttatgtgaatttcatatccattattgatttggccagcaaagatagaagctgtttttatttggttttaattagtcaatttattcatttattttgacaagagagggaatttactttctcagattatttccttctggttggtgatacttgttgttagtttgaatgttaaggttgatttttggtccagctgctaatgatgcaggattgctatgctctagagaaaagattttagatgtaattaagtgcgaatacatcctcatcagcttgtcttctgttcttacaagaacttttgcttattaaaaagtgccagctccaccttagttcttctcctagtgaacactttaagattatgcaagcagaccagtacttctagtctgattcaatacttatatcagacaatgtgatggggttacaaattaaaaaaaaaaaaaacaactctcagttgctaacagctagggataaatggcatcatgggaaacctatggtattgagtcataccaaacatatggtaaatcttggttttatatatatatgtatatgtatatgtatatgtatatgtatatgtatatgtatatgtatatgtatatgtatatgtatatgtatatgtatatgatgtatatgtatatgtatataaaaccttctttctagaagctaatgggattcagagaaaaacagatgaacgctaacaagctcaataaaataatagggactcaattgtctgaaggatctgattagttgtttgcttcgttgctttttctctttttgctcccggggaatcaaatgtttgcccttgtatatgctaatcacatactctgctactgagctacaactcagacccatatctgttttataaaccaattctcagaccaggtatgtacttctgagaatagtgccaaggaagaaaagaggaagcagctacagaaggccatgctccatggacatggtcaataggaggaatataggggcaatcttggtaggaagggaggagaaattagagctgtgatgagaaagttcagttccttggaagatcctgataaggctttcatgtgacctgagcacatggcaaggaaagactctgtttaatgatgtagaaatcaaagaactgtgagtttttgcagcatcacggtgatatttttcactgagctcatacattttcatgcataatgaacttggtgtttagcctgactagtgtagcattacccagtagaaacaaaatgtaaattgtacaagggagaatctggatgtaatctccatcactgagagagagggtgggggaatattactgtaaggtagatagctaaggtagaattttctagtgactaaatttaagcatgcaaaatataatagacaaaattataattaatatttggtacaatatatcaaaaatattctcaccaagttaatcaatagtaaatattgatcagatgcaagactttcctcatgctgacatttagaaacccagtatgttttttgtactgatagactacctcaatttatatcaaccacatttcatgttcttaataatcacatgcaactagtgcctcacatactcttatacacagtattaatttcaaggactccattttttcatcactatacatgaagtcatggaaacaaaacataatttgttcagaccaatagatctgcactatccagtatgttagtcactaccagtactgttactgggattagtggttatagcctatgccccaaggagctatgtctagacatttctcctcaataagcaaattaaagaagtcaaattaataatgaaatactaaaaaatttttttcaatgtgaacatctgtcttggggaggtcttgatttgagagtagggtgtaaatataaaggaaaagctatgcagcgcatccagcaaagtgtggtctctcctctactactgtctcaggaataagtctctcctgcatggttagtctcttctgcaattctttggtaagttataaatttttctccagaagacaaattccccttcttcaggcttccggggcttcagccattttgtctccacagcaggatattcctatggggtttccttattttttggtgtatactcttttaacaatctactagccaaattgatagtaacatgtctccttccagtgcatcaacttctgccacacaaactagatacacagtgtgccaatctatgttcaaattaattttaatcaaaatcaaaatatagtccctcatttgaactagccgcatttcaaatcttcggtaagcaaaggaagcagttgacaactctgtaacaggcctgaccaagacacacagagaaagagagagagtgggggtggacggttctgtctttcaatctcactattagactattgaaacagtggatcgcaaagaaatgtgactctctccaggaagctcatgctgagagaaagataaagtgccagccagaggggggatcttgcctcaaggaaagaaattttattttacatagttctaacaatttgtcagaccacatttcaagatgagactgaagcccaggtaattactgatcaatacctggactacttagatatactcatttttggtcctctatttaaactctgatctaagttcaggacccaaaaaatgtacttgaagggtttgctagatctgtttctttccagtgtggccgcagtggatactgacttacattttaaatttggctcttttaattgaactgattgatgattgtgaccagacctgacttggagcacaggttgtgatcccccaagttttgtaacagcacaaaaggtttacagacttattcttctaacttctaaagcaaacgtcagagaataatatctaaatcacatagaatttgcatcacctttgatgaaaacacatgtaccttgtcaacataaaaaatagctctcatcttaaagggaatatgagatagtgtgaccggaagctcacctaagaacatttcaacaaaattcaaatctctccacagtactaaaatgctaatcagtctatcagtctttttagacatgcaagttatgaaccatcttaggcttgaaaaccatcctgtagtaaagacgaatgaactaagtgtatccctgtttgtgattaaagttctgtttctcaaagattaggcaatatcccatctataaccttcaccacaaatggttctatactacctgtttcaggaaatagcgaccaaccatgcctttgtttcaaatggttacagtggccacctgttgttatgattaccttatgaccaccttgcaatcacatctttgtttcaaaaggttgttatggctaacttgttagcttatgttctgtttctgtagcctcacctatttatctgccaaatttctcattttaaaccccctggtctataaaaaaaacttatcttccccacatccaatgctggcttcttaaatcccaccttaaggggaggaggcagtccatgtacacagattcaaaagcttgcttgctttgattagttgcttactttaattaatatggccaagggaatttgagtcagctatctttctcctcacctctttgggcacttatttttcacaattagacatagcctaatttcaggaatttcttgtcccaacctccttcatctcttaatcccgttacccattgaatttgtactcagctatcctgtcaccaacatattaccagagcatggctgcaaggtacagcattgtccaagagaatcctgaaaatagatacattttgtgaacaagatttctgtctaattgcatttttcttagtttcatacaaatgtgtcactctgtatttgaaatatatgtacaccttgaaaaggcgggtgaaggagtacttctaaacaagccagatgcatctttgaaaatgttatatcatagggagcaccataaggactgcagaatgcctggcttgcaaatgacaaagaaaaatgcaaacatgtgacagtagtcttttctcctccttctttatgtactttacagacttttccccttgtcaatgctctgggcagtgttctaacttggtatttgcaagtcaatgggcaaggcgtgttctgcactgagggaattacatagtcacagacaattagtcttttaaaaggtctgctgcttggaaatctgccaccaaatccagtatagcctcagcacataatgtaaatttttaatgattataacttttctaaattcagcctttaacaaatcttatagtggtgttttgaaacttttcaatcaaacataacccaattaagttcatatttgattaaactgaactgccacttcatcgaagtgcttaaataaatcagcattaatatgttttcactacagtaaataaagttaattctacatagttgaaatgtcaatattggcgtgtggttttgaaaagtactccctccattctgaataatgaatccagtgttggagggaaagtgtttctttttccaaactctaaaagttcttaatttttaagaagtagtaaatcaaatatgatgttttaaattctaaaatattatcaaagttgttttaagactctgattaatgttttctttttcctttaaaaaatacaatatcaatggatccttcaaagaataattgtagggatttctttttattaggattaatttgtttaaacacctctgacagcttttcttctagaacagctattctcagccttcttaatactgcgacctttaaatacagatccttatcttctggtgaccccgatcataaaattattttcattgctactttataactataatattgctattgttattaattgtaatgtgtgtttcccagtggtcttaggcacttatcaaacctaaaggagtatgaccaacgggttgaggatcactgttctagaatataacagaaagcacaatttaaacagcaatatttgaatatcttaaatactaggaaccagacacattccagatttttacctccagatttttataaaagcaaacaccacagctctcattctaaagggagtaaaagatagtttcttttggagccgttttgagttagcatgcctgagaacacagatttaggttacctccaaattctatgctccaatgtggaagcagtttcacaaagtctatatagttttacagaacagagaaaccttttgtgatggtgaaagctagttgcttgataaatcaataggtcctaaataagttctttttaatttatcgtcacaaaaatcttggatcccatataggggtgggcaagaaatccaaaatgtttcacaatgtgagataatggttatcctggagggccagaattcatcccaagtaaaggtaattagctgctgggcaggcaacattccagtctctctacaggactggaatttgaaccagccaatcagtctcctctacagacagattcttttcaggggttttcattcacattttgaacagtctccccctactccataattctgaaatccaaaatgttccacaatgtgcaataataggatatgaaactctgagtgccttggctctgttgtattaagcttgagaggctagagtcccagaaaaccagagactagcaaagccataccaagccagaggtttgcaaatattaagaatacagtgcaggaactgggacaaccactctggaaatcagtttggcagttcttcagaaaattggacataatacaaccggtagatccagaaataccacttctgggcatatacctagatgatgctcccactggtaataagaacacatgctccactatgttcatagcaaccttatttataatagctagaagctggaaagaacccagatgtccctcaacagaggaatggatacagaaaatgtacatttacacaatggagtactacacagctattaaaaacaatgaatttatgaaattctcaggcaaatggatgcatctggaggatatcatcctgagtgaggtaacccaatcacaaaagaacacacatgatatgcattcactgataagtggatattggcccagaagctcagaatccttttagaagtgggaacaaaatacccatggaaggaattacagagacaaagttcagagcagagactgaaggaaagacaatctagagactgccccacttggagatccatcctataaaccaccaccaaacccagacactatggcagatgccaacaagagcttcctgacaggagcctgagatagctttcttctgtgaggctctgccagtgcctagcaaatacaaaagtggatgctcacagtcatcctatggacggagcacagggtccccaatgaaggaggtagagaaagtacccagggagctgaaagggtgtgaagccccattggaggaacatcaatacgaactaatcagtacccccagaactccttggaactataccaccaatcaaagaaaacacatggtggaacttgtggctccagctatatatgtaccagaggatggcctagtaattcatcaatgggagaagaggctcttggtcctgtgaaggttctatgccccagtataggggaatgccaggaccaggaatgggagtgggtgggttggggagcaggtggagtggagcagggataggggattttaggaggggaaactaggaaaggcgataacatttgaaatgtaagtaaagaaaatacctaatttaaaaaaaaagaatacagtacagggattagagagggtgagttttagaagtattttattatagggaacttaggtgagaacaaaggcacagctcctgtacagcaggaggaatcctcaggagtgggatacagttgagctcactgccttggagataaggctttagtggacagaggaatggaagagtgaatgcaaaggtcagtccagttctcatgccagtaaaccagaccctttccaatgtctctagcctctggccatggcagaagcagagacattttcagtttaagacacatttgtatctcctttagcaggaatgaaatttctagcagacccaaggacatttctggcttttcctcaaaaaagaaactggtcacttttgaactgcttggccagtttctactacttgatgtcattagaaccatatgttagatttcagattttctgactaaggatattcatcctaaatatgaattgtcccattacaagcagttgtttgtgtttttatttttcaattaaaaacctaaccagcagagctagagagatagtcagcagttaagagcactatttcctctttcagagagctatagttcctagaattcaaaagggtggttcatatctactattgtctgtaactttaacttcaggggatcccacaccctctttccagcttcaatgggtccgagcttgtacatgtgcatgtgggtgtgcaactgtgtctgtgtgtgtgtgtgtgtgtgtgtgtgtgtttgcttgtgcgcgcaaacacactctacattcctaatagtttccaaaaagagttaattctaatatagtaggtttttttcctgatttcctacattctcagagtccccctcttcatatcatcataacatccccattcctctcagagactacagtccttagagttctttctttatctaagctttcctttctgccagtataaggacctcctttccaaatttctgtcctggtataatatctcataggatgagggaaggttgaattcctttctgaactgcctgaaacactgactgaccttttgtgtcttttcctttgccctatgttaaaacactttcactgatagtaaagactttctggaaaacccacgcttgaagagacaaatgtataaaaggttttggattctgtcatgtataataaatagtatcatctactgtgcctttggggctttactctatgtcaggtattctgttaccagtttgacttaaattgtggtattaaatcttcagaagaaccttctaaggtaagactacagatgaagaaacaaagtttcatagaaaccatgtagtttgcccaaatgctgcagacaatgcataacagagcatgaaattcatcccgaatccagatgcccctgccctcatactctgtgttctcacctgatgttcatcagttaaccttattttacatgaaaacaacatctaagtctgctgtcagtatggtagttactagtacaatatggccatttacatttcaactgagttaagtaattaaaaacgttaaaatttcacttatttgttgtactcaaactatgtactcattacacacaaatgggtagtggctactatagaggatatttctatcaccacagcttttctctggacaggactgatatagataattctaatcctaaactgatacaaccaatgaaacatgggggcaaatcctaaagaattctagcaagattaaacattttgctccttaaagtccatttttatgcctaaaagctgagtgagaattttgaataatccttgaatgctgtctctgaaaccatcattaattcaatcaatgctggtacacagtggtggctatgaagttacaactgactagtattcccagtaaatatacagctctgtaaagcatactgtccttatttgagctaaaaaattgccttcattataagtacttgctacataaatgtaaacatttcactaggaaaataattagctatcatagcagttctagatactggattttgtccaatttgactgctgtaatataaatactacaggctaggtagtgtctaaacaaaaattcattacaattctagagtctggggagctcaagggggaaaaaaatcttttattagctgataagagttcacttcctgtggccaactccatcacagtattgaaggggaaaaggtggttcccaggcctcttttttatgaaggcaattatcccataccatgtcctaattatctatccaaagccgtacttcctcatcctaccaattcaagggaggaggcataagcaaccagttcttggcaatacttatagtctaaactgtggatgttcacagaatttataggaccgatttacccattctttcaacgttaccaagaaaaaaacctaattctaattgttttcagtattatacagtatttaaaactaaagaaacaaaggatacaaaaatacttcactatgtggaggataaaatattatcttaatcttatcccattggctgtattatgaaactatttctaagataaaggctcaaatgtgagtacttagggggaaaacctattatctacatagtgaaatgcattggcattaccaatgcctggaatttcaacactgttttgtaaaaagcacaggtttactaaatcactcctatcttttacagaaaagaacaacagtagaaatagtaagaggaagaggaggagaaggaggaggaggaggagaagaagccctgtatattttcgttatatttgaaaaaaaatgctacataaaaggaatacttactatctggccagaaacagaagaactccaatgatttaatacactactgtattcaattagtactacttttctttcctcaaaggtaaaaggagaacatttaagtaggaaaagcgacaatgttttatagcttggatatctggtctttttttgtttgtttgtttgtttgtttgtttaatatactcagatgacaaatcagcaaacaccatagttatgttaatatggaaaaagaaaatggcaggtttcttctagtgagtaaaacagccagcccagtcctttccttatctctgtttctcctgaattaaagagctatgtgtgtcactttaattttttcaaaccttatttttaatgatggctcttgaaggcttcaacatcccttttagtccaccacccaccatcagcagttcagttcacaggttagcagaggcagcttcatccactagcaaatacttcagggatacaccaacagtccagtttggtagagtcagaatagcaaacaagaatcagcagtgatggtactacctagtattgtattgtgcccagattgcaaaacccccagagaccaccaggaaccactactctgatgcaagtatatgagagtctttattcaagcatgagctcaggccacaaaccttcctgatgcaagaggataggaaaagagactatgaggtctaggggaaagggaaatcccacaagtggggggtttccaagccttggcattaaatgattgggtaagaagttcatggagaccatctgctcattgattaactgctgctatggttttttaaatatttattttatttaaaaaattatttaaagatttacttatcttataggagtaaatatctttacttatatgagtaactatcttcaaacataccagaagaaggcatcagatcccattacaggtagttgtgagccaccatgtagttaggaattgaactcaagacctctgggatagcagtctctccagaccatagtaccctttcttaagtgcaggaaagaatgcagtaagactggtgactcccagggttgctaggaaacgttatccccttagttgaaaaaggaaggtagtaggaccggtaactcccatcagccactgctggccatacctgctccaccctgggacctcgatccctgaccaaacttttgcctctggcttctccctacatctctcactagcagagacagccaggcctcaacctcagcacaagtcagcacaagggaccagcaggaacactgggagaagttagctgtgtctctctcagggaagagaagctcagcaaagatacaagacccataaactttatacagctaactgtaccagcaagtcaaactctgtctccttcactctgtcgagtcatatttataccctccaaatatcatgcgtcctccacatgtctcgcctccgcatgtgtcttgcatctagccagcctgagtcctcagagtccagacaaatggagctcaactatgagatgtaaatcagactgatacatgtgtgttgttagcaaagaatccttcatctgtcctttcacatctttgccttagcagaacatcctctctcctgtgtctgcttcagtgaaccattccttcactagtttgccttgtctttcacctgtgtccacttcaggaaaacactccttctcgtgtttgccccagcaaacacattgtccaacacatttggctctccaaagaacccttaagtttccacttcaactatgagtagaaataataaaatgtcatgttgctaatgttttggggtcttgtttgggttcttttctcttccaaattagagaatgaaaaagcagagaaattcttaagtgtgacaattgtaaaagggaactctgaacatggcaaacaggaacagataaaaggagggggagcattttttctagggtaaaaaaaatacacataaagatcagatcttctttaaagtagagctagggctgaaagccaaagcccaatctcttcttgaggacaggggatactttaatggtttttgtggaggtctttctccagcaatttagagttggtcaaaggtttgaacaatgtgacaagtctgcaagtttggggtaataagactctggtctggccttgaacttgttagaccagtctgcatccagggtgccttactggtgcataataatcctgtaaggcctttgttttaagatgccagaatattgtctcagatccgaagtatgaagaaaagggcaggcatcttggaagtcaagcaactttattatctaatcattgcctttcccaactggctgtctatgaggggatctatctaactcatagtccttcaattttaaagaagcatatattctgatcctgctatgttggatggagattgattgaggtgatgtggaaataaagagaaacctttggaagggaagactcaggctgcaggtctgttgccctgtgatctcaaagtggtggaaatcaagggagttctgtgtattgatcttatcaaaaggttccaagatcctaagaccccaaagatgttatcaaatcaagttaaaattcctgttcctattttcccagcccatctgagacttttaggccattaaccattcaccctatattggaattcttctcagtaataataggtattcttttttatattatatttatttttattttatgtacacaggtgtgagggtgtcatatgccctggaactagagttgcagacaattgtgagctgccatttggatgctgggaattgaacctgggtcctataagaagagcagccagtgctctgaaccactgagccatctctccagcccagaaataataggattttttttaaaagaaatgatttgcattgcaatgaaaaaatatctaccagggaagagagtagattgatgatctttcaaagttttatgtatccctgagataaaatgggcattataccaattgtcagcactctaagttgtattgtctgttttgagtactatgtaaaagtccaaaaatatgcttgagcatgctcatacttccagccttattaaataataataataataataataagtattttatataggcatattagttatagcattgatttgaagaaactaaggtatttggggtagaaggagacagttaaatggagaattttagttcaggaagcttggtactttgatgagtaggtagagtagatcaaatctatattttgaaagataagatctgactgtaatagtcagttctgatgtcatttgtaaggctttaacaaagtcttctgtaaaagcaatttaagccttatttatacgtaagtcctacacacgatttatggctattgattaatggtaagtactaggttgctcccactccttcaaatggcaggtgcttacctacgtttgaacacaggatttctagcaaagagataaaagccagcagtgtgagactgctatcttctctgcttcctgaaaggtagccatgggaactttggacacctccaaatgtctctacctattttatctctaccatgtgatagccacaggatagtttcatatttacaatgaaattttcttctttacacccatgtagccatgcactttgatgttttcactgtgttgttgcttccagtaagcacttagtgttttagaagactacctaatggaaaagctaaatttggtaacattatcatctgcttcatttaagagataaagccgagggaattgaaatcaagcgtacatttgagcttggtggggtaatacatgcatttaaccagagcactcttttgagtttgaggttagcctggtctatatactgagttctgatttccagcccagttagggttctacagttagactcctatctcaaaaaaagttggtggggaggcaaaagtaaaagtatttgaaacaaatgacagtggcatccaggaaatgtttataggtcaaactccagtcccaaatattctcatttttattttctgctctagatattgttaatttgcacagtgttgacaatgaagccttatctaatcattattgccagtaaaatgaaattctgtatgtaagcttacattgacttgagctagaaatctgccttgggtatttgaatttaattttaatttgaaaataattttaagcaggggttaaaagcaacaacagtgtttctgcccaacttttagttaggcaatttaattatttgcagtgtcctagtccccaaatggaccagttaatgaggatttcactgagctttctttaaactgtctaggaagttaattaattggagcaagtgaattgtttggtcaggctagatgtatacactgatgtaactacttggattttattgctttgtttagtaaggagcaaaagtgcaggaacagtgacatagatgaatatgtttggctaaacaataagtatagctggtggtgatagtcagatttgtgaattgagaattcctgggtttgcacaaactgatttgactgattacaactcttatgatgaggagtggttggaatgttgtaggccctgagcctaatgagctggtcttgggctaactttagccctcggaataggcaggcgttctttacccatctctggttggaattaatatcctgtgactaatagataaaaacatttcaaaatttattagcaaaatagactactagctcctaccaactcaaagctgaggacacgaagtctgtaggacagattcctccatcattctgtaaccacctttatgatatacccaccaataaatctatgactttgttgtacagctagtatacaacttcataaaactgttttgacataagaacatgctacctgggtaattaagctccctgtttccttggccttggttactcaaatttggctccagaataaataactcatatagttttggacaagagctgtgcattttttatttgttgtttggttttgcttttgtttgtttgtttgtttgtttgtcctaacagactttaataaattcctgcatatatcctaattatacagggtcccagctggggtggtttgaatgagattggccttactggctcatatatttgaatggttggtttctagttggggaactgctgggaaggattagtaggtatggccttgttggaggaggtgtgacactggaggtaggattttatgtttcaaaagcccatgtctctttctgcctgtagcctatagctgtgctgttctcagctacttatccagcaccatgtctactttcttgagtgcatgtttcgtaccaatttaatgtactaatcctctgaaactttaagcaagcccctaattcaatgcttcctttttataagagttgccttgatcatggtatcttttcacagcaatagaactgttactaagataccagctaacccaaaaagtgttcctgtggatttttttttccattttttattaggtatttaactcatttacatttccaatgctataccaaaagtcccccatatccacccacccccactcccctgcccactcactccccctttttggccctggtattcccctgtactggggcatataaagtttgcaagttcctgtggatttttttaaacccatttctaccaagagctatgagtcgacattttttgtacttgtccttatttcttatgatactgttaaggctaagcaacagcttagcttcttctatgtagcatgtttgtcttgtattgaaagaaatagcaggatcagccccatggcaggaaatcatctgatgttcaacattccatatctacctcatctggcacatacttttttctcagaaagtacaaatgagtaaatgatgaattagttttttgatttatagattattttagtagctatattttttaaggttagctttgcagtcatcaagaattcagagttccttaagatttagccatgatgaaatagaatgtcaactgactgtatctcaagtttaacctctccctctttctgttaatagagagaactgattgatgatagttcttataaagactcaattttgtagtgtgaatatattagagaaggtgtcctaatcacaggatcttgatcaggttcattttctctgctaggtaaggaattaaaaggcttaaaaagaactcaagtgtaacaggtagcagaatggaaagactccgagagatcagccactgacagagtcaaccagtgaacaaaggcgtttattaggggtgaggacacaaacacacacatacacagatacgcaacaaagcacacagaaagaccccctgcaaagcaaagaagggactttgaaagcacaagtccaacctctcccaatgggctgggaattttaagggtctttgagtggtcttcttcccctgatttagggttgattactttgaacacaggcaggaagtttgacaggtctataacatttataacaagccttgaacttgatgagtgggtctttcagcagggaatcctttctgggggcagaaaaattttaggcctttaggccattgtttgaggtcaggagtttgaggagtgcatagaagtttgccatctttattaactaattgttgctcatttccccatctgtctgcttaccagagatctaattcctagtcctccaaagggaatttacaaatttaagtagactcattttttattatttatttttctccagcaaaaagaaaaagtacagtttggagtctgtcagcttccaaagtaacctgtacaaatctcactcagaatctgtggctcctcccagcacttctcatgatgctaaacttctcaagtccagggtttgggcttcccttgctctagcttggaatttttttatatatataacttagccactttggctacatgctgtctttgctttctccaccctcttttgtctcctcctctctcttttttttaacatttaaaaattttttttagattttttttcatttatttcatgtatgtgggtacattgttgctatcttcagacacaccagaagagggcatcagattctccattacagatggctgtgagccaccatgtggtacctgggaattgagctcaggaactctagaagaacagtcagtgctcttaaccactgagccatctctccagtcctctccctctctattcttcctttttctttctccctgtctctctctcctcatggcctggtctattctactgtccacattcagtttggactctttcagatcctctgcctttttttcctctcacatttatgataaaacccttctcctcagaaatacctaggagcagccatgctcatgttttcattcagagttaattcagatgatgaacttgacaaactgaaggtgtgcatatagaaataaaaagttgacacattaagtaaattaattttctcttaactagaaacataagtcagcaccagtaaagcagcatccaagtcagttttattgatcaatgtcaaatattttaaaaaggataactgtataggcagttttcagccaaattccttcaaatcttaaaagtgcaagaggatgatcgagggcattttgtctcttagtaggagacttacaactaatagtaaaatgtttgtaaattattcacaaacatttatcaaaagccatatgccacagagataaatctaagtatatattcaaagggacatcctttgtgatgtactataactagccattttggtcaagtgctatcttggcttgctcttggttcttggtcttcttttgtctccctctctcttctcttctcttctcttctcttctcttctcttctcttctcttctcttctcttcctttctctcttcctggctctctcatcatgacctgatctattctgctggccaaaacacgacatgctatacaagtaggtgtagattaagggataaagggtggggtagattctctgtaggaagtcgaatatatagtaatggatggaatgtggaactggaataaaagaatcaatcagggaggtgaaaagaagaggggatgagggatggaatataagggccatttgatgggtggtattgaaacctaatgcactagaagcttcctaaaattatatacatatatgtagctctaaatcaaatagcagggttgatagtcttaactggccatttgtcaacaaatgaagcctccagttctgggaatgggttatatctaattgactaccaggccaagggggtcccacaggaacctccaaacaacccaacctactgctaaggctattggttgtttaccatgtactgatggtaaggtcctattgctgaagacagcacctacacaactttttgaacacgaacatggagaagttgagctggtgtctacctagaatccttcacttctaatgactagtgttcatggtactcacaggtactctctatgctaccaaaggataaagtcaattaccaatctatccacaaacactgtgatctacattggtaacctgcctgcaaaatgtgctagtacaacagtggcacaaagcttatggaaatatctgattgattttaaggcccactccatgagatagaacccaccacaaataattcactggtagcctagcataaaaccgaatactactgttctgctaaaggaacataccaataaaatggctcttaaagacattgtcctgtagtcataaatcactgtatttcttagccattagagaagcattctcctgtgagaatcaatacagagacccacagttggacagtgtgcagagagacctaggaaaaatcagccctaaatagtttgtcttcatcaaaatccctcctctcagggctcagagtaccttgtggaacaagagtcagaaaaacagtaagagccagagaggatgaacaccaaggaaataggccttctaaaaacagcaagacccatgtacatgtaaactcacagagacttgcacagtaccagcttgggtctgggccagatgggttgccagtattgagaaatcataaggccccatccctaacccagaagccatcttcaactgataacttctagcaaatgtacaattacttttctctaacatattctcacaaaccactctttaagggaagacctcaagcccagcagcagatgacaaacacaaaatgaactcaatggtaattttggaggttctttgtctggacacttaaaaaaaacttactgttgttttgcgtattttctatgttttttgtttgtttttgtttttatgtgatttctgtgttgggtaattaattatggatgggggtatgtgtgtatgtatggtatatatatatatatatatatatatatatatatgtgtgtgtgtgtgtgtgtgtgtgtgctttttctttggctctttcttctgtttgctttgttctatttcaatctgtttttgttttatcatattatacttagatcccaggttttttcctaaggagagagacagagacagggaggagagagacagagatgcaaaaactcacacacacacacacacacacacacacacacacacacacagagagagagagagagagagagagagagagagagagagagagagagaaggagagagatgggtggatggaacagaggttccatttgggaggatgtgggatgaattggggaaggagaagttataattagatatattgtaagaaatatgttttcaattgaagaaaaatagaaaaatatatacacaagaaagtgtaggcataaactccttgtaacctacttttaataaatgttcatgttcaacctcttctctttcccactacctaccagaagttgtggaagagaaaaagtattagggtatggagaaagaggacatgtttagcaatagttctttgggagtgagcttggtcttccttagcaacagttcattccagtcacaaacaccaaatacaactcagtagctacagtctagtcctctctgcaggcagataccttacatgaaccagcagctgtagttcaatcctgaagaaactgcatccttgcgaaggagaggctgtggaaagcagtaagctgctacaggaactttatgagaagttctttagtgagtttctcttaggtgtaaccactagaagagctcaacaatgctatgtaaagtataccaatacatgcatgtcattagtgaagaatagggaagcagggcaaaccaatgttcaatgtttgtctctcactgtctgtggagtcatattaatactccttcattacatgtcctttcccatgtttgctatatcaaacatcttttcacctgtgtctactccagcaaaacatctgttcacctatgtctgcttcaagaaaacatctttcacttgtctgctttagcaaaacattatttcatctgtgtgccccagcaaaacatcatttgacataactgactttccaaagaaactagaacattccacttcaagaaagtatggctatgatctaataatactttatatatacaaaaacaaaaattgagatgccaaaagtatgattgttggaagaatttgtttgattcaatattaagagaagcataaatctcatttcaacagcagctacaacattgatcattcccttcatgataagcaatggttaatgtgcaagattaactactttttaaaatcattttaaaaattagtatatatttgttgtaaaaagtagtgacattcattgtgacattttcatacatatacattgattatatttacacatacacacacactcacaagtcaggttcattttctagcacattttcatgcagatctatatggatgtcatagtttcatctttggtttttatatcaaaatatcagggccttgtttacctttgttatatagttccatagaccactgcaaccaaatgttgagaaactctccaattattttagagaaaatgttggatagtaaagagttttgtcttctctgcaaaacattttggatctacctgctctaaatagctgccacacacctgtgaagtgtctgtgccactcccctatcagccagttgccttagtctcaaagtgaaggggcgtgattgagcatctaaaatctgcaggtctgtatactgctgctgctgacaaaaagaactcattttaaaattatttaatagactgtatattttatgttatatagttttctgaacacaaagttatcaagataaaatagccacttgaatatcataattacacttgatcaaaaaaaatggagcaaacccaaaatttactggtaacggaagactatgagggttttatgccacacatgaaaattttttctttggtttctatttttacataaattaaaggttctctgatatgttttgttaaatactcacaattacaaaaatgtcctttgggcgagttgagagctggtttcatttttttttattagatattttctttatttgcattgcaaatgttatcccttttcctagtttcttctctgaaaatcccctatcccctccccctgctccccaacccacccactcccattcctgatcctggaattcccctgtactggggcatagagccttcacaggaccaagggcctctcctcccattgatgcctgacaagactagcctctgctacatatgctacataggctgaaaatcatggagaaaaatcggtatggatgtgtgcaaattacgttgaaaatttcaaaatgcatgttctcagtgctcaatacgtagcagctctcagttcacaaaaatgctgatttccagttatattctctttttccttttcttttcctttgttcctttctctctctctctctctttctttctttctttctttctttctttctttctttctttctttctctttcttcctctcgttcttttgttctttttttttctttgttctttttgtttgtttgcaatttttgaaaaagagtttctctgtagccctgactgtcctggaactcacaaagctggtatcaagcccagagatccacctgtctctgattcccaagtgctgggataaaaggcacgtgccaccctgtcctggcttcctattgcaatcttactgatgtttaaaggatcagctttctaactgtggttttttgtttgtttgtttgtttttgttgttttttaacgtaatttgatatttgcaagatgacattgttttaggcagggtttgtgctaagatctacaatcaaatttgaaatttagctgctggggtggggtgggtggactacttctgtataagtactccaacccactttctcttcctctaccctgccccccacccccacagtctgcctttcccaaatctgagcagatatttgaggtcatttgcagattaggcttgggtttagcaaagctaaatgggagtatagcagaacacgaaagtccctggtgctaggagaggtgagaaatgcagccaaggggttctctgtgaatgaactgaactggaggcggtgctgtcacattggcaccgaatcccaaaaggctttcaattgttttacaacatcagtgcaagcccttccttttctatcctcactcttggaattcagtttcttcttcattgctttccccaaagttgtcagtgagacaattgcattttgtctggtcccagagcacatcttaatcagttttcccagctattcttcctcctaccctcatatccaacattattgcctattagttttaatttctttacaaccacaagtacgctttgtgtcctgaataaaatcttttatgttcttacataacaactagtggtaacaactaaatgtaaatgaatcttaggtatacttgctgacattttgactgacaaatctgacagctgtgagggagagaaaactagatttttgtcagttacaaaactgtccttaccaaccagctcaatgaaaacatatttttgattggtgtctcagaattgtgaagctcagcatgggcctacataaatttaacaaatattaaaatggcttgtgggaatagtgttcagattcccagttaaatgtatgttatcataattaataattgtgttgggtagccactcttttattcctatatccctctctttctcctatatgttccattttaacttacttgtattacatttgcttttgttcatagaaagcaacatagcggagactgttaaagttagcaccaggaatatttcactgttaaacacagtgatctttcttttcaagctaaggcagagggctcattgtaattccaaatgatatgttggattgctcccttcttaaaaaaatcgacatggtaatgataccaagttaatgtgccatttctttaaatgtagtctagaagtggtatccgaaggatgctttgagaattttgcccaggaaatgggctgcgtgaatggaaaaacaggatactttttgtaagttcagatttcaaagacccatagagtgttaaaaaaaatgtcttgtattatcactagtatagagcacttattcttaatgaggcctgtctaggaaacttccaaatgctggcaaattacatagagatatagacccatatactgaagttacatctccttatcagaccagtcagagttttggaatgagataaatattaaggaccactggagaatctgcattttaaaatatcctgtagggccctctgaggtatagaagagatggagcatccccctgaccaggaacttgagtctgaagttgcatcccctgtaagttacttttgtgtagcaaatttacatagaactatttgccaggatctattccaagtgctttgtagtattcatttaatcatcataacaaccctatgaaatagtaactatatcaccagaggaaagaggatgcatagctttccccggaccaattattcttctatggttaagtaaaaacacacaaaatatctcatagaaatatattgactaggggctgtagatatgacatagatgtagctatgacatagatttttaacagtaattgctgctcttgcagaggatctaggtttcgttctcaacacctgagttgagctaataattatcacaacagttccagggggtcccatgcttcctttggggttcacaggcacacatgtgatacccatacatacatgtacgcaaaacactcatgcatacactgtaagataactaaatcatttaaaaaagaaatacattgtctatttcttaagattttttttgtgggggggggcatggcaaaccttattagttaatccaggtagactctggttattctgccctagcctcacaatactgaaatcatagctattaccctgactattcttaatgtaaacatggagaaataggtgcagatggtgaggaactgtggcattaaccaaaagtgagagaaagtaccttgatctttttaaatgactaatacaaaacaaatggatcactattcttctcaaagtgtgcccaactgagttgaatagttgaagatttggctctctattaaagttaggagagagtagaacaacaaacaaacataatatgcaaatatttattccggtccttaaatatctgtttgcaagcttccttctctctctctctctctctctctctctctctctctctctctctctctctccctctctctctctcgttatttctttcttccttttacaagtcaagaattttttttcctcaagaaaatatcattaacttgtcgttttgttaaaaaaaaatgtattacaacggatcatgtttaggtcaggtctgatatactatcccatgtttgtcctttgtttgtttgtttgtcctttaccccttgctcgcttttttctttagaatacttatttacatttcaaatgttatcctctttcccggtttctcctcaggataacccctatcccatcctccctctccctgtttcgatgagggtgctacaccatcgatccactcaatcccgcctccttgccctggcattcccctacactggaacatcaagccaccacaggaccaagagcctctcctcccattgatgtccaagaaggccatcctctgctacagatgtggctggagccatgggaccctccatgtgtactctctggttggtggtttagtccctgagatctctggggaggtctggttggttgatactgttgttcttgctatgcgttgcaaaccccttcagttcctttctctaactcctccattggggactccatgcccagtccaatggttgactgtgagcatcttcctctgtatttgtcaggctcttgcagagcctctcaagagacagctatatcaggctcttgtcagcaagcacttcttgacatccacaatagtgtcttgagtttggtgtatgtatatggaatggatctccacgtagtagagtctctggatgtcctctccttcagtctctcctccacactttgtcttcgtatttcctctattgaatattttgttcccatttctaagaaaggctgaagcatccacactttggtcttccttcttcttgggtttcatgtggtccgtaagttgtattatgggtattccaagcttttgggctaatatccacttatcatcgagtgcataccttgtgtgttcttttgtgactgcgttacctcactcaggatgatactttctagttccatctgtttgcctgtgagtttcatgaagtcattgtttttaattgctgaatagtattctactgtgtaaatataccacattttctgtatccattcctctgttgagggatatctgggttctttccagcttctggttactataaataagcctgctatgaacatagtggagcatgtgtccttattatatgctggaacatcttttgggtatatgcccaggagtcatataactaggtcctcaggtagtactctgtccaattttctgatgaaactacagactgatttccagagtagttataccaatgctgaacttttaaattcttttaaataaactccacggatatcgattatagtattacttacttgcaaatctattaactggaataacagaaatcagtccacagattcagtcttctgtgtatgaacccatactacaaagctggcctttcagaggctttcttagtcacattaaaccagagaataattttactaatctagtcttagccctgagagtttatagctctgttatccctttaagagcctcagtttatctgtctgtcaaatggatgggttttccctatatgatctttcaaagatctctcttctggcatccacattctacagttctgttgagaattattgtggcaggaagttatcagcttctgcttcttctcagtattaatttgttcctccctacctcctgggatctgtaagtgagcattgattagaaagaagtcagtgctctgtggtggacagctgccttctcttacctagcagaaatgaatctgtcaagtctcattaagtgttgtcaggtagtattatgctcactgatagattgcactagaagtagtatcaggttgacattcaattatatcagtgttctaaagaagtagtgtattctatttttctttaaagcattgagaagtagcgatgcagcaaaccatgtaaactggttgattggatgcaagggttaattgctcccatgcattctaaatgtgtttgagggttttgaaattatatctggttttaccacctacagctgtgtcttttaattttttgtcaaaatagaattaagaaaaggttttcagaagacctcaatttggcctttagactttggcctttgtgcttttgttcaacttgtttcccaaggtgacacaagatgataagaacttcttgctaaggaaaatgtcccaagaaggaggagattgagaggcttagttagaaggtggaatggggcttcctttaattaccctaatcttttaaagaatgatattattattattatctgagaacagagacggcattgagacacaaacacagagggactgaaaatgtactaaggcatggttaaagaatcagatatctgtttaataattatgagcatttgaatatttaaacatatccaatttgatacagttacatttctctatactctgcaaaccttcattaaatttcgttatggagattctgtgtgaagttattgattcctattgtttgacatagaaaactattcatgctgtattggtaaataaaagaggcaagctacaggaaaagtcttaatctgatcctgtcaaaagaatgtatttattatagtttatacaaagatatgagagtaccgtggtatacagaatgggggtctgataattctacatgacccattatccattacatttctttattatttcatttctataaaagagctagagtacttttctatcagatcaaagcaaaataaaaacattaaccattaaatgaattgagggaaatttgaagactttgaggtattttgtttttcttctaaaaggaattgtctgaattgtcagagtcttttcattatcagcttttctccttaatctaaaagttaaaagctattattcttattagaattgattttctgttccttgctttacttcatctgactttttgatgaggaaccattgaataattcaagacattgtctctaaggtttaaaaaaagacaggaatgccagcccagctcttcaggccaacactgggtaggaagggctcagtatagattattttgctgagcactcagtggctttatggcattcttttctattgcctgatattttaaaagttgttctaaatttggcatggaaacatagtgacatgtgtaagagtctattctgcctacctcaggataggtcttcactgatgttccttattaacttggtataaaataacaacatcaactcatccaccactaccccaaacaaatcccctttgtaattaatcctttgtttagaaacaggtatttgtcatgtgccatatactgtggaaattgcaaaggaccaacacccttgagtgaacatactctatccagaagaacatgcaccctacccttttggcttttatagtaaggttagaagtcctagaccttgggctgcaaaaatgattcaccattgataaacacgtgatcttcagagtacctaaatcagttcccagccctaatattggtcaaaaccacctataacagcttcagggtattcaatgccctctcccacctctgtggacatccatacacagttgcatacactcacaaacatatacagatatacacataaataaaaataaatctaaaaaaatatatcctaaatatttctaattctagaatttttctagacttttaaaaaattaaaattcatacttattaaattactccataaaatagaaaaggaaacagtgcattcaaattttatttatgataacaacaaaacactaacacctatatcttatgtaaacatgataaatgaaaactataagcctatcttccactgaacataaattcaaaaacatcccaataaaatacttacaaagtatattcaagaacatcaaaaaaatatttctgagtttgaggccagcctggtctacaaaatgagttccaggacaatacagagaagccctgtctcaaacaaacaaacaaacaaacaaacaaacaaacaaacaaacaaaatcatttatcattatcaacttagcatcattccaggaatgcaggaatgtttcaatgtatgcaaactgataaatgtaattcaccatatacatgaactcaaggataaggaaaattaggggatcatttcacttgatgctgtaaagacctttgacaaaatcccaacatccattcataataaatttctggagatatcaaaagtagtgatttgaataggtttggccaccatagactcatgtgtttgaatgcttggcccacagagagtaacactatttagtagatgtgtccttgttaaaataggtttggccttgttggaagaagtgtgtcaccatggggatgggctttgaggtcctatgctcaagttctacctagtgtggagtcgagacactcttcttagctgtcttcagatcaaggtgtattctcagcttcttctccagcatcatgtctgcctagatgctgccatgtttcctgccatgacaatactgacaaaaccactgaaactgtaaaccagccccaatcaaatgttttatcttataaatgtttctttggtcattgtgtcttttcacaataatataaccctaactaaaacactagagatggatgtaatacatcccaatataataaaggctatgtataagaaaaatgatagctaccaccatattaagttggggataacctacagcatttccaaaaggatatttacttttaccagttctatttagttcagtgcttgaagtcctagttagagaagtattataagggaaaaaataaaaggaatacaaataaaaatggaagaagataaattagtccttttttggagaagttggttctatatatatgacaaatgccaaacattggactaggaaactctgttattggataaatgctttcagcaaaatgacaggttacaaaattatcataattaaaccagtatccttcctatatcccaaagacaagggatagatgaagaagccagggcgacagtcctattctcaataacctcaaaaataccttggaaacacaatccagtaagaacctgttattaggagaaacctttgatattgttactggccagtaaaccaattgaagtaaattgaaccttcttgatcacactttgtctgcacagactttttactaatgaaaggcagtctgtataattactatgtgaaaagacaaggaggatttttctctctgggacctaagtttgatagtccagtgtccagtgttggtttgagtcccagttccaagcacactactgatatgagcttgggaaagtcatctaccatcttctttttttttttttttttttagtgtccttgtctatacaatggggaaaataatagtgttggccttcttgcattgtaatgattcagtagaaagtgcattagactaaccacaaagtcagtagacaactgctgctgctgctgctgctatagcttccatgaacagcagcctccacagtgactcaaccaccactatttatcaagaaaggcagcttgtgggtggcttttgtcttgacctcaactatgcaacctcctagaaaatagaatagttttccaaacctgggtagctcagagggctcctttgtttaagcagggataatgataatcctttgtccatgaatgcagtgcatattatttagaaactcatactaaatttctggcataatgagttgatatagacctgtccacaggaaagtgtttgtttataatcactacctgtactggagatagtgtctttgatgttctgggattgttctaattttagatctcaggggaaatccagtttctctactggaccttttcttgcatataacctcactcccaattacatggtgtcttgtagcattggcagaacactacaacaatatggaagcttatatccatgagattcaaactctgatttgtttttggtgttcttgattttctcttagcttcctcacctctggaagaaatgaaggcacttctatttatgtggtttatgaacactgcatggcttagttagagtgatgtattgttgaggcacatttgaaccacatgtgtatgaaatatactacacaaatgactttataatctactggaaatgtcagaatctttcaaaggaagtcattaaatgctaaaataataaaattcttccagaaaataatgcagtgtaaatcattgtatcacgtgaaatagtccgtcactattagtgtctggtaattgtgagcaagactaagctgaattttttttattggttattttatttattttcatccctttcccctgcttctatgagggtgctctctcatccaaccacccactccagtctcactgccctagcattcccttacactggagcatttgagtctccacaggaccaagggcctcccctccaattcatgccagacaagaccatcctctgctatatatacagctggagacatgggtccctttatgtgtactctttggttggtggtttagttcctgggagctctggggtgtctggttggttgatattgttgcaaaccccttccaagctgaatttctgatgaatctaaaagtggaagatgtggaaaatggtgttgagcacttagtgatgagtaagactcatgctgggcctgctttaatgaacgataacattcatttgtaattgtaatcactataataatgggatggaattaaagtatttgaaagcacagttcagtctattaactagtttgaatattcttccagtatttctgtttataacattaatttgcttaacaaagcctttttcatagataatgcaaggccaacttaagcccagcctgtgtctacatgatcacagcacttcagtttataagggccacattaatttacaatggtaacaaagtgagaaagaacaaagcatagagcaggctgtgaactatgttgtcttattttgtttctttgctttgttttcctcctatcacaaatttcacctttactgctgctctacatgtgatattaggattagaacagttcctgggaaacaatcaatgctaaatgtgtgtttttaaatagagacctacttactgaagctggttactcttcaatgaatgtaacatcagtaacataagaagataatacagaaatgttaaattttattgctaatcttaaatcttgctttagggaggagaaaaaccttaatactattgcaaaagagtcaagtcacactagattaacattggtatacattaataatgaaaatagctgagcccgattagtgtcacttaaagttttgtgaatcacagatatggccttacaaattaaacagcttgaataccagataaagagtctaggcgaataatgattatttttaaaagttaaaaccttcacatttctcctaaaggaaaatttatcactggtgtacaacagagtactattcactctagagtgtgaaaagaatgggtctttgctaaccataaaaagtgtaataaagaagccactaaaattgattttcatttaagtagattacgagtggtttttccttaactggaaagcatattttgttcttcttcagactatttttagccgctatactatttatataagtatggttattatatgctccacttagggatatttcaatgttccatattatcttcaccatcaactccaaaacatttgccaatttaataggaagagaaaactatagaaataagtgtgtaaacgattttcaaaagtgtacacatagaccaagttgtgagataaacaaaatgattaggtctctgttgtgctgattctcagtatgtgttgccctctgtaattttttcctaccttaatatgcccagtggcctcctctgtagccaagaaccttttggttcaatagcccaaacaggcataagcttctgtttcccatctgcttttccatcttctactctgtctccagaaaatttactgtcctcagtccattttatcagacccttgctatctttcaagagtgtttttagtagtagtaatgacagtaggaggaatcataatataacaatgaaaacaatagccagtgttgagtataatcactgttttattatgctctaggcactctgtaagcattttacatccagcactttatttaatcctcactttacacaagatgaaattgaggcttagaaagattaattgtcttgtctaaggtcccgtagtgaataaaaggactcaatttgtttgtttaattccaaaggctaggcttttaaccactacaattctacaactctatgctgcttttttagttgtaggaaaagtaataagagttaatatcccagaaagtatttttaaagttttttcaaaaggcaaagtgtttttttctacccaatcatttatagttcttattagacttatctggacatcttgagttggcaaggaaggagggagaatgaccacaggagttgaataagcaaggttataatgatacacatgtgtgaaaatttcatatcagaatccattattttgtaaatgaaaataaagtaagaatctgtatatggcagattctgttaacccagaattcaggggatggagctatgaggatctacctgagtttgaagttcatgtggtccacactgagaatagcattccaggctagccagcttaatagtgagagaccctgtctcaaaaaaggaggaaagaaacaaaaaatgagatcaaagaaaagtagaaaaaaaaaagaaataacaatcaattcttggtccaaaatatatagcttgaattttcaagtagacaaccttataagctgtccctttgtcaagtcacaggacaatcaatatagagatgctacaaaactgattgtctctatctctatctctacatctatatccacatctatatatctatatatctatatatctacatctatacatatatctatatctatatctatatctatatctatctatctatctatctatctatctatctatctatctatctatctattgtttctatccattcacaaaaatcctaataacatataatcagggtagaagggcttgtttcactcaacagaggtaatgtcacttctcataagaagtacgaatggccaataagtagattagaaatgcttgatatcctaagctactaggaaaatgtaagtcaatactgccttgggattcaatgtcactgtcagaatggttaccaagaaaatacaaattatggtaagaatgcagaagaaaaatagctcttatacatatttggtgcaaatgtaaaatgatacagtcactgtgggagtcattatggatgtttctttaaaaaaaaaaaggaaagaaggatctacaattagaactattatatcaaccagttataccacatctaagtgtatacttaatggaatcaaagtcaccatccaataagtatactgcaaatccatttcatttttattgtgatactattcacagtagccaagtatggactcaacctatatcttcatcaatagttgaatccataatgataatgtagtccatatatgcaatagaatcttactcaccagtaaataagactgaagttttatttgctggaaaaatgggtggaactatagattatcattttaaggcaaccacggtagactctaaaacatccatatcatatatacaaacagtaacaaaacaagattgagtgaaactagagagggactactagcaactggggccatggatatgaggaggaataagataacagaaggtaagagagatcataggagagagtagatgtgatgaatatacaataaatgtatgtattgaaatgtcacaatagtgactcatgtgagaaagaaatgcttcagttcacttttttttaaatgacaaatttaaagcactttttaattaacattcatcgggggatatgtaggcttagatttttcaaaacctacttttaataggggttcacaaatgctttaacctcctttctatcccactacccaccagaagtagtagaaaggaaaagttcatgaagcaaaggaggatgtggacctgtttagaaatagttctttggagcaaatctaatctgcagtatcgggatagcagctgttcagctcacatgaatctgcagcagtagctcaatccactcccaaacaccattcacaaatcagcaatggcaggtcagtccagcagaaactgcaaggttctaccaatcagacagagtccaaggaagtagcaagaagctgctggaataccaccagaagttttttgatgcatttttctctatgaaaccatgaaaaacattggccaggaaagattggtaagtcataccaataccatccatcatcgtcagagtgaccagtgtcagcaaagcccaaggatgaccagcaaaaatggtaaggtgtactaataccatccagtgtcatcaaagattgctaagacataccaataccatccagcatcatcagagaagaccagtgtcagcaaagcccaaggatgatcagcacagaatggaaggtatgccaataccatccagtgtcatccattatctgttgggttatatttatatctctttcaaacatcatgtgttctctcaagcatctactctagcatctttttccaggcaacttccagaaaaacaccacatgtctgttcccaacaaaacatctttacacatgtctgcttcagcaaaaacattctctcataagacaatttccagaaaaacatcacatgacacaacggagtctacaaagaaaccagaaatttccacttcggggataggacatagatgtcacaaaactcctgtggaggctagaggactatttgtgggaatcagttctctcctcctgtcatgtagaaggatttcaggttgtgaggcctggtgataagtgcatttaccccactaagctatcttactagggcaagatggcacattttatacagtacataatataaaaggaataaatatcatatgatgacttgctcaaattatggcctgtggagcaaaaatagaattaaaggctcatcttatacccgtggagtcaggatctggcattttcaacaaggctccaggtagtctctacacatagtttgaaagaaagcctggctgtgctggacttattagaagatgctgtcatttagctctccatcatttgtacctgtcttcctccgtttccctctggaagctgccattgactaaatagcctcatgcttcatgaaagctgaattaatcaccattgtgataatatactaactggtcagtggcatgtgggtaggtggccatgttgtttaaatctaggtacagaaactaagggacgatgatatccatttcaaatcactcaaggagaaatggagtctccttcctttggatgtttacacactgagaaagaatcagagaaaattctgtcagcattttggaatatggaggatagctatcctggacttgataagatagacacatccattgacaaacaccccagtccacatcatcaggagtgcttccaatcatatgagattagaactggatctactgttgaaaatgtttgaatcaatcaggattttctagtatagcccagggatctctaacctcaccactattgacatttagtgctgaatagacatagtaggtctcagagtttacctggacttctaaagcctactacatatataaatctgctggtttctttatagctcagtggataggtgaacaatataaatttaggaaatccttaagatgaatagggcattgtttcatgtatgaggattctctagtcttaagactatatatactatgaaatatcagttgctactctcctcatttcccaaaccagtactttttgcgagtgcagtctatgttcttaccaatttcaactgctattcctaatatgtcatgtctgactccggctctctgaatataaaaataatgtcatagtgaattacttttcctccgattttattgatcttaaaaaaatcattaatacatttcagaacacaatgaaacttggatgatgctttaaaaccatatatcctacttttatttattttttgagaattttcttaatatatacaatatatttcaataagatttacctcttttccttactaactcaagatcaccctggatgtcctccttccaaaattatgctctttacatttctttttaattataattgagagctcagtttgtgctggctatgagtacagggataggaccatcctctgaagcatggtctatctgccagagatcacacccttgaaggaaattgactcaccattccccagcatgtcaacagctgctcgtctaggggtgggaattatgagtcacttccctttccatgctctatgttagctggcttaatcttgtgcaggtgttatgcagggaactcattgatatgagttcatgagtagagtgatcctgtcatgtccagaagacactgttacagtctagtcctccccaacctctgactcttagtctttctcctttatgttcagcaatgcattgattacacaaaattatttgttttagaactacaggtcatttcaagataaaaatatcacacctttaaacaccttgtgttagtgacataaagtgagagttcttgccttcccactctgaccatactcaaatttctttcctaattagaagagtccttcattacaaaggggtttatttatgattcattgtaaatatagcctagtttcataaagaaacttaccaatgatttctccacgagtgaccattgatgctaatgctttctggttcctctctctttttttcccttcttcttttataaatttgctagaaaagaacctgaatgaagtccacatatatgagaattgacttagaacaagaaaaagacaaatcattggataatagacataagattaaccaatcattttagtttgaccagggttgtaggaataccaccccaaatcctgtatccaggaaaatgccttagactaaggttagcatggctgtctagttatctactagatgtatacttaggcaaaaggtacattaaaatactagtcatttaaagtgaatctcatgttctatttgtaatatttaattataataatgtctgttattcaaagtatgagattttaatgtggcattttgacatatacatgttcaatttttctttcctagtagaagggaataatagcactattaaaatcatatacagttttttatatgactctatctctaaatatcagtattgcacataaagcagtcactcttgcttattgaattaatatattaataattctataactgttattgtcttctattttctgtccataatggagatattaattatatccaaaagttgtgaaggattaagaaatgtgtatgtgaaagggattatgctataaccaatacataaaagatcaatgataataatgattgcatgtaatgtatgataatatcttttttattgatttccttacgacttcttagctcatttaaggctttatttaagtctgtgcttatacactgctcatcaaaagggctaattgcgagattaaaggtgaaatttcaagattataatcacctctgacataagctgcaagtttatattacagtgtacattatttatatatatggctatctaagacccctaggcaaacaaaatttttttgctagtatgtgaaggcaaaaggctgtagttcttttctgtgagtttacatagtttatcatggagagttactgagaggtcagttaagttgcagatgtcaacaggatagagtccagcaggtagatcctgtcagtgccattctaattctggtgctttgcttttccatgtgtactctgtgtacctgataagcaatgtagctttgataagttataacagggtatgtgtgctcacatatagaacaaggaatgcctttactgaaagcctagccaacaaacaaaaagcagagatgatatctgtctttcatgtaggtttcctttttcttagttttaaatttgaacctgtccttatgtattgactcttagtcgagatacacttgtaaaatgtacagtggagaaaggaagacagagcgtttgtctggggtgagatactatcctgccatgttcctcctttatgcaccagagctttatatagccacttgcatggctacacctttacctaagacttcctttaaagatccatttgtaaaagtccacttggagggttaaacacgttttctgctagagccattttattttaacaaatggattcttgaacatcaaacaaccttcatgacaaagaaattcattaatttctttttgtgagatttcttgtactgatttttgaggccatataatcgcttgggatcttctcaagtcagggaacagccagccatcttttaacacttgtgttagcccacaggatagaagaagaggtagagaaggaaagataataagagaagtgagaaacagaggtaaggggaattattctgaagctctgaagtaatctgcacctatttagaagtgagaaaacagaattcaaagggccacatcacatggaagaacatcaaaagcttaaataaacaaagaaagcccaggaatcataaaacaaaaggaaggcaaatgaattgatactactattttgttctatttctaatgaaaaaaaaaaaggaatggaaattacaactcacttacttcataggctagtagcaaaaagagcactgtagtcagaaatacactttttacacctcaactccatcattagttaagtggccatagaaaaacttccttgcctcctttgcaccctagttgaacaactggcactaacaatccaatttcatagtaaatttacagtgatgaggttagtacacttgcagtgcttagggcaatgttggcataaggtaaggattctgtacatgagatttatggtgatgtattgttttcacctataaaatggacatcatttttttttactggcaacatcatagggtgacatatatatatatatatatatatatatatatatatgctttccaaaatgatgattgcctgatctagtccttatgttgtgatgaatactagtaactcaggaaagaatgagaagcagagtgcatgctgagtcatcatcccaggagtcataaaaccatcatcaaagctttgttatctggactcatgctgtgaaaaaatcttgaatgatgtggtcatacatctaggtttaaatctattctgtggtattttcaccttatgtaacttccaagaaagacttagtctttctgagattcaattttctttatttgttcagcaagggtgcaaacatgtgcctcacaaattacacagtggatagttcctgatgaattgtgctatttttatcattcagaattttcagagattatataaatatgattggaattaatataaattattaaaattatgtataggtaatataaatataaaatatatgtttatattaatataacatatgtttacattaaaacacaaatgtatagtattttatatatttatatataatgtaaatataaattagtatatataaaatataaagtataaaatataaagaataatatgaattttatacaaaccagtttttacacacatacacgtatatgtaatatgtatgcacatatatagtatatacatatattcaaatgaccaatcctttacaactgaattgttttggtaccactattctggaagcagttgatattagacatatattttgatacttgaatcctcaagtccactttattgttctacttctttgtccttatgccagttttacactctttcgattactatagctttgtagtatgcttcaaattgggaagtttttcttttaatatttcacatttgttagttttccaggtttcttttgctattcagaatcacatgtccttctgtattccacatgaaattgaaaattagtctgtacctttttcaaagattatggttgacacacacatgcatgcatatgtgtgcatgtacgtgtgtatatgtacacacatgtgtgcatgtatgtatgtgtacatgagggtgtgaaagggtttcatgtagctctggctgtctttaaaataattatatagttatgaatgaccttgatcctattgcatctatctcaaagtactgggattacaacatggctacatggaattttgataagagtttcattaaatctatggttcagttttcaaagtagtgtcatcatcactactgtggatgatgacagtgtagaatactgtagtatgtcattggagaatacctatcatcattaaatttgtctttgaaaatttcatgcatgtgcatagtgcatcctggccactttcacacccatcctatcccagtgtcctagactcctatctactctacttcttccctacacatacttttctcacattcatgcttttttgattttatgacctactaagttaaaccagactcatgtgtgtgactatgggtttggagctaccaattacaatatggtaggctcaacagtgagtatataactgagcgtaatgatccctactctccattccaagaatctattagtagctaatagttcagcattaaaatgtagaaccacatgagcccccttccattcctatgactgatttgttgacatcctgtgtgggcctaattcagataactgcagttgcgagtccatgtttgctgtggttatactaaatctagaagatgctattccacagcactttactttctcatcgcattctgacattattttctgccctctcttgcctgttccctgtgccctagagaggatggtataaatgtcctctttcaggatgaatccctaatggtctcttatttcagtactgtggcaaccatgaatcttacacatttccagcagttcactgcaaaaaggggcttctctgatcaaggatgtttgtctgtgggtataagcacaaggatttaggaggtagcttaatgctatgttaatttcattacataacaatagtgagtgctcaatagggacacctatgaccttcctagttaatacaatatcaagcatgggcagtccttaaatatggtgagagggtgacggattaaccccacaagcttgtgtcactattatattggaggccacttctttcccaggtggttagttttttagtttataaggtttagacgtgggtaatatcagagatgccttttctcccctagctccatgcatagaaccttctgggcctttgaaagctaggtagcagagaaccttctagtccagaacagatccagatttcgttctctacatcttctaaccaagacatgtggtgccttcctcaacatggtcttatcttctagctctggtatgcaaccaagagtactgacaagaatctgtattgttttaggagctttggctgcctcttctttgaaagcatcccatacccagtactgagaatattgttcattatcctactgttaataagaatagctatatctagctacacagagtaacttccttaagtctctcttttgtgtttttatttatgttataagatagtacacttatatatcacttttacatatattttttcatatgttttgattaatgtctccaccaagtatcattgtctccctaatcatcttactcccccttttattttaatctttcctctccctagctatttatccttccttctcttaagttttcttttatttatattctattgccccatcttaaggcaaccctacgtggatgttctcatttaggtaataaaaaagcttatttgtttacatgtgtgatggtttgtatatccttggaccagggagtggcaccatctgaaggtgtggtcttgttggaatgggtgtgtcactgtgggtgtgggtataagatcctcaccctagttgcctggaagtcagtcttccactagcagcctttggatgaagacagaactctcagctcctcctgcgccatgcctgcctggatactgccatgctccctccttgatgataatggactgaagctctgaacctataagccagccccaattaaatgttgttttattacgacttgccttggtcatggtgtctgttcatagcagtataaccctaactaagacaacatgtatagactattaaagttcaaaagtttaacattcatatgctctttgttttgcagcagctataaatttcctctttgatcatttttctctttggaaaatatcctctttgatgattctctgaatttgttgtgatatatcccaaatcattcctctcctctgatactgatgccttttccttagcttaatcctttattgctgcaccaaataaccttaagataaataaaggcaagatacataggacactcatcacataataatatatttgctaagctttctacagaatattatagttttatctgttggagatatgtaattatgtctagaaatattggcaggaagtagaacatatattcatcatactagggaaaggcagtatatgtctttattttgtctatccaaatatctgtaaaaatagaacataatactcactacagaaatatatatgaaaaatacatatgagatggtgtattgaagaaatgtgtgcatcttcattgtcttcaaatagaactgaagtgtgtctcttttagagatggatattattatttttattttatacttggaattatttatttatttctgttttatgttatgagtattttacctacatgtattcaagtgcaacatttgtatgcttgctacctgaggaggacagaatatttagttgagttccctggacctagaatcacagatacttgttgagtgctgagaactcttcatgagaagtgactgctcttagcccactgaaacatctccccatccctcaattatacatttcaatttatctcctttcttgctacacaatacgacatatggcttataggatatttcttcttactagccttttaagattttcagctactttggtgctttaccggctcctttgttgctctgctagaatcatgtttctgtgctaaagcacaccttgcagtcctccttcatttctagattctaggcaggatgttcataactaggtcagtctgcttttcttaatcagttacctgatttcagactccatccatcttctctctggttctattttattattctctgatagattccctactgtatcctaatactgctcatatctcaccataaaaaacatacatgggccataactcatactgaaatagttttcctttgcctcacaaccacagaatttggtcacctaagcaagggcaatatatattttcaagtattaatagactgtctgactgggcactatttgagataacttctaggaaaatgtcgaaccttgtattctaaaacatttgatatgttttgatctgtcggctttctttaggctgtgcacactttgtatgaagggaggctgcttcataaagcatcacactgaatacaagaaaatcaataagcaatctgtgtgataattaattaaggtgccagaatgaattactgtttcttcctctccgtgtttgggtcagagtcttgcttgatttgggaagttgtccgttttcaattgcagtctctgtgtgttcttttgaggtggcacggatgaatgtatggcagaaaatcatactatgccagaaaactatggggtaggtttaacatggcaaagatgtgacttcaaaaaggtatttcaaatatgtagctgttataaagtgggggtaatgtagaagtttcttgctccacattaataggtaagattaaaataaagccaactttgttctcggtgcactgtcatatatatgttcatatacttacacggacccacgttctaagagctcatgtcagaaataacacagtgtgcttaaaggtgcatctatgtttgagtacattatagttactgaattcagagaatatttaatttaccaaggggaactaatattaaactaagccacatgtgctaatggggagcataccttatttagctggaatttttctgtaacctatgtttactattcaaataaagccagaaatcatactgaaagctttcagtgctctcactacatcataaagctgaaaatataagcaaataataaatgaatatatttctttaaaatatattgagatgtctgggtgacctcaatatggaatgtgcaatattatctatccatacacaaacattcttcttgtattttttaagatttatttattttattagatgtcttcagacacaccagaatggcatcagatgtcattacagatggttgtgagaaaccatgtggtagctgggaattgagctcaagacctctggaaaagcagtcagtgcccttccccattgagccatctctccagccccaccaaacatcctttttgtcacattcttttcctcttcaaatcaaccataggctaagtgtggtagtgtataccctcattgtcagcattcaaaaggaagacagatttctgaatgtgaggctggctcattctacatagtgagatccaggccagttagagctacatagtgagacccttgtttctcatatatatatttctcatttaaaataattgatattataatataattatataatttaacataattatataatttccccatccctttcctcttgcaaacactcccatatacctttccttgctgtgtttcaaattcatggcttctttttttcattaattgttgttatatgcatatatgtgtatttatgcaatatatttttaaatattacctgttcagtgtgtataatgttatttgaatgtacactttcagggttgactatttggtatttgatagccagctggtgggatcttccctggagaagaccatttctcccattcagcattccttggttgcctgtagtcttttgtgtatggttgaatgctcatgggctttctcctgtctgctttgacacatctgttgtccttgttcagaccatgtttagacagttatgctggtgagattttatgtgcgaagattctgaaattactaggctacatggtctcacagcaaactccctttggttcttaaaatatttctgctccctcctctgcaatgttccctgagccctgagtgcaggatttcttttgaagatgtatgcattggcttcaggttccacaactctgcattttgcttggttgtggttttctgtaatggtctccttctgttgcaaatagaagtttcttagacaatgggtaggaattctactatttataggcatgagaacaactatttagaattgaattagagattatgctgtttttagtagaatgatgactgtaggttcttatccaaaatccctgattttactagccctggaggattggctaggtttctggtaccaggtgtgatttctctcataaattgtaggtcttaagtctgattagagaactattactgctaaggtacgaatgccactaactcatgtatctttagggttattgggtcatagtggtcttttatgtggttcataggcactacaatcacataagattgcttgttacccccctcctttgcaagcttgcacggccccttctggtaccatgaaaactagtgctcagggagggggcatccaggtcagatcttactgagagctctgtgaatcctgtgtatgacgtgcatggtatcttcagcaatagatgtgacttaactttcatctctcaggagcaacaaagggtattagcaatacttgataacattttgtgagtctcttggacaaccttgaccaactactcaaaagcaagcttttcattcctgatgttgggtattttttaggtggttgttgtctattatagagaacattgtcagcctggttgataaaattttgtttaaacaatatatgtctatttattcactgaaatttacttttaaaactgtttaaattaaatttagttagcatacaaagtagtgagtttcattatgacatttttatacatatgtataactctaacttggtctttttccagaggaatatatttaatagaaaatatttctggattgcctcatgttgaatatatcagaatgattgaatgaagaagactggagagtttccataagtgcacagattatgatttgccctggagggcacaggaatcatcagggggcctggaacagatcttttcaggtctaacattctgtgatgttaatgtttctgaggcagtagcacccctggaaaaatggctgagtgccaagcctactttctttaaatgtgtgttttaagaacacttgcctgtgtcaatttattcttagctctatgagctttatcatggctatgttacataggggggcaatacttattgtgatgcaagagtctcagcccaaatgggcttagggttttcataactcaatttagtgtaattatactcaacttaggaaatgaataaagggaccctttttcttcccagtggacacatgattaattggtttagaagtaaaaatgccttcaaaatagacctaagctccactgggctcccagaaggttgtttaaaatctcaatagagtttacttggccttttctcattaaagttggataagataaattcaaaacccaaggccttttcaaatcagcaagggcaagagaaaacctaaagtaagcacaagagtttacctaacatcaattccagagagctatcaaatgctagttgactgacataccttttagggcaacaatggcgcattttactgattaggtctattttagaataagtcacaagtagggtcttcctgagatattttggggataacattatttgagggagatcattctgattctatccacacatgaaaacttcaatagtatctacttgatctgtgttgtcatgaatgataataattctaggcacaccagctatttgtataagcagaatatttcatatgcagctatatttttttagcctaagcatgaatgcatgtgtgctttatccctttgtgaataatttggagatattaaaaaatggaaagaagtgagattgtaggaatagtacagcccaaattgcatataggctcagaaaattttgtattcagacatttaaaaatgtctgttttatccttaaatggtccctataaaatgtgtatttctaaatgactgctttaaaaggaaagtattattaccatggaaattggggtcctctaaaaaaacacttggaaagaagctcaagatgaggactcaaaagccacatgctcagcggctctgatgttcatcaagtttccagatctctagctccttgagaaaatcattattctcaaatatataccaatattctcatacaatagggagagggcttcggagagagagagagagagagagagagagagagagagagagagagagagagagagacagagacagagagagagagagagagagagagagagagagagagagagagagagagaagagagagagaagagaaaagaggagagagagaggagagagatcttatctttttggacaagggaaaagaaaaagaaaaagttaagcttgtacagtgctgcatgatggacgttcttcaaatggctgtacaggggtggaatttatggtaaggataagtacattctcttattgaagagataattattcctcccatgaccttaacatgacattaattgtatcagccttcctaagaggtagtcacttagccaggtgattgagaaacccagccttattaactgttttgtaaaatttaattaaatcattattataccatttcccctccctcatccccctccagctctcttttttctccatcctcactacctctgaaaatcaaacatggattctttttctttaattataattgttataatacatgcagaaattatatatagatgcaacctgctgagtctgtttagtgtcatttgtatgtatatattttagggatccttaacattgatgactgtttaggaggctctcccccagggaaaattaattagttaattctccttctcttagcagttttcaatttcctgtatctcttcatttaaatggtaagccctgccaaatggtattcaatgtccaggtctcatttaggcagccatgttggtgagatttcatgaatttagatttcctgtgattctctggctcttacaatctttcaactcttccacagtgttccttgagtcataggtgaaggagtcattttgttgatggatcatttgtggctggacacctcacagtcatttgttttctgccttttgattagtcattgtttcctgtaatggtctccatctgctgcaaaaagaagcttctttttatgcagggtgagaaatggactgtctgttggtattaggtctttagaatgcagttagaaactaaagatttagaaatgtggtggtagtaagttctggtgtttatgagctcacaatccacaggtggctagctaggtttatagcactaggtatgctttcccacctgatttaaggagattttaaataagctgttggatagttccaaagtaatgccactactgaaccttagggatattttgttgtccagcaggattaactcttaaagaaagagacaagggatggcaagtaacataatctttgatgctgataagaatgtcatgcccctacccatggccagaggcacacttcattctttacatgaagagaaaataacttacctttaatggtccccatcagaacctgatttccttaatggcttctaagactacttatgttttataaaatttgacccccaaatcagttctggttccttagcctgcagagtaaaaagctgcattaaaacagcaaacagtgtgcttttatgaatgaattttccagagtaatatggtcctgaaatataatgaattcttacagaatactattgaatggaaatattagttattaaaatacatagtgttgtatagcaattttctctgtgataaagccatccatctttgagtttctcaaagaaacagaatgttctaaagaaaggtaaaacattccatcctgtaaggaagctcatttaaggtcaagaatgtacaaaaaagcttaaagaaacccttgaaactgaccaggttcactagccctctctctacaagtatataagcagtagtaaggacttttgagagaaacagtctcagaccagtgaaaccacctgaaagaaagagaggccatccatgctacctagaagagtgttagacctgctgacctatctggaagagtcaggaaatagccaagatacctcaatgaagcagaggacagccttgatgcctgaaagaggcttagagctatttatttggaaaggatacttttcaacttcttgagctgccagtagattttggaatacactcaaggtttccatctttcatgagctgtcccacatgttggggtgggctttgctaattattgtctttgagtcatttctgctgctgtaataagtgcttatttacactcctataagcaaccttactaaaaatcattgtttcagtaatttggactttgagagtatccatattttgtctgttgttgattccttatctggagtaagctgatgtttgtttaagtctcaccacaaatggctgtgtgaattactgtctataaactgacaactatagagagttgaggatatagtcaacaggagaccagtgttgcagttttgcagtcaggatgagagaggaaactcttcctgagatatgctgttgaaacctccaacaaatagaaagagtctacaaagagtacgtaaatctactgagtttcacagttcagatgctaatctcagctagcaccaagaatacctattgtttttttgtttgtttgtttgttttttgtttttttttgttttttgttttttgtttttttcaggcaactctttactttatgccgatgtccccacctttggctcacttgtcccgtgatgagaaaggtctcagccacccacaataatgttattaatgggtatatggatcagtttcatgaagaagccagtgaatcctatgatagcaaatcctatagctgtagccatggcaatcttctggaattcttttctgtagggtttgctgcatcttttaaccagccaaattgagtcctttacaaactgctgactgggctctacaaactgcattacctcatccatgtttgtgggatggcagattgagagcttagagacacgtagcctagtagagaactgagccaaggtggactccagaaaatcaaataaccccattaaaaatggggctcagagctaaacaaagaactttcaactgtggaataccgaatggctgagaagcacctgaaaaaatgttcagcatccttaatcatcagggaaatgtaaatcaaaacaaccctgagattccacctcacaccagtcagaatggctaagataaaaaattcaggtgacagcagatgctagcgaggatgtggagaaagaggaacactcctccattgttgttgggattgcaagcttgtacaaccactctggaaattagtctggcgcttcctcagaaaattggacataatactaccggaggatcccacaatacctctcctgggcatatatccagaagatgttccaaccggtaagaaggacacctgctccactatgttcatagcagccttatttataataaccggaagctggaaagaacccagatgcccctcaatagaggaatggatacagaaaatgtggtacatttacacaatggagtactactcagctattaaaaagaatgaatgtatgaaattcctagacaaatgggtggacctggagggcatcaacctgagtgaggtaactcaatcacaaaagaactcacataacatgtactcactgataagtggatattagcccagaaacttagaatacccaagatataagatacaaattgtgaaacacatgaagctcaggaagaacgaagagcaagttgtggatactttgccccttcttggaaatgggagcaaggtacccatggaaggagctacagagacagagtttggagctgagacgaaaggatggaccatctagggactgcaatacccggggatccatcccataatcagcctccaaacgctgacaccattgcatacaccagcaagattttactgaacagaccctgatatagctgtctcttgtgagactatgcccgggcctagcaaacacaggagtgtatgctcatagtcagctattggacggatcacagggtccctaatggaggagctggaggaagtacccaaggaactggggggatctgcaaccctataggtggaacaacaatatgaactaaccagtagcgcccccccccccagctcgtttctctagctgcatatgtatcagaagatggcctggtcggccatcagtggaaagagaggcccattggtcatgcagaccttatatgcctcagtacaggggaacaccagggccaagaggtgggagtgggtgggtgggggaataggtggggtagggtgtggtggacttttgggatagcaatagcattggaaatataaatgaaataaatacctaattaaaaaataaattttaaaaatgtgaaaaaaagaatatctattgtttataggctaatatccatttatcattgactgcctatcatgtgtgttcttttctgattaggttatctcactaaggatgatatggcacagtttcttctgaattccaaagagtactctttggatagagttgtaacaacactatatgattttaaaagtccaatctggactcttgatggaaaatagttaataaaaaaggataaagctgcacaccaagtcagttagcaggccactgcagtaatccagagtgagaaatcatagtgatgtgaatttggcagtaatggtggagatggaaactggttagatactgtctttaaaaacatgggcaagaatatttgctaagacattgagtgaacagtgtgagagaaagaaagcagaaaaagttggtactgtgatgagaaaaactgagaatttgaggggtatggaagaattgtagacacaattttatatatgctccattatatatcttttttgcatcattctaaaatataaatgagcaacttcatcagctaaagaaatgtctcagtgattaaacacagttattgctcttgcaagtcccaccaaccacacaataaattacactctctttaatagcagatttaaatgatcttatactctctcttggcttccatgggtactgcacatatgtggtatatttatatacaataaagcaaaactaataaggtaagaggctagagatggaaaacgtgatcaaatgtattatatgaaaacattaaatatataccaatatagttataatttataaatgtatatttaattgtataattatatgtaatttatagtaaatttacaagtatatatttaaatatattaaattttatataaaaattacatataatatgtgtatatttttatattcagatatatagatagatctttatatgttccctctactttcagtcacaactacatcatcttgcaaactcagtctacacattcttctgacagatcttcacatttggtgttaagtgagcctttaaaaacaactgcttatgtcttacagccactttctaggatgtctccagatactttcttctggttctccatctctaagtaagaaaaatcattgacacataagctcttaatcttctcccatcaagctttatattataaatctttaccattgtctttcactggtcatagtgaatactagtaacattgactgaaaaaatcagctcagtaagaaagtgttcatgagaccagacaatctggccaacatttcccactgttattcattttttttaaaaatatgtatttattttattttctctgatgggtatgttccagcatgtatgtctgtataccaagtgcatgtaaaatatgcagaagccagaagagggcatcagatcccctggacctggagttacagacagttgtaagctgccatgtgggtgctggagatggagcccaggctttctggaaaacaatcttgtctctctctctctctctttctctctctctctctctctctctctctctttttgtaagatttttaattagatttttttcatttacattttaaatgctattctgaaagtcccctataccctcccccctgccctgctccccaaccctctcactcccacttcctggccctgggtattcccctatactggggcctagaatcttcccaggaccaaagccaaaggcctctcctcccattgatggccgactaggtcatcctctgctacatatgcagctagagacatgagctttgatggtactggttagttcatattgatgtttctcctatagggtttcagatccctttagctctttgggtactctctctagctcttggaataacaaaaaacctaggaaagcaaaaactattctcaataataaaagaacctttggtggaatcaccatccctgacctcaagctgtactacagcgcaattgtgataaaaactgcatggtactggtacagagacagacaggtagatcaatggaatagaattgaagacccagaaatgaacccacacacctatggtcacttgatctttgacaaaggaactaaaaccatccagttgaaaaaagacagcattttcaacagatggtgctggatcaactggcagctatcaggtagaagaatgcaatcttcttcttaaattgtctcttaaacaattatccttctctttgctcagtcttcacctttattcaggtatcttcccagttcagattttatgtcagaacaagaaaataaagacattgggaattataaacacctcacacaatgacaaaaaattctcagagttcactaatgataataaatgtatgtgtgtgcatacatgtgggtttttgggcctgtgtttatgcaaatatgtgaaattaaatgtacatattcattcataaaactcaacagtagataaagcagaagtatcatgtgtttggaaccagaaaataacttaagcaagtgtctgctaggaatgtctgaaagctgtttacaagcccaactctagggaaaccaacctgctccgacctgaaaaaagaggttttttctgccatcttgagagtaagctcaagagtaagtatagtgcagggagaatttggcagagagccttgctggcagaaagcaaccagaacatcaggacccttcttcattgaacactagctgaaagatgaagagaatgttgtgggtttcttaaggaagggcagatgaacaagtatgtctttgatgcctgtgtaaaaagtctgttgtggagattcctctctaaatccaatttatttattacaaggacttaccttgtagctccagcaactatagggcagggagaatttggcagagagccttgctggcagaaagcaaccagaacatcaggacccttcttcattgaacactagctggaggttgcctactgaacaacaacaaccctaagttttggggttttttttttgttttttttttttgttttgttttgttttttttctgaaccctgttctcatgggaccagctatatgggccagagatgagccttataccattaaaaatggatcattggctataactttttttttatttctgccagcagagtagattaagtgtcatcatttctcacttcatatcatgctcttctttgtaggaaaagttcagaaaacaacccagcaagagagctttcagggagttgttgccttggagaactttgttactattggatgaaagtgtaactctgtttaggtatgtagattttggcaggcatggcataatacctaagaaagaaagaaagaaagaaagaaagaaagaaagaaagaaagaaagaaagaaagaaagaaagaaagaaagaaagaaagaaagaaagaaaatggctagaggaaggtaagaactgggaaagaaagaaacaaaattattttgaagtttcctgagtctaagtacctgagaagtggatataaatgtgaatagcctatcctgagcaaactaggaataagatgtttagttggacactagaaccacagagcttattgctttgacaatgaacagtagtattagaggaccagaaagggaagacttactgattaatttattccttcaattgtttgtaattcaattattcactcaacaatcctttatcgattattcactctgtgttctatctattacgaagtaattttgtctttaggaatcagacagacatgaatattccctgtaggaaccacatttcattgattgagaggatagataggcaaggaagcaaatacatccataaaatcctataccagccaagcatgatgatgtacacttaggaggcaggggtagggtagggtcagagacagaaggatctctatgagtctgaggccagccttgtctttatagtaagttccagtctagcaagagctgcacaatgagacctcttctcaactcttaaaacaaacaaataaaagcaattgagcaagcaagccaaagccctacggcaaaagctcttatatactgaaccatttaataggaagtatagaaatgatgatatatgatgtaacaatatagacatatacataggaattagcagcacatgaagatatttatactcataataatgacttttaattgaatgcttattatatatcaggtaatatattagcctttgtggattatgctattcagtagtcttccctttttatatccaagcattctgaggaccagagagctgaagtgactcatacaaggtcaaggaggtaacagtagaaaattaattccattgtcagttttcaaggccctagcgcactatttgacatcaaaacacttgctgaggctttatatgtgttgcaggagaataccagatactatgttttatactcacttgactgccatttggtttcattagttttgtttgaagactgaacaggaaactaaatctagaaggggaattttgttgctctaaggttacacagagtttcatttcaaagcaaaggccagatctggggcttcagacttctggactagtttctttgttaaaatcctatttcttcactttgttgaaggtctcctaaatttaaatccctgtaaaaatggtttaatttctgaaataaactacaaatattaaagttttcttgtacctagaaaagaatggaggttgtgatgtagaagtgtttactaagttcacatgaggtaaaaacttcaagggtcaaagtttgatttccaggctcttttcttttcctttaaagtataacagggttaatttctcttccagtgtcctagtattccacaggacaaacacaaagagcttataatagtgtgtgtgtgtgtgtgtggcttagaagattttaaatggaatcaactccacaaatggcttagaatgatgcccaacaaaatagtaaatggtgatgatacaaattatttatgacaagaaagatcaggaaaaacatatatatatatatatatatattatacaaggtgagccaggaagaattgactgaattcttgctctgtgcctagcattgtgtttgttactgaagaaatatgatattattccctttgccattaaagagcattcccttgaggaggacacagattcatgtctagctaactataatgtcatgtctgttctcaacaagcatttccaacaacagacattatttgctgtcatttatctctttctctttatcacttagctattcagcatacagaatgttaaagagcagatggtgttaagctgtctattttaggactcgttgtaaaagttcattcctgagcttacatttaacacactatcttaatgagaaaaccatttgcagagcctttatggagtacttactcttagtgggtaccttgagatggatataaatgagtggggctttgtggaagtctactagatttcaagtcggaaatgttgaacttgagtcaggagcttgctgctgaccagttgagtgaccttggatgagtcacttagctgcattgctgggaatagcatattaataaaagtgggaaaacagctggttttcaattaatcacacattaatcagtctctcattacttcaagatgagagacagggtctcttgtttaagttaaatcataatttttagaatatttagtaagtcatgaaagaatatatctggcttcctatactttaccatacaaatgaaagtaggtttttttaaaatatgtataccaacaactttattatgaatacaataaactcttttatataactgtcatctatggttttcataaattactactctcttattttatttgtacaaaatgatgggcttcattaaaacattctaatacatgtacacaatacactttgatcataatcattccattatattctatatttcgtttctacttcccttctctgctagctttctttgtaattcatatccttatgaaatctgaattttgcacatgagagaaagcagcaacattattcttcctaagtctggcttgatttcttaatatgatcatctccatttctagttccacctactttcctgcaaatgtcatgaatttgttcttcatcatagctgaattgaattgctctctctctctctctctctctctctctctctctctctctctctctctcacacacacacacacacacacatacactcaaaatttattcattcctgacatacatgcaggctggctcccaaactaggttgctgtgaatactgccacagtgaacatgggtttataggtattttggttgtctgtagctgtgtagcatccatggatgaactgggttacctgaaagggaggctggaaatgaaaaaggatgtgatgggtgggggcggggggggggcgagagaagggtgaagccaagacaaagtttctgatcaaggctcaaagatccatcctttgtttcagctgggttttattgctttttgtcctcagttagaatccttcagttatatacccagaagatgtacagctagctgatgtggtgatttctattttcactggtttccatggacctgcatgagtatatgttcctatcaccagtgtttaagagtttcttttctgtcttgtctcttccccaaaatttgttattgttaattttcttgataacaactatacctactagggtatcatagactcttaatgttttgatttagatttctctgaaggctaaacagttttaacatttaatggccattttttgtttgtttgttttgttttgttccatttcgagaaatttcatctccacaacaaacagtggctaaattgaagagtgtgcctacagaataagaaatgcttatgtggcaactaaatgaccaacagagggttaatatcacaattagtaaagtactcaaacaagaaaagaacaaatctagccaatgaattcatgaattgcagaattgaacagacacttcttgttgcaatgtgtgtcttgggtttctgtgagagagtcctcaactttcccttagatttgctttcaaaaaattccttcgcagatttcttatattgtactaaatatcacaaagagtattcatcaaggttcagtgatgtatactctttttactagtacactttcactacatttaaattatccttttacataatcaagcttacctcactacttagtcaatatattttccactcattgttaccttgcatgttcatgagaacagagatgatgtttgtctttttatcaagcaaagtaccatgcacatcatatttattaaaattaatcttattaaatatatatatatagtatcataatttgtaattgcccccaaagtacttattaatatcctctgttaaattgggaaacaaatgtgttatactcatgcaatagaatgttatttgaccataacaaaggatgaaatactaattcattataaagcatgagtaaattttaaaaacttgacaaatgaaataaatgagtctccaaagaccacacattactaagattgattagttttgtaagaaatgtttgaaatgggcaaatccatagggatagaatgtagatttgtgtattctacaggctgtgaagttagagtagaaaggaactgctaaaaatctgggctttttttttttttttttttttgaaagatgactgttttaaaaatacatagttgtgacagaagtaaactgtggtagttgaatggatattgttcctgtggacacatgtgtttgaatatttggcccatggggattgacactattaggaggtgtggccttgttagagtacaggtggctttgttgggggaagtgtgttactatggatgcaggcttggagttctcctatgctcaagctccacacagtccctttctgatgctcgtggatcaaggtgtagaatgctcagctcctccaacactatgtctgcctgcaggctaccatgcttcccaccaggatgataaatggattacacctctgaaactttaaaccagccaatattagaagttttccttcataagttttgccttggccatggtgtcttttcacatcaatgaaactctacaatatacaaccttttcattttcacataagagttcttattttagactttaactatgtaaatgttaatgcttatggtgcatatattcatttatctatcaaagactgataagtataaaactccaaatcatatgttcaccactgctgaatccaggtgaaaatcatagcacatccttaagtttgcatacactgatttaatgtactttcttttacgttcttaacaactgacaactgagaaaaactatctaagatgttatattttgcaaagtgctaacatgttaagtaattcaggtatgtaattgtgttactaggtacttttgggtgtccctctatggcttcaggcaatactagggaaatctttgccccttcttggcatccttggtttcattaataaaataaattaagaatagacacaatggaaactagaagacaattttattaaagtttaaaagaaaaattccaaagaagacaaactgtaaatatggacatctgacaagtagagggaaatagagaaaagaaagagaagaagacatgtatttgtatgagggcagaatggacatcagttatgtgcatacaaacagacacaatgtggagaggggagcctcggagaaagtataattcaaagtgtcagggaaagccacttagaaaagatatagaaaaaataaatcattagacatttctgattaattcataataccagcacacttcggaagctgcatggttgtggccctgtaagctactgcacttgggattggggattgtgggcagaaaagtgtattatctcattaaagggatagttattccatctaactctttagtatagcctaagtgtggacactctttcttagggttgttctttcaggcaggtaattgactcagacaaactggaatgttaggtttgcaactagaccagagattctattctcttgaccaggagttttcctttgttccatctttattgctactctaaaaagttcaagtgtgagaaaatgaaagcttagtgggagtgactctaagtcctccaaataaatgaatgaccttatctgtacgaaactctttctctactcagactcactttaaggttctttccatcatatacagtcaagtcagtcttatgaaatttcccagcaaaccttcactacttttgtttacaaattgcccctgtctggaaggaaggctggaaaacatagtttcctttaaaaatagtaacagaaagaacagactttttgtgtagtctctaccaaaggttcttttgctgcaacattgaataggtcacttttagatttcaaagggcatagttttctctgaggttcctacaaagttagtactcatatttccagtcaacggtgagaacaaaagccccacgtggtaccctttttataaataaaaaaaatttcctgccctactcttcaattgatcctgactacatggcaattggcaggaatttggtataaggtatccctggctcaaatgggtgaaactttagaaacaaattaaggcatcacttgttgctctagaatgaagaaacatggtgtgaaagaccatgttagaatgcaaattacaatctgtgttttacaaatgcagagtgacatgtctagactttgcttaaacataaaagctcaaatagtatcctacattctctcgtctacatataattgtttatggaaacaagtgaacaaaaatagatactattttgtttaacttgactttcaactgtaatttcagtgatgtaaatattctcttcaattaccatttagtttttttttttttaaataaagcatgatagacttttctatacatcactaccaccacgtgttggaatcagcccctttaacataaaagtgtatggaaaggagtcttggttgtgtactgatctctgctcttgttggtggtaccatgtcccattaagttggtattaatgatgttaattatacctggagatttgatgtttacaggacaaaattaaaagtttattagttattaacaaactgtattctaagaagttagattggaagaatgcctttaatgttcttaactgaacttcaagactcagtcaagtaacatctatttgtaggacagagaaaacaatgacaatatttcccacagatgagtaattatctccctggaaaaatgtttcaagtttcttcatctactaatgatattagaataacatgggtggttccaaggcagtgtaatgactacccctgcaatggcagtcttcagaaaaatatttctgactcctaattaacttataaagtttccttgggcatttctagctgttgttttgaaactgagaatgaaggaaggaaattatatggtagatactgaatgcattctttccgaatctctctttagatgacataaattaatggctggtctcatttttcatgcttccatgcatgaaaagaaagaaattaagacagtaatactatttaactattgtaggaggaattctgatagtgctgtactttactgagacacctcttaggccaatgaactaattcaacctctgccaaattgaaccattcaaattttagtgattctggccccaaacctcactttctctatgtactgtcatggaagagcaccctttcctaaagcatgagaaattctattactcaaaagcctgggacaagttaaattagtctgcagacaatttaactacaggagcacttgcctctagtaaaaccattaattttgtttaaagtaagtatattgagatcattggggattttccaatttttattttattttatttttatccataaagccttgtttaaaagaatggtaattgattcagcattttcccagttgcaccttttcctatcaaaagatcatgataaaaccacactattgttcttaagtttatatatatatatatatatatatatatatatatatatatatatataatgtctgagaagggggctatagggattagaggaaaacttttgggaaacatttctatttttcccccaatggattgagttttaggtcctcttgcttgaccatagttacctttgctaacattttagcagtctcatttacccaagttttcattaagctttttaattgtttggtagatgattaaaattgagtcttagtaggttagaagataatcaactctgaagctgaaaccatatcatgactccagtttcaggatcttgatcataatttgacctactaaaacccaaaaagtatgtcacataaaggtatactaataagtgaatagaaaagtagttgaataagataatttgggaactgtaaagcatgtgcccagtgaatctgcatagctcacctgtttgaatttatgcctgtacttgtgtttttgctaggtgttagactatcaagtacaacgtaatttggtattggtcaacttccacataactacagatataagcaccatctgcatccaaagtcaaaatgaaggaaatttctaaaataagtaattctgcctggcattttccatgtgccctcaaaggtggtaaaatctcttaagggcattagacatgttcagttgtcatttatattcttgagaaaagagcacgtcttcaacagaaacctactgacctacattagaagggcctttacaaacatttctaggttttccaaatgcccaaataatagaaaaagtcattgtatacctctcatagtcaagacaagaatctttgcagctaagtgccgcagaccctctgggcccctttgtctgcgtggaacgggtctctagttgcgggtggacaaagcgtaggatgagtgacaaacagacgcacacaggagagttcgtgtggaatctgaatgtaattttttcaaatcaagcatcagactttttatgcagaagacaataaggaagttgggtgacatacccacaaggtacaaatgaggtaaccggatgcttaatgactcttacacagaacagaggaatgaaaacgcaaagactggcaggaactgggcaataaaataaccgagacagagtcagctctatctaaggtcagctatagtcttagaagccaggtgtgagaacttttcactcctagggcaaaggctttcacacccaagtcatggttctcactagggagttcctttctagctaaccatctcatgaataatgcaatactctaaaaccacagctggatctacttcctaaaccattgtaaattcctgtatatgggtgtaactcagctatagttctaagtatctattctggtttctcctacggtcagaaacttctttcttccttggtgatggtagattcctgtgaagggcagtgacctaacttttactcaaagagatagtgtaataccaggggcagaactgaattccaagcccaaggtcttactcaaggacgatctaggactgttggaacactgaggctttagctatgtcagaattcaatcttaaaatgcacttataatagaatgatattgaaagagagcacgtgggtccatacactagactaacaccggaatggagaattaagggaatgccagactccaggagtagagtttccttgaaactcttttcctcatgagtgacttttaaacctctcggcttccgctgacttgaccggagtgcgtggcagctaagtgtgcatctgtgatgactgacatagggcagacatctataattatatgaggatgataagaaacagaaactaaacagagacacagtgaaagcaaatctttacttatatatcacaactctattatcaatatattctccagggtctcactatcaagaaatagtaaacaagccaacctgtgtagaataaacatacctatcccctctcactagagagtttctttagggacaatgatggtgctgttgtacattactattgggaattatattagttcacgctaattgaaaacaactttcttctaccctcgtttttcaacttctgaccacatataaccatattattaggctttaggtatcattttttttctgaggtgggactaagcattactctgtatttccagagtggttagtgaaagaagacataagagagtatagtcttgaccttgttattcatgagtatgttaactaattgttcatgtataggaaaatgtaattgaataaattgccagctttccagaaatgtattcctatttttttctgcctcagagtaagacatcgaacttccactaaatggcaccttgatttaaacatttctatatttttgtatttctacttgtcttagttatttttcataaatactatgacaagacagcaagatcaccatagaagaaagaatttaccaggggtttaactgtagagagtgagctcatttccataatggcagggaacgcagcatccagaaggcaggtttgatactggagaagtagctaagagctacctgcagatataacaagcacgaaccagaaggagtgggagagagagagagagagagagagagagagagagagagagagcaagctggaaagctggaatagctttgttgttgttgttgttgttgttgtttgtttgtttttcaagacagggtttctctgtgtagtcctggctgtcctggaactcactttgtagaccaggttggccttgaactcagaaatccacctgcctctgcctcccgagtagtgggattaaaggcatgcaccaccatgcccggcttggaatagcttttaaatagcaaggacttttgaaatcttaaattcccccaactccttgtgacattccatctccaaggaagctacacttcctaatctttcccaagcagtgccaccgactgggggaccatgtgttcaaatatatgagcctatggggtccactctcatttaaagtgccaattcttccttattaccatatataccttttctaaattctctatgacaaaagcttttagcctttaatattgctatacatcattgttttcttttacttcttaacctacttcaagtttgaggaccataaagttaattctgataagatctctgatagagataagtaacactactgaacagtagaagaaagtccatccccccccacccacacacatacatagagagagagagagagacagagacagagacagagagacagagatctggcttaaatgtattaatgtatttatacatttgtgttttactgaaggtagaactttggaataaggttatttggtacttatctataaagatatctacacaaaatgttgaagagtagccaagttttcttggctatgtaaagtatatactaaaagggtgaaatgaaattttaactgaaagtaaactaaagtaaaccttaacatttaaagaattaaaagcatatgtggtaaattaaagggtgtggggggaaaagaaaacatgtgtagtaaaacaaacaaacaaacaaacaaacaaacaaccttctccccccaaaaaagaaaccacacagtaagtgtaaccctatgtgacaatcaccataagtaaataaattagctatccaaagagaacgagaatctgttgtccaagataaaaaaggaaggatgataccacctgaacataaataataaaaatcagagaaagtatatctgagcagtctaggacattttatttattaatcggcagatgttatcattgtcattaaatacttaaatacatttttaaaatgtgtcatgtaatttatttttcaggacagatttctacctctatgtacagttgcctttctcctatgtagcttggtagctacactgttcatacctaccaggtgagactagtcaagggatgaattggcacgggggaagttgaggagtaggtctaggatccatggaaatgtgttagaaatggaagaatttctgcagcccatacataaagtagcaaagccatatgcaactatttgagatatgcctgaggtctgagatacaacccttttagtttaagaatatactttttgaaaattataaatccttgccacaaaaattgttctagtagaaaacttttttttcagtaggaaagaaaagttgtagagcaaggactctcatgtcttttattggaaagctcacagaataactcctatctggagctccagttcttcttggcggacttaacattgctaagaaatgtactcataggaacatttagtttcttttaggtcctgtgaagagttgccaagacataactgaacgacttttaaattatttttttttaatccttgaaattttcatgcaggaatctaatgaaatatgatcatatctactcttctcttcctgtgtccaactctcttccatgttcccctatgatatcattgtcctgacttcaggccatttcttttgataacccactaagtcaacttagcgcatagggaatgtctagggactacatattttcactaaacatgattctccttctactggaaactctaaaaagctcctcagcaagctctgagcctggagatcatctcctctctgtatattcctctctgtatttaagcaaacttgatcttctgtagatcttgtacaaactgtagagacgtaaatataaagattcattattgtccatcaattccaatttacacagttttttgtcacaaactgaaagatttgatcaaggaagaggtagagagactgatgtagagagactataaaaatgttttgggggtattgggattttttggtagaagactttcttgtcattttcatatgttttacacaactcaataaatcaacataagcatgtatatccattgcaaagttgcaaggctgtgtttaaatggcatgtgaaagcaagagaaatttgagttcagaggagtaatgtaaaatatcttgatggtaaggaattatatggagccttattgcaaggggactggaaattatcaatcagttcacctccctatctcttgctttttagaactacataatttgtcatttctccttctttctaaacagttgtctgaccctatattctgcaaaatggcttcctgtatggctcttaatttttttccatacatccagctcagtgggagctctaggtttctgtggtacttattctagttgtaaatatgtttttattcccctttctcactatttatattttgaaagaatttgagctggttcttctcaagcaaaaatttgctccctccctccaggtatgtccacctaggcagtgttgggggaaaagatgggaacataaaatgtacagctatgatgcacaaagaatatacagcatgatcactgaagcttaagctagaagagttagttgctactgcagacaaattgaccaatggattagaaaaggccattatcgtaatgataatggggataaagactgactatggtaattaaatgactatggtaattgaaacagctacatttatggaactcttttcaagcatattacataaactggtttagtcttgagaagcatgcataaaatagatattgttttttttcagctttcactaagaggaaaatttaggctcagatttgtgcatggtctcatgtctattgcgtggctagttaagactctaactagacagtctgacactagagcctgtgctgcttagtctgacactgtcacagtggatttgtgaactgtggaaagacatctttatgatgtaaaaggtaaagttccctcaaatttaggaagtccttttaaagcatgtgtcctagacacagatcttcagaccctgcattgtcccacaaaggaagggagtaagtctccatgtagttgaaaaaggaattgctctctcatttaaattagtctagcgatttcaaataaatagaataacctttaaatattcgtcatcagagcaccatccatttatctctctgccttaatatttatttgagttcaaattaaatctacctttggcaaagatcaagagccagatccaccccttcggagtagaaagcaaggctggaatgtgtgtgatgttactgccttcttcccgagccaccattttattgctcttctgggaatccagttaaattacagctgctgatatattgtggactgtggatctaaattccggctttgaccaagtcaagggctggtttctttaggcagtatttcacttcctgttttatctgtgctgtcacctaaatttagcacttagactatactccccgatgtctgcagaagttttaaattattttctagcgatgcaaaccgtgtccatgcagagttgtggatgacagatttgcaggaaaatcctggagctctccaagtcccctgcccaccccccttttcagtgaattagatcagtagctcccacagatctgactttgggataggttgtaaagtgacgtgtttcccacaaactgagttttctttgggggttttgtggccctgctgtacatttttactagacagcagactattaaaaaaaaaaaaaaagatgggagctcttttatgcacctgtgaaggcacaacaaacctgtcattaagacctttctctctaattttaggaatgatggttgtggaaaatactgtaatattgttctaaattaagcaagcttgagtaagacataaattcaaattctctagtttaaaaaaataaaacttcaacaagagtcagctgtaattggtggaacagcctgacctattaatccatagataaaaatgattcaattaaaatgaaatataaatattgaaggtagcataaaaccaaatgaagcacatcacagaatttatgtgcaaataaattcactgaataaaattctctagtacatacaaagtccatatgccgtcttggtaatgttataattaagtcagagagtcatgtcgcactggccttttccatctgctctgtgatctgttaagggacccattcaaacagaatgacaggtgacctcaaaatgatacattctgctagtgcccatttggacagagctgctggccatgcacattttgtcttcatttatactgggctacaagtgatttttttcattaaatcgagcaaattagaccatgcagtgttctattaagtgggtttatttaaagcactgttgttgttgtgtctgagtatttttttttcatttgcacaaacaatggttgtacagagatactttttgttcagttgtgttccgtaaattcatgtgacactgaaaagacacagggtttgaaaggagaagtcctactctcttttccttttaatttctggtatctgatcaaagccagtcctttaatgcttggaacctcggggtgttgggtatatatgtaactgactttaaagacctgtgaaaagggaaccactatttatgatactaattgatttcatttgttttgcttcccttgggcatgcttcactgtcatgcctgccattatcttaatgttgttgtttccaataacactcataaaagtcattttaaaggcaggggatctggagcacagatgtgtcaggtgtaaaggcccttatcctcagagacattcaaattggccacaggaaaccccaccgaactgtgcagctgaagatgcagcatttgtccatctgtttgtatccaggttaccttgagacagtttatttaatttctcatccctagagtgtctcttgttcaacagtacatacatatttcttttattagaaccacacaaggggaatattggtaacaaggttgaccttaaaagattaaggttttggttttttttttccccatgtgtttttgaacaaacaatacgacttctagcaataaggtttgttctagtccaagttcttggaggagatttttaaatgcctgcctttttgcattggaagaaaaaaggaagagggaaaataagctataattacaaacagagaaatgcttaggaaatgggtttaaatataaacgcctttttaaaagctactaaaataaacctgagcctcaactggagacaggcaatatctaaggagtgacccagactagtagaaaaagctcagatttacaaatggtgataattagtcaaatgtacattgctcttgggagaagcttgaccttggaatactggtttctgaattaaatctgagatcctaattggccagtatgaaaaatgtcacttggcaatgtgtggtactatttataagtttaaaaaaaatggcgctttcttagcagagtttaggtaagtctgcaatggttaggaagtatcccatttgtttgctcaggtggaagcattttctgaacatctaaatggctcctggcattgttttagattcaaagaatatggtagtaaataaaacaaagtatatgttctcataaagccaccattccctttgtggcaaaggcaaatggtaaacaaacctgttatctgttctgtacgggaaccagcactcattcattagccttgaatttggatattgcttaaaagataaatatgtatgaggtctttctgaatttgaaaactttgacttaagagcatctctatgagccaaaattaaatggatactcatttcaatgaaatagtgtttgtggtagccatttgccttgaaaatgtccctttctgttttcccatgttcacacagcacttcattgtggtgtggcaggaaagacacaaagctaatttctgccaaaatgcctctgccctgtatacccatgttgcattggataaaactataggttcttcaaagcaaagtacaaataggagtctggggaagaagaagattgagggagattgaatgggtacagaaaatcataccaagaaaattttatttctacgatcttatataaagatttattttaatattgaagcaatatccaactaaattgctaagagttccatgtttggagggaatcatacttgcagatttaagttcttgttggagccagttagctcagacctattccacctccttatcagtcatcgtacaaatgcaagcgacaaatcaaaagcaggtgcacatttctctcactactggaaaaaaaagaaagagtggatcaaacacatcctctttctgtatgatcagtgatgcataagaataatgggtagactgatgatctgagatttagctggtgaattaagaccaagaattctgccaggcttgtggaacaaagagcatatcaaatgggatttctttgtggatgctgatggcagtggtaaagtgaaagaggattatttaaatacatgtttaaatattcaaaagctatatgtgctggcatgtaagtgaactagtatttcctttccctccagtgaccttgagatcaaactacatttatcaaagttctcattttatcctcctttgcactcttcctccaacacctaccggcttttaaacgcatacttgtcatggctctaatcaatgtagccgttttgttttgttttgttttgttttgttttgttttgttttgttttgttttgttttgttttgttttgttttattttattttattttattttattttattttattttattttttcaagtcaggatttctctgtgtaatctcttctttgcagaactctagttgtcctgcaccaacctggcctttaattctgcctgtctctgcctctgctgagattaaaggtgtgtgctacaatgtatctggttttgagccactccccacatgatttagagttcagcatcctcagacctgatttgtttcagtctcatgattttttataactacttttcaggttgaaaattgttagcaaatttaatattcatcatatatgcaaatgtagcatgatctggaatatttcaaggattttttttaaggtacaaacttgccttcctgtcattttgaaattggcttgaaacagtgctggccctctgcttaagtgcttaaccagttgctattgtctctgtaccacacagcatttatgttcctgataacccatttgctactttctagagtctgtcaccatgttccttttaaaaatagcattgaaaaataaaagtttgtagtaataatgcacagaatggctcacagaccatttttcttccttaatctagagaaaataaacctttggagtatatatgggcatacacccatggttttattcaatttccagagaattgatggattcatgaaacctacccatagggttttaatcacaaggttatggtgtcaagattgactgatttgcaaacatttaagtaaccttacttgtgcctataccctcctaagtattatagtatttaaaaaagttatattaagatatgcctgtgttttctccttttaattttttgctttggctagttatgggctttgaaattcttgattgctcattagattgatttctaaacaatgaaaatattggtagtaatgtctgtctactcacttccattgctctctacatgtgacttaaaaagaattattttaatgtacttcacaactcatataactatactttaatttagggatgatcaaaacatcgtttgttttaatgacattgtgtttatggatgatagacttccttcaggctgattgttggtaacttccaggcacatagatgctttgttttctgtagcatctatttcagagcttcatattccagccaatacaatattctccagatatgtgcattgaatgagtaatgaattggtagtttgcataaagcttaatttttttaatttattttttattaggtattttcctcgtttacatattcaatgctatcccaaaagtcccccatacccacccacccactccccctttttggccctggggttcccctgtactggggcatataaagtttaaagcttaatttttaaaaaggcatttagtcatccctacttttgcatttttatacattctttttttctcaaagacatattctaacatttttaattaatcctggctaaagattaaataatatacccatgtagtcatttgctaaaagggtgaaattatttttcttcatgttcagagatgagtatagcaagcgaatcaacatatattaatgtgtcagagatggtccagaaagtttagttgtggaaatgatttctctcttttggcattcattgaagacattaagggactatgcaaataaatacactgcttgtcctgaatcacgagctcttgagtaaggtttaaaagttaggtttcaaacagtactctatataattattatctatatttttatttgagaatgttggagtattagttatggttgggggagaggaaacagaacattcttaactttcaatagctctgtgctatcacaatggttaacttagtttgaattcatcatctgtaaaatgattgtgaccaagtaccaactgtatacagttttgtggaaaacacaagtgcagagtacttgcttgtgtctgatgctacaaaggactgaataaacattaaataacatcaccagttttatcttcatggcttaatatataagatgaaggggcaagcttatgagaccttgttttctacactaacccctttatatgcaagttaaacaggatagtctaaaaaactggatatatgaggaaactgtgcaagatctgtgagtagacatgttgcttaaacattggtaaacctggctgtggaagcttgctgaggccatctacactaaatatgtcaagcagcattgtcatgttctcttcaataggaatggaatactattatacaaagatccctgcagtctcaaccatcctcaatatataagctagaaaataattaatctgggactcaggaacacatttaggcagcagatctcagcactgattctagttatctgacttcagacatgactctcaaaattacacccccaggtaattttatgaagttctatgccataaattgaatgcatgtctcttcaaaatttacctgtttgaaacttaagtaccaaaggaatagtattaatcccatacaatcaagaggctaatggaaatgaagaagagcataaaactaagactttacttagatgaacaagaggtgtggctctttttctctttccctaataatagggtagaccactcaccacctttgccaagtgaggttacagcaggaagataattctgaagtatgttagagtgctgtgtgataagttctgctctacacatatgatctcaagattcaatatgaatacaagtcagtatgtctgaagtgtgtcctagttatctgtaattctaagctcccagatgctgaaatattgttgcttcatagacaccactagaactacatgcctcatttaatctgccaagactaatttagcataaacatgggtattttagttagagtttctatagctatgataaatagcatgaccaaaagcaaattgaggaggaaagggtttatttcttcttacaaccagtagtcactcatccagggaagtcttggctagaactcaagaaaggaacctggaagcaggagcagatacagaacccatggaggggtgctgtttactatcttgctcctcctggcctgctttgcttgccttcttatagcacttaggactaccatctcaaagacgccaccatacacaatgtgctggatccttccacatcaatgatcaacaaagaaaaaacaccagagggttatccacaggccaatatggtagaagaatttttcaattaaggttccctcttccaaactgactagcttatgtcaaattgacataaaaattaggcagaccaatgtgtattaattacagcaaacaacatcctttacaaataaatataaataggaaacctcatatatatatatgtatgtgtgtatatatatgtatacatatatatatatatatatatataatttacactatgcaagtcctcttatttgtattttaggatcatttcagagttattatcatttattttgaatagatttctagtaaacttctacttaaatttcaccagataagtgctcagtaagattggatctcttaaacaagtactgaagtaccctaatttgaagagcttgccacatatggaaattcgtgtagaaatttttgttttataaataagaaaaaataaagtatgagaccttagaaggctaggtttgagaaggactacagaatccatatctattatgttttcttttaaaaaatgaaaataattatatatgtatactgtattggcatcatttatccacctcatctctctaactcctactcctctcaagtcctcctcacttgctttcaaccccatggcatcttctttaaacacacatacacacacacacacacacacacacacacacacacacacgtgtgcgcgcgcacgcacatataaaagatactattactaaatttatatagggaattaatgacagggaaaataaactttattatggttccaattttcatttaaactttaatctttgttgttatttaattaaatctttttcatacatgttttcccctcctgtactcctccaagatcctccagccccccatcaactttatgttcattttctatttaaaattttaaaaagttaaaacaacccatatatatatatatatatacacacatatatatatatatatgtagagggagagagagagagaaatcaaaataaggtaactaaagatcaataagacaaaaagatgcccaaagaaagcaagatgagattaaaaatgaaatctacaaaaatactactgaatgccttttatgttggtcaattacttttaggaatagggtctgccctgaggtgtgattaatatatctgatgtgatggtattggagaaaaactgattttcctttgccatgggctatcagttgcagatagcttcttagttatggatgagagcctttctctacttcactttctcagcactgggactctttctggcttgaacatgtgaaggccttgtgcatgctgctgcagtttctgtgagttgatatacatcagtcctctactatctggagggcactcttttcttggagtcatccatcacgtcttgttcttacagtctttctaccacttctttagcatagattcttcccctcttaattaattgattaattaattaattaattaactttacatcctgatcacagatgtaaagtcttcttttcccagtcctaccctgacacctactctctccccattcctcctccttttctccttaatgaaggggaggcccccaatgggtaccaaccagccttggaagatcaagagccagaacaactaagtgcatgttttgctactgaggccaaacaaggctccccagctaggggaaagtgatccaaaggaagacaacagagtcagagacagcacaacagcaactgttaggatacccacatgacgaccaagctgcatatctaatgcatatatgtagggggcctaggtccagcccatgcatactctttagttggtggttcagtctcagtgagtcccttgggcccaggtttgttgactcagtgggtcttcttgtggtgtccttgattcctttggctccctcatttctttaccctactcttctacaaaactccctgagctctgcctaatatttggctgtgggtctctgcatctgtttcaatcagctactggatgaagcttctcagatgacagttttgctaggctcctgtctggaagcatagaataatatggttaatagtgtgagggggttggctctatggggctctatggacctatgggatgggtcttaaattaggccagtaattgattggctactccctctctgttacatattaaaccctgtacttcttgtaggcagaacaaatttatgtcaaaggttttgttggtggtttggtgtccccttccctccactggaagtcctgtctggttatagggggtggccacttcaggctccatattccttgccgctataagtctcagctagtgtcaaccccacagattccccagagcttcctatattcctctggtttgtcccagaagttctccccccacccccacacacacacatcaatttccgttgtttatcccagatttcaccatacatgaatccccctccaggtctcctccccacaccttcccccaccaagtttcctctttccatccacctctgatgtctattttatttctccttctgagtgagattcaagcaacctcccttggaccttccttgttacttagtttctttgtgtctgtagattgcaacgtggttattctgtatttaatggctaatgtccacttataagtaagtacataccacacctgtcattctgagtctgggttatcttactcaggatattttctaattccatccatttgtctgcaaaactcaggatgtcctctttcttaatagctgagtagtattccattgtataaatgcaccacattttctttatccatttttcagttgagagacatctagcttgtttccagtttctaactattacaaataaagctgctatgtgttgtggaaaatattaaaaaatagccagaatgttccaatgcttgagccggcaattctctgcgccagtggcctggcctgccatgcatcagtaggcaattgctgacctgttcttatctcatggagactctgactcagtgctccaaaatctctccaccagctcactaaattcccactggtgggtcattaccacgccaaaaccatgcttcaattcctccatggactttgtggtgtaaatctagcgcgtgtgtgtgtgtgtgtgtatacacacacacacacacacacacacacacacacacacacacacatatatatatggcgacaactagggatattgtcccagaagaaaactgcttttgtctctctgtagcaactatttgtctatagctcttcatctaaggattgggctttctgagatttcttcccaaacacatgataagaaattctacaaatgataatatattataaatgaagggggcttaggagccctatggaattctcagatttctgtctccccttcagtaaatttcactctattgattcttgtaaggaatactcaaagactcagttaggattcttttttttatccaaatcatgtaaagaaatagtcaatttccaacagtagcagcagcaatggtggggttgtttctattacatttttgtgaatctgttgattagttagttcatttgtttgttttgctaaaatctgccaaatgctgaaatcaaatatatctctggagatatatgtgctggaccagaaatttaagaacagacgaaattggttaaaaatattttaatagatatagatttctatcacctttctcctccttttctcctgtatcgactccaaactatccttcttcaaacaccttccatgtcagattgatagcccacttttcttttattactattgttttacacacacacacacacacacaaccttctgagtccattttttaatgtttgtatatgttttgagggcagactactctatcttctacaaccagaaatggggttcatccctgggtggggctaattcttcttccaagagtcattagttgccttcagcttttatctagaagtatgaccccaggaaagtcccccttccacatgaagatatccattgatatcctgttccacattaaaatgtccatcaatcatgttctggtcttgtttgtgcagccattcttagaagagagtgtttcacagagttactggtactcttgctcttattatcattccatgtccacttctttcatgttccctcagccaaatatatacttggtctcctcatgaactgttaagctctggattgtgtccagttgcgattttctgtgatggtgtccatttctttgatgaggggtgttatctatacttatcggtgtacataaggataagatttagaatgtaacaaggatttaggctggtctagcaaaacatcaatatgagaatccattctaaggatcatgacctcactagctacagaagctaactagctttccagtatcagtcatgatttttctcctgttgactgggcctgaagttcaattagacagctgttggttggccctgacatgtgagtgactttgctacacctttttgcatatcttgtcatgctggtaattgttgtgattcataggtattgcagctgagtaggactgtttaattgcttccctccattggcagcttgcatagtattttctggaaccatggatgcttgagtgcaggaaagaagcttttagatcaaatctggctagaatcatgaatctagtgtactaagtttgagttgtattcagcaataggggtctactggaaaacccaagaggcaactaagggcctcatggataatcaatatagttttgggagtctcctgaattatactgattaaccatttgaaaggtctttttattttctgtccctggcactaaagtttttgttagtctatggttctgtaaggaacagtgtcagcccaagtggcttaatttccatatgcgtgtgtatatagtatatttaatatatcatattatatatctaatatatatatatacagtcatatacatacatacatacatatacatataattttagacaaatctagaataatatgattctttaaggctttgtcaagccatttcggtattatttgtctctcacttgcccttctccttttgtattgacttccctgtctctacccatttggagcctcattacattattccattttccaattcatatcatctatatgctcctacctcaggccttcctcccacctctggttataatttcctattttctgtggttgttctatgatgtatactcaaatatgaatatttgcagctgagttacctcattcaatataatctttatttttacagaattcaattcaaggtcattttattttaattttgatacaggttttctcagtgtaacattcctggctgtcctggaacttattttgtagaccagactgactttgaactcaaagaaatccacatgcctctgcctactgaatgctgggattaaaggcatgtaccaccaccacctagcaatataatgttttctgaatctatccatttacctgaaaagtttatgatttcatttttttctttgtggacaataataattagtaaatactttaaagtagattcacaataaaatattgaacatgttctatgcattttgaccagttgtggatttctgtaatggtttccattactgccaagaaagtttttttgaagagggttgagagatacatttatctttgtttataagaatgcatgtctataatgcattcagaaattatatgggtttaggaaagtgtcactagtaggcttgcctatagaatctattacctcataagctatgagtgcttgggtaggtttaaaagtacaaggcataatttccctccgtttgaaaaggccttaaatccaactggacaatactttattccctccatgatataagtgttacacttgaatacttagagacaccttactatgctggtcactgatgtcattcctaggttttacagctgtgtagggtaattagttgctttccttcattgacaccatgcatatagtgcctttagatactatgaaagctagtctcttggaaggaggcttttaggacagttaaagctctattcctccaagccctatgtccaaagagtgtagcatcttaggcagtagggaatttatcttcaagttcagagaggtgacaaaaggcaaagtcattgtctgtattcttggagctcttttgtactttatggaataaaaaagaaaggaggttccacatgtccaggaaattgtttttggttttgtttttttgctgttgttgctgcttttgttgttagatagtctatggctcttgaggggattgcatttgtatcccaattggtatctttattaaaaactatatacaattatatatttacattttaagtaaacttaaaatctatgtctctataaggatttttcaaacacctttaataatttgataatttcccctcatccttcagtattacttttgctctgcttccccagttgctgcccatttgttctttcaaagctgatctctttttactttccttattaatgactataggatacattgatacatctacagcccaagacctagatataaggcctagggaatattgtgggagtgaccacaaaatcacagctatagtcatctaaacaatgagaccaccagttgacattgtattatggatagaggtaatctctcagggtccaatattgagatgaagaaacataagcagttaatggttactgatatgagcctcttgacaagttatccaatccctagttgtaatctctggacacatttttctatgagcaacactgcaacattaaatggattcatcaggaaatatatatatatatatatatatatatatatatatatatatatatatatatataattaaataattacgaatgaataataattattattaaagaaggagatatggctacaatagaagtggctaagagatgggaaaatttggaggggcataagaaaaggtggaaattatataaatatactacatatatatgatattctcaattaaaaacatggaacattttacaatttcactttaaagaacaaacatgcaaccagtaacctctgtatctaaagttaatgatttgagtttagaaggcattttgacagactaaaaagcagtctgtgaactagctgctctgttatatttggttaggagatgaggcatttccttgagatttagtgtgcgttattcctttgaattgtggcagggaggaaggaaagtgacagtagtttgaaatcacctgatgtgtagatggcacttggtcaaataccaaaggtttctgggaagttctctgggttcattgtcagatcaagaagacagggaaatgtcatattagcatacttgttttgcaaatgtcagctttaacaatgctcaggtgacaaacttggtgctctaccatttatttatttattttaatcagaggaaaatcacagttggaaattcaaccagaatattgtcaaatgccattagcctttcaaagttattttcaaaatggtggataggttttcttcccttaaaaagttcaaataaaataatttccagcatgtagaataggtaagggtcgttataataataacaatgatcaacttaaatttagggttcttttaaaatacacgtttacagggagaaaagagaagcacaaatttagccattctaacatgatatttttacatactgcccagccttcagataaccagctgcagtaggaaggtggccaaaaaagggacaatgagcctggctggcttcccaccttacttcctttccaaaaccagtgacttcccttaagaaagttattctttaagaaaacctggagaagattcttgaatatatatatatatatatatatatatatatatatatatatatatatatatatatatatgaatttagttctaagaatataaaccaaaaagaggttagattttttttttcactttgtactccatttgttgtgattgaggcagagagaagattgggggaggggcaaattcaggtaaatgagcaatttattctgttttatacattcttggggatggacctcaattaaaatctaggaaaaaatcaaagaccaaaaagtataattctgctcatatgaaacctgaatcagctaaaagcatgatgtacatacaactattgcatagttgaagtttgttctataaaaatatttccattttacttacaatttagtattagaatctctatgattgttttctgttgttgcatctacactttcataaattcaccgtaattatcaaaaaaatcaccaaaatattgacattggaagtaaattacattttgcctagagaatgtatacaaatgcctatgaataaaacctctgaatcaaattctgttttatccactgactttgataatttgggagaaatgtataacattttagcattctttaagagattgtggttgataacatcttagccctttccctctcctgttcttaacctttgagaaacagcaagttgtaaacaaagatttcactggacatgtaactcacggaaattcagtccttgtattgtctaaaggcgaagaacaacctttaaataaattgccacttcaacatatttgataatatttttttgaacttaggtaaaattctatgtgtgttcctagtatcctttttataaatttgttctaggaaaatataattaattacatagaactggccacatagttaaaaatcatgctattaagcctcactaccagaattcaatacctgggatctctatggttgaaggggagagcctactcctgcaagttatcttctggcctgcacacacaaaacagacacacacacacacacacacacacacacacacacacacacacacatactatacaagtgtaataaaatgttttaaagatgattaaagattatattttttctcttggttttggctgctagaataacctagactgggtattttatgaataacaaatttattgctcatatttttttccggctggtaaatctacaataaataatgccagcagattacatgtttagaaatagcctgttcctcatagatgatatttttccgtgtcttcacctggtggaaggaataaacaacctactttaggcttcttatacagacgcttattctattcatgaggaccctgtccttgtgatataaacatgttccaaaaaacctccaacctcttaatacccttactttaaggattacgtttcagcataagaatttgggggacaatatctgcattaaaaatataccattgttgtttcactattgaggaaagacctgcagaaatgttcttatttaaatagacgattcaacttttctgttttacttgtaagatgttgttttatgtttgtaaattacctgagttacagcaccctaagttttacttccactttcagattgacttagctatgataattatttatggtcccgtttgctttccctattcagaaatatttacttatgatatcataataatctatagttcaattagccatgttagtaaattatataaagaatttactaagtaaactctagtgaatttctttgtttaaaagtgaaactggccatttatttgaataaaatttctggttgattaaattaaaattatgtaataagcaatttcatgtgactatagaggttggaagctctgtctcttcctagtgccattgcaccagaataatatacttcatagtcatttcttcaacaaatatttacagtacttatctagtgtatgttcaaccttgtacgtatttctagagatgaagtgagaaataagacaatgtcctttactcattggtctcatacacaaagttattaagtggtagttgattagttttccttactctggttttaacattgtaattttaataaccaacaggggctcaagtaatcagctgttcagtgctatgtacatgtagggcctatatctccaggatccaggaccactttatgaacaatagaagacagagctgactactcttggtttccacactctgcgctgatgagtatccacatttttcagtggtgtgtgctaactttgaatttttgcctccatttattcttcattatagaactagtacatgccctagataagattttcatatatatggcctatattggaatctaaccctacccaggcttatctttgttttcttcctctaaaataatgagtctaagacttaatctttagtatattagtagtatttagtgttccaatgaacggcacagtttgacaacctcactagtgtccctacatgggggtgagggggtgggggtggggagatgattccatgatattgaaacaacataggacaaagagaagtattttacttggaagagttatattgtattttaagctacaaaaaggaactctcacttgccacactgttgcttgtctatccccatgttctttagtatcacattaaatacatgcatgcagtaatcactatggtttaattatatttaatacatgttatagttgttatatttatcattgtggccagatattggacacaggcatttaaagtaataaggtaataaaggcttggcatcagtagcatgaggcagctggccacatggtgtctgcattcaataatcagacagagatgagtgatgctggaattccaccctttttctccttcctcaaccccagtatagcactccagcccattggatgatgccaccaatattcagggtatgtctttctttttcagttaactctagaaatacacaaaaaatatatacccaaccaaggtgtgtgtcctggataattccaaatccagtctatcaacaatgaaaattagctgttacagtcaggaagcttgcactgtacttggttgaataactttatatggtcctgaaaaatcactgaaagaagaccccagaatcagatagtatgcaaagacaagtagggtttattctgcagaaacaaccagcatgcaggagacaaccattctttgaaatggcgactcagacaaaggcacaagccttcttaaagaaaattaagggaattatgtagacagattaagtaatctaaaatttttgttgattggtgctaggggatcacaggggtcggcttctgattggtttctgccaggttgtcagtggtctgcattccaatgtcatgaatatttaaccataggatgaaataggtctacccagtacagataagatattttcccattcttgtggttatccccaggctgttctttgggaggagtttttatgaccttgtaccttgatttttcggtctgttcctggaactggtcctttatggctttctttttgaaatcaggcctggtccttaaatggagacaaatggggtttgtatagtctttataggggagtgggtgggaggatatgggggacttttgggatagcactggaaatgtaaatgaggaaaatacctaataaaaagtattaaaaacaagttagcatgaggaatttctacctattctattggtttcatttgctcctagtagtctaactgttatgattgacttgtaatttagtagttagaatgatttaatatgtttgaaacattcttctattaactcagatgctactgtttcttttattactttttcccccaaagaatggggaaaaaaatccaacatgaaaattagtttgttatatttgtgtgtgtttgtgtgtgtgcgtgtgtgtgtgtgtgtgcgcgcacgtgtgcgtgcgcgtgcagcttgtagtttaaaaaaaatcatactaaatccctctaggggctgcattggtagtttcacacacacacacacacacacacacacacaccacttccatggttagccctaaggagccttctggccctaattccagtagccagctgtgaagctgaccaaactgttttttcctgaaactgcctagagatagctggttgcattcctcaggccaagccccatagatggtctgtggaaccccaacaacattcccttctcattcagctccctctagtaccatgaaaggaaaacactagagacttatatttataccagttagattcatatcagtaaatatacaaccccaacatgcaggtgcaaagaacacacaactcagttaatatgaatacaagctgcatgcctaggttgggcaaatataccctacactactctattgcccagctaggaaatccctagctacttgtggctcctccaggcaggccatgtggccctgttctatcttctacctcttcttcttccctcttctttctccatcctctgtctcctctcctcttcttcctctttctgtcctttctataaaactttcagctttcccttttgcttccactgcccaatcataggctctagcctttagcttttatttgactgattaagatttttcctgacatcacctgagtatgtgatatactcctcatcggagtgccactcttgagggagcagaaaatacaaacagcaatccacaacatatacaaatacaaatacaaatacaaatacaaatacaaatacaaatacaaatacaaatacaaatacaaatacaaatacatatacatatacatatacatatacatatacatatacatatacatatacatatacatatacatatacatatacatatacaggggtggatatgtatatatatatatatatatatatatatatatatatatatatatatacccatggctataggtcttaaacactaggggaaaacaggatgttattattctgttaaatagatatagtattaaaacaattaataacatattttacccatacctctcaatcttcatcagagaaacttctccatgcaggagatgaaaagtgccacagagacccttaactggccaatatgcagagaataagacgcagcagagtgctcaaccttaaatcggacatacttatcttactcctccatgaaaggctctgagatcttttcagaagaagggtaaaaaattgttaagagccagaggtggtctataacattaggaaactattctgtaggcacatcaggaaagtggcatatatcaattcacagtgttcatgaaagcatcagcaagacctgtgcaagcaatagtcagacaaaataccaacatagcgataagaagataggcatgaattctcaccaatatctggagtgttattgttatttgataactgctgagagatggagagtcagttttctttaatggtgtgacctataatacattgaccacatcccagggcaggccccacttccaagactagccaggcaacagaaagtagattcactttggagagaataaaagaagaaatagcaaatttgggtggcaagggatgaaagggtggagaggcaggttgtagaaagagtatgggggtatattcaaaatatattttgtgaaattctaaagtgatttttaaaaatattgtattgaaaacgaagaatttcaaaagttatatcattataccatccaagcatttcattgtgcatttggaggctgtaaaataattgctggctaagtatttttggcattactaatccaaaagtatagaattaaactataaggtccttgaagatatcttaagtcatggttttaatccctagtaagttcacagtgatgggcatataagtgctcagaaaatatttgatgattttaaaacatcaaaataatcagcttgataattagttgctatttcactgtagagatttcatagaaaatttgagaactatctgcctttcctagtctgtggcaaggagggattttatgcatgcggccccattcccctaatgacaagcactttcacaggctgtgtcaggagaggttgaggtttttaattacaagttgttggtctggttttctgggacattaagcagaggttccgcttactcaatgtataggtttgaaactaatttcacattttagcatgcttttaggattgattaccatggtgagagactgggtcagtgaaaagatccacagaaagccgaaaaggtggcatgatgcgttttagtgaaatcagcacaatgcatgtcaaaatgtgaaagtaatactaacagtgagaatcagctaggttggtgttttgtgacttcatttaatatcaattatatacaaatattagcaacatgattactcctgacacctgaatatgcttctaggttaattctatttatacggatctagctgacttcagagaaaggaatgtttttgtgtaccaaaactctgcagtaaggcccagttagatatccctatgttaattttgattcccctgacctttactgccttttcctcttagaccttcatttctgcacagttaaaaattgtactgtaagaatcttctgtagcagcatgcacaaatgcaatatgcattttctgtcactccctcttatgtggatcaaacacatgctgtgaaataaggaagcacttgaatgacaataatacctcgtactgctgatgtgtatgtgttcaactatggtatttgtttacaaacactaattgactagagatttttcataattttctcatggtgtttatatttgtgctctttgaaagagcctaagctgtcatcagaaaattatagcattatctcaaagttttagttgacagcatgttgtaacatcaagtttcattattttattctaatttcttattgcatcctgatgtgtgtgtgtgtgtgtgtgtgtgtgtgtgtatcacatagaaaaaacagagtagagattagtacagcaggaacactcaatggtcagggtaacttaagaaaatatctgaggatgtcaacttcaatgttttcttgtataacagccctttaggaacaaacaggaatatcttcttttattctctcgcatcttaatttggctaaatcttggaaagaagcagagtcaaacaaaattatgtggatagagttattctcctgtccaaagtcatgccctgccttaccaagtaagaaatttaggcatgtattttcccagtcattttatactttgtgatgagagaattgactgatataagatgaacatctttatgaattgtaattgaggaatatcaaacaccctaaaacacttgaaaagagtagatggaactcaaagaaagattcctgtttactcacatgtcctagaatctcggtataaaattcagtagatactaactacctgtggttatgtttaaatgaacttatccagttaataatccatgccttgggcccataagccatatctccaatgctcagcagctactagtattttggataacactgatagaagatgtttccatcagtatggaaagttctactgaagagcactgaaccagagaagtgaataaaaccaattttttgacaaactaggtaatataatacccttgggaactattagtatttaagtgaaaactacagagcaagaaatgagattataaataggtggcatatattttgccttactagaaagttcaactgctgctatgtgatatattccatgagaaaaacaaatgtggctataaactaaaattgtggaggctgagggttttgttctcctttattttgctttcaggttgattttgttctagtgttttagctaaaggcctttgctaaattaacgaataaattcttggctacatttgtttcctttcctgggtgaatctagtggtgtacgccttctgaaacacagcctcttagggaccaagggaaatgtgatacagcttttctcagacagtctttggattaaaaagtagctgttaccactctggaaatcaatcgaggttcctatgaaattggaagtagatctacctgaagatccagctataccaccttgggattatacacaaaagatgccccaccatgtcacaggggtacatattccactatgtttatagcaaccttacttgtgatatccagaagctagaaacaacctagatgttctacaacagaagaatgaatacagaaaatgtggtttatttacacaatggaatactattcagttattaagaacaaggacaccctgagtttttcaggaaaatgaatagaactagaaaatatcatcctcccttccgctccacttgagccccgggctaccttgccagcagagtctcgcccaactccagcaaggtcccacacaggattccccacgggatcctaagacctctggtgagtggaacacagcgcctgccccaatccaatcgcacggaacctgagactgcggtacatagggaagcaggctacccgggcctgatctggggcacaagccccttccactccactcgagtcccgggctaccttgccagtggagtcgactgacacccgcaagggcccacacaggattccacacaggatcctaagacctctagtgagtggaacacaacttctgccaggagtctggttcgaacaccagatatctgggtaccttccctgcaagaagagagcttgcctgcagagaatactctgcccactgaaactaaggagagtgctaccctccaggtctactaatagaggctaacagagtcacctgaagaacaagctcttaacagtgacaactaaaacagctagcttcagagattaccagatggcgaaaggcaaacgtaagaatcctactaacagaaatcaagaccactcaccatcatcagaacgcagcactcccaccccacctagttctgggcaccccaacacaaccgaaaatctagacacagatttaaaaacatttctcatgatgatgatagaggacatcaagaaggactttcataagtcacttaaagaattacaggagagcactgctaaagagttacaggcccttaaagaaaagcacgaaaacacagccaaacaggtagaagtcattaaagaaaaacaggaaaacacatccaaacaggtaatggaagtgaacaaaaccatactagaactaaaaagggaagtagatacaataaagaaaacccaaagcgaggcaacgctggagatagaatccctaggaaagagatctggaaccatagatgcgagcatcagcaacagaatacaagaaatagaagagagaatctcaggtgcagaagattccatagagaacatcgacacaacagtcaaagaaaatacaaaccacaaaaagatcctaactcaaaacatccaggtaatccaggacacaatgagaggatcaaacctacggataataggaattgatgagaatgaagattttcaacttaaagggccagctaatatcttcaacaaaataatagaagaaaacttcccaaacataaagaaagagatgcccatgatcatacaagaagcctacagaactccaaatagactggaccagaaaagaaattcctcccgacacataataatcagaacaacaaatgcactaaataaagagagaatattaaaagcagtaagagagaaaggtcaagtaacatataaaggaaggcctttcagaattacaccagacttttcaccagagactatgaaagccagaagagcctggacagatgttatacagacactaagagaacacaaatgccagcccaggctactatacccggccaaactctcaattaccatagatggagaaaccaaagtattccacgacaaaaccaaattcacacaatatctttccacgaatccagcccttcaaaggataataacagaaaagaagcaatacaaggacggaaatcacgccctagaacaagcaagaaagtaatcactcaacaaaccaaaaagaagacagccataagaacagaatgccaactctaacaacaaaaataaaaggcagcaacaattacttttccttaatatctcttaatatcaatgtactcaattccccaataaaaagaaatagacaaccagactggctacacaaacaggacccaacattctgctgcttacaggaaacccatctcagggaaaaagacagacactacctcagagtgaaaggctggaaaacaattttccaagcaaatggtctgaagaaacaagctggagtagccattttaatatcggataaaatcgacttccaacccaaagttatcaaaaaagacaaggagggacacttcctactcatcaaaggtaaaatcctccaagaggaactctcaattctgaatatctacgcaccaaatgcaagggcagccacattcattaaagacactttagtaaagctcaaagcacatattgcacctcacacaataatagtgggagacttcaacacaccactttcatcaatggacagatcatggaaacagaaactaaacagggacacagtgaaactaacagaagttatgaaacaaatggacctgacagatatctacagaacattttatcctaaaacaaaaggatataccttcttctcagcacctcacgggaccttctccaaaattgaccatataattggtcacaaaacaggcctcaacagatacaaaaatattgaaattgtcccatgtatcctatcagaccaccatggcctaagactgatcttcaataacaacataaataatggaaagccaacattcacgtggaaactgaactacactcttctcaatgataccttggtcaaggaaggaataaagaaagaaattaaagactttttagagtttaatgaaaatgaagccacaacgtacccaaacctatgggacataatgaaagaaagcatttctaagagggaaactcatagctctgagtgcctccaagaagaaacgggagagagcacatactaacagcttggcaacacatctaaaagctctagaaaaaaaggaagcaaattcaccccagaggagtagacggcaggaaataatcaaactcaggggtgaaatcaaccaagtggaaacaagaagaactattcaaagaattaaccaaacgaggagttggttgtttgagaaaatcaacaagatagataaacccttagctagactcactaaagggcacagggacaaaatactaattaacaaaatcagaaatgaaaagggagacataacaacagatcctgaagaaatccaaaacaccatcagatccttctacaaaaggctatactcaacaaaactggaaaacctggacgaaatggacaaatttctggacagataccaggtaccaaagttgaatcaggatcaaggtgaccatctaaacagtcccatatcacctaaagaaatagaagcagttattaatagtctcccagccaaaaaaagcccaggaccagatgggtttagtgcagagttctatcagaccttcaaagaagatctaattccagttctgcacaaactatttcacaaaatagaagtagaaggtactctatccaactcattttatgaagccactattactctgatacctaaaccacagaaagacccaacaaagatagagaacttcagaccaatttctcttatgaatatcgatgcaaaaatcctcaataaaattcttgctaaccgaatccaagaacacattaaagcaatcatccatcctgaccaagtaggttttattccagggatgcagggatggtttaatatacgaaaatccatcaatgtaatccattatataaacaagctcaaggacaaaatccacatgatcatctcgttagatgcagaaaaagcatttgacaagatccaacacgcattcatgataaaagttttggaaagatcaggaagtcaaggcccatacctaaacatgataaaagcaatctacagcaaaccagtagccaacatcaaagtaaatggagagaagctggaagcaatcccactaaaatcagggactagacaaggctgcccactttctccctaccttttcaacatagtacttgaagtattagccagagcaattcgacaacaaaaggagatcaaggggatacaaattggaaaagaggaagtcaaaatatcactttttgcagatgatatgatagtatatataagtgaccctaaaaattctaccagagaactcctaaacctgataaacagcttcggtgaagtagctggatataaaataaactcaaacaagtcaatggcctttctctatacaaagaataaacaggctgagaaagaaattagggaaacaacacccttctcaatagtcacaaataatataaaatatcttggcgtgactccaactaaggaagtgaaagatctgtatgataaaaacttcaaatctctgaagaaagaaattaaagaagatctcagaagatggaaagatctcccatgctcatggattggcaggatcaacattgtaaaagtggctatcttgccaaaagcaatctacagattcaatgcaatccccatcaaaattccaactcaattcttcaacgaattggaaggagcaatttgcaaattcatctggaataacaaaaaacctaggatagcaaaaactcttctcaaggataaaagaacctctggtggaatcaccatgcctgacctaaagctgtacaacagagcaattgtgataaaaactgcatggtactggtatagagacagacaagtagaccaatggaatagaattgaagacccagaaattaacccacacacctatggtcacttgatcttcgacaagggagctaaaaccatccagtggaagaaagacagcattttcaacaattggtgctggcacaactggatgttattgtatagaagaatgcgaattgatccatacttatctccttgtactaaggtcaaatctaagtggatcaaggaacttcacataaaaccagagacactgaaacttatagaggagaaagtggggaaaagccttgaagatatgggcacaggggaaaaattcctgaacagaacagcaatggcttgtgctgtaagatcgagaattgacaaatgggacctaatgaaactccaaagtttctgcaaggcaaaagacaccatcaataagactaaaagaccaccaacagattgggaaaggatctttacctatcctaaatcagataggggactaatatccaacgtatataaagaactcaagaaggtggacttcagaaaatcaaataaccccattaaaaaatggggctcagaactgaacaaagaattctcacctgaggaataccgaatggcagagaagcacctgaaaaaatgttcaacatccttaatcatcagggaaatgcaaatcaaaacaaccctgagattccacctcacaccagtcagaatggctaagatcaaaaattcaggcgacagcagatgctggtgtggatgtggagaaagaggaacactcctccattgttggtgggattgcaggcttgtacaaccactctggaaatcagtctggcgtttcctcagaaaattggacatagtactaccagaggatctagcaatacctctcctgggcatatatccagaagatgccccaactggtaaaaggacacatgctccactatgttcatagcagccttatttataatagccagaagctggaaagaacccagatgcccctccacagaggaatggatacagaaaatgtggtacatctacacaatggagtactactcagctattaaaaagaatgaatttatgaaattcctaggcaaatggatggacctggagggcatcatcctgattgacgtaacacattcacaaaggaactcacacaatatgtactcagtgataagtggatattagccccaatcctaggatacccaagatataagatacaatttgctaaacacatgaaactcaagaagaatgaagactgaagtgtggacactatgcccctccttagaattgggaacaaaacacccatggaaggagttacaaagacaaagtttggagctgagatgaaaggatggaccatgtagagactgccatatccagggatccaccccataatcagcatccaaacgctgacaccattgcatatactagcaagattttatcaaaaggacccagatgtagctgtctcttgtgagactatgccggggcctagcaaacacagaagtggatgctcacagtcagctaatggatggatcacaggactcccaatggaggagctagagaaagtacccaaggagctaaagggaactgcaaccctataggtggaacaacattatgaactaaccagtaccccggagctcttgactctagctgcatatgtatcaaaagatggcctagtcggccatcactggaaagagaggcccattggacatgcaaactttatatgccccagtacaggggaacgccagggccaaaatgggggagtgggtgggtaggggagtgggagtgggtgggtatgggggacttttggtatagcattggaaatgtaaatgagctaaatacctaataaaaaatggaaaaaaaaagaaaatatcatcctgattgaggtacctcagacctaaaatgacatgcatagaatgtactcactaataagtggatatcagccaaaaaacatacagaatacccaggatacagtccacagaactcaagaagattaacaagaagaagggcccaagtgaggatgctttgattcacttggaatggagaagaaagaagagggcagagggagggagggacctggttgagtaaggggacagggagggaaaaggggaacatgatcaggtagtgaggggcagaagaaaagccctgagggccagcagaatgaatggaaatatgcagcctcaaagatatagacacaggggaaatattcctaaacagaacagcaatggcctgtgtaagattaagaatcaacaaatgggacttcataaaattgcaaagcttctgtaaggcaaaagacaccgtcaataagacaaaaaggccaccaacacatcgggaaagaatttttaccaatcctaaatcagataggggactaatatccaatatatacaaagagctcaagaagctgaactccagaaaatcaaataaccccattagaaaatggggtacagagctaaacaaagaattctcaactgaggaataccaacgggctgagaagcacttgaaaagatgttcaacatccttaatcatcaggaaaatgcacatcaaaactaacctgcaatttcacctcacaccagtcagaatggctaggatcaaaaattcaggtgacagcagatgctggtgaggatgtggagaaagaggaacactcctccattgctggtgggattgcaagctggtacaagcactctggaaagcagtctgacagttcctcagaaaactggacatggtactacagctagatccagcaatacctttcctcggcatatacccagaagatgttccaaccggtaagaaggtcacatgctccactatgtttatagcagcctataatattcatagtagtcagaagctggaaagaaccctgatgtccctcaacagaggaatggatacagaaaatgtggtacatttacacaatggagtactactcagctattaaaaacaatgaatttatgaaattcttgggaaaatgaatgtatctggaagatatcatcctgagtgaggtaacccaatcacaaaagaagtcactctgccctgtggttgttgttgaagatgtgagtgctcagctactgaccatagctgtatacttgaagccacattctctactatgatggtcatggactcacactcttaaactgtaagctgcaagtcaacattttcttctctaaatttcttttgtaatgctgtcttagcaaagcaataagaaaataaccaagacacctaagcaaaatttttcaagagttttaaagcaaagtgatcgaagaactaaagaagtcatttcagacattcagttgcaaatgttaattcagagttgagatatcaaatggtagtcaagaaaggaaaactttctagaaaacaaatgatttttaaaaaatgtacatgtgaaatgaaacttgggtgttcagtcaacaaaagcaaacaatgtgaagggttgtagggaggagccaaacaatagctagaaaaatatagaaaatcatcaagattatctcaagagattgcaagtattgatatagctagaatggaggctacttccttgggattcacactcctatagattctaaaaccggaatctataatggatatcattatttcttcattagaaagttattaaaaaatctaccctgttccctttaaggggatgctttagatgttactaattgaaatctcgaagctaaaagctaaattgaacaagatacagtctgtgccaatctttcatttacattttcagttgtaacctgtgggtcattctattgaactatctgaaagctgtaggtgaacatcacatgaaaggatatcaagaattatagtgctttgaaaaaggtttatatttacaggttctttaagagcgttaaagcagaagtaactggcagtttctgaggaaacaagaagaaggggaggaggaggaagaaggaggaagaagaagccatgcttccggatctttgctttgtaattcaaaataaattacattaaaaaaaaaagatctgggtggtattgaggattgaaccttgggctgtttgcatgctaagtaagcactttactattgaattatgtccacagccacggggatacaatagtttatgtgcactagctgagacaggttactatgtcacagagaaggtaaaccttagacctcattactttaaaagaatatttagtttcaaatgaagcaaaatgatagtatagaaaatatataacttaaaacaagctgtcatagacactaaaattttagaactggctcccctaaaagtggttggttgaaagtgtagcatgggtaccctattatttcacttgcataaaattaacacatcataactaatagttatttccaattacgcagtagcaaatgagtcctaagagagattggaataagatctgtgatagctttggtgaattcttgcaattgacagtttgtcataccacagctttagattatgtgaaacctgacaaaagaatgtagcctttctgggaggaaggattcttttcagttctatcctgttgaaaatgtttgccatggagcactaatgcctttaatatgcaaatgatcataattgcatttattacactgtcaaatgcaagctcaaatacccattctttgtttcacaactcagcacatcacacaaaataagagaaaggactgctttcatcatagacttcttaagaagaagaactaattctatttcccctgaagtttctttcaaatatgttatttaccaccagccctgaagtataaaaatttagttgctcattgaaggactttgctattcatattttctccttagcctcatgtgcacagcacttgctgagacagattgtgtctttgaaggagacattgcgctaaagtaccccatatggcttttattcttattttttcttgatctttttgtacttaaaaaatcccaaatgtctcatttttctcttatctcttaaacaagaacaatattttttctcatttattttcacagtaccctccactcactcacctgggtttctttcacaagaagccccgcctggatgccctacatttttcccagtattagattaggtacctgtgaaggtgttgagggttggtgcaaagagaaggaaaaggtgaaaacagtggtccacttcagtgaaagctgtttacagctgtgatatttcagaagacatttctagtttgtggacatgctccctaaagtacttctatttggaacattaagtaatgagttttctcactgcagtgtctggactcagattattatcagagcctcaattgcctgactggcagttaggtacgtttttcctgtcttttctctatctgtgcctttcatatttcattttttctccacctcctgggattggaggtttcttactgtcaattaatacttcagcatccccaatattttattgttttggttagtctgtctatgttttattcactatacccttcaccccatttctgtgctaggtaacttgtgaccttgggaaattcctgcctaaaaccatttactcttcatttcacttgaccaaatctcagaaatgtgtaagtcttcaataaaatacagattgtaggaatagagcacattaagccaatgtcagccaatagcttcgctatactaatgaggttgctagagttagtataggcacaatccaggcacaatgaagtggggcctaaaataaataatttggttaccaatgagaagagaaagggtcgatatatagaatagtcccatgaagaatttaatctcttcatattgttgtccttataagaattcagcccttttttcactagtttttccattgtctagctctcaaattgttcatctgtacacaaagtagactattagaaactcacttatcctattgaacttgttcagtggcttctcactgtataaacgataaaaatctagctcccaggcatggttaagtgctcagaatttgatccttccacctggcttctatccctcacagtcattcagtcttctcacttttgagagttttgtttgtttgataatgtttcaattggatcttatttatttagcatgcatgcgtgagaggtgggtgggtgcacatagagaggccaaaggccaagttttaggagtcagttttctctttccatcacgtgaatcccgggaatctacttcaagtcaaccagctttgataatgatagctttacccagaaaatcatttccccagcctcagtttgcatttgagctctgcaattgtttctattttcccttgtgatccctgtgtgagtcgagagataattttgcttatgttatttcttatataaggaacatacttactcttattttggggctaattatctagactgtggttaacacatagtctggtacataggagccactatggttgttttgattcagtgttcagatcaatgaatgatatctcttaagattttgctcaaggaattcttcactgactacattcacacaatttctttagttcatgttaggcaagaagttgctaatcaaaatctctttagattcctcaattatacttaccatagagtgaggatgtgaacatctcaaaagttaaagatcatgctgtatttgtctctgtgtccctaagagctgaaaaagaggggatctatttgaaaagtaatggcatggcaagtcagttctctctctctctctctctctctctctctctctctctctctctctctctctctctctctctgtatgtgtgtgtgtgtgtgtgtgtatggtttgagcgatgaaactcagtgcctaatatgttatgcaagtggcaaatggtctacaaaaggatgtataactttaacacaataaatgtgttttcaatttaatctttattttagagaacaaagattggtaaataaataatatgaagctcatatctgtacttctaacaataaactaatctcttgaaaccagaaaatcatccttgcagccctttgatatactaacataatgccatacatataagtcatcatactcatatatatatgtatatatgtatatacatatatactcatatatatatactcatatatatatatatatatatatatatatatacacatacatacttatatagctgaattgctatctactttatacatgccaaatgacaaaaactccttaagcaagtctcaaccaaagctggctctatgaactttcctatatcagccttgctgggttatctttagaactcttttagtagtgtcatccacagacaaaaagatgactggtaaagaactgccaggacagtgattatttatgaagaataaaaattgttagggtctaccgtagattcaaaatgttcagctgttgtattgttcctatagattcatgttaagtgctcccagtgaggttatattcccatcatctgcttctcagtatttgaggataggatatgtctctggaaatggttgactgtttatttggggttagatcaggtttaccacagtgatttaacctgcaatgatgctacagtttgcatttgctactcaagactatacaatgtttccagtttatatgtaacattaatcctcttatttcttgcaattcttaaatgtgttcattgctctaaagtctcacatattgaaaactgcacaccactttgtggtaatatatacacagggccttttagaggtgatcaggccgtgaatgtggagctttcaatgagtagagttaatgttcacataagagtggatctagggacttgtttattctttccactatgtgaagacatgttgaactttgatcatcaaattcccagctttcagaactttgctcaatagatttctgttatatatatatatatatatatatatatagcatccagtagaaatatccagactagattaagaaggcatgctcttttcataaacaagttaaatcttctttttctttctaaggtggtccagaaggctctctttcctctcctaatatttatcttttgtttctaaattggcaatcaaggcattcctaggacccttccatctcatttttacgttactataaaaatctcataaggctacaattctagagatctactcaatgatggaacaacagtaaaagattctcagtcctatttatctactctatccaagtagtttatgattttccaaatttcttatctgggcagtgtaaactttatccttttattttattgtaaagaaattcagctgagccctgtggtacagaccttcaatcctaccactcagaaggcagagtcaggaagatataggtgagttcataggtcagcttgttctacacaatgaattccaggcaagccaggggtatagagtgaatctctgtcacttaaaaaaaaaacaaaagaaatacaaacataaaacataacacaaagcaaagaatctgttgatccttgcttgaaactctcatagttttaagtaaatcgtaagtatattgagatataaggagtgcaccatgtaatccatatatatatgtatataatttaatggaatttcatgtatgcaaacttttactttctttatcatcaattttgtcatctatttgtcactctcaaaagaaactccagaacttctgccaactaaaaaaatatttctcataattgccaccatattccctagcaatcattaatctaccttttcacttttctagttctgaaaatttctcgtatacatggaattatacatctgggattttgggtctgtttaacaactactccatcttgtatcagaatttatttctgagggccatattatttaattgtaaaatattttcttcactcattaatggatacacatctgggttttttcattgttttttgattattagaaatagggctgctatatagcatggacaggcttttgtatgtatataccagtcttatttattttgtgtctatttttaggcacagaattgttaattcatttataaaataaattttcaagaattccatggagacagaaacatttacggtattcttttattgggtaaaagaaaggcattgacctttctgccctctaattctgtagggttaaaatatccctagtcattaaagaaaattgtctccccaccctctcatcaaggtaattaaagcagatcatttttggtctgaaacatcttataatgaagtaattggcttgttttttttctcctcctgtcaaaagtcaacaataaattaacagttgtattgtcatctatcctatttcaaagtcataatgctattctcttaggaaatggattgtgcccatatatgggcaaagctaactaccaagtcagcttgttgttacttccaggctgtaatacatagagcacattctcacaagcctgtactcatagcattgctgatggcaattataatgtcctaacttgcatttgttatattcatagcagcaatcagttaacaacatacacaggaacttatatgaaaagctactattggcttttataaatgatgttataaatgtgtcatttaacatatttttgaaagacctatcttttattcttatttttttttctagcaattgattcgaattcaggaatcctgatttggagtaaaggaagtagagaggcaatcttttaaagacagatctgagagtagggaagatattaagccttaatctgccattaaagaggattttttttgagttgccatttgatttccattaatgggctcaaggtattactctgaatctaagactaaggaaattttcttaagtatctagatcatgctatcattggaatgtctagactagcccaaattcacatttttgaaaacaaatttcagtgaaatgtcattatgatgtggggatttgggggagatgattaggtcatgaggtgtcctcatgaatagaatctttatcaaagaggcctaaggaagtctgttcatttcttccactatgtaaggaaataacaaaaatttgacagttttgaaggaaagaacaagcccttggacagagtgtgcatctgctggtatccttatcttctaggtttttttggggggactcaagatctatggccaacatatttctactgttaacaaatgtagtttaagcaaaatttttatagctgtagaaatagacacatacacacacatgcatgcatatgcacgcatgcacacatacacaatgcactttttcatttgggcttctaagataaaacaaaaccatgaattcatgcacagtgcaaaggatgacaagaaatacaagctaatttctcagagcctgaggtgtttcaaaagaataagaagtgctgcttatgtgggcacttccctcatttttgactttttgtagggagaaaccatgaagtcttctttataaatgtcaaatatgcatttaaagtttatttataaagcctcatctcctcagaccaatacatttcattgactgactgaaaagcataggaagatgaccatagtgaaagcctttcagagaaagatctgcaaaatatttaacacgtgataagactagtagagaaaaaaatcaatttaacatctgttccttaacatctgcttcctgctgtgcccatatctctgctgcttcactgtctgtgtattccttgttttcacgtataaaatagtagaaacaagagtttacaccacttaatattgtggagacagagaataattatattataatactatggtggggggaaggaaggttcaacctgtaaaagtgcttgctatacaagcctgaccacctcagtttggtccccagaacccacccatgattaagattgtattattctaaggagccacagcatagcaaaactacttcttttgttgtgtactaacttccgtaatcaaattaaaggacacatttttatgtgttatatcattcatttaaacctttgtccatgttggagattggacacaaagcctattgaaagagtttatacaggctattttctttttttaattttttattttattttattttaattaggtattttcttcatttacattttcaatgctatccccaaagtcccccataccctcccccccacactcccctacccacccactcccacttcgtggcccaggcattcccctgcactgaggcatataaagtttgcaagacaaatgggcctctctttccattgatggccaactaggccatcttctgatacatatgcagctagagtcacaagctccggggtacaggttagttcataatgttgttccacctattgagttgcagatctctttagctccttgggtactttctctagctcctccattgggggccctgtgatccatccaatagctgactgtgagcatccacttctgtgtttgctaggccccggcatagtctcacaagagacagctacatctgggtccttttgataaaatcttgctagtatatgcaatggtgtcagcgtttggatgctgattatggggtggatccctggatatggcagtctctacatggtccatcctttcatctcagctccaaactttgtctttgtaactccttccatgggtgttttgttcccaattctaaggaggggcatagtgtccacacttcagtcttcattcttcttgagtttcatgtgtttagcaaattgtatcttatatcttgggtatcctaggattggggctaatatccacttatcactgagtacatattgtgtgagttcctttgtgaatgtgttacgtcaatcaggatgatgccctccaggtccatccatttgcctaggaatttcataaattcattctttttaatagctgagtagtactccattgtgtagatgtaccatattttctatatccattcctctgttgaggggcatctaggttctttccagcttctggctattataaataaggctgctatgaacatagtggaacatgtgtccttcttaccagttggaacatcttctggatatatgcccaggagaggtatttcgggatcttctgatagtactatgtccaattttctgaagaaccgccagactgatttccagaggggttgtacaagcttgcaatcccaccaacaatggaggagtgttcctctttctccacatcctcaccagcatctgctgtcacctgattttttaacttagccattctgactggtgtgaggtggaatctcagggttgtttggatttgcatttccctgatgattaaggatgctgaacattttttcaggtgcttctcggccattcggtattcctcaggtgagaattctttgtttagctctgagccccattttttaatggggttatttgattttctggagtccaccttcttgagttctttatatatattggatattagtcccctatctgatttagtataggtaaagatcctttcccaatctgttggtggcctttttgtcttattgatggtgtcttttaccttacagaagctttgtaattttataaggtcccatttgttacagcacaagccattgctgttctattcaggaatttttcacctgtgcccatatcttccaggctgttccccactttctcctctataagtttcagtgtctctggttttatgtcgagttccttgatccacttagatttgaccttagtacaaggagataggaatggatcaatttgtattcttctacatgataactgccagttgtgccagcgccatttgttgaaaatgctgtctttttttagctcccttgtcaaagatcaagtgaccatatgtgtgtgggttcatttctgggtcttctattctattttattgatctacctgtctgtcgctgtaccagtaccatgcagtttttatcacaattgccctatagtacagctttaggtcaggcatggtgaatccaccagaggttctttcatccctgagaagagtttttgctatcctaggttttttgttattccagatgattgcccaacgaattatacaggctattttcaaggacacctaaatgtttaggcagaaaacttacaaatacagtttgtttgctaaaacatttgaaatttccttctacctttaccaatcttttctaagtacgtattgaacatacccccttttttaaaataaatatattccaaagaaactcaaaattaatctttcaggtagcataattagtttaattttttctttcttgctacccttttttattagatattttctttatttacatttcaaatatatcctttcctagtttcccctctgaaaaccccctatcccttatcccctccctctgctcaccaacccatcctctcctgcttcctggccctgacactaccctacactgaggtatagaaccttcataggaccaagggcttctcctcccattgatgactgactaggccatcttctgctacatatgcagctagagccatgagaccctacttgtgtactctttgattggtggtatagtccttgggaactctagggttactagttagttcatactgttgttcctcctagggggctgcaaaccccttctgctccttgggtcctttctctagctccttcattggggaccctgtgctccatccaatggatggctgtgtgcatccacttctgtatttctcaggtactggcagaacttcacaggagacaggtatttgaattatattttccccttctgggatatcttctgcttttctttatcacttaaacatgttaaaatgagccagttcaggcacagtgatgcacaccttaatcctagcactcaggaggcagaggtaggtagatctctgagtttcagactagcctgttctacagagcaagtttcgggcatctggaactacacagagaaaaccaaaacagagaagaagaagaagaagaagaagaagaagaagaagaagaagaagaagaagaagaagaagaagaggaagaagaagaggaagaagaagaggaagaagaggaagaagaggaagaagaggaggaggaggtggaggaggaagaagaggagctaaaatgtatgactttatctaatgtggatgtagttatctaggaaagtagaagcctcactgactgaaaattaagggaaaaaaaagagtctgaaagtttacatctgtgatccaagcgctcctatgaaaagattgtattaaagacttagctaaatgtttgtgttctgataagatgtgtcaaaatacacctgtcaggttgttacagtgtgactagtagtttaaactttgaccaagaattttattgaaagatgacttatttaaaaatccaaagttatttttctgtgtgtgtatgtacatgcatacttgagttggtgtggctgtgtattcatgcaaaggttaaagaggctgttgggtgtcctcctctattatttttttgtctgttttttttttttgaggcagggtttttcatgagcctggggccattactttaaactagcctgccaaggcctcaagcagagacaatcctccttaaaccactttccttagagatgccttgcatggggcatttggctccttgtatgtgtgctggggtaagaactctgctcctcctgactgggcagcaaacattcttatccacagaacaatcccttcatttccctctgtattttggttttatttcctagaaagagatgaccatatgttgtttccatttccttatctctcagaacatcctgcatcctaggaagataggattgtttcctaaatctggcatcctaaaaaaaaaaaaaatatttcctctcaaatgacaaggatcggaattgttgaggttttgtttgctctgtgttcaaggtctcggcttatatcactctcctactcctttcttttgatcctcccctgatctcttgttctcctttttagtgggtggttttagcaggggagtgaagcaattcacttacccttgaacaaaggctgtcttctctttaacaaagacagcaacttcaggagagatgcatgtggagcaggaaagaaggaaaggagacactgttctagccagccagatcagtgaaccaagaatcaaccctggctatcagtgaagtgacagatatggtagcaagatctctttcacaccctgttccccgccccccaccctgtgcttgccctatctctcacatcacctccctgctctccctcatttcatgcctccattccttcctcctcctacccactcctcctcctctctgattcccctcaccaagtctaactctgccccctttccttcttggctcttattctcctgtacacctgtacattggatccagggcttcacacatgctaggcaagtgctctactactggcctacatgttcgacactctttgaactttaaagttttaaacaggatcttatcaagttgtccaatatttccttgaactcactctgcagtcaacccttgaaattgtaaccctcttgcctcggcctttcgagtagcaaagattccagatccacagcactaggccagttccttctttttctttgtatatgcattcatagtcatgactctgggggagtaactttaagagctctcatcagccggtatcaacagctctgatggttttacaaacctcctatcataagctcacttagtctaagaacaaacctgtcaccctctttaccaatccaatttgatgccaacttttaattttagtagtacgaatcagtctgaaaacttcccactcatttgttattcatgtttctgattcccctatctcgtcaatcatccagtcctgctgatgccttctatgtaatgtatctcatccattaattcttttggattcccaaggtctgaatattttccaggcctcattatctctcacttgtaagagcataataaccttctagtgggtctcttggcttctgcagtacttaccccctactgtttttttccatttcatatccttatcacctgttctgctgagacaatggaggaaaacactcaggacagattgaaaatcaatggaaatagagtagtgtgaagtcagaggagcacacactcatagttggttggagcaatcagggaaagctttaagaaggaaatggaatttagaatttgtattttaaaaaagagagatcttaggacagcacttatgattgaggaaaactgtgaacatttttttttttttaagaaatgaaagacaagctagagaacattgaatgggcttggctaagcctgggtattgtatgaaaaaaaatgaggtttgaactatagtctggcttgtgcttatgaagcaaagtctccatcaagcaaaagcattttaaatgcatgctataggaaacggggagagacgtggtgaaaatggcattttgcgaagacgaatctggcagctgtgtgcagagtagattagtgggaggagatactggatagaggaggcctagtgaggaggtcataatagagttcagatgtgagttaatgatggctttgaataggaagatactgagagcacagagaacagaactgatgaggaggatgcagatgtgaaaagcattatggagacagatttgagaaggtccctgagtgtctgaatttgcaggtggcgatggaaggaagtgggaaaactggagaacacatgatctgggtagtgtctattgaaatgttctcattcttggagttttagggtttcttcttctgaaaagtgttgtccaaacagagcactgggtgcatgacaccttgtttataacagataggcagagagtcactccagctggcattgactttgcacgctgtgccagcgaaaagacccaggactctatttatcaggagcttagcataagcgtcatgctttctaccttttctcctcagggaaacagatgacatgggttaagtggcctgtctaaggttacccagttaatgactacacacaaatgatttaaggagacaacatcctttttgttgttgttgtctgtaatgaaaatgcttatgttcatagaatgtaatttgttgagacctgacctagtgatccaacctgaaagccatacttatttgaatatttgctctgaggctattttactttgagcataaaaaagatcagaagcctcccaactgcacaaaccatgcttcatttgtagataattattctaaacagtctagttctaggcctgtagcatttggtgacaattattctctttgcttttttcactcattctcttaaaggactcgactaactcatctactgattttcttccctcttcattattatgatgggcaggattgcaagcttaaatatgttactacacttgagcctcagttattccaaagactttcagtgtcttccaccaccctggtctcttttcatcttctactactgtttactggattaggtcacatcattctgtttcagcagcatcttggaagatgctggtttactttcttctaagattcctggctgtggtgtaggttctgtgcttcatggcaaatgcagattgtactccatctgaatactttaacaacactccagaaactgaatatatttgcacaaatgataagttttggttgtttaattttgtaactatttaaattttgtttatttatttgcatttttcaagtttttacaattgaagtgaactatatggccgttcgtctctggagacatttgatactgcctgaaaaatacagtttgttttatgagtcagatagtttgaatcaggcagaagaatgaatatatccataaacaaatatttatttgattttgactttctttttcccaaatgtctttctctcatataactgatgacaatttcttcaagcacatacatttaaatatttctttaacttgcgtaagggctaatggactcaataataatactcattagagacaaaatgttgcaggaaattctcagttgtgtataatattttagagccctgcattttaatgcctgatctacttcttaagtgttatgagtgagaacttactagatctgcctgatttcccctgtttataaaatagtgttagccttttatctaagtaacacttttggattcaaatggaaaaatatgttttgaaaatgcacagtatgggcattgcagagactcacaggaatctagcttagtacaaccagatcccatagaaactagaaggagggacgggaaaaggcaacagaaaataaggttacttgcccctgccacaatcttgacattttattgtctgtagatttattccagtctcaataaaaattacagcaatttaaaattttatccatattatagaagctttaagttcacagaaaaaaataaaagaagggtacagaagtgccccaattagtcaccttctgcatttaagtaatagcctcttccactagtgatttattttgtttatcatattagccattatttgatcaacaatcaatgaaatcaacttgacacaatataattattcttattcttagtgttgtttattgtgtagataataaaaatataatggcattatcccatgttataactcatcgagaatattttttaaaaaattcagtgtaaagagaattaaaatgatgacatgaaacaaaatgggatactgagtacacactactgagcaaacatgcggtggtaagttatggttaaggtcatatatccaagtaaatgggcaatagattattattattagggttcagtgattttttttattactgtgacatgtatacatatacataaacatataaaactaacctgctgagtatgtttagtattgctcatgtgtatatgttttaaaggcctgccacatggtagggataaccaattaaatagttaatactcagaaaagattgattccttttcactcagaagacattaattgactgtagttctgtagttcttcatctgtggggctttgtgaaatttcaatcatacacattggcatgtcaatcagagatgccattttttcaggtttttgttaggcaaatgttctgtccaggttttgtgagagtatttttccttaatacacagaggatacaaaattgaagtagacatgctggtcctctggcacttgtaatatttctaccttcacttttgtgatgtaggagttgtactttagaagatgtatcaactggtgcttggcaccccgtagtcaattcttatttacattttgatcaattatgctttctgtaacaagcactgactgctacataaagaagtttctttgatgaagggttagaggtatacttatctgtgagtattaagataagaaattagactgcagttagaaattatactggtttgggatctggttagtagagagtacatactctgtatcctacatacaaacccttgcatttctccatacatctattgtattcttctctttctcctgctgacttcattgtatgacccctggcctcaaatggcccatgaaagtttcagtcttaagtgcagcattttcttttaccttagcttccacaaattattagtctctctctctctctctctctctctctctctctctctctctctctctctctctctctctctctctccttccacttacgatatatgagtagaaaaattattggtttgacctattttaaagacagaactaataagtcatatgttgctacatagcctacagaatcaatatacttgcttcaagtgtccacattggtccaatcattttgtgactgctaggactatatgctggttctgttgagattatgagggaggtgaaagattgcacaaactataatcctgaaaaatatgtaggctgaaacttgatccttcaaatcctacctacgagaatgaaactcttatctgaaaaatactatttagtatgagacaacagagacagcactttagcaactagaaattgggtagcagatattttgattgttgttctaacagaagttcttctataaactttggctgtcttcatctttcaggtgagtggattgtaacttcttgcttgaaaagcaggttttaatttctagaggctagcatcaagttgttttctttttttttcttttccatttttattaggtatttagctcatttacatttccaatgctataccaaaagtcccccatacccacccacccccactcccctacccacccactccccctttttggccctggtattcccctgtactggggcatacaaagtttgcaagtccaatgggcctctctttccagtgatggccgactaggccatcttttgatacatatgcagctagagtcaagagctccggggtactggttagttcataatgttgttccacctatagggttgcagatctctttagctccttgggttctttctctagctcctccattgggagccctgtgatccatccattagctggctgtgagcatccacttctgtgtttgctaggccccggcatagtctcacaagagatagctacatctgggtcctttcgataaaatcttgctagggtatgcaatggtgtcagcgtttggatgctgattatggggtggatccctggatatggcagtctctacatggtccatcctttcatctcagctccaaactttgtctctgtaactccttccatgggtgttttgttcccacttctaaggaggagcatagtgtccacacttcagtcttcatttttcttgagtttcatgtgtttaggaaattgtatcttatatcttgggtatcctaggttttgggctaatatccacttatcagtgagtacatattttgtgagttcctttgtgaatgtgttacctcactcaggatgatgccctccaggtccatccatttggctaggaatttcataaattcattctttttaatagctgagtagtactccattgtatagatgtaccacattttctgtatccattcctctgttgaggggcatctgggttctttccagcttctggctattataaataaggctgctatgaacatagtggagcatgtgtccttcttaccagttggggcatcttctggatatatgcccaggagaggtattgctggatcctccggacttctatttgaaaaataacaaccagcctcccctataatgggattaaaactgtgtaccaccattcaaaataccttagtccttaaaaaatagtagattctatcatctccattgttatcttgctagtcaatgtcatccccacctcttccttgtcctgtgtgatttcctggtttggactacatgataaaatagacataattagtttttcaggagatggtgtaaaacccatgtagtatgggacttagttccatctttactattaacttgctatgcaaagcaatatgaataatttcactctgattaaaggaggtcttgctatttctttccatactatactaatctcattttacttctcaatcctccaggtatagtaattacctaccagttccaagtggctccctacccacttcactacatctagtctgatggcttaagaaggatgcttatttttgtttcattttgggtatttatacttttatgtacatttaaaaattttcataattctgtggaatggatatgattttattatgattttaaagataagggaaacaagctcttgtatcattaagcaacttatgcaagctgtaacaagagatagactaaatagttccaggttgcctataagattgttttttccatttttttttttttatagcctagaggttggtgagaagttcgattgtaatgttccacaaaagaggttgaagaaatgtcaagggctaacattgtttctgctcagattgagaaatcaagcatacaacaaatcccaagctctcactgaagacattaaaagattttttccctcccttctttactaccaaaagaagagtgaagggaaagtctcctccatgaagtttctattgctataattaaattgctgaaagccattttaaacagaagaagcttacttggctcacagaattcaaagatgaaaattcaaaaagcatgctacccactcttataaaggtctctgtggctatataatgttaccatagatggcataatgcaaatatatgtgagattgagaggcacaatgtgagacaggaagcctgtgactggagtcccagtcttactttctggtaagaacattttcataagaaacaagagcccccaagagacctaacaaaagcactataaaagctgtactcttgccttcattgaatatggaggttaggtcaatatctgaaataacctaaccattaggtatctattaggaagccaccttttaaggtcccaccatcttcaataacagagaccaagcttccaactcagaatttcttgtgtaacaattcatatgtaatatttacaaaacctaccctatagccttttggtatagaatttgactcatcagtgccaagttgggagaaatgggaacaaattacaagcatttcttctggaaatgcattgctttctacacaaagaattattagacctgtgaaattttacactctcacttatgggcagacatgtaatgtactttggtagactgcttgccactgaacataggtagctgtttgctctgttttcacaagcctttccatgagctctgacatttggcttcatttagtggaccaggtgatttttccatcctccccacaaactcacacactttgtattgaaagagaccttaaagttcacctatcccaagcctctgacatttcctcaggggaaaaaatgacatgggttaagtggcttgtctaaggttactcagttaatgactacacacaactgatttaaggagacaacacactttttttgctgttgtctgtaatgaaaatgtttatgttcatagaatgtaatttgttgagacctgacctagtgatccaacctgagacccatactgatttgaacatttgctctgagctaggtagagttaaaaaaaaacctatgccagcttctgtcatgtgtattcctttacctcaaaactggattctgaagactgggagaaatctgaactttccttgtatacttcttagttcatttacaaatatatgatgcaattcccagcttcttctgtctgactctgagctcatagctttagtactttgttagtctctgcagttgtcctatgactgagtacaggcaggtgtggaaattgtcttggcatctgggattcatctcttgtattagttttggtccacaatttaatcagttttatatatgtatataaaccatatccaggggcacttgtacgatttagaaacacaggaggcaaaaatgtgagaattgttttagaattatatataatgtatactgtaattactgattgtacctttaggggatatctctattttagatgtacaaattatatatatatatatatatgtatatatatatatatatataacatatacacacatatatataacatatacattacatgtatacatataatttagtatatatgtatacatgtaaaaaatatatatacctagtttattcatctgccatttatttcattctgtctgcaactagtcatctagaacttaaaaataagcaaaccttaaatctaagagaacatatggaggaagggagagagggagagagaaaggaatgctgattgagagactgtttgattttaattttatctgtgatcccaaaaatgcatctaggattggtatcaaattctttaaaaaaaatctgggcttttattttacttttgtactagaaaaatctataaatataattgatctgattttaagagagtagctgatcaacatttaggattctaggcccacacatgaaaatatttggaatgatccatctggtaggcaacaatctctttgaagtatatatatgtagtgaacaatcatctaatacttaagccactaacctgctataggaagcaaaacagcaaatcactgtgctattcttcctcatttatttgaacttaaaatcgaacttgggggtaacaagataagagacaaattggtgtaaaaacagcacagtgtaaattgctgcaggtgatggtgccacagaaaaattattacaggcagattcaagatgcaaaattatttatttgacagtaaccagaaagacaaattactcagaggctgtgtacatgtgattatataattgctcataaagtattgtggttcatgctaaaatttaccaagcttgccaaaccacatggtcttcttttaactaggaaaattgcagattgttagaaattggagaatgtaatacacattataaaatgactactcccttacacaggaacatggaatttatgtgcactttttcatttactagcacccatctttcaaaatctttttttcatcagagcttttaagactataaagcttacaaaccacaatagaaaaatcttacaatggaatctcaatgagagcttatttgccataaattagagttaattataaggtacatataacttggacccagtccatggagtttgagttactactgggtggcattaggtactttctcttatagtgagacttctctggctctgatcctgaaaactgttacggaagacttcagcaggcttatccccacatagcttcttgaactgaatttaatgactggaataaatttttttacctgaggaataaatgtggttattcaacctagcccatatctgctcaccattgttaaatgacactgtaattcaggttatataataatgtaaactatttagttatcttatgttggtttggctggaacacaggctattgaactaagaaaggagttataactcactgtgacatgaatgaactgatggcttctcttggcctcattctctgtggcacttgaaatatcaatgtaaacattccctacccctaaccctcattactgttgtgaggaagaaaaaaaaaattcttagacaattgcttcataaataagaccctttagaaatgggaagacattcttttcatggtgaaattaagatcatttgctttacagtgtcatttaatgtgtgtatgtgtggcctccagagccaaaggatcaaaggatttcagcatgtgcatcatgtgctacaaaataatgttcaaggtgtaatggaggaagacttaagcaactgtcttctggttcctttaaactgtatatcagatgttatgaaacaaattaatctcactctttatgttttggaatacaattacacttatttgattatgtcctctggctggtttctcactatagtggagagtttagtttttataacatgaaacatggctgttactgctgagaatatttattatcaagccttttattgaaaaaataatcattgactcctgttctatgctttgccaaaaccctggatgaaaattaccctactggtcaggtatgatggcacacacttgtaattccaccacctgcgaagctgaaacagaagtgtggagagtctgacactacctggccagcctggatgacataatgagattgtgtctcagaagaaaactaaccaatcagaaaagaaaatctaaccaatgctctcatatttcagataaaatattgcctgtccaccaggtttttggtacttatattgttcaagagaataacaaacaaaaggaagttagcgggtctcttgcttctggttttggtaccttctacctatgcttccaacatttaccatgtagacaatgaggttaatcctccccaggttttgttagccaatttttaaggattttgtttttcacatgtgttattatcagaaggtaaactacactttatataatattcagccaatgtgtcgttcatgtttcacatcaaaatactgcaaataactgcaagtatagcaagccatcaactatcctcttaatagtgtcttggaattcctgtcattttggcatccctgagtctacctactgatagaaaatgggcaatctggactcaagaatctggatatactcagaccttgatcaaaaatcaaaggagacttgtccaaggtcctttcccacttatctcatcaatgaactctgtgaaaagaactacactttaagttttccatcccactggattctaaagaagagatttaagaaagttcatctaaacacattcaattcatgttagtagaatggagtaaccaggaagctgacaagccacacttgtgttgtaagttgtgggtcttcatgtgttcctgtcagtagctaaagacagagaagaatgttgtcaacaaatgcctttagtaaaacaagcaaaagacattgagttaccttggattcactaatcttagattgacagcagatttccctccaatcagtctgtgtcttagaagtgataacagattggattctcacatttatctttgtatgacaggttttggtaaaatagaaatggtctagagctattcctatcatgaaaggtagggaatggagaaagctatctcaatgctaatatgtgaaagaagccagttggtagaaaatgacggtaagagcttccccatctgggctccatgcaacaaccagattatgccctacaaaagcccacagtgtacaaatgtaggcaaggtgggcactatatgaatgacctagaatgggccatgtatgtgatttctctttctcactgctcacttcctttgtcatgagtgctctcctcttttcacagattatcattgtttgtattggaaactgtgtgctcttgctctaattctttgcccaggtacacaagagcctggagatgctggaatcttccagggactcagatctctgactgtgaccttcccaaaactcttgattttatgtagagggtgatcaatttgtggtagtttgactaagaatatcttgtttttgaaactgaaagtaccatgttttgaatcttaaacagaaacatcaataatcagtaaactcatgtagataaaatatcaactcaacttacatacagagcaaaaagtatgaaaatgttatcaaataccactatgcagccaaagtgagacctgctaaaaatgcaaatgaataggataagggcaagggttccagtaagtcattatatgatataagggcctgtatgttataggggctcctggcctaataattgtttctttttattttatttttaaaaagatttatttatttaatttatatatgtgagtacactgtggcttccttcagacaaaccagaagaggacatcagatctattatagatggttgtaagccagcatgtggttgctgggaattgaactcaggacctctggaagagcagcagtcagtgctctttactgctgagccatctctccagcccaccatattgtttcttaagttctttcaattcacattctgttgtgactaatgattagtacaataccacagcacttgaaacttttgtcttgagaattagataaggtgagtttaaatcctgactctgacatttataacctgagggatagcgaacttattacataaactctatgggcgttaatttcaccatcaatatgtaagaaggaagctattgatagtagctgctttttaatgtttaggaaaagattaggcaaatcatgaaaaagcatttagacattgcaggaacatagtttgtgattggtgttagcctattataatattttctacactgttttattccttttcatacctattataccatgtggttgtctcagaggcagtttcaaatcaattaatctaaattttaattctgcatactggtctccagacatctctttcttctgtatttcatttctgattctagaaagaaattattttagcctgaatccttggactattcttgactcccttctttccttaactctctataaatgagaaatgatatatagcttttattttgtaaatacctacctttaactatccaccaactcactctttcatttttaaattctgtattcattagaaagcttagctggttgccagtcactactgtaaactatgggaatgtagttaagcataaacctgagagccagcaatttccctttgcctaatcctccacaacctattatcatttttcttttgagatagggcttgacagtgtagcccttgctggcctggaactcaatatacagagcagacctgctttgaacttgcaccagtcttcctacctacatttctttaaattctgagattaaaggcatatgccactatccctggaatgcattcatcttttatatgtcctatctttctacctctacattatgtttgtcaatgcctctattattcactcctgacttggctcaatttcaccttttttgcctgagctacgataataacttcataaataaccattatgcttaaaaatattaacaacgaatcattagagagccttaagtgtttccacatagctctcatagtaattgccaaaattcctaactttttaaagcctatgtgtggtctgtcttctttttatctctgttatcttctgatgctacctcatatgtacttctggtagtctccttaccatgccatattgttttagatctttatggcttcacaagtgttctttcctctaattggattattctattctttagattcatctaactttaggtcacttggtccttaaaatgtggattaagggatgcctcctctcttattctgccttttacaacacaacatacttcttcttggtcacactaaggaggcagtgtacttaatgcttgatttcaaagctctcatatattccagccaagtatttgggggtaggttatataatattatgtgtctttgtctgtgaaatgagaaaatgcaaatgctgagtcaaccccaagagggtgttgtaaagagactcaattaataaatatacatgtttacaatagtgtctggaggatggtaaatagaaaattgttacctattaacagcatcgccagaatatttactaagtgcactatatggcacaattttggagacagaggaccatgaatttctagtcattatagttccaggatttatgccaatgcctaaggcacagctattcaataaatgctaattaaagtacatgagtaaatggatgaattaaaagatgaaataaaaaaccaaaaactgaaactcattgtcttaccaaaagcaattaactttcaaacccaataatccctactgagcctatatgaggtatatgacatggaagaggcatagactgatgacctaactgtcacattctttttgtacatgtattatctactgtgtatatgcattaggcaaaaatatgaagccttggctccttttgtaaattccaagagtttttgctttcattattgctttaagccttggcaaaataatcaaagaaaccatcctttattctgaagccgacatcctaagaaatcacacacaaaaaaaagaaagaaaagaaaagaaaagataaggaaggaaaaggtgaatgagcttcttaatcatagagttatctgtgttccatcttgctcattctaaacacttggatggatgattttgagaatttgtgcttccagattaatcagaaagcagatgacctggaatgactgacagcacagaaagaagaacatctttgctgcacataaatggaggaaagctgacctagatttgaggctgtacagtttcacaagaaaaaggcttcttgatgatgcctttaatagggaatcgggagagactttccacttgattgacagctcttccataattaagacatagtccaaactcacagcaaggccagttttttaaaaaaatgccatcaaatgtttcaagccttattataaattattaccttccttctgtctgtttctttttgtcgttattattactctgtggggtttgatcttgcctttcttcaaccagataactaggcaagttgggcttagcgctgcaacgtttctcacctcttgtctgatcctaaaatcaaggagttccaagatcagtgactggagtagtgagccagcagtttgaacactgctatccagatttaatgaggtaggggacagttggcccagggctctgtcatgaagaggtatatatatcatgttgtaaccacaaattttgctggcatctccccaaaggtctcttactaaaaatgattttctaagcctcacatagcttcatatgagctgagatgaagaaagaattgtttacctccattaggtgagcattattattttttcttcttcacatcaatgtgtctcagaggggctctggttacaacatcacgcatttacactatagctcatggtagcaaagatatatggtcaatttggttaattcagtaaggcactttggaataaaatggtaataaataaataggttctgatgaattctggcatgacaaaattttaagggtggtggagctaaatatgatagtatcttgtcatctgtcatgcattactgccacgtataaccacctccttgatagcttttgttaaaaaccaagaaaactatttattgcaaaattcaaagctaaagccagggattgtatctgtagtagaaagcaaggacttccgagtcatatactcactactttgccaccatttgctattgtaagtagccacaatagtgttatttacaatgtttactatgctttcaagtctataatgaatagcatcatttccattttgttctttaatgactcataaatagacactatttcacatatagggaaactaaggcaaagtgaggttgtcctagctgtccaaagacatgaatgcacaggcatgtcagtgacatattctgaatattagtatttctgaatattactaatttttctcctctacttccttaacaggcatgtgatcttctttagataatttaatttgttattttccagtgtctcaaatgcatgctacaggaacaccagtgattccatccctcacttttcataagagctaataaagccagggatggtcagccacttcaggcaataagggccttgccatttttttcctgataaagtatcacatgatattcttttctatgtgtaaacaacatgaaaagtttgaggaatcattattttattggtgtgagcttcaatgccctcatccaaatatagaactcatcatactgtgtgcttggcatttggtaaggattaaatgaagtaatatctataattgtcctttagataaataattatatatatatatatatatatatatagagagagagagagagagagagagagaggtaggaagatgacagatagatatcaagagagatacagacatttcttttataagtagcttatgtagttatagaggcttgtaaattcacaggatctgcagtcagcaaggtagagaccaagaatgactgatagtataaattatagcctgaaagtcagcagtctctagacacaaaaaaaagcccatgtttcatttaaagtccaaaggcaagaaggaaaccgatgtactggctctaaagcactcaggcagaagaaatagtcttatactcagtctttgtgtgtgtgtgtgtgtgtgtgtgtgtgtgtgtgtgtgtgtgtgtgtgtgtgttctgttcaggtggattggataaggccaaaccaagccacgttagggatgacaatgcattttactcagtcaactgattcatacatatatcagtcttttccagaaacaccctcaaagaagcatccagaatgatgtttgaccaaatgactagatagcgacttaagttgatacataaacctagttaccacagtcaccttacatgaaatcgcacctgtggttataacaaatgaatgatccctcacgttagatctccttccttatagatagaagagaactgaatagtaagcagaagaagcatctccatactacagatgagaaagttggatcaaaacacacattttagttctctgtccttttagttaataggacatgaccttcacagcaccctgtgttgagtcacatgctttagtaaggctaagagaccatctaatagataagtaaccttcccttttttctattcctattttcccaattaaatctaaatacacatagtctcattatagggataacaggttagtcagaaaaaaataaacaactattcgatatgcatgtatatgtgtgtcagagtgggagaaaatgagagagagagagagagagagagagagagagagagagagagagagagagagagaattgtatgatgtttgttattcctctttatgtataagacattctaattcagaaaacaaaacaacaaaaaatgtcctgctgattcccaaagactctaaaatataacataaaaatgcaaagtaaagtaaatccccttctgtgtgagtaattccccagcttctcttaagcaagactctttggacagctatgatgggacagggtaggctctgtttgttctgcctataaattgtgatgattctaggcacttatgaaagccaactggattgcatgctttatctttgaaagccataagacaccagcatggtgtccatctcaattctcattttgtaattatttcatgatatcacaatcaatgtcataagagacaaaacgtatgtatgtagtcacagccgcttctttgtcatgaaaagttctcatgcagattgttaataaggacaccatccaaagagttataaaaacaaagggagagagcctttgaatcctttgttggtgtcagctggaaacagtgtgcaaatacaatgatgacaggaaacaaattacaaacaagtatatgaaaatatttataacatcttaggggttattattaggataatgagttgatttattcctaccaaatgtaagctgaattatcaaagctgatattatatgttattttcaattatataaattatcattcctaatattaacttttccatatcaaaaattttattactgataagaattgttactaatacagttatgaatcaaattgtttttcatattgttaccattaacttaaccacaaataacaaatagatgagtgctaactagatgttacattctgtttgctctaagtgctgtcacaatgatcctatgaaaaggacacaaatgttatttgctggagtaaaatgacttctttgggaatatcaaactccaaagactaattatatattccagccctcttcaattccattcctgccattcttcctgctgttagtagtaaagatcctcatggcgccaggcctcatatggccaggcttaggcatcttacaatgaccagttgaaggagcctcaactctatcttagactacatcatccctctggttgttcttgcaatgtactgcattcttaaggtcactgaaaagtgtaccttttcctttccaatggtgtctgtgtcagtaggtacataccttggacagagatagagttacagcaaatgttggaaaggacaaggtggagaaactgttgtatgaaacattaacctgtgctagagcattgaattatgccccttcactgttttaaagtaaaacttacaggtgatatggcttctgttgtaccaatttgagaaaagaaaatagtgacccaacttcattataaatgtgaaacaaaaataatttatattgaaatcatgtatattatcatatgcaaaggatttagagatgctgcaaaaatcagcaaaataaatatagaatatataaatatatcactctacacatcagattgttccaccagcagatggataagatgaatatggagctgtacactctggttaaaggagaaattaactgtgctgccaatgttttatttctttaataaaacagagctgctgaaagtgagtggggaaaatgtgaacattattaatttggaatggtgatagcatatgagtttttattattatgtgttttagtttttcataatattgaaactgaggaaatgcactaaaaagtgatcaccagggagctaccccaagtgagcatttgaacatcttgaccatagacctcaacaatactcagactatatatatattgatttggagtttacacctatttagtttaataatcctttcttttaagcataggaaccgactttcttcaagtcaaatttctcaataaagaggaagagggggataagaattcaagctttcggatctctagtcagctctgtgctaatttcctgaccttggctttgaagtccaggatgattgcctgaatggcatgacaaaccttcagttaagtcagaaagacgtgagtctcctcgcatgtctttaaacttgatacaaaatggattcagttgttttaggaaagattttcaataatccaacaattaactcccagttagaattaaattaataacactgaattctgtgaggttttatgggaagagaatatataaatgtgttttcaagaagacataccaagtttatggttgaggaagtactgattggaaatagaaatagtgatagaaataatagatagatagatagatagatagatgttagatagatgatagatagatagatagatagatagatagatagatagatagataatatcaaaccacaaagatttgacagataaaaaccactataaaaaacatttctactttgactcctagaaaaatgcagctcaaaaaaaagtacaaaattgaagaaattcatggaaggatgatgatgcagtgtgaggttccaaacaagaacgaactgagtgggcaagagcccaggtgtaaacactattacacaaggtttgtgtaagcaagactataggattctgattgggggtctgcaaccctataggtggaacaacaatataaattaaccagtgcccccaaagctcgtgtctctaggtgcatatgtagcagaagatggcctagtcggccatcactgggaagagaggccccttggtattgcagactttatatgcctaagtacaggggaatgccagagccaagaagtgggagtgggtgggtaggggagcagggcagagggagagtatagggaactttcgggatagcatttgaaatgtaaatcaagaaaatatctaataaaaaatctcaaacaaacaaagaaacaaataaatataagtttaattcttaggtaaaagagtttaaaaaaaagaaaaagaaaaagaaagaaagaaagaaagaaagaaagaaaaaagaattctgattggaccagggaacttcccctttggactgtgattgactggtgctttggtagaattgggcttactattgaaagagccaggatataaacttggttctttcttttactcagcttggaataaatagtgagttctggggcattatggtagagatagattgattattaccaggtctccttctgtgtgctaatatcagaatcattgtgatcctattttatacattgaggctactctgcctgacatttttagacacatcagtactctagtagcagagtatctctgagaagttaagataattctttttagagaacttgtttggcagctacagaattgtaatctgctgaagatttaataagtgcctataatgtacaacacatcattgagcctcgtcctagagatgtagatgaaatgagacacacattattcacttctgataaaacagtttttaaaaactcactaggtaagagtatcatggaggaaataattcgcatgtaatactaaagtacaatttcacagacatggactttaaggctttgtcttagaaagtgtatcagttcaatagaagcaagtactaatgcaacatatggaaggcagatggacaaaagctgtgctgactagttttatggcaacttgagacaagctacagtaatcagtggagtgagccacaattgagaaaatgctcccatcaggtttatctgtaagcaactctgtggttcattttcttgattagtgattaatgattcatgtgaaaaggccaagcatactgttggtggtgtcacccctgggcaggtgctcttgggttctataagaaagtatattgaagaagccatgaggggccatccagtaagtggcattcttctattgcttctgcgtcagctcctgccttcaggtttctgctctcagtatgatgtggaattataagccaaataaattcctttctccacaacttgttttttatttgtttgttcatttgtttgtttgtttttggtcatggtgtttcatgatagcaagagtaaccctaagtcagaaaaatataggaaaagtggaggcacccttaggtaatggataaagagtagagtgtatgaagagttgtaaagaggggatgaaaagataggaactcccaaatgaggcaggggaagccaggcttagcaatgggcaaataggaacactctaatatttattatatgtaaaagggtgtggctatgggtttaacatgttcattattatcagagtttcaacatcagattggaggttgggatgtagggtaaaatgtttgtctacattggtagaatgtttacctacaagtgaggagacttcattcaatacctcaaactgccagaggcttgggaaaacctgaataggaatgttgggatatcatttagaaatattacaaaagaaacagtaaaaatcagcacagactacaaaagcaaaagtagaaaattcacaatattaaaaggcttctacatgttgaacaatcaacatggcacagataaactatagaatgggagaaaacatttgtaaactatataggtagggagttattatgtataatgtatataggtagggatttcctatgtataatgtatgtggtacttaaacaactcagtaaaacattctgattaaaaatgaacagtagaactagatagtttgcaaaagaagacatgcaagcagggcagcggtggctcatgcctttaatcccagcactggggaggcagaggcaggcaggtttctgagtttgaggccagcctggtttacagagtgagttccaggacagccagggctacaaagagaaaccctgtcttgaaaaaccaaaaaccaaaaccaaaaacaaaacaaacaaacaaaaacaaaacaaaacaaaaaataaaaaacaaaaacaaaaaagaagacatgcaaatgactaacagacttataaagtaatgctcaatgccactattcatcagagaaaagagaaataaaattacaatgagacatcatatagcacataataaggtgtttttataagaaagacttaataaagtagttgacaaaaatgtggagaaaaaggacacttgtacacacttgatgataatgcaaattaataagcaattaagaaaagcagtatggaagttctttacaaattaaaaataaaacttcttttagatatgtaaccaacagatagatatctcacttttgtgtcaatggaatatttgtgtaggaaacatatatgaaatatatagggtattatatatcaatatatctggatatccatatactttgtaacacaattcccaatagctaaagcacagagaggaaactgtcaacaaagtaatgaacaaggaaacacttttatatatatatgtatgtatgtatgttatctctatgtgtgatgtaatgttgtctagatttataaaataattttgtcatctgatacagcatggtaaaatatagaaaacattaagctaagtgcatcaagccaagcatagaaaagcagttgctgcttgatatcacttacatgtggaatgaaaaatataaaggatgagcgtgtgaaagaatctagaatgataagtacaaagggcagaaagaagaggacaagtattgtttgaaagcataaaaagcaggagattaagtctaagacatctatttacttaattacatacttgcttacttaattactacagataatagtaataataatgtatagatgagcatttttaaagtatatcttaaatgttctcctgaaaaaaatgagaaatacttgagttgaagagtatagtaatttagtttaatcatttcacagtagacacagatatcaaaacatcaagttctatactctaaatatataaaattattctcaaagcaaataaagacatttaaaaaggatattaaagcaacacaaggaaatatggtctcctatgtacttcagcatctatgagaataaagaaattcaaagatatgtgagttacattggaaatgacaaggcttaatatattatgggagtaatgattaaagggaaggtcagcaggaaggaaaagataagattcatggatgacacccaacatttttggctcagataactgtgaacaattatgggtggtggggctgaactggcacaggaaagtggtttactgccaagtactctggatttgagtagacagtagcaactctggcagagggtttgtgggcagtgctgatatcttgcctcccatggacacatttactggccattctcagcgttaacatcactgcatatgagaagagcatctggctactgactatttctcaggagctcatcaggcttcatggaaacaggagttgaggagttggatgtaatggcccagtgtgacttcacttccattatatcacccagagtcctctgtcagataaaaaccaaaaagttaatcctgacaaagcatcgcacagatcttgtaatgacagggaaattgaaaggttgccaggccattattaagcataatgactaggttgaaatgagatgacggactctatttcagcagaactttcccattgataaatagtagggggtcatgaaaatggaacatataatccaattcataaaaatataaagattctttcaaaaacacaaagcagtgatcattcatcgcatttacagagctgaaacaggaaatcttctgtctattggtgaatattgaagcacagatgaagtttaaaagacaatgtttcctttttccccagccagaaatgtattttaaaggaaataatgtacagaaaaatccacaagtctaagctggaagcaaataggcacagatctagcaataaatgcacaagtcaatcactttttggagcatttgacttgcttgttctggagaaatgaccacatgagatacagtcctctgtgatggctataaataaaaagaaatttggctttagggagcagagtgacctgagatagaaatagaaaacatgtaattctaacattaaatttctaagatcagggttcataatattgtttttaataaatataatactggtatagatactaagataagcacacatctctatgatgagattataatagcacagatttggttgatcatctctagatatttaattttaaatacattgataagggttaaatactgtatatccaaggttttgacctcatcacaagaaggaacatgatatgcataaattattaataactcattaatttgtaagcactatatgtgactcataggtaaataattggcatatattacttgatggccattattcctacagtgtttatgcaggcagaggctatgactaaggttgaaagggctatactcattggacagatgtggactctggggcatacctatgacaatttggatgccactaagcagaatttaatcttctattggattgtgagctagaaagagaaagaatataagaggaagaacatgaaacacacagacatcaagatccatagctctggagttcactttatcccaatgtggtgtctgctgtcattgtacctcaagtgaccttgagttagtcacttaaagtctcagaggtttttcattttttctttctttctttttaataaaataagaatattgagtccctttctttctgagtaaccatgagaataaaatgagagggggaaaagccttgtaaaacatctcaacatctaatgtattatttgcctattctaaggctaaggattaagtgaatttctcttgctactgctatgtgtttccagctgctactcatgtggtctatgcatgctcttgaccctctcttttgagaatgatctctgctgcatcctcaatttttggctacctttgtcgccacagcagggcatcctcatagctgtgctatgattcttctccagcaaccagtgcttagtgcttgacctctaacaaattcttagttttagaaagtagacacggaaaacttaagtgctacacaaagacttggacagctctccctctagtggaaatttcttgaattgcccccaattactaactaccctattgattcaagagaaatagtggtgaaaatgaatggggtggagttgataaaggttttttttttttagttttttttttaaaagattgtattgaacacagttagcatgaggctagaggctataaactgcgacaaaactactcaccagtgtctggaatttgcatagtttctcttgggccattgaacccattttacttaatggggattttgaggcaaatcttgatttttaggtaaaaatacacaattagcaattatatgtgcagctgtatatcaattttccctctatacctgtaacagaattgtgatgtgcatggctgttggagtctaaattaactacactctatgttcttttttcccctttaaaaatgtatttctagttgttaatgttggcatcatatccttttataaggattcatacattttcacggggcttcgtttttgaaggcatgtaagtgtggcagtgagaaatgtgattataaaatggctaacctaccttgctgcagtcacctagggtactttgcaggagatttcactagtttacatctctaggcttcttcttgtggcaaaataaactgcatggatgtcagtatccatgaataaagtccatacacccctcgttttgaatcttcacatcaagattcccaatcacacatctgtttgcctgtttttgcagactggaataaaattattaaaatagagccctgaacttttagtggctttctttgctccgttataattggtttggaaaacttcaatattaaagcattttctgccaagaagactgaatcaagaataattatttgaaaaccttccagagatctgaatcaaggtggtaggcatgagactttaaggaggtagccttttatattttcaatctgtttttctgtaataaactttgccaactgcagaatctcaccagttgggggaaagcagtgtttccctgcctgtggtgcctctgttcacacttgtaatgaatgaatcagagagacccagctatagaatcacctgtgagagaattcagtctatatggaaaacacttcgatgaagcccagtgggaggtctacttccagagctgccactggaattgtgaacagaatagggctggatgtctctgtggcccgatgctaggttgatgaggtcaagttcacaggctagcctacgctgggggctcctgtgttgactactcagttccaccatgtaaactccttgactatagcctacacatttgccagctgcttcacagatgcatctcttcagctattttccaaatatgtatggccattcagcatgcaaataactctggacgtgtgatgtgctattacaatatctttgtggcatcaacgtaacttacacttgtgattcctggtggcacttgaaaattcagtcatgtgtgaactattgtcccattgtttgggatcctctgacatctttctgtgctttttaccaaatcttaagatttcagttccttaatactaggataacacctgattttttttaggcattgaactttacactatacattttagttggtttcactcttcccaaatctaaaactaaatgtactatattttatgccacccattcctttccctcaagtgaatggctaagaatagaaatccaataaaaacaaatcaagccaccttgttagaatctagtagtggtctaatgatctaaagatacaaagctacaataccttaactcatagaaatgaatttctcatagtgtgttttctggagaaaataatatttggaatcaggtgagtcttcagaattcctagcatcctttgtttatcttataggaaaagacctttaggtctattggattaggtcatggtgcaatcatggattgtgaatattaaaaacaaaaaattaagagaatgataattagaaattttatttacccctagttgctaaatttctggtttgtttgtttgtttgttttggctgtttgataccttatttataaatactccttcactgatgtctagaacaaaggaagaagaagccaaggaccatagatctattaaactaaatgcattggattcaggaggtattcaaactgaagtgaattttcagtgtattttcaaggtctctgtgataaagctaattgtaatgtcacaaattgttcttgggcatgactgctgtgattcaggagcaatatttttactatctttagtagcaatgatgcctcatagtttataggcaaaactagcctgctaagattgggaaatgtagcttgagcttgcagtgatctatattatatataacagagaggttagaggtggaaattgaaggacttgaagagggaaatgaaaaaaaaattttttttctatcaagatggtaattacacaatttgagattattttcgaactcaaatttgttaatgcaaaacaattactgttctcatacttcacatactacttgaggagcttgatataaaagcctatatgaaccagggtagtcaaaataggaaaacatgcttaggtgtaaatcaatctcagaatacttgcattaacctgcaaaaggccatgggttcgatctgcaaaaccatacagcaattatgcaaaagaaaccatggagttttaggcaatgcatgtctttgacaatgtaatgaagtgtagtcgaaaatctcccaagaaaagtatgcctatatgaataggcacattattttgccaacagtctaaagcctattagggtacctttcccttgagtgcccttgaactctagttcaataacccttcatatagagaaagtgaaactttgaagtatgatagttattacatttgagcattgcatctggctttaagctccctgtcaactgaggttaaaagattaaacacactgggctacagagttcccaacatctgaaaaaggaaacagaccagcctacagaattataagcaaaaaaaaaaaaaaaaaaaaaaaagaagaagaaatcaatttaaactggaagaatttacacatttttatgatatgatttgaaagggtaatcaagtaatataaaaggacagcattgattgatgggattcctgaaaaaccaataggcattcagaggtataatacctatgctagttgtgttgagtagcatactaaattggcttctgcatctatttctaatccttctggaaaaagagattttactgtatctgcatttctttatactagatttatctacccagtattatctgattaaaactgacattaatatacttccctattagcatataccacttaagcagcaaggcaggcctaagaatataaagaaaaatcagcctatgtttaagtatctgctattaataggtgatgtgtgtgtgtgtgtgtgtgtgtgtgtgtgtgtgtgtgtgtgtgtttatatgtgtctgtgcatgtgtgtgtgttggggagtaatcactttaggtgtccagcacttacaatctcagtattgcttttccaacagcaagtaaataacacagtggctattctcacgattatagatacaggtagtataaagtaggggttgagaatgtatgtagtctctggtcagatattgtgttctaaccatttattagctctgtggccttgggtaggatctttttaagtgaatctcagtgctctcacctgtaaagtatgaatgtaagtgttactatccagaactgggcctggtctgagcagggttttcttagtgatatttgttttataagactcctgacaaacagtcagaatgacctgaaagtggcatggcagtgtcacaccagtagtctaggttcataggctctcacagagcaaagattttctggttaactggagtgactcacatggcaggccactctactactgtgcagccctaggatgattatgtaggcatatgtggattgatagagagtcttttgtgtggggggattatctaacaggatttttttttttacctaaaagttgctgtagaggataagtaaatgtcttaagaacacaaaactagagcagcatctatacttactaaagtctaaggaagatgctggtctatctcctccactgagaggatagaataaagccatctctaaagctctgactcacagaaagtcccatatacattatggcagtaattgctgttgttatacatgatgttccccatatctcatgccttgtcttgttctctttcagtggatggctgcattgattggtcggtggatctcaagacatacatggctttggcaggtgaacctgtccgagtgaaatgtgcccttttctacagttatatccgcaccaactacagcatggcccagagtaccgggctcaggctcatgtggtatagaaacaaaggtgacttggaagagcccatcatcttttcagaggtcaggatgagtaaagaggaagacgccatatggtttcactcagctgaggaacaagacagtggattctacacttgtgttttaaggtaagtatcatatgaaaatgttgttcaaccatgtgccttgtaggtttttttcttggtttgtttgtttgtttgtttgttttggaatgttgtgtcagaatggtggctggagtgattcacattgtgaagaaagcagctgaagaaattcagtagactcaatttcaatgattgatcagaattacacgtcacattcttatcagattgtcacaagattggactcttatttactgtgattttgttttgattttttaatgtagagcactgtgtgatccatttctttcctaactccacccctgctccagggtcttatagtaacaattattttactacagaggcaagtgactcaatgatcttggtgcctggccatggaactaacctaacatatcatttaggccaaggtcgtgcctctcttgttgatggaaagaagcttcaaatgctgtccaaagacttcacagcaaatgaactactggtaccatccacacaatttgtcaaataatctttattctgtctaaacattcagcataaaactcaataaacacttggttatcccaaagttctaagtcctatattctgaagatttaatagatctaactcttgccagaaatttacaataagaagcaaattattttaccttaggggctcctgtgatctccctccacagcccagcattacaacctaggagctagcatttcagatagagaccacatttggtattaaagtacatagctgaaatgacctttaactcacctttcaattctgccattttcactggggacctgcactctactatttgattttaacttcttggaaatacagaccctttctatttttatctcaggtgtaaagctatgccacttcttcatcaaaagcacttggaactccctggtgagtcctcattgttctaaaggccaagagaactaggtagtgtataaatagagaaacctcctaaagctttagaattacttttgtgcacatgtgcaggggagtactgagaggaacagacacagaggttagtttcctttgaaggtaatatgactccctatggtcacagcaaaagcagcaatcatttgtactgattccttagtgataggcaatatactctacttgtgcagctcttggcacaactaagaaatagatagcattcactttttaaaagactgacattgtgttttccaggatatcactactttttgcctccttgccccttattaatcctcaccatcactgaagcttgtggatcaaaagtacttcatttttcttctaatctacttgattttgtttatgtttgttttcataattggtcacttcctttacaaagcattattccactatgcaaaggttattgactgaaataatgaactagttattggttattgcctctactatacaaatatcctcaatcttgctgtctcctttctttcccttttcaacccttactcttagcaaaacccatcatcatgatagtatatcaaggttacaaataatcaatatgatatgactattggtgttgactttgatcacctgatttgaagtagcatttgtctttatttactgttaaaaataactgtgttttcttaaatctcctggaactagctatatatattaaactgaccttaaacctgtagcttttctgcctcagcctctcaagtgttgggattataggcttacgctatcacatcacgcttcttactatagtctttggaagaaagtcattattcacagcccatctttagaagtaggtaacaatagtccacccccatcacaacagaatattgatataaactataattcttccctatagaagtttaatctttcttattcattttatctattcaggcaattgctttttatcatgtgtatttatattatacagtacaattccactattttttctttgttgagatctcttaaatttagaaattggaagttccttcagttggctcctatttaattttgatataatcccatcttttctgggtagtttttctttctatgatcgttccttacattactgaaagattctccatgcttatcttgtatacatactgtcatagactgagactcacgcattttctttagaacccaaattctttgtagtagagactacacaagactagatgacccatcatttgtaggctaggtataatgagtgctaggctgttactgattctatgttttcaccacacagtggattcacttttaagatacctgtggacgttttttgccatgtttgagaataaatccatggtcttctgtattctaggcaattagtttaatgctgagctacatcctttgcctaagcattgtattattttatggacaattctcttgatacttaagaaatactctagaggtcccagagattctcagtgtgcctttatcttctccacagtggtcccctctttctatttcacatcagattggcttggattataacttttattgataccatatgagctagtgtctccttaaaggcaggcagatcagaatcagaggcttggacttaaacataattggtgacttatttcatttgtgcagcaggccctagggagcaaagaaaaaaatggatgagtaaaactttgaaaaataacccaaatatgtcacttagtaagtaaggctcatcaaagttgggaaccatcattctacaggaatctaccagtcttttcaactcaaagaagtaggaactattctagaaaaaaatgcaaacacacacacacacacacacacacacacacacacacacacacacatctagtagtagaacacctcacttttatgctaatgcaaaaggtattaaaattaatattctagtatatgacaatggtacaggtagcagtcagtggtaaatattaaacctgtttttctgacctagtagtagccactccaaatatgttacaagtgataatatcagttaatatagatgaatggagtaaaatttctggcttccaaaaatattcttttttgaagggtgtgaggaattttcatatttttattagattaataaaatttattttaaaatatacaactcagtattgacatttttaagtcatcaaaataatttataatagataaatacatcttaaatgtacatgatatattctgaagctaaaagtaatatgcactcaaccagtttttaaaatctatttggaatatgaaatatgatagaagtagaaaaaaaatctcttgtgaagtcctctatgaaaggaaattgtgacaagttcctgattaaacagacaccatttatctccaagggagaatacacagcataactgtggcttcatagaatgaattggatagtggtccttctctttctattctgtggaaaagtttgaagagtattggaattaggtcttctttgaaagtctgataaaattctgcactaaactcaactcatctggattttttttttgattgggagaattttaataactgattctatttctttaggggttaagggactgttaaaatagtttacctggtcctgacttaacttaggtatttggtatctgtctagaaaagtgtcaatttcctccagattttccagttgtgttgaatacaggctgttgtagtatgatgtgatgattgaatttcctcagttgctgtggttacgtctccagtttcactactggttttgttcatttcgattctctttctatggcatctgtctagtctggctaaaggttcatcaatctcgttggttttctcaaagaaccaactcgggtttattgattcattgtatagtcctttttgtttctacttggttgatttcagcccggagtttgataatttcctgccttccactcatgtctggtgtgcttgttttttgtttgtttgtttgttttttgtttctgtttttgttttttgttgttgttctagagctttcaagtgtgctgttaaactggtagtgtatgctctctccagtttcttttttttttaaattttttattaggtattttcctcatttatatttccagtgctatcccaagagtcccccatacccacccccccactcccctacccacccactccccctttttggccctggcgtttccctgtactggggcataaaaagtttgcaagtgcaatgggagtctctttccagtgatggccaacaaggccatcttttaacacatatgcagctagagacaaaagctccggggtactggttagttcatgttgttgttccacctatagggttgcagttccctttagctccttgggtaatttctctagctcctccattgggggccctgtgatccatccaatagctgactgtgagcatccacttctgtgtttgctaggccctggcatagtctcacaagagacagctatatcagggtcttttcagcaaaatcttgctagtgtatgcaatggtgtcagcgtttggaagctgattatgggatggatcccagcatatggcaatcactagatggtccatcctttcatcacagctccaaattttgtctttgtaactccttccatgggtgttttgttcccatttctaagaaggggcaaagtgtccacactttggtcttcattcttcttgagtttcatgcgtttagcaaattgtatcttatatcttgggtatcctacgtttctgggctaatatccacttaccagtgagtacatattgtgtgagttcctttgtgattgggttacctcactcaggatgatgccctccaggttcatccatctgcctaggaatttcataaattcattctttttaataactgagtagtactccattgtgtaaatgtaccacattttctgtatccattcctctgttgaggggtatctgggttctttccaacttctggctattataaataaggctgctatgaacatagttgagcatgtgtccttcttactggttggggcatcttctggatatatgcccaggagagatattgctggatcctctggtagtactatgtccaatttcctgaggaacctcaagactgatttccagagtggttgtacaagcttgcaatcccaccaacaatggaggagtgttcctctttctccacatcctcaccagcatctgctgtcacctgaatgttttatcttagccattctgactggtgtgaggtagaatctcagggttgttttgatttgcatttccctgatgattaaggatgttgaacattttttcaggtgcttctctgccgttccgtattcctcaggtgagaattctttgttcaggtctgagccccatttttaatggggttatttgattttctggagtccaccttcttgagttctttatatatattggatattagtcccctatctgatttgggataggtaaagatcctttcccaatctgttggtggtctttttgtcttattgacagtgtcttttgccttgcagaagctttgcaattttatgaggtcccatttatcaattctcaatcttacagcacaagccattgctgttctattcaggaatttttcttctgtacacttatcttcgaggcttttccctactttctcctctataagtttcagtgtctctggttttatgtggagttccttaatccacttagatttgaccttactacaaggagatagaaatggatcaattcgcatttttctacatgataaccgccagttgtgccagcaccatttgttgaaaatgctgtctttcttctactggatggttttagctcccttgtcaaagatcaagtgaccataggtgtgtgggttcatctctgggtcttcaattctgttccattggtctacttgtctgtcactataccagtaccatgcagtttttatcacaattgctctgttgtacagctttaggtcaggcatggtgattccactagaggttcttttatccttcagaagagtttttgctatcctcggttatttgttattccagatatatctgccaattgccctttctaattcgttgaagaattgagttggaattttgatggggattgcattgaatctgtagattgcttttggcaagatagccatttttaatatattgatcctgccaatccatgagcatgggagatctttccatcttctgagatcttctttaatttctttctttagagacttgaagttcttatcatacagatctttcacttccttagttagagtcatgccaaggtattttatattatttgtgactattgagaagggggttctttccataatttctttctcagcctgtttatcctttgtgtacagaaaggccattgactggtttgagttaattttatatccagctacttcattgaagctgtttatcaggcttaggagttctctggtggaatttttagggtcacttatatatactatcatatcatctgcaaaaagtgatattttgacttcttcctttctaattagtatccccttgatctccttttgttgtctaattgccctggctaggacttcaagtacaatgttgaataggtagggagaaagtgggcagccttgtctagtccctgattttagtaggattgcttccaacttatcatcatttactttgaggttggctactggtttgctgtagattgcttttatcatgtttaggtataggccttgaatttctgatctttccaagacttttatcatgaatgggtgttagattttgtcaaatcctttctcagcatctaacgagatgatcatgtgttttttgtctttgagtttgtttatatactggattacattgattgatttctgtatattgaaccatccgtgcatccctgggattaaacctacttggtcaggatggatgattgttttgatgtgttcttggattcagttagcgagaactttattgaggatttttgcatcgatattcataacggaaattggtctgaaattctctatctttgttgggtctttttgtggtttagggatcagagtaattttggcttcatagaatgagctgggtagagtaccttctgtttctattttgtggaatagtttgtgaagaactgggattagatcttctttgaaggtcttttagaactctgcactaaacccatctggtcctgggcttttttttttttttttggttgggagactattaatgactgcttttatttctttaggggatataggactgtttagatcattaacctaatcttgatttaactttggtacttaatatttgtctagaaacttgtccatttcatccaagttctccagttttgttgagtatagctatttgtagaatgatctgatggtggtttgaatttcttcaggatctgttgttatgtctcccttttcatttctgattttgttaattaggatgctttccctgtgccttctagtgagtctggctaagggtttatctatcttgttgattttcttaaagaaccagctcctcaattggttgattctttgaatagttcttcttgtttccacttggttgattttgcccctgagtttgattatttcctgccatttactcctcttgggtgactttgcttccttttgttctagagcttttaggtgtgttgtcacatgctgctaatgtgtgctctctctagtttctttttggaggcattcagagctatgagttttcctcttagaaatgctttcattgtgtcccttaaatttgggtatgttgtggcttcattttcattaaacttcaaaaagtccttaatttctttctttattccttccttgaccaaggtatcattgagaagagtgttgttcagtttccacgtgaatgttgcatttcttttatttattttgttattgaagatcagccttagtccatggtgatctgataggatgcatgggacaatttcaatatttttgtatatgttgaggcttgttttgtgaccaattatgtggtcaatttccagtttctttatggaggcattcagagcttagttttcctgttagcactgctttcattgtgtctcataagtttaggtagattgtaccttcattttcattaaattctaatagactttaatttctttctttatttcatccttgaccaagtgatcattgatgagatcattgtacagcttccatgtttctgtgggctttctattgtttttgttggtattgaagaccagccttagtccctagtgatctgatcggatgcatgcgattatttcaatcttcttgtatctattgatgactgttttgtgaccaattatatggttgattttggagaaggtaccatgagatgctaagaagagagtatattcttttgttttaggatgaaatattctattgatatctgttaaatccatttggtccataacttctgttagtttcgatgtgtacctatttaggttgtgtttccatgatctgtccattgatgagactggggtgctgaagtctcccacttgtattgtttgaggtgtaatatgtgctttgaactttagtagtgtttcttttatgaatgtgggtacccttacatttggagcatagatgttcagaattgagagttcttggtagatttttcctttagtgagtatgaagtgtccttccttatcctttttgataacttttggttgaaagttcattttattagatattagaatggctactccagcttgtttcttgggaccatttacttagaaaattgttttccagccctttactctgaaatagtgtctgtctttaatacctaggagtgtttcctgtataaagcaaaattttgggtcctatttacatatccagtctgttagttgatgtctcttttggggaattgagtccattgatgttaggagataatgaggaatagtgattgttgcttcctgttatttttgatgttatttttatgtttgtttggctatctccttttgggtttgttgaaagaatattgtttcttgtccccccacccccaccccagggtatactttccattcttgtgttggcgttttccttgtagtgttggatttgtggaaagatattgtgtaaatttggttttgtcacggaataccttggtttctccatctagggaaattgagaattttgctggatatagtagtctgggctggcatttgtgttctcatcacttctgtataacatctgtcccagatcttctggctttcatagtctctggtgagaagtctggtataattctgataggtctgcctttgtatgttccttgacccttactgtgtaaaatattttttctttcttttttgcattctgtgttttgactattatgtgtcaggaggaatgtcttttctggtccactctatttgaagttctgaaggcctattgtacgtttataggcatctctttctttatgttagggaaggtttttttttttctataattttgttgaagatatttactggctctttaagttggttatcttcactctcttctatacctattatccttaggtttggtcttctcattgtgtcctggatttcctggatgttttgggttaggagctttttgcattttgcattttctttgactgttgtgtcaatgttttctgtggtatcttctgcacctgcgattctatcttctatctcttattttctgtcggtgaatgcttgtgtctatgacttctgatctctttcctaggttttctatctccagggttctctccctttgtgattcccttattgtttctatttccagttttagatcctggatggttttgttcaattccttcacctgtttggttgtgttttcctgtaactctttaagggaattttgtgtttcctctttaaggcgttctagctgttttcctgtatttccttaacggtgttgtgtccttaaagtcctctatcatcatcatgagatgtgattttaaattggagcctccttttctcatgtgttgggatatcaagggctctctgtggtgggagaactgagttctgatgatatcatgtagccttcgttttctcatttatgttcttactcttgcctcttgacatctggttatctctggtgttagctggtcttgctgtctctgactgtagcttgtcactcctgtaagcctgtgtgtcagaactcctaggataccagttctctttgggagaaatttgggtatggagagctgtggcatagggtcagatcagagcacagaaggaaacaggctgctcctcagttcctggttcctgaggtccctgggcgagtcccttggagcaaaagtggtggtctttcttttgctcacaggtttaccaccattcctgggagaccagctctctccaggcaatagatatttgggtatggagcactatggcataggatcatctccgggaacccaaaaatattcttaaattgacaatgtcaataatcactcaaaattccaaatgtagtgtcatcttaattgtagtgtaatcattaatgatttatcaatgcttattgatttcattagaaatcattctgtagtcctgattatgtttatgtttcaagatatgaagcatgaagtaatattctctactcacttgaattacagcaagatatttattatttgagaattttcagtaacttaatgagttactcatttaaaatatttcattgttcaatctcagaaaatagataagctagtaacagatgaatagtagagttctgaagcatattttggctggcaggcagtgttaatccaaaatttgtttccttatctctcctctcatcatttcaattaagtttttcaatgttgtaacaatgttgaaatctattttatttgataccacatatcatactcaccaatgatgcatgaggtgatttaatctgtagatgaaactataatccaataattccagaatgaatttatgcatattaaaaagaatgagggaatatatatatggatatctgtagcaatcttctaattttagggtagccttagctgaatgcagataaccagttggaggcagaaacacattatgatcactactgtgcaataagtacacaaaattaggaaggaaaacttttgttaaatgggactataccttagatatttttatttttaataatcaaggaaaccattgggagcctaaaaaccttaatgtatcacaaattctttccagataatcccttgtttattcaatcaaaaaacatgacatttgtctttaatgatccaaatgtaatttattgttatatttgagtagttattgtactagcaagggacactatcagaaaaattgaagaaaatagaactattctaagtaaaatatgtaatatgttgttaattcttgaatatctataattagtgtagagcaattcagtatactgtcttcttaatttctgaatatgtttgaattattctagcatataaaagaaataaatacaaatataccaataaatttgtgcgtttttttttctcttatagtgttcactttatgcaatatagcaagaaaagctacatcttttaaaaagtgattatcctagtctatcttagacagtaagaaatagtttttatcaccttctccccttgtggcttcctctctaccatggttaccaagagattttcaaggacatctaacagttctcataattcaattccagcctaactattgatccttgaaaagttaagtgtcaacaagtcggttgcctcggtagcaatttcccggtgagcagatagtttcttgttgaaaaaaatgaaagcctgaatcttatagaattaattgacctcagaaaagttcaagattgtgcagcagggtcttgagacagtagcaatatcttatttggtccatgtaggatgaaatgaaatgcaattacttttgacctattttctgttacatttaagagaacttgatttatttttgatattaattatgtgtaaatgattacatagctgactgacaattatttttcaatgttcaatatttgataatgtgtttgtttataaaattatacataacctaaaatagcaaacacatggcaattgtacttcatttctcccccattaacagcaaattagataggctacatcttagaaaatattatgaaattattgtacatcagctgtataattcacaactataaccactctattgcataatattaattaaatatagctctattcactttgtttattagagagaagcatgttgttatttttcataagttagcaggaatttacttcataaaattaatagattatattttataagtataaatgagaattgatttaaagcaaccattggcaagatggttaatactggtgtgtatatgtacttctataagtttcatgccttgtatcataacacaatctttagggatttactgctctctagttatttttgtaagagttatagtttttaccattctgtacactaaaaggtgaaaatatactcaggaacagaaagaggaatgtaagaaatgtggtagatcacctgaggtatagaatattgaatgttgctcttttatatctactctcttgcttccataccttatttttcttttccttagtatagaatagattttattcagggcatggagaggggagtcaaaagggtagtagagacagagaaaggcagagagtgagagagagagagaaaaagggagggaaagagaaagaaagagaaagagaaagagaaagagaaagaggaagagaaagagaaagagaaagagaaagagaaagagaaagagaaagagaaagagaaagagaaagagaaagagaaagagaaagagaaagagaaagggaaagggaaagggaaagggaaagggaaagagaaagaggagaggagtagaggccagtaattagcatgtggacagagaggagggaagcaaatggggagagagcaggagcaggaagggaagagcaagagcataccctattttttctatatcctatttccaaaaattcactggtgctgagaatctgaggtaacttacaattttgcactgtctctttttcttttcccacctagaatatttaaatacagtgagcaattgttataatcatttccatatataccatcttgattgtttttaccctttctccctttatcttatttgcttgtgaaaatcacaaccctatttaagcctattgattcatttgtgctttgtcgcctctatttttgctgcttatcatatatatcatatgtgtgtgtgtgtgtatgtgtatatatttttctttatttacatttcaagtgtaaccctttcccaggttctaccctcccaaaattcacctacccaattccccccccctgtttctgtgagggtgttcttcttcctatccacccactcccgcctccacaccctagattctcctacaatggggcatctatctagccttaatatgaccaagaacctctcttcccattgatgccagacaatggcatcctctgctacatatgaagctggagccatgggtccctccatatgtattctttggttggtgatatattccctgggagttttgtggggtctggttggttgatactattgttcttcctatggggctgcaaacgcctcagctcctttagtcctttccctaactcctccactggagtcactctgctcagtccaatggttgcctgcaagcactcacatctctatttgtcaggctctggcagagcctctccagagacagctataacaagctccacactttgcttctgtatttcctactgtgagtattttgttcccccttctaagaagaatccacactttgatcttccttcttcttgagcttcatgtggtctgtgaattgtatcatgtattacaaggttttgggctaatatccacttatcagtgagtacataccatgtttattcttttgtgaccatgttacctcactcaagatgatattttctagttccatgcatttgcctgtgaatttcgtgaagtcatcatttttaatagctgagtggtactccactgcataaatgtagcacattttctgtatccattcctctgttgaaggacatctgtgttctttctagcttctggctgttataaataaggctgctatgaacatagtggagcatgtgtcctatggacatagtggagcatgtgtccttgttctatgttggaaaatattttgggaatatacccagtagtgtgtcctcaggtagtactatgtccaattttctgaggaaccacccgactgatttccagagtggttgtaccagcttgcaatcccagaaacaatggaagagtgttcttctttctccacatcctcaccaacatctgctgttatctgagttttcctgacggagggaactatggcaatatttactggttttaatttaagtgaattatcatgaaattcaaatggaaccttaatgtttctcagtggtcttactatgtattcttggttcagtcttccctctgcttaaataactactttatgttttcctgcctgtcccatacctacagcatatcttcccaactgtttcccacttcatgacaaaaaatgaaacaggagagatctttaactctatgtacctgtcaactggcatttatatctacttaaactccttacagcctattactatggataaattactaagactcttcccatcattcttccttggtcatcttcctggttgcctacttgaaactatcatctgactgcttctctttactttccctatatcatggaagatgtccaaaacaactgactgtatcactaaaatgtatgtgattctttacgtagttaattataccttaatacaacatttgtctgtacccatattttttatgagcctcatcacttaccaaagctgcttttatcaaattcttcaatgacctaaactgaccaagccagctctgtcagtcaacagggtctcaaggaagggggtaaggatagaaggaaaaaagaaaagaaaagaaaagaaaagaaaagaaaagaaaagaaaagaaaagaaaaggcaagacaagacaattaggcaacattataacatgactcaagacagttctacagcttaagctgaagcgggtttaattttttctagcctgtgtttatatcattctaggttaatacaaagaatagggtgagttctaggtcaaggaacaaacaaagcataaataaaatagtcaaggaacaacaaggcaataaacaaagtctgtggtcactgttgtctagatcttgagcctacttcctagtcctagcccagtgtcaaattcttacctgagcctactttcttgtcctagcccaatgtcaaattcctagaagaggcccctcaaagcttgtcacactaaatgatgctaatgacaatgaccaaataatttttaagtcctctgatgtcttgttctatcagtgcatttggcatacctgatcttctacttcattttgacaatgttctttatccttattttagactctccttctccttagcgcattttgtcattcttccctaagttattttcttggcaattcttatttttcttaaacaattaatgttagataggtcaatatttctgtggtttctgacttttaaaagtagatcatggaatctaagtatttgagcaaaatttccatttttttttaagtttggagagacctttgctctccaaacaacacatgctaatgctcacaaatagcttcattttacaaactctgactgggttctaacaccaacagtagcctaaacagtgataatataatcctcttagaacatagctagagaaggtttagtgttaattaaagtggaacagaagaataaacattctcatgactgtataatagatggaaaattactcatgcactccaggttatatttgaacacttagtactaaagtcaaatgttgcctcagtgtgtgtattcaggaatcaacctcagcttatttgtttcaatagctattggaatctctagaaaagacactttgttcaatataggagtccttaccactaagcatagtgtaataaaatagtattctgcaaggaaatttctactgctattgatctgtgtttcttctcaaacttcctttccaacacaaaggaaaacttggaaaaaaaacatgtaatcagaagtctaatctcaggcatgaaaagcaatttctacaaatgtattcattagaaccaaggaaataattactgggttgttgataaatgtattggccagttggcacttgtatatagttctaacgctatgatgctgttttatttattgctaccaacatcattacattgcctttgtagctaagtctctgtagctaaggtactcaggtttatttcctggagtgattacttatcatctctgtggccatggacaggattaggttgaaacagtagacacacagcttcaaaactataagctgtagattgtgattacaatattatcagaatgactgacaagtatgaatgtttgtgtcttgctttctccacatggaaaatgaaaacttctttactcacttaacagatatttttaatacttgtgttagatatggagtatttgcatttcatgatatacatataagttcctccttgcattctagattgtggaaacatacaaataaaaaaaaatactcccagaatgtgatgggcaacatcgatggtgagcctaaaaaaggtcatgctacagaagcacttttgaaacttctcttatttaggtgggcatggcagtttctcagagaaaatgatgcttaagatgagatctgaagtaaaagaaggaaccagtccttttgaagttctttggagcagattgttttagtcaacaaacaacaaatggaaaggtcatggaatggaatcatgcttcatttatttttgtagttttatgcttgctttttgttctttggaagcaagtttctcatattcaagaaagccagagggcatggttcacacacaccgattactgggatgtctgcagagtaaacccagagcagctagagagcagcatcctttgaggcagaagatagtgggatggtactgaagctgtggtagtgaacacacagaatgaaaaaatgaaaagaaaacatagtgtgcaaagatatggcttggagtatgtgcacatgcatggcaaaggaaggagaaaagaagattgacagccttggaaaacagtataccagactcagtgcctagtcaagttctgttaaacacttctgcaatgaaaactataaaacatgagagaaagaagttgttgaaagtactaaaagataaaaagaattcccatgttttttggatcagaagaatacataatataataatcatcacattcctgaaagtgttacacaaattcaatccagtttccataaaaatttcaataaccttcctcacaggaatgtctttaaaaatctaaaactcacagtgaaacacagaaaaccccaaaaaatagaagacccccctagcaaaaagagtggtgctgtaggcatcataatatctgacttcaaacaatacacagagccatagaaacaaatcaagcatgatactgacatgaaacaaacagttgaaacaaatgaaatagaatatccagaaataagatgaagcaaatacagccatctgtgtcttgagaaaggcactaaatatagtacaggaaaacctactttaccaataggtacttgaaaaactggctatctatatgcatagaaacatttgagctttatctctaccccatataaaaatcaggtgaaaatgaatcaaacaacttaaggtaaaaatttatgtctttgaagcttgtagaaatcttaagctagggatagaccaggacttaatagcccaagaaataagagccacagtagacgataaatggaactgtattcactcaaaaagctttgctcactgagagacagaatgaatagaaatcccatagaatgataagccaaaagttgactaatatagagaatgtataaaattataaatattaaattaaaaattcaaattaccttatcagtaagtgctaatggcaaataagtattttaaatatatatgttccatctttaggcatcagagaaatgtcagagaaatgtaaatcacaaagacagcgaatgtcctcctcagtgtagtctaaaaaaaaataacaaatactgatgaagatagggtaagaggaggagcatccttagtcattgccaatgaaaataaaaattattccagcccctatggaaattagcgtgatagtccttcaaaatgtaaaaatatgtattttgcataatctagatatgccaatgtgctgcatataagtcaactcacttctaggacacacacacacacacacacacatgtgtacttgtgtgtgtgtgtttgtgtgtgtgtgagtatctaagttatggaatcagttgaggtaaatgcatgaaggaagtgtggcatacaaattcaatggagctttacccaactataaaaaaagaatgagcaccatggtccctggccaggggagtctccagacgacagaaagaacccacaaaggatccgccatgggatcctaagacctcctccagtgattggaacagagcgcctgctccaatccaattgcacaggacctgagactgcattaattaaggaagcaggtaacccggcctgatactgggctcaagtcccttccagctggctcactgcagcactgaggtccctggcccgggggagtgcaagaggtgagcttgcatgcagagagtactctgaccactgaaactaaggatagagctagtctcccaggtctgctgatagaggctaacataatcacctgaggaacaagctctaaccagagacaactataacaactagctccagagaatacaagatggcaaaaggcaaatgtaagaatactactaacagaaatcaagaccactcacaatcatcagaactcagcactcccacgccacctagtcctgggcaccccaacacaaccgaaaagctagacccggatttaaaagcatatctcatgatgatggtagagaacatcaagaaggactttaataactcacttaaagaaatacaggagaacaccactaaagagttacaagtccttaaagaaacacaggaaaacacaaccaaacaggtagaagtccttatagaaaaacaggaaaatacatccaaacaggtgatggaaatgaacaaaatcatactagacctaaaaagggaagtagacacaataaagaaaacccaaagtgaggcaacactggagatagaaaccctaggaaagatatcttgaaccatagatgcgagcatcagcaacagaatacaagagatggaagatagaacctcaggtgcagaagattccatagaaaacatcagcacaacaatcaaagataatacaaaccacaaaaagatcctaactcaaaacatccaggaaatccaggacacaatgagaagaccaaacctacggataataggagttgatgagaatgaagattttcaactcaaaggaccagcaaacatcttcaacaaaattatagaagaaaacttcccaaacagaaagaatgacatacccatgaacatacaagaagtctacagaactccaaatagactggaccagaaaggaaattcctcctgacacataataatcagaacaacaaatgcactaaataaagagagaatattaaaagcagtaagggagaaatatcaagtaacatataaaggcagacctataagaattacaccagactattcaccagagactatgaaagccagaagagcctgtacagatgttatacagacactaagagaacacaaatgccagcccaggctacgatacccggccaaactctcaatcaccatagatggagaaaccaaagtattagacaaaaaaagcaaattcacacattatctttccacgaatccagcccttcaaaggataataacaaaaaagaagcaatacaaggaaggaaaacatgccctagaacaagcaagaaagtaatccctcaacaaaccaaaaagaagacagccacaagaacagaatgccaactctaacaacaaacataacaggaagcaacaattacttttccttaatatctcttaatatcaatggactcaattccccaataaaaagacatagattaacagactggctacacaaacaggacccaacattctgctgcttacaggaaacccatctcagggaaaaagacagacactacctcagagtgaaaggctagaaaacaattttccaagcaaatggtctgaagaaacaagctggagtagccattctaatatcggataaaatcgacttccaacccaaagttatcaaaaaagacaaggaaggacacttcatactcatcaaaggtaaaatcctccaagaggaactctcaattctgagtatctatgctccaaatgcaagggcagccacattcattaaagacattttagtaaagctcaaagcacacattgcacctcatacaataatagtgggagacttcaacactccacttgcaccaatggacagatcatggaaacagaaactaaacagggacacagtgaaactaacagaagttatgaaacaaatggatctgacagatatctacagaacattttatcctaaaacaaaaggatataccttcttctcagcacctcatggtaccttctccaaaattgaccacaaaacaggcctcaacagatacaaaaatattgaaattgtcccatgcatcctatcagaacaccatggactaaggctgatcttcaataacaacataaataatggaaagccaacattcacgtggaaactgaacaacactcttctcgatgacaccttggtcaaggaaggaataaagaaagaaattaaagacttttagagattaatgaaaatgaagcaacaacatacccaaacctatgggacacaatgaaagcatttctaagaggaaaactcatagctctgagtgcctccaaaaagaaactggaaagggcacacactagcagcttgacaacacatctaaaagctttagaaaaaaaggaagaaaattcaccccagaggagtagacggcaggaaataatcaaactcaggggtgaaatcaaccaagtggaaacaagaagaactattcaaagaattaaccaaacgaggagttggttctttgagaaaatcaacaagatagataaacccttagctacactcactagagggcacagggacaaaatcctaattaacagaatcagaaatgaaaagggagacataaccacagatcctgaagaaatcgaaaacaccatcagataattctacaaaaggctatactcaacaaaactggaaaacctggacgaaatggacaaatttctagacagataccaggtaccaaagttaaatcaggatcaagttaagaatcaaaacagtcccatatcccctaaagaaatagaagcagtcattaatagtctcccagcccaaaacagcccaggaccagattggtttagtgcagagttctatcataccttcaaagaagatctaatcccagttctgcacaaactattccacaaaatagaagtagaggtaactctacccaactcattctatgaagccacaattactctgatacttaaaccacagaaagatccaacaaagatagagaacttcagaccaatttcccttatgaatatcgatgcaaaaatcctcaataaaattcttgctaaccgaatccaagaacacattaaagcaatcatccatcctgaccaagtaggttttattccagggatgcagggatggtttaatatacaaaaatccatcaatgtaatccattatataaacaagctcaaggacaaaaaccacatgatcatcttgttagatgcggaaaaagcatttgacaagatccaacatccattcatgataaaagtcttggaaaaatcaggaattcaaggcccatacctaaatatgataaaagcaatctacagcaaaccagtagccaacatcaaagtaaatggtgagaagcttgaagcaatcccactaaaatcagggactagacaaggctgcctactttctccctacctcttcaacatagtacttgaagtcctagccagagcaattcaacaacaaaaggagatcaaggggatacaaattggaaaggatgaagtcaaaatatcactttttgcagatgatatgatagtatatatatataagtgaccctaaaaattccaccagagaacacctaaacctgataaacagcttcggtgaagtagctggatataaaattaactcaaacaagtcaatggcctttctctacccaaagaataaacaggctgagaaagaaatcagggaaacaacacccttctcaatagtcacaaataatataaaatatcttggcgtgactctaagtaaagaagtgaaagatctgtatgttaaaaacttcaagtccctgaagaaagaaattaaagaagatctcagaagatggaaagatctcccatgctcatggattggcaggatcaacattgtaaaaatggctatcttgccaaaagcaatctacagattcaatgcaattcccatcaaaattctaactcaattcttcaatgaattagaaaaagcaatctgcaaattcatctggaataacaaaaaaccgaggatagcaaaagctcttctcaaggataaaagtacctctggtggaatcaccgtgcctgacctaaagctttactacagtgcaattgttataaaaactgcatggtactggtatagtgacagacaagtataacaatggaatagaattgaagacccagaaatgaacccacacacctatggtcacttgatcttcgacaagggagctaaaaccatccagtggaagaaagacagcattttcaacaaatggtgatggcacaactggttgttatcatgtagaagaatgcaaatcgatccattcctttctccttgtactaaggtcaaatctaagtggatcaaggaacttcacataaaaccagagacactgaaacttatagaggagtaagtggggaaaagcctcgaagaaatgggcacagggaaaaaattcctgaatagaacagcaatggcttgtgctgtaagatcgaggattgacaaatgggacctcatgaaactgcaaagcttctgcaaggcaaaagacaccgtcaataagacaaaaagaccaccaacagattgggaaaggatctttacctatcttaaatcagataggccactaatatccaatatatataaagaactcaagagggtggacaccagaaaatcaaataacccccttaaaagatggggctcagagctgaacaaagaattctcacctgaggaatacctaaagtctgagaagcacctgagaaaatgttcaacatccttaatcatcagggaaatgcaaatcaaaacaaccctgagattccacctcacaccagtcagaatggctaagatcaaaaattcaggtgacagcagatgctggcgtggatgtggagaaagaggaacactcctccattgttggtgggattgcatgcttgtacaaccactctggaaatcagtctggtggttcctcagaaaatttgacatagtactactggaggatcctgcaatacctctcctgggcatatatccagaagatgtcccaaccggtaagaaggacacatgctcctctatgttcatagcagccttatttataatagccagaagctggaaagaacccagatgcccctcaacagacaaatggatacaaaaaatgtggtatatttacacaatagagtactactcagctatgaaaaagaatgaatttatgaatttcctaggcaaatgtttggacctggagggcatcatcctgagtgaggtaacccaatcacaaaagaattaaaatgaaatgtactcactgataagtggacattagcccagaaacttagtatagcgagatataaggtactatatgcaaaatacatgaaactgaagaagaacaaagaccaaagtgtggacactttgctccttcttagaattggaaacaatcacccatggaaggagttacagagacaaagtttggagctgagacaaaaggatggaccatctagagactgccatatccagggatccatcccataactagcctccaaacgacgacaccattgcatacactagcaagtatttgttgcaaggaccatgatatagctgtctcttgtgagactaggccggggcctagcaaacacagaagtggatgctcacagtcaactattggatggatcacagggcccccaatggaggagctagagaaagtatccaaggagctaaagagatctgcaaccctattgttggaacaacattatgaactatccaataccccagagctcttgaatctagctgtatatatatcaaaagatggcctagttggccatcactggaaagagaggcccattggtcagacaaactttatatgccacagtacaggggaacaccagggccaaaaaatgggaattggtgggtaggggagtgtgggggtgtgggggacttttgggatagcattggaaatgtaattgaggaaaatatgtaataaaaaaaagaaaaaagaaaaaaaagaacgaaattatatggtttgtaggaacatgcgtgaaactagagatcactacattaaaagaaaatcatactacaaagacaaatatcacatgtttttcagtcatatgttaaatgtaggaaaaaaatgacatgtaactataaaggttattgtcaaggatggagaaaaggctatgagcattcacttctatatttgtcagacacagggtctccaatgaaggagctaaagaaaggaacaaaggagctgaaggggtttgtagccccataggaggagcaataatatggactaaccagtacccccagagctccctaggactaaactaccaaccaaagaaaacacacagaggagctcattgctctagctgcatatgtagcagaggatagcctagttggtcatcagtgggaggagaggcccttggtcctgtgaaggttctatgccccagtatagaggaatgtcagggccatgaagcaggagtgggtgggttggtaaacaaggggaggggggaggaaataggggattttctgaggggaaactaggaaaggggatatttgaaatataaataaagaaaatatctaataaaaacaaacaaacaaacaaaggatgtagaaaaggcaagatgcatgatagagagggataaaaaagtagcagaaggagtaagtatgattaaaggactctaaatacctgataggaatgtcatgatgaatcttctcactttgtacaattaatatgtactaatttaaaaggaacataaagaaatgaactataagtaaaatacagaaagccagatataaacagcaatagatgagactagaagagcaggctgagaccaggtcctgttgcatattattaaccaaaaggaggtacttttgattagtaatcagagaaaaaaagggtgctagtttgtattaagatgaagaatagcatcatcaaatttacagtttataaagatacagtttataaagataaagggcagtggtggcacatgcctttaatcccagcacttgcgaggcagaggcaggcagatttctgagtttgaggccagcctggtctacagagtgagttgcaggacagccagagctacacagagaaaccctgtcttgaaaaacaacgaacaaacaaacaaaaagatacagtacataaaaggagaatgaagcataaggcaaagttgggaagcatttttattaattgaaaagaaatgtaacagtaattcaaactgtgttggcatctgtggaattagtaaaggggtggatcctaggtatgcattgtatctagctgacaggtcacagcattccctagaccagtggctctcggctctcaaccttcttaatgctgtgaccctttaatatagttacttctgccatggtgacccccaaccataacattatttttgttgctatttatttatttatttatttatttatagtatgctagtacacttcactctctggagacatactggaagacatcagatcccattccatatagtcgtgagccaccatgtggttgctgggaattgaactcaggacctttggtagaacagtcagtgctcataaccactgagcaatctctccagccccttgttgctatttcttaactataattttgctactgttataaattatcatgtaaatatacaatatgcaggatatctgctatggaacctaaagggttgagaaccactgcactcgatggtaaaaagagttgaataatgggtaatttctatcctgttaagtgagacagaagacgtgaagaaggacaagaatcagagtatccatctcaaagtgctgagaatttagcaccaatgttcacatagagttctccatacaagattttctttctatatccactaccacaactgctataattgcaagcagaatgtcaagcttttattacaacaaatggtgtaatataaagaatatcatgtataacccttagagcaagcccatgaggtaagtcatactattaggaatgataaaaaacaaaaacaactggtacttataaaggttaaaaaggcttgcccagtgatatagctgagactaaggcagctgtttcagattccagagttcaggcacaaatcagcttgctctacttgcttctcatttagtacctattcttcataggaacctatctctctgtatcatgacaaaagaggtgcacttatgttaatttatgtctgcataatgatatgtggtactatttgcagtttccttggtgaacagtgtgatctcatgataaagaccgaatcatacagattaaagatgaacaacagagggcagtagaatagagataataagttcatgaaaagtaaagatcaagtccaaaaaggaattttcagaaatagaatcagctcttgtttaataatgtcagaaatgctgtggtcatttttcagtttccaaactttataaactttatacaaaagtgtttttaaagatgcttttcattgagaatctttgtaggaggcctgtccttaaatggcttgttttttttttttttttttttttttttttttgagacaaggtctcatagtttagtgctggctaatttggaattcactatgtagacaagactatgctcaaaataatagaggtccacctgcctctgcttcctaaatattgggattaaaggcaggtaccacaatgcctggattgttctttatttttgatgatttaacttctagatatccaatgtataaggttcagaataaattccagaaacattcatcagcatatcacatgatggtgggataaatataattataggttatggtttatgtttgtctaagaactcattgcttgacatagtacatacatactctcctttattcaactcaaagttgaaatgattaataatgaaagagaaataataagtcattcattcctaactgtaggtgtttagtttaataaaagtatgttttcactcaagattagtttggccattaagcatcaattacataagaaacaactctctacagagtgtcctctgtgtaaaaagtactgaagtgagcaaaagcaaacaaaaggtctctaacttctaacagattaaaagaatctgtggcatgcctacaaattataatcaagcaaacacaattcagaacattgaacattccttcttatgtgattcaacacagaaaacatagcccagaaactaaaaaaaatttaaagtttgaatatctaaacctttcctgtgtttccttaaacatcagagggggttgtctcttacttccaacaacacaaattatttgagtttttttttaatttactttcactctcagcaaccagaaaagggtgtggtatctcttggtgttgggatatagaccattgtgaactcctggacatgggtgctcaaagccaagatcaggtctacaggaagaacagcaagtacttttgacagaaaattatctctccagcctcatatatattacttataggtattcctttcaaatgtaatttgttcaaattcctttttttttttttgctcatcactctcattctctgtatgataaacatctgtgactgatatgatatttcatgaaaagatagcaattgacttgcagagtcagtggcatctaagtagtatctgaaatgactcacggttgttgaaacagatagtcaaggttttcacaggttgatggaacagtacttgaggtcaaggaggtagtaaaacaaggtcatgtactgggaaaaatgcgagagaagttccattggaacatgggcttctcaaggtctttgttcttaatgtaaaccacacaataattaacctttatttagtagaggcttcagatagagttggagcttcttagaatggaagttaaacaaaagagctaatgtataatttgacctgtagttaggcaatagagcatgcttataacagatgacagccccatggagaaaatgtatatttaaaggacactcattaaaaaaaaagcaatgctcacctcagcactgttaattagagcatatattccaacacatacttctaagaatgaggaccaatttgcatggaaccgtcctgaccctctaccgtgcacaatagtctccccatggcaagataagttggttgttatttggtgggaatggtctagacctattactgtgaaacaacataaagtcagagggtgatgtacatgcccaccctgaggtgctgaatgcattaaaataaaaccaaggctaatatgcagctatgcatactcattttaggccagatcacaggcaatatacacttacttgtatataaagagatattagatgatggttttttttttttttttttttttgtgctattaccctgatttcctcttgatgccttttccttgactccccttaaggaaagggtttgttcatgctttatagtcgcaatattattctcagagaggaaatgtcttctcttcttttaactttagcttattccatagcctcttcacacatagagtgactttccataaatgtcattagttgactggcagaaactctcaggtccctgaaatctggaggcatttttaagttactcatacaaatctgtttttgttgtttttgtttttgttgttgttggttggttggttgtttggttagttgcttgttttttgttttattttgtataccaggctggcttctaatttgctatgtagttaaggatgacctttggaacttttgttccttctgccaggacctccctagtgttggaaatgcaagtgtaatatcacattcagtttataaatttccatgcatatttttcttgacccccccattcttttcgctttcctgcattctcccagccccctcctattttaccaatgcaaatagcatgtacaaaatttttgaaaggggaaaaatataaagaatgattctagttacaccagttccttgttaagtagaataataataataataataaataacacttagaaacctggtttgtatttagaggcatgtagagatacatctgtatcataagtaatgtttttgtttgtacacatagtttagtattttatattgatctcacatattgtaaaaagaaaaaagggaaagtgttgtttttaagcggaatatgcttcaaggttttcttgttattttgaaacactaggcaaatttagctttgtattgtgtagatgactcatatgaaagacagtggtcaacaaaagggatttccgtaaccattctctgtgaaaactgttgttatttccaaaggaacatctcaggagggctgttagcacttggacagatggaaaattagctgttttagacagaggtattaggtaggcccaataaaatcttcttccctcttccttactgtcagcaaagtatttttaaaaattgttttgcatttatttgtttattgattgattgatattttgtttgcatgcaaatatgtgcatatgtgaagatcagaggacaatctactggagttggttccatctttccaccatgtgggttccagggatggaacttaggtctttatacttggtggcaaagtatttttacccactgagccatcttttagcccaagaattttgtctttaaagttttctttgttcatagctgccttgtcactatgtttccttggtctagagccacagaaatcttcctgcctgtatgggtttgtagaagctactcaaatgataaactcacaattaattttggttgtcactttttaagttttatagttatcattttaattttattttgttgagacagtctttctataaagcttaggatgggcttggactcaccatgtagcctaggctaccctcattcctgtgttgatcacctcatctctgcttcccaaatactagtatcttaggcatatgctaccacactttagaccttagactgaaagaaagtgtgccatatgtgctttcagggagatgattttattttttctccaatcctttcaaacataaaacgaatatccaaacagtgtgaggattttactagaacaaaataataagaatatgttatgacactgccaatacttgtgtctggtgtccttcttatgactccattcctagcctctatcctaaagccctgctctagagttctgatgctatgctaaggccaagtttccttttggttgggcccttttacaaatgagtcacccatatttagccatccattatttcccctcaccccactgcctgaatactctgaaataaagcacccttcagaaagctcccctcttttatatccttgttcaatgtaaacacaagcctaacacacaacaaaagacaccttgctttcctactatctagtcactcagtctcctgtctcagaggaagatacagcctttccaaattacccatgcctataaatctatgttttgtctttgggggtggggacaaaataatttcactacatttataaaacagacatatataaggagtactatctccttggccttacttgaccctgcaacatcttgtacctcatttttctcatcccctagccctaagttcccttttcaaaatgtctttcaaaacctttaaaaaacataactaaatgtatctcagcagaacttcaggcaaaaacttgaatggattttgtttagtgaaataacaaatggtgttgtcctttgaattataaaatttagtaatccaataggtttgcctcaggattttatacgatctcataggtgatcatattatatggtacaatacatgtgatcatattgcctgcattccaagttctcttctgctacttccttccgaatagctcaaggtttcccctactcactctcttaacctcattttagtccttctcttcacagcctataggacttgcagaagttctcctcacttcttgtagtttctgctcagccaccatcctgagtgtgcttgaatatgtacaataaatgcaaggcttcatggactttgttcagctgcctcaaactctgtgattttgccttttgattcttcccctgttcacactgttacatacttcattgcctgataggttcctaactcaggttgattttgctttctagtggacatacagctatagcccagaggcaattttggttgtcacaatggaaaggttagggaatgaatcacatagacaaataaagactaggaattctcctgatcaccctacaatgcgcaagaaactgtaacccacaataaagatctatccaaatccagatagcaaagatttatacaaatccaaagacactgaaattaggaagccctgcagtagagggagataactgagcccaaaaagtgtttggaaaattgcaagctagggatctggcctctaatcctgatggcaactataccttcaccaataacagacgatctaaaatcagatctctgttcctctggttgtttcacagctacagcagcgtctcattctctaggcttgtagtgcctagaggatagccagtgctcttctagtagttcctcaatctggctcaggtacagtccctcttcctccttcgacctgtggattaaaatttacacatagttaattttgacatatcttagaaccacaagagagagaggaaaagaccaacctccagcccagcttttaccccctcctccaactcatacctttccatcccactgccctcccactgagacagagttctgttccactttctgaatataccaagagcctttgaaatccatgttctcctccatttagcatgatgccaagttggaagaaggccatcagctaacactatgctttggtccatgtggactggcaaaccctctgtgcactctcagtagctgactcaccttggagcagttggcagaagtttcctgttcagatctgtctctggttctgccctctggggactagggacgatttctattaagaggctgtataatcttagaaatccttgcttgtacctggtgctggcatcctctgtagtcttgcagaactctcattcaggtggaaaatctctgccatgttaattgaatcaatcataaactttagagtaacccattccaggtcccatttgatggtttaatttcttttgatattactctgccagaacatgagcctcttatccacttcactcctgggaacaacctcactaggcttgacctgttaggggtaatagaattccctcagaacgtaagtgccctaccaagttctttcctgggaaatttgggataatctactacttactagcagctaattcaactcccctgtcaattccagtagtttgtttgatgaagtgttttttaaactacttttctgatccaggcattataatacagatctacaaccttaaaactttagaaatggaatcaagaagatgtgtaattcaaggtcattttcagctacatagtgagtttgagggtgtgatgagctacaaaaatccttgcctcaaaaattagatggggagtgggggaaggacaaaaaaaagaaagagaaaacattttgctcttcttgtgctaccttgacatggagagaatctagtaggccagaacagaaacccacttcttagcctattgtgataaaatggatctttgtataacacaattgcaggaagtatgaaatagctgagttctctggagtccaatgagcagctctgtactctggattctcccactaatgctcctctaaagttgtctggaaaatagatggggctgttccccaccttagccagatctaggcataggctatgccctccagtatggctatgatccaggacacaacttcaagttatccactgactctttatccaatcccatcctggccttagaatttacctcccttcagattctccacattgagaaccggtttgcatcaaataatccttttgacttcctcatttgagggctaagcatgtggagagggaaggattttgtgtatttagctatcttggtccaccaggcactaaggagataatacacatatacataccacacacacacacacacacacacacacacacacaccaacatacacacaaacacacaaacacacagagtgaggccattctggggttgtgaatgctagtgatctggaatacaacagaaatcattccaaacatctgcctccccaaaccatttctaccatcccgtatctcacaccaagatttatcccattttcttcatgaccaccccaactccccttctccaattctggaggaccctccaaactcccccagaaactgatttcccatttgtttgtttcagttctattttgcattccaaattcactaagggttttgcagccaaatccccttcccacagtggaaacagttttccctccttgaaaaattcacagctttacaccaaggacagtcccaatccccaggcctacggaatgctgaaaatctcttgtcttttggtagttcttgatgatctcctctgtggattctcatatcagacagatgacttatatcagaggccatagaatagggatacacatgaggctgtctttctgtggtcggtagttgggatgtggtgggtatggctgggaaggggctttcataggagtatgtgaatgaggctgggagttggacaataaagggctcagaggacacagtggatctcagatttagggactgagagaaagagcacatggatgccttcttgggtctgagatctaatctctgccttttcaggggataatttttgcacttcatgactcctagaagcttcatgaaacttccattgggatcctccaagacctcttctggggaagttattgtccctgacagggcagtgtcgctcatatttgccctctcattcggtcttcctgtggcagcagccatccactctgccaagttctcctttgtgcttgaccattgtgtccttatccctcctcttctgacaacagcgggaggaatggccacagctggtcttactgcattcgggagagccctcagctcctaggaaaaagtggaaaggttaagactcctttgaagaatgtggtattgacataggcatgggatgggaaggggtaagacaggaccaggtgacaagcttactgcttggaggatcttcagtctcagtaggtctctctctctctgcacttcttctagtttggcctgagccatttgaagctggagagctacctccttctgagccatctcttgctggtggatgagctgcttcaggtctggtgacaaggagagtgcagacatcttatgtaggctagacaagtcttgtagccactgcaccccatgcccttgtaagcagccttgcctgtgagcgaagcgcacacccaaggccagggtaccccaggcacaggcttcccgagcctcattagagacctcactatcctcaaggatgactttgaacttgtcttccacctcttcccaagacagggacaggttctcaaggtagaaatcagggcctttgtcgtgcttggccatttgttcattgatgaacattgacaccttgctatgccggaacccactaccaagatcctcaggattcaaggccatggtggttgagtgtcttacagacttttctggccctggaagatgaaataaacctgtagtccttgctcccttagcctcttggttttagcacctcttctctccttcagtgtcttactggccgtttgttcttcccggctctcccattcccacccatcccctccccttccctcccctctggtcttctggaaccctcccttcccttcccctcccaccaggctctctggctccaccccccaactattatgtcataatgactcctggtagctgctgtttaaagtgtcttcagagcagatctcacctttccagttcttgatcagaggaggttcagatagaccatgtctgtctacttgctgtagagtccacctaacacccgtgcaaagacctgcctaccatgcttcaagggagaaagcacaaccttgctagcctatctctctccaaagacttaagagaaggaaatcttcagtcaaattctcatggcttttaactaacgactgttccaacttccagactgtgaaagtagtaaggaaagttagtggaaggtctccatacctccttggaaataagggaaacttacacacacacacacacacacacacacacacacacacacacacacacaaacacatgcatgcacgcaccacacacacacatgcacacgcacacacacacacacacacacacacacacacacacacacacaaatcctcatgctgtggggaagagcaagacaaaaaagacttgaagcaaaaagaaatgaaactctccaaaggaggatttaaaatttacatgctcctcttgccaggagcttattccttgccaaggactgatgtgcttcagcctggaggtgcagtgtttcacatgtcttaaagacttccattaccaaactcttccaaccccccccccccaaaaaaaaacaaagagcaaaacaaacaaacaaacaaacaaataaaaacccaaccacaagtcaccacttcttgattaaaagagaaaaaaatctgcaaattaaaatttatttgaataaatgatagttcatgaattcagcattattaagaaatagtaaaaataattaagagcatttcaaccatcagacaaaacagagggatagataagccaaacctgaaaggagactacctgattggttgtagcaaggcatttgacttactgggcattattagatcactatgctgcctgggattagttgaaaaccagtttattttgactggaggaaattcagctttttctagaacttttaagttgagatttgtttaagcatttgaattaggctgtagttaagcaggaaatgtatgtagagtacatcatattgacctgtagtttatttaacttatttaccattttatttttattactttaatgtgaagtgtttttttttaatttaaaagaattagtaggtattttaagccattttatgtttttagaaaactgagcagaaagcattttctgcctactttattcccaacatcaatattagtttcactttttaaaattactgagataatttagtacagtattaattaaatttgagatggaagttcaccgtcagaatagtataatctgtaggactttaaaaatatatatcatatgtatccactatttttgtccttcaaccatccacatctcaccctatttcctctaatgatgcaataattaagaacatttgatggatgttcttccagaggacctgagttcagttcccagcaagcacattgagtgacacacagccacctataactacagctctcaggcaacaagtatcttcttttatctttcacaggtatctcctacatgaataaaaatatgtttattttaaaataataatatccattaaaaggatattctaagagacataaagtttgactaaacaattaaaattctgttgctctgaattactattaacttaaggtttatgaattcagaccttgctgggcagtggtggcacacacctttaatcccagcacttgggaggcagaggcaaagggatttctgagtttgaggacagcctggtctacatagcgagtttcaggacagccagggctacatagagaaaccctgtctctaaaaacaaaaacaaaaacaaaacagaacaacaacaacaaaaaaacccaaccaaccaacaaacaaaaaaatcccaaacaaacaaacaaacaaaaaactgaattaagacctaggaagcccatgtcttctgtcaataagtgttcatgaaatttgttagcaaattcatcaaaatctctcagactttacagttctgacatttgggaatgtaataaccctatcagcacaattgcatttactattctcattttttttcatatcccaaaaatttgagagtcatctgaccaaagacccattgttaagatactgtagaggtggggtttgaacccatgtctcttgattttaggggctatattttctcaaacaacaatcttctcaagtacagttaaatttattttctagagttaccttcacatattccctaactatactgtgaactataaggatataagtagatgattctgagttggagattaactgtaacatgccaaaggctggatatttatatcagtggaagatcaaagcacttgagaaaatattccctgttcatacctccaacatatctttgtttgatacaacatcatgtaaaaagcaaagcaaagcaaagcaaagcaaagcaaagcaaagcaaagcaaaacaaaacacaaaacaaaacaaaacaaaacacaaaacctctgactcttcaaaactctacgaactaaaagtacttaactaaaggggattttttttcaaatgaccttgtatttcttccaagttcttttatagcttaaatactttttattcttacattagatttatttactttcaatgtatatatctagcatagcaagtagcaaatagttgtcattttaatgattacatagaactttttttttcattgaatgtcatcaataaacttgccaattagccctctttttggtcttctattgcattaatattatatggttgtagctttgtgtagttactgtttaaattagttttaaaattgttgcattaaattcaaaaatatttctatggactggagagatggctcattgatttaagagcactggctattcttaaagagaatgtagattcatttcttaacactgacatggcagcttacaattgtctaaaaattctgctttcaggagatctaatatcctcttctaatagccacaggcaccaggcatgcatgtgtaacactatgctgcacagacataagaaagttttcttttactaataaattttgaggaatgaaaaatcagcaaaggacatgggaatttgctacagcaatatttttcccccctttggaggaggacagtctcctttaacaatagtagattggtttgtgtgtgtgggggggggattttcagtttttacaagttttgttttttgtgcatttatgcctgaatgcctatctgtgcatcacatacatgtgcagtgcctgtggaatccaaaggacagtgttacattctctggaactgtagttatatatggtggcaagcagctatatgggtgctagaattcaacctgggtcctttagaagctgtgaatgtgcttaactgaaaagctgtccttgtagctccaatttacatttttatatgtgtgtatttatttttttaattagatattttctttatttacatctcaaatgttatcccctttcctagtttcccctccaaaaatcccctattctttctcccctccccctgctccacaacccatccactcccacttcctggctctggcattcccctacactgggacatagaacctttacaggaccaagggtctctcctcccattgatgaccaactaggctatcctctgctacatatgcagctggagccatgagtcccaccatgtgttttctttgattggtggtttagtcccagggagctctgacattactggttagttcatattgttgttcctcctagggggcttcaaaccccttcagctccttgggtactttatctagctccttcattggggaccttgtgctctgtccaatggatggctgtgagcatctacttctgtattagtcaggcattggcagagcctctcaggaggcagctatatcaggctcctgtcagcaattacatttttaaagtgccaaaatgaagggttttttaggttgttgatcactagatatttttggaatttacaaccaaaaaaaattttttaaaggaactaagactatgaaaggaaccatttaaaaagaattctgctatatcataagcccttttcctaatgcttctaattttaggtttaatttttcctattttttagattcctgaccattgattaacccatgtgttacacaaaatcatatatactcaaaccaaactttagattttgtaatgtaaacaacttataaatgtgggttataatggatatttcgattttttttaatgaaagtttgagtcttgcctttgcctgagaaaccgttttatcaacattccctcttagaattgcatttggtaggaaaaaaagcaagaaatgcaacttaaactagagggcattaaacttttgtatagaaagctatgacatttatttgaaaatttgcagcagcagatttgctacatatgtcaataaaatttttcttagtacgttatttgtaaacacatacttctaattttaccagcttacaaaattgacacgataaccacaaattagtttgagtattaagcaatgttagtatccatttctgaaattaacaaccaagagatcttcatcttagctagacacattttacaaagttaatttttaatcttctttacatttacattttattcctgttatttgataccttgcccactcattttcccttatgatggtagaattaactatgataaaaactgtggacttagaggcagcttcttttttgttttgttagttttacactcctggacccaaatatctatgaaccaaagattcatagaaataaaataattctgtcagtactgaacatatactgactttttgtcagtagtcactagacaatatagtataaccattatttacatatttacatagcttctacattttattagttacgagtcatttggaaattattttaagtatccaggagaatgtacacaagttatatgcaaatatattatcctctattaaaaataagcttaagcatctgaaattttttgcttcagaattgtgttggggcatcctgaaacaattcccttatggatacaaagagataattcttcctgcaaagattacagatgcaagtaattgtaagctattgctgggatagcattgtaaaggccctttccttacattaagccagagtgtgtttcttgtccctcttgggatgtgaagagagagagaataaaaatttatgatcgtcattcttgcatactagtcagcctgcctcctcaacctagcagagctctaattgtacctaatgaaagaaaaagtaacatttaggccccacttgcaggaattttttttttaaatagaacttgcctgaggcatttttcaaaataaaatctaaataatgcaagattgttagtaggaactgtgccagagctggattacatgactaataaaaatcaacttgaatctcagactgtcagggaaccttgatcacacctcttctaggtcagccgcagtgacaacaggactcaaactaggccttgtctttaagttcgggagaccttggttatcaccaaccatttcatattagggcttgttcatgggttaacaagcaatttgtcagtcacaattgacatgccagtgagcagatctagaatgagtataagcagggccctggcctacggttgtttgtgtttaagggttagggaagggattgaaacatttcctcctgcaacttatcagccatcctcagggtgagtcccctgcccttatggtcaccccaagttaatacaagtgctgctcacagggtctaaatcaatttagtctttggagaggttggagaatgaacacatgagagcatctcttgtgcctgcaaatctttgcctggaggtctggattttattatagaaaacatttgtccaaaaagtctaccagaaaatttagtgggccatcattaaccttttaacctccaaagttctgacctttgtcctgtagctagtattttatagtacctgaaattttcttttcatttgttctccttttagtatctaattcagtgtatctttttgatcctttcaggctttcctggtcctctggtatttgatttgttccccaaattaacacctgcagactatttcctgttcaagtaactgtcctacctactggcttattttaaatgtttgcaatcattattttgtctctaaaatatatttgtgattgcttgtgattttcatataagtatacattattgttattatttattgatgatatggataactgcaagctatactaaaaattctggttttataattataatttattgaatacctaatatatgacaaataattgatattttacatattttatttggcatgatgtacatcattacaatactactttaaaaatgtcaaacgacttttaaattttaatttaaaaacctttgagaatttaatatattaaagctgtatttatattattttatccctccttcttccctaaactctgcccatgttccccacattctcacttcctcttaaattaatgaactcttctttaattattgctgtctgtctgtctgtctgtctgtctctctctctctctctcacacatgcacgaacatacatacacacacacacacacacacacacacacatgcttgctgattctatttagtgttgcttgtattgtgtatttgtttagtattggccacttgcgattcaataacctatgagggagttcatccctgaaaaagactgaatctttatctctcagcagccattaattgcctatggctcttcatctaggggtagttacttgagagagttccctcacccaagttaagatatcacctggtctcgtcattatatggttcttatataagtgaacatacttttgagattttgtggatatagctttcctgtcaaataaagaagatactatctcatagcatcctagtcttctagcatttacaatcttcttgtacctccttccagaatgttccatgaggcttcgtttagggtttgtgttgctactgtatctcttggagttgaggtccccacagtaagctgagctttacatgttgactttactaaatggtctgtctctgttgcacaaaggaacttctttggtgagagatacatctgtatatgggtataaggataagtatttaaaattcagctataaattacactggttaagaaagtagcagtaagtgggttctcctctacgatccatgcaaccatgagtagctggttaggtttacagcaccaggcatggattccacatgaactggctgtacatccaattagagaactgttggttactccccttcctccaaatataagtttactgtcataccattgcacgtatatcgtgtcatgcttgtcattgttgaagctcataggttttacatctgggtagcactattgattgtttttctcccttggaagtttgcataacacttttagataagatgataatttgttcttatgattgattttcctaagtgagctccaggtctattcttataagtcctgtgtttaaagtgtgtgctgtctttaataatactgaccttcaagttctgggagacaaccaaggacatggtgaatagccaaattgttttagaagattcttgaatttctttgaccaagaacttgaagaaaagttgtccatgtttgacattgggttttgtttgtgtcaatgaagtagctaaatcttgtttgtcctactttaaagttggtgcactgtaaagaaacctctgtattagatttgtcctttcttttaccttattttctgctcacggataagtgcattttggatagtgaacttattttatatgactatgcgttctatctattatttctttttcttttttcttttcttttttttttagaagccaagacacacattagcacacacagaaatcacacgaaatcacacaactagaagccataatacatatgcaaaggacataaagtgttaaaaaaattccatgacttaactttttgagacaaaaaaccttcaaaggtgccattgtgtttgttttctgttagctttctactcagggacatgaggcctaactacccttatgagtggcttgtttcttcagtgagattcccttgagtccattgatgttaggagatattaaggaatagtgattgttgcttcctgttatttttgttgttatttttatgtttgtgtggctatcttcttttgggtttattgaaagaagattactttcttattttttctagggtatactttccctccttttgttggcattttccatctattatcccctgtagtgctggatttgttgaaagatattgtgtaaatttggttttgtcatggaatatcttgttttctccatctatggtaattgagagttttgctggatatagtagcctgggctggcatttgtgttctctctctgtctctgtctctctcttttgttttgttttgttttgttttgtttttcaagatagggtttacctgtgtagctctggctggctgtcttggaactcactctgtaaaccaggctggcctcgaactcagaaatccccctgcctctgcctcccaagtgttaggattaaagacgtttgccaccactgccctgccatttgtgttctcttagggtctgtataacatctgcccaggatcttctggctttcatagtctctggtgagaagtctgctgtaattctgataggtctacctttatatgttacttgacgttttctccttactactgttaacatttttcttttcctttttcttcctttttttttttgcgtattttgtgttttgactatcatgtgatgggaggaatttcttttctgatccaatctattttgagttctctaggcctattgtatgtttataggcatctcattctttaggttaggaagttttgttctataattttgtttaagatatttactggaatgccagggccaaaaagggggagtgggtgggtaggggagtgggggggtatgggggacttttggtatagcattggaaatgtaaatgagctaaatacctaattaaaaatggaaaaaatacacacaaaaaagatatttactggccctttaagttgggaatcttcactctcttctatacctattgtccttaggtttggtcttctcattgtgtcctggatttcctggatgttctgggtcagaagctttcagcattttgcattttctttgattgttgtgtcaatgttttctgtggtatctcctctataactggagttaaagatggttatgagccaccatgtaagtgctgagaactaaatcttggtcctctgcaagagcaaaaatgcacttacttgagtcatctctccagctccaatcatttgttctttttgaatcccagttgtttggttttggaatcccacattagaaacaatggaaagcagtatcatacagaatatactggtgctgtacttgaatgtcagagttggtttactttagtactatcctttgataacacttgcctagtcccagtttatgagtgttttgttcgttattattttcactgattatgtttgtttgtaacccgaatgtgtacagccattgcctttctgggttttgaatgtttggaatgttgtaaaatttcaaagaatgactactaaactatgcatggcaccaaccatttgggtccctcttcaaaagtgtatttggcatgctaattctgcccaatataggactttacaactactttgatttgtgcagctaccattgatacttcccatttttccccattggagcttcatccctaaggagaagctgttcctttatgtgttagcagtcattagttaattaatgatctttgtctaggggtaggacttcccaccactatcccatttaaagaagtattttaaacacatatatatggttttagaatgagtttcttgtggtaggaagacttaccctaaatgtgattagcatcatggaattaggtaatgtagtgaatcatgttcagggtagttctcctagatgaatatagatactatcaaattgacaattatcttcaaccattacagtaagcaagggggctccctttcttctgagaatgtaggagtctattttgttacttcagacaactttgatcatcactgattgaactgagccttattcttgagtgatgaaaaacaatttatattgtgataagtaatgattatctcaaactcaactcgaaatatatagttatgtcaacttagtgattctacccttgaaagagaagtataaatctgagtatacaaacatagtcactactatcttaaatatgatttaaaaagttaagtaaaataaaagctatatatgttaacaggtatcctgtatacctatacacatacatacatcttacggaaggaatagttggggtagaaaccaatgttaagttccacaatcactaggagaactaccaaaagatacaaagaacagaaatgtctctgacaacagttctcataaggaacccacaattttcctctttaacatttcaggaaacagtttttattgctaggaatgaagtctgactgtgttacactttcatagattgctacatcttagccttggaactctgtaactatctcataatcaggaatgttcccataaccattttgcttcataccattttgttggttgaagacaaaagtcgctatgtgttggtttgatgccatttcttatttctaggcaatgccctaaatggaaaagtcaatattcttgaaatatatagagtacacaagttgtaaacagccaataaagccattttcttatttctttgttcctacagaaactccacatattgcatgaaggtgtcaatgtccttgactgttgcagagaatgaatcaggcctgtgctacaatagcaggatccgctacttagagaaatctgaagttaccaaaagaaaggagatctcatgcccagacatggatgactttaagaagtctgatcaggaacctgatgtcgtatggtacaaggtaacttagcatgaagtctagttttttaaaacattatttaaaagcagccttaggggttgaaataaaattgccagtttttgatattaaacagttttcttggaaaaatgaatagatttacaaacaagtgacatggagatataattcctatatgtcactgactttcatgcatttccatcagcagatgtcagaagctgactcactttgcccaactgttaaaaataaaaaaaaaatacacccaatcaaataaggataaagattaaaaacaaaacacaaaacaaatcagttaatggacatatagaaatactatgctttataaagaagaaagggccatcattatcagtagtatcacctatgaaggataaccattgttaccatgatgcataagatgagctactacattagaggcagaagtgacaaacaggcttcgtgctgctcatgtaaacacagttaaggttatggttagctgggtgtaagctatattcagaggtctaatagaaaggcattgaatgaagaatatatttacttgtgtagagacagtattgaagtaaacatgagtggtaactgctaactcttactcctaaggagcagtcagtggaattcagaaagaatgaaagtggtctttcaagagtagtagctttagaagagcatagtaagtaacatagcctctcttaacacttgcctacatttctgaagccagttatctcctccccccaatagaacacaggacaaaagcagataggtagaatcagaccttcacttgcactagacctagactaaagcacaccaggacaagcctggtagaaagcagagaatagttatacaactttagatacattattcttgctacaatcatggggccttatagttctataaaaatattttctagagcatagcacatgccactttatacacgcttatatatgatagccacaggtgatcaagtacattttttataggtgcggtgtgcattattggacccgatttcttaagagttgaatttggttgtttctgtaggagtctgtggccctgcactacccaaggattctgatacctgaacattcaaagctggtagaaaaatttacatttggaaacatgttcatttcacacttggagtaacttactaacagataccaagagaatgtgctcaactctcacttccactaattcttttttcttaacaaagatattattattattacaaataacatttatcccctcaagcagactattgaaatttaatggaacctttcatactatcatcaaaatcctttgcatctatgaagtaattattatattttattccctacaataagctttgtctctacattatcctacctaaatatcaatacaattctgtatggtgagtgtttttatgctttgtaataatgagaaggaatcttcgagagaagcatcgtattacatttatttatggtgtttgtatgcatacactgtagctgtcttcagacacaccagaagaggcatcaggtcccattacagatggttgtgaaccaccatgtgagtgcttggaactgacctcaggacctctagaagagcagtcagtgctattaaccactaagccatctctccatcctgagagagcattttcttaattactatgcttttccataatgcttcagttttgatcatggatccttcgatatgatgcaaggttcatgaaaaccagccatgctcctaccttcaaaaagaagtaataaaagagttcacttcaatttttctttttatgaggaaaaggagagttgacctaccccagagatagcagctggaggtaaattccaggtcagcaagctctttgtgcagtaattcattctatctcatcttcttatcttctgctaccttccttctgcccctttacttatgtcttataacactcctagtcacttactcccaggaaaatgctacccctcactcccctctacaaatgaaccaataaatacagaacaaaaggatttcaaagctctgcctgagtaataatgtctaaagtctagtttattaactttaaattatcttaattgatagaagagcataaaattgtgtgtaagagttgtgcaatgtgatgttttaatggttgtgtacattttgcaatatttatattgcaatatttacattagattaaaggaagctatctcctcaggcaagtatcatttgtttgtgttgagaatgttcaaaatcctttcttttagatattttataaaacttcaataccttgttaattatagtcaatttactataaattaaaaccatatcacaaacttgtgatgccatatgaatgtaaattcaagaagttaacctcttcctcctcctctgtactgtgagttctgctctcaacttctaagagatgctttttgcattctatatgcgagttaaatcatttggtacatgtctctttgcacctgacttcagttaatacaataatctctagttctcaccatgttgtcataaatgacagaatttctaggatgtcataacctttttcagttaccattacactctatctgcataacacattgtctttattcattagttgtacatgtaagtagttcccgatatcctgctttttgtttgtttgttttactttcagtaaaatttgcccttttcctttaatatactaaatgtttgttctcttcattgactccatctttagaactactatataaatattttatctgtattttgtggaagaagagactagagactcagaaaaactaaatagtaatgtatgcttttcattttggatatgacactaaagaaactatgaggcatccaaatctgttgttaaccattgattctcacattaaagttcaagcaaaccctagaagatgctttgaggtactaggaaaatattttcttcttgaagttaatatttgggtatggcactctatcctctttgaagtctaaatttcctacctgacaacacaggaaggaaattttctctggctatagaactgctatatgaagtggaggatatatttgtagaaagttcattctgggacaaaatctagttttgaaatgtcttatgtcttattttcccagctcttttgtagctatcttttcaaatatgcaatctttacaatcttgtttccattatgttcacccctattcctttaattgtctctcttatactgttactcttacactctcttgtgagtttccaagattgtgtgaaatgtgttggtggtaacctctaatggttattgtcctcgtcccacttgtatcacagaaatgagtcttagctgggatgtattcacaaagggatactgggatactgggaatatattcataaagatggatgagcaagccaattttgtctgtgcatataatgcaagggataaaagtaagtggtccaactagcttctattgcatttcattggttaacagaaggaggacaggagtggagctgcacttttagaaattcttcctgattctatatgaatgacagctagacactggataaaacattgcatgacttttattagcattttagaaatgagaagaatattttatttcctgaattaagaacatttaataacttcttattctctgataacagttttcataagagcatctagtcttttttaatatttttcttcattttttacattacttttcatctgaaagtattaagtttacatgattgtatccattatacattttcatacatgtatagaatatatgtatttttgttatgccataccattactgcaatttgtctaccttcttctcatcccttaatttccccaaaaagtttacacttcatttatccaatttgtaaaggaaagggacctctagcttttcaagaataataacagaacaagcacaaaaatgtactttggcatgcaatattctcctagcttgactagttgtctcaattggtagcccagtgttaatgaagtaaaagatggcagtttgactttttcttgttttcactaggcctgtctaattgtggatgtttctctttagttataattgatactgactaagaataaatgatttcatattcattcattcaatagatcattggctcaatgcttaatttctgggtaacaacctgggtgagacacaacattaggaactggcaatggtgtagtgatgaaattaaacacatggaaccattctcctggaggtaatgtataaataaactggctcttcgcaatgctctaagaaggatatgtttcaatcaaaatatgtaagaatagcttctacttttgactaatagcatccatgtagtaagtcaagggcaatgcacatgcatgtttttcaccaaaagaaaagcttaaaacaatgatttaactgtttctcaacacatagatggaaagatctcccatgctcagagaatgggagaattaatatagtaaagatggccatatagtcaaaagcaaaatacagattcagtgcaatgcccagcaaaatcccaactcaattcttcatagagttagaaagaccaattctcaaattcatttagaataacaaaaaacccaggatagtgaaaactattcttaacaataaaagaatttctgggggaatttctatccctaacctcaagctgtactacagagcaatagtgacaaaatctgcatggtattagtacagtgacaggcatgtagatcaatggaatagaactgaagacccagaaatgaacccatacatctatggtaacttgacctttgacaaaggaagtaaaaccatccaatgggaaaaaaaagacagcattttattttgttttattttattttattttacaaatggtgctggtacaactggcggtcaacatgtagaagaatgcaaataaatccattcttatctccctgtacaaagctcaagtccaagtggatcaaggacctccacaaaaaaccaaatacactgaaactaatagaagagaaaatgggagaaatcctccaatacatgggtacaggacaatatttcctgaacagaacaacaatggactatgctctaagatcaagaatctacaaatgggacctaataaaattgaaaagcttatgtaaggcaaaggacactgttaataaaacaacatagtaactatcatatttggaaaagatatttaccaaccctacatccaatagagggctaatatccaatatatacaaagaactcaagaagttaggttccagaaaaccaaataaccctaataataatggggaacagagctaaactggaaattctcaactaaggaaattcaaatggccgagaagcacctaaagaaatgttcaacatccttaatcatcaggaaaatgcaaataaaaacaaccctgagattccacctcacaccagtcagaatggctaagatcaaaaactcaggtgtcagactggcatggtggcacacgcctttaatcctagcactcaggaggcagaggcaggcagatttctgagtttgaggccagtctggactacaaagtgagttccaggacagacagagatatacagagaaaccctgtctctaaccagtaccccggagctcttgactctagctgcatatgtatcaaaagatggcctaatcggccatcagtggaaagagaggcccgctggacatgtaaactttatatgccccagtacaggggaacgccagggccaaaaagtgggagtgggtgggtaggggagtgggggggagggtatgggggacttttgggatagcattggaaatgtaaatgaggaaaatacctaataaaatattaaaaaaaaccaaaccgaacaaaactaaactaaactaaactaaactaaacaaacaacaacaaaacaaacaaacaaaacctcaggtgtcagcagatgctggcaaggatgtggagaaagaagaacactcccccattgttggtgggattgcaaactggtataaccactctggaaatcttttggtgcctcagaaatttggatatagctgaggacacagctataccactcctgggcatatacccagaagatgttccaaaatgtaataaggacacatgccccactatattcataccacccatatttataataggcaggaggtggaaatgacccagatgtccctcaacagaagaatggatacggaaaatgtggtacatgtacacagtggaatactattcagctttaaaaacaatgacttcataaaattcttaagcaaatggatgcaacttgagaatatcatcctctaccttgggcacaaacccagtggtcaggagcttggtcacaccaggatctcagggtatcagaggcagcttgactcccaggaactctgacatacccagaatatcaggatcacaggatcctggaatcacaggatcaaagagaaagctggactctgaggagtcctgaatgaactgagattataggaaggacaggctccaatcagatatatggagggcagcaagcatttgagataatcagacagcaggaggcaagcataagaacagaatcaacagaaaccaagtttacttggcataatcagaaccaaatgctcccaccatagcaagtcctgaatacaccatcacaccagaaaagcaagacatgaatctaaagtcacttctcatgattatgatggaggactttaagaaggacatgaataactcccttaaagaaatacaggagagcagaggtaaataggtagaaacccttgaagaagaaacacaaaaatcccttaaagaattagagaaaacacaaccaaacaggtgaaggaattgaacaaaaccatccaggatctaaaaatggaaatagacacaataaagaaatcacaacggagactaccctggagatagaaaacctaggaaagaaatcagaagtcacaaatgcaagcatcaccaacagaatacaagagatagaagagagaatctcaggtgcagaagatatgatagaaaacattgacacattgacacaacaatcaaagaaaatgcaaaatgctaaaatctcctaaccaaaatcatccaggaaatgcaggacacaatgagaaaaccaaacctaaggatagtaggtatagaaaagagcagagattcccaacttaaaggaccagtaaatatattcaacaaaatcataggataaaacttccataatctaaagaaagacatgcccatgacaatacaagaagtctacagaactccaaatagattagacaagaaaagaaattcccccatcccataataatcaaaacaccaaacgcacaaatcaaagaaagaatattaaaagcactaagagaaaaaggtcaagtaacatataaaggcaaacctatcagatttacaccagacttctcgccagagaccatgaaagccagaagatcctgggcagatgtcatatagaccctaagagaacacatgcatgccatcccagactactatacccagcaaaactctcaattaccagaaatggagaaaccaaggtattccatgacaaatccaaatttacacaatatctttccacaaatccatcccttcaaaggattaaaaaaaaagtaaaactccaaaacaaggagggaaagtatgctctagaataagcaagaaaatctttccacaaacttaaaagaagatagccacatgaacagaattccaactctaacaaaaaatatcagtaagcaacaattatttttccttaatatctcttaatatcaatggattcatttctccaataaaaagacaaagactaacagattggttaagtaaacaggacccaaaattttgctgcatacaggaaacacacctcagtgacaaagaaagacactacctcagagtaaaaggcaggaaaacaattttctaagcaaatggtttcaagaaacaagttggagtagacattctaatatggaatataatagactttcaacctacagttatcaaaaaagataaggagagacatttcaaactcatcaaaggtaaaatctaccaagaagaactctcatttctgaacatccatgctccaaatgcaagagcatccacattcataaaggaaactttactaaagctcaaagcacacattgcactgcataaaataagagtaggagactttatcattccactctcatcaatggacagatcatggaaacacaaactaaacagagacacagtgaaactaacaaaagttatgaacctaatggatttaacagatagctacagaacattttatcctaaaacaaaaagatatatcttcttctcagcacctcatggtagcttctccaaaattgagtatataatcgatcacaaaacaaacctcaacagatacaagaagattgaaattatctcgtgcatcctatcagatcaccatggactaaggctgaacttcaataacaacataaataatagaaagcccacatacatgtgaaaattgaacaacagtctactcaatgataattttgtcaaggaagaaataaataaagaaatagaagactttttttgagtttaattaaaatgaaggtacaacatacccacatttatgggacacaatgaaagcagtcctaagaggaaaactctaagctctgagtgcttccaaaaagaatctggagaggatacactagcagcttgacagcacacctggaagctctagaacaaaaataagcaaattcatccaagaggagtagatggcaggaaataatcaaactcaagggctgaaatcaaccaagtggaaacaaaaagagctacacagagaatcaaccaaaccaggagcttgttctttgagaaaaatcaacaaaatagataaacccttagccagactaaccagaggatacagagacagtatcctaattaacaaaatcagaaatgaaaacggagacataacaacagaacctgaggaaatccaaaaaaacatcccactacaaaagcatatactcaacaaaactgcaaaacctcaacaaaatggacaattttctagatagataccaggtaccgaagttaagtcaaaatcagattaatgaactaaacagtctcatatcccctaaagaaataaaaaaaaacatcattaatagtctcccaaccaaaaaatgcccaggaccaaatgggttttgtgcagagttctatcagaccttcaaagaagatctaatatcaatactcctaaaacaattccacaaaacagaaacagaaggtactctacccaattcatcctatgaagccacaattactctgatacctaaaccacacaaagaaccaacaaagaaagagaacttcagaccaatttcccttatgaatattgatgcaaaaatactcaataaaattctcacaaaccgaatccaagaacacatcaaaacaatcatttatcatgatcttgtaggctttatccaagggatgcagggatggttcaatgtatagaaatccaacaacgtaatccactatataaacaaactcaaagagaaaaccatatggccatctcattagaggctgtgaaagcatttgacaaaatccaacaacccttcatgataatagtcttggaaagaccaggaattcaaggcccatacctaaacatagtaaaagcaatatacagcaaaccagtcaccaacatcaaaaactaattggagagaaacttgaagcagtcccactaaaatgagggactagaccaggctgcctactctcttgaaaatctgaagcattttgagcaatgttgccacaagtggaaaaatacacacaatctttgcttcatgtataaagttacaaagtgctacataaagttgtctttaaactattcataagtaaattttgtatttacctttggtctctgtattcaagactacttgttaggtacatgctaacatttcagaatctaaagtaatttaaaattcaaaacacttctaagtatttttgtttaggaatatttatatttaatctctctctctttctctctctctctctctttctctctctctctctctctctctctctctctctctctctctgtgtgtgtgtgtgtgtgtatatgtttgcatacgtaaaaacagatcattttcagaaaccaagcaatgtgcaggtctataaagacatttgtagcttttttttccactgtgtttaaccacatcagcaacataaatcatttgcatattgcattctgttcccttgcctcctgccttcacttgctttttcttcttctctcaatatgcataaactttacttgaagtcacagcatacatattctctctataggctttatttatttgcatacctataccacattttataaaaacagtatcctactgtgtataccagtcttcagcactctgcattacacacaaacatgaatatttttctatggtcaattttttcagcctagttttctttcccaggtcatgtggattgaactcagcacaacacacttattaagcacatgctgtaccactgagctacatccacaatcccagatctaatttatttcttaatggttcataggatgaagggtaccttatttatttaacattattgtactcgtggattttaaaactgttttattaatcaaaagtttcaatattaattctagtaaacatgaatatatcattttgctttctgttggcactatcatttaatatatgttctgtatgattttcaaaaccagagagaaaaatatcctaatttttgatgatttgatacttagatatcccaagggatgcaacaatccacaaaacaaaaatagaaactgaagtaattcaataacatagatcactgaaatttttcattatattttcttttccaattacaagttaaatgcataatagagaaaaatcaaaataccttatttacaacaatggcaaactgtaagacactcaaaacttcagtaacactggaaaagatgtaagtaaatctaatttatggaaaaaatatgaaaccttagttaacagagatttaaagtttatttctgcatggaaaactatgacagtttaaattgacaaaattaagaactttgaaactgaaaagcgcatttacagagttcctaggtgtgtttgttcttggtgtatctctggtcttgctttttttcattttttttcccaagaagtttcttcaaaataagacccatcatatcattacttcagctgtaatcctgctttatccttaaattgtttttaacaatacatttatttatgtgtgtgtggcaggggagtgtggggactccacacacttgccataggacatgtacaaagaatagagtatggccggcagaagttgatactctgtttcaaccatatggtccttagaattgaactcaggtcaaaagacttgtggtaattacctttacctcaggagccatctgattggctccataattgtgaattattatagaggagccttatcactttgccaatatagtacaaagtaggggaagtattctatgattttgtgattgggtcttagcattttagtgagccttgtctcttggcagatcctatcacacagacctatgatcttaacttttatcttttgctctcaaagaaggaaggccagaagtgttagaggggtcatttttctttgtacaattcagaggctagggggagctttaacgttcagttatttgctccagttactatttgctaatacctatgattctctgcttagggtagaggttttcttcatgcttaggtagaggttttctccatgacatcaactatctgagaaatctgagaactgttgaacttcagtaggtttggctgtgttcttttcaaaatagtgatagtgatggctaaatcccctttaatgagactgaaaaagatggccctggctctagaaatgtaactgcttaaaatgttatttctagagtcctataggaatgttaatcacattgctattcaataattgatggatatttaatctgaaaaagaggctattgagctaacagcaatagaataatagtatttcttacacagttttagcatgtggtattttataatacagggcattgacatgcattgcctcattcaatctttattatttcaataaaaaattgttacccccatttttaaaaaaataggtgcagcaactgttccaaaacataaaactcatatttttatttaagtgttcagatctagaactttaagttttcatgactctgtgctattaataccaacattaagaatgaaggtatgacaggatatttagaacattagagggaaaagactccttggagtaagggattttagatttttgaggtagggtagaggtatcgcttgtaaggttgaggttcattcccagtttgtacttgtggtctgaaccatctgttctatccttatatagcagaaaatgtgggttcactgaagaccattaaccagatgtgtagatgcctcaagggatagtacaaagtcaggtgaaaggacggagtcatcctgagggaggtgggctttacatattcacatataagtgatttgagggtcaaaagttactgacatgcctttgtccaaacagctgctttgtgattaatccttagaatcaggtgatagatttaaatcacccatcctgatcttctggcagtgaggaatgaattgtttgttctgaatggcagtaaattaatcatgcccaccataacaaatggatttaaacacttccatggttatgaggatgatatctcataagttggttatgagtacagtggtgactgtttcaagacaaaaactccaatatccaaatgagtcagccaataggttaatatcaagagactatgtaaacagatgtctcttttgtgcattccagtctcccaatctggcaactgtttgtatgtgatatctgtgtccaaaggaggacaaaagggaaagaaactgaaacttatatactggcattatgttgattgtgcatgaacattttacaaaaacctgctccataaggggagaataaaactataaaatgaaactggatgctaaagaactggagggagacaacttctacagatcttcaaattgatgcagtttatttcaataatattgggactaatacctagtagaaaaatagacaatgtaaatatttatgatttttaatttgattctttggtggttttcctaactattcttagaaaaacaactattctgagactttatctgtgcacttaaaaccttgttcactcaatgatctgtcacaaggaaccacggatgagactgaactgtggcatatatttactaggaaaggaagggacagaaatgatgaagggataacactaagctaaacagacagtatcttagagaagaaatatttcaaataagtagaatcaaggcctagaaaaacatctgcaattctatttacataaatagacccaggtaaactgattaacaaaacaactttctgaatggtagagagagatgggagcagacagattcattcatttatgtggtaaagataacttgctaagggtctctccaatcaaaatacagttcctccaccaacctgctaagactagtgttagagtaccctgtaaagagctgtgcatattcaggcagctgaagtattatggtgctgacaagatagttaaacaattaatgaggatttatttttatccaatcagtccattagctccattgcttattaaacagaacaagagattcgagagagatacgattcaggatcaaaaattttagaaatggaaacattctttgtatctatgatactgttgcttaaaattgtggtgggtaaaaattctgcctttgagtaatggcaaatcagatgtcatttaatattatctccataatagaaagtgaagaactgattcttaaagaagctggctaacacctgcatttcagcctggagatatggtcacccaaacctagttttgtttttgcatctttatcacgtggcctgaggaggaatgaagaaggcatgaagacatttccacaaactgcagttttacaaagacacacctacttctgctagctacaaggagtcatttatatgtctaaatggcaagttagaaagtacacaagactgtctagattcatctcagaggacatgcaaaaattctagcctgtttctcaggatctattttctaagtcctctacatattttagtttttatttcctgcattggggtaggaggtatctgtgatcagtgaatataaaagtacttgtaactaatcacatatgaattttcccaaaatgacattagaaaatgaggccatttatctttgaataaaataagtgtgtgggcttttgcctgcccccaccacctctatgtgagagtagagcagctcagctttcattttcctttcctctcagaatgcccagagggaccgtatttttgtttaatgaccttcagaatgattctttagaaatctgaggctatcagtgttggaagcaatgcgaaaataattgtggattattgttgtatgacgttagtggcagctgggccgatttttttcctctctgtttagacttttcttcattttcccagaaaccttatatcccaaggtttagctcagaagcaaatctcatataggtgataaaccttgccagacatgctatgtaatataatttcagacagactttcttaactgttcttcagaaagaccccagggagtaaagcagccttatatctagatgtcctctgttgtattacttttatttactctctgaaaatgtgtttgggtagttgtagtggacatatctcctgaatattatacctatgaacttaagtgccaatttttgtgctttgttgccaaatctactgctaacaaaaaataaagttatagtgaaaacctaataaataggtacttgctctcacaaataatttataaacattttcgggcactcacagctggaaactgagagtcaatacagattccaacattttgtgagtgcttgagatatgtgtatggaatgtgagggtaaggaagagtagatgcagatggtacatacactacactggttaaaagaaaaaatactttcagctattgtctacataatccactttgtaatcattttttgactcactcagaaggaaaatgataaaaataattttgtcttaaccgtacacctttatagctacctgctatgcttctgttaatgtttgtacaatgaccagctaacaatttggtttaaaactttctagttaaaaggggagagacttagagcaatatataaaagtagtctgagaaaattcccaattcttaagctacttgcctgagtattcctctatacgtggtggctaaatacatgtaactcactagaaaaatattatgcattcctttcttgggaagttcgaagtagcatcaagactttcacatcaaaaggaaaggagaatttgtttcaaaaataaaattttcttcattttttcatttatcaataaattcacaaagcaagtagttgatttctctatgctattactataccaaagtacatcttcattttctgtgtttataaggaaattctgagctctaattttctagattccatccaatctcttttgaccacaagtacagaaagtctgagatagcagtattttgttcgtttgttttgggggtgtttgttctttattttgggtattttaaaacagagaatacttaataaaacacttaaaaacttcaatgctgctgtaaaagcctgctataaatgttttgtgatacaaatgttttgattcccatcaaatatgctacatggccaaatgaaccactgacccttgggactcgtaggaaagatccatatcaattagtaagaacgggacattaaaataatatttagcaacacttaacactactttatgtgtgagttttgcattctgcaagcttgaatgcttttctgtttttgcttagctctgaagtcttgttgctttaggagtcaagtttttaaagtgactcctgatgttgtaactaatgatatttgaactggatgcaatgatatgcatctatgatattgcctggacattgtttaaacttcttagttacacatttggaagagcatatggaagaatacaaccatgcaattttaccttgccaattctaagtcttaggcttgcgaatatttatttttcacttacgactattttccctgtaggaatgcaagccaaaaatgtggagaagcataataatacagaagggaaatgctcttctcatccaagaagttcaagaagaagatggaggaaattatacatgtgaacttaaatatgaaggaaaacttgtaagacgaacaacagaattgaaagttacaggtaggagcttgttctactacagtgtaataaatgaaattttaagtaaaacttgatttgatggtgaagagttttgttcaaagagacaacttcccgtatacttagaattggcagcaaatcacgctgttggcaatatcactcttaataagatccagtgaacaaaagatatatatatatatatatatatatatatatatatatatatatatatatatggaacatgtatgattagaggtcaagggctcattggctgcctacgtgtcctttcctgttatgaaacattcttaattcttcaatccactgctgattgtgagtgtagaactctgaaaagatgctggaaccattctgagatgttgacttaacacgtgtgaaatctccatgtaggcaaaaactgcttttagattggaggatttttttttgggggggggggggttggaatgaaatccgttgaacttcatttacacaaaattctttatgttagagttcttggataaaggaactccaagtgagagaagaaatgagtaggagcccaaaggaatttaagagataatactattatctggtaggtattttagtaattgatttcaaccacatagtatggaatttaaaactatgataatgtttttcacaagagatatggtacatcccaagagatggtgtgataataattcacttttctttgttcatctacaaatcttggttattttacctgtaaactacttgggtagttcttacctaaaatttttggaccagaagtgactcagtacaattcttaaaaaattttggatatttacatataaataatgaaacagcttagtgatgagactcagataaaatgcaaaattaatttatgttacataaaataccttatacaaataaactgtcagtaatcttatagtattttcttatgatcatgaagtcaggtatggaccttttctgaccttttctgtggcattatcttggcattcaataattttttgatattgtagcatcgaggagttggcattcagaagttgcattaatagtcttaagactaatatatttaagccttgcttatctaattacctaatgttgacatcgtctagttgataaataatgacatacacttgctaattttaagtgatttttttaaaaaagactacttttgtttatatctgcctgatcttttagagttagtattaaaataggatgtctgagagtctctgaattcagacatatcactcacatattcaggtaaaattttaatctccaagtttcaattcactacttcacattccatcttaataaataaccattttatttcttagtttcaatttgtaaagcacccgctgtgaaagtttaaatagttcttgggattagaatttcatgttctttctctgtatgagttttcaaagtaactaccatgttgaactaatcctaagtagcaaagatctgcttttgattagtttctgagttcttcaatgtgaaccaaagttccatgacacattcatggcagaagattcaatcacagacttatcattaataagtgacctgaccatgaacaagacatggtcactttgacttaacccacagattcttatcagattcatgctaagcccttgtgtttggcaatcatttattaaagtttatgacattatagcagttggcttggtttttaagctgaactataagaaagcaggcattaagccttctttacagtctcatctaatgagttttggtgagaacaatttttttctttcgttttatttcaaatcctgggaaaaacacagctaaggatgattactgtatacatttatatcgctttaatttacatgtgataatttttatattactaaagtaggggtttaacaattcatttgctaccatgcagagggtctcaaaagttactgtgtatcagagtcatgtggaatgaagcaggaagggtatacatttggattctcagacccttccacatgattccaatttagtataccagtaacagtctttttgttgagggacttctgttccatacctctttgtggggaattgcaggctggtctccagtcgagctgaggtctgaaccccgatagtcataattcacctacatgacacggtagttgttccctcatgctcctggaactccggcccctgcctaaggtaccacctcccacagccctacaaaagaagcatggtcaatagtcacataagcaatggcccaagcttctgaccttcaggctaaactcctccccagttacctagcaacagtgaagaccattaaaaggggttctcagcctgcaccttgctctcttattcctttgtcctctcacttctctctctctctctccctctctctctctctctctctctctctctctctctctctctccctctctccctccctccctccctccctccctcctttctaccttctctctttcccctgcatttctataataaagctctaaaaccatagagtctctgctctgctccttcaagttcagctgcgcactctggtcagtattgggaacttcttccctcttccctttctcctacaacccttgtggctttggcaaagtagctgggggggggggtccccaggcaggactgccccttgaccaccccctgaagagtgggatagaggaatgcccacccagggatgagtgggtagggtagatagcagccttcccacgcctgactgaccagagaatagggaaactctggcagggtgtgggcatctttttcctttcgttcttccccagggccccaggcccccccccccctttttttattttgttcccaacacctcttaaggatcaagaatgctttgaaagacaatgctagaagagaggatttttagttaatttaaaaggccaatgttgtaggtttgatttcctatattacagttcacatacatagtataaacacattctcccaggtctgaaataatttcccttcaacagctaagaatgaacattccaattcatgtggttggtaaccaagggaaacatggcaagggaatttgtaggcaaagcaaatccaatcaatgaaatcagttatttattcactaaaaatttactaactatttgagacagaccagagagagagagagagagagagagagagagagagagagagatcctagagccagaaaaattattcagaaattctttcattattattcccaggtcagtcagtgataatcagtcatataagaatgtgtgtatatatatatatatatatatatatatatatatatgggtatatatatatatatacacacatatgggtatatatatatatatatatatatatatatatatatatatatacacacatatgggtgtgtgtgtatacatatatataaagaaattaaatgttatttttgaaagtggcttctaggtatagaagtttgagttgccatatgaaagctgattcttttttgtagtattatatgcttcatcatgaaagcaattacagtgattttcttctcatcattcaaaatccaaggctggcatcacataaaagcaaaacctacttattcttgtttaaaatctagtagcataaagacatggggcagaaatttcaatatggaaataatagtatttgttaattataaaattatgtaggttaaggttagatggtgtgttgtaagtgtacatattttataagattatcaattttagaaggctatctccccactgttatttgaaaatttataaatctaataaacatgtcttcaataaaacaaatgttaagtgctggttaatttaaggagatcaaattttaaaatgtccagatattaaaaaatgataagttagaaagctaacctttgataacgaaaagatttcctatatgaaacattttcaatacaatttctcgaaatagctttcttattgcaaaatgggattcgtctaaaatccaagttcctgcaacatatttattatataaatcacagcatacttgtacaacattattataaatttctttttatttcctttgaagctgcatatgcatatgtaataagatagaacagaaaacatacacaattgcatgtttagatcatgtgctcaatgtgcccatagctaatagttttatttcccacagcatattttatgtggctgtttgcaattttgtaggattttcccctttattctcacagggcatttgtggagaggactagttgaagtaatcagataagatgggaaatttgggccttagaaggtgaagatgcagatcaggtgataatggaagaagcaggaaaggaatgagagaagatgagcaagataatggaagagagttcctggggtgagcagaggtctgccttaagaaggttgaagagagacataaattactgagactttaaaaagaaacaaaaggagaaatccaacatgagttgacttattcacctggtgaatcattcataaacaaatgcttttgtgcagccttttagaaatgagcattctccatttaggaaacaaaccctagcaacctgttctctgctgaagatgaaaataataaataaataaataaataacaaaccctagcaacctgttctctgctgaagatgaaaataataaataaataaataaataaataaataaataaataaataaataaataaatgggaaaatatttgtatggctgaatccaaacaatcagtaaccctccagtgaattctcaaatgcttatagaatccaaacaagtactatatatgaatgttgtagaccaaggattccaggccttagcggcagtgaattgcaacatactgatgtttctcagtgctgtcaaatgagagtaggctccactattactgggtgctctgacatttttgtaaagaaatagtaaaagcctacattttttaatgtggaaattcctgaattgcaatgcgctctatgaggcatacaaactatgttggttggctcaattgaatttagcaattgttcatttattttcttgccataagcaattttgtccaggaggactttgttttgtttcattttgttttagacagggcttcacttatgtagtgttagctgacgtgaaacgtgctatgtagatcattctggctttaagctcacagggattcaccaagctcttcctctagaatgctaagattaaacaagtgtaccactgtatctggcatgctcagtaggactttaaaacaagcctctatgtggctggctcataatttatttccacctctaatagtggaggggggatgtttgaaatccgagagagtgttggagagaatagaccagctgagaaaagtacttagtaactatcccagtcacaacatctactagactggagagtgaaggggcacattttatggatgtaatactgcaggaagaatattgacaaattgattacctcatagagaagaacattccaaacaatgaagcatgttggtcttgggtgttacagatgaattcgaagctccaggagaaaacacctaccttggctttttcctgaagtggtgtgataaagaaacaacccattgctgtttgttctctcttctgcactttctctctgagcagccagttgacatggtctgaatgcatgtgtcctgatgatcacaccgaaatggatctcatttgtagcttttctgtgacttaactaggaaagacctctgcagtcagtagtacttggctgaattaaagaactttcacgatatgtactgctcttttgctcacacacaggtacagacattgtaggacccaaactggcttgcaccaactgcagtcccattcttcttaacctccacgtcctcctccctttctgagtgacactagccttttattcccccacagcacaccctggatagtgtcccactgactactgtgctttttttaaaatattttttaattaggtattttcctcatttacatttccaatgctatcccaaaagtcccccataccctccccccccccactcccctacccacccactcccacttcttggccctggcgttcccctgtactgaggcatataaagtttgcaagaccaatgggcctctctttccagtgatggccgactaggccatcttctgatacatatgcagctagagacacgaactccggggggtactggttagttcataatgttgttccacctatagggttgcagatccctttagatccttgggtactttctctagctcctccattgggggccctgtgatccatccaatagctgactgtgagcatccacttctgtgtttgctaggccctggcttagtctttttaaagtgttctgatattctcttttctttctaggccgtcttctcagatccttactctgtgttgccactactctaggaccttggacctcagtgaggttagcagtttgtgagtgataagaaccaaaaatgttttcttctgaaccagcttatttgcagtttaatagatatttcaatcctgcaacttgcaggtattactaatggtggggaattccagtaactcttcagggcctgtgcgagttcttctcagactgtgacaattccttgactgcaggtggccgattgtttcctctagaaacaaggtcaaccctattgctgaccttgagagactaaggggaaaaaatgctacttagaattatggaaaggaggtctttgggtgtcaggtgaaagagtgattttctctctttctctttcatcactcttattgtatctctgtcctctccatagttccttcactgtgttctaacctatgacaagagaatatctattaaccctgatgctgacagccagggtcaaagggatcaccagtttctgtcctaagaaaacatttatgtcatgttcctatgccctgcagggagataaatgagcattgctaactatcctgtcagcagaaaggctggcttgtttctctgtaaaactagaggctatgagcatattcattcttgtgggctgatttcacaggcagctattcaggatcacagactagaggtgagggtgaatatggtagagaacacagcagcagaatctggcaagtgagacacatccttctcagtccagctctagaggcaatcttctagtaccaggggtcctcaatggctctcctttctggcttctctgacatcaaggaaatggtagagtaggctatttaaggaaggcattgcattttgattcctgggtgtgtaacctgtgatatccacagaaatagatttttcttaggtccggtgtgtttattagtaaaagtttcgtctactttgctttgcctaacttgaaaacattggtttggtcaagaagacaatagtctatcaagtgactcttctgtaaaatggaaagctgaggcttcctaaggaaagagactagccatgaactcagtttagtagagtggaggagtgactcgaagtccaatttatgggatcagacattatacatcgcatctattcagaactcccaacaaccttttagcattggtgagatcttttatattttttttaaatttaacaagagaaatgaggagttataaagggtaagatccttgcttatagtgagtgacataccaaataagtagtgcagctatgattttattccatatttgcttcaaatgttgctctttaagcactctcttgcaagctacctggagagctcctgcatataactgtgttaagtaaatgtcagtaactggtttccaccctccctttctgcctactccatgttctctgtgctctttgtctatacacatttttgcacttctataatttgtgaagactccaaagacttgtcttaccatcacccatttcattctccacgagtaaggatttcatggctctgtctgatgataatttgtaattattttggagttcccttttcttttcttttcttttcttttcttttcttttcttttcttttcttttcttttcttttctttctttcttcttcttttttttttcagagatagggtttctctatatagccctggttgtcctggaactcagtttgtagaccaggctggccttgaactcagaaatccacctgcctctgcttcccaagtgctgggactaaaggcatgcgccaccaccacccggcggagttcccctttctttagatttgcctttacaatctctttaagatattccaaaatgagctgctctctagagattcactgtaacacttaaatacaacatataattatagatctatgctcattgctatgtgtgctttttttgctatgtgcttttatgtacatgagctcatcataaaaaaagaacatgtaaggtgtgccattttgttcttaattcactgacatagcaattgacattaggaaacaagtttctcagagttccatagcagctacatgatagttttgcagtataagctcaggtgtttttacgaagcctgagctacttctactactagatgcttatagaactacctagagctcatgataatatgatctggtttgactagaatgggtactcttacaagaagaaaaaaaattctatgctgagcaaaatacctagaggaaatactttcaaacacacacacacacacacacacacacacacacacacacacacagagagagagagagagagagagagagagagagatacatacacacataactgtataaaacaaaggatttgtctgtgagaaaatattttttccagagccagaaaactatgatccaaactcagaatctagtggtgtatcagtctaaaattattaatatacttggatgaaactcaaacttttatcttttattgaaaatactgttattttgccatgttcacttggagaaaaataatattagaaaccacaacaattgtgtttggaaattaacaggtaaattacagtgataagtcttaaaatgactgttttcactgtcatcactgtcatttctggaaagcttgaaaaggtgacttttacgcctgtaatcccagcacttgggaggcagaggcaggcggatttctgagttcaaggccagcctggtccacagagcgagttccagaacagtcagggctacacagaaaaaccctgtctcaaaaaaaaaaaaaaaaaaaaagaaagaaagaaagaaagaaaaaagaaaaggtgactttgtaacagttttaccacaagaaagaagttcagcaaatagtctagtacagatggttataattattagagtgcttcagttacaggggatgcattgtgaacacaacgaagttaatgaaggactctggactactcaagcaaaatgctacatggataagtatttagaaccaaatgatttcatccaagggcacacaatcttgtgaaatagtttgtcaattaagatggtcagaaaaaaaatactgttgttcatataaatgagctttttcagttagcaaaggcattttaatgatgtgtgaggcaacaaggaagactgctgaaagaaagctgaggtggaaattagcctcgaggacaagcatgctgaggaggctggccctttcttatccagcaatcccctatgtcattatggttcatccctagtggtttataaaggcagttaaatgtcctctttttactgtcaaaggggaatataatccatcagtttgaatctataaatcatttccttgtaccaagcatactttataacctaagtgtcgctgatttggcacgatgtttcactggggatctggaggagcagctggcaactgccagatgcagcagcctaagtgatgagctgtatgggcacaggtcaggaaggaaagaaaattgattcttttctgggcaatgcctctttaaccttcttacctagcttaggcatctactcacttgtgtgtctagaatatagatctttcacaccagaggttatccatactatgcaatagctctacctatgtcggggtaagagacagatcagcagtaatgatcttcatatgtttttgggttagctccctgagtgatttgcccatttgcaatagttaagatgctcatgaataaccctgccataagagttgtgtgagaaatcaaagtttactttctttctttctctttttctttttttttttttttaccttttctgataataagatattttagtgtgctgagaatgtagttcagttggttgaatatttgcttggcgtatatgaccatcataagttcaattcccaatactgataaaccaggcctgtaatccctgcacttgggagcatctttagctacatagcaaatttgaggctagcctgagacctatgagactctattcccctcaaaacagatacttaaaattatatttcagctacctatacccttttctactcaagccaaacatttcttgatatttttaatttgaatattatatgaataaaatgagttttatgattcaattgaatttagctcctgagaaaataaagtacaaagtaaaaagaacatttggggccaagtgaataaatattaatgctgtgattatcaatatagaacctttagtattctttgtgtttatgtctttgtagtgtgcatgaatgtgtgtatacttgtttacatttgagtgatcatttatatgcagactcagagtttttcttatcaatcaccatccactttatttcttgaggtagggtttctccatgaacctgaagatctcccagtgagtctggatagcaaatttgccctggagagccattgtttctgcctccagagtattggaattagagatgactgctttctctctctctctctctctctctctctctctctctctctctctctctctctctctctctctctctctctttctccatggattctggaaatataaactatagacccgagaatgtacaactcaatgataatagtgcttaccttacatgatcatatcttgaatttccatttccagtaacccaccaaaacagaaaaagagcagactgagtttggggaactacttacttgatataacttagattctgaatagtttaaaaagccatctaggggaagagcagagaaaatgacatttgatgatagaggctttaaaagcatagtgagatacacaaaaattacatattgtaaggttttgcagatataaaaatgactactctttctcatattgatttgtgtgtgtgtgtgtgtgtgtatacttttattattttattttactaataccatggaaaatactggattttgattaaatggggaagactggaagaagctagattttgtgaagagtttcaagaattctgtgttagccatgttttatttgagatacctactagatactttctagagagcattgagtagacagttagaaatatgagtctggcattcagggaaaagtgtggactagagatataaattttggagttgtctgcatggtgtatagggcaggatacaatgaagtactaaattgtgtgggacaactgatgattgctataggagatcaatgcaaactgcagctcctgggccctatgttaaagattgctgctagaatcatgacagtgcgagaaagccattcatcatgattttcccaaagctcatcaaattactaaatatcaagcatgatgtttgtaccttcattttgctgatatgtggggtaactttctgtatttagctgacatttgaatctttagagcaagagaaatacaccttagctgatgctaaaaaatcagctactattagataatctggggacctattattcaccataaagacatcatttctaggctttgccatcccctgaacagccccaatttataggtaaagaaaacttatactagagatgtcctaaaacttacctaatgccacacaccaagtaaagtaggatttatttttagctccacatattgagacacatgactcagtgcttccttagtgattctatcaggatcacaggtcttctacattgtaatacaaatcatttttaaaatatgatgctgcatatgctagctattgaataaaatcttacaatacaggactgttattatggtctctgcaactttttttatggtgagcacactcaaatttcctactaggatattcagtcattgctgaaacacttgcttgaactagtaatttgctgtcaaaccctttacattttctaccaagaggagagcaactctgtaaatgttgtgcaactagaggattataaaccttcctatattattggttcataataagtggtaactattatcattattttttcatctcattcactaactggttcacaaaaagttgataaggcaggcttcactatcttttagtgaagacatcaagagtcagcaagattaagtacttttctaggacacatagttacagaggaactgaaatggaattttatgactgatttctgattcttaagattgtgattttcatattttcaggtttaaaaactgagagaatccagaggactacattagaagttattgagacatattattaaaggtagacaagataacggaaggacctttgaagacagggaagaacagctcctattagcttattaggatacagaaacataaaatgttgttatgatcttgcctccctagtagaacagatccagcctttaggcatcagtgtcctgcttcctaactcaaagctattacaaatgtgaataagaccttctatctaattccatctataaagcttgttgttgtttgatttgcatttttttcttatactatcttaatttaactcatctcaatggaaaacttatcagaatttttactctatcaaggccctatgataacttggtcattatgagtatttcgatatatctaaccacagtaagtggcccagtaagtctgagttgtggtaaggatgagaggagatgtttgagaaataggtagtgacatttttgtatgttctgaagaaagtatatgtttgtcctgcctcgttaattaatacttctttttaaagataaattaatttatacttgtttggaattgtagccacatacactgaaaaacattttgtgtgtgggtatgtgtgatgtacttgtgcatatttgtgtgtcttggtacaggtagaggccattagtctttaccctggggggtgttttagtccccacatttaactatgttttgaggcagagtctctttgttgtttgctgtcatagtgaatatgccaggctatctagcctgagcccctgtctctgtttcccatctcatagtaggaatgctacaagcttgatttaacatttgttcttaggatatgaactcaggtcttcaggcttacaaggcaatactatgctcactgagccatctccccagttccagatattttattttatttcctaagagacacatgaaagctaagaaaataactcagacatacattgatgagcatatgactatctgagctcattctgtaaatgagataacacaagtccaggctgcatggcagtaggtaatgtgtgacactgtccaatgaagtgctgcttcatcccactacctaccactttgtggtatctttcttagtccacacttttgccttggaggctttttatatgccaaacttaatcaatgtcttcattatgattgaaatgtttaagtcaaattaatgtaaagcctttggagagttttgctgatctaatttataaaagtcattcaggcaaaactgtggaagtatatgcggtttttgatattttctagaagttattaacttatgttcttcaataagtttcagaaattatatcaaaggaggataattttcaaactaaccttagcaggctccatatttatcctcttttgattagttcataaatcaattttctaatccaaaatgttttcatccttaaaacctgaagctttcctttgcatttatatggactacaagatcatgtcaaaaattctttattgaacattaaagtcgattagtaggaagtggataaagtcgattgattagtagggagacagccaaaagcagaactgagaaaccagtaggagaaaatatgaggaacacagtattaaggtaagaatagttggatgtcaagatttgcttactttttaaaatatattttatttatttacatcccaagtgctatctaccttcccagtctaccctccaagagtcctgtacccactcccattccccctttgcctatgagaaggtgctctccctaccacctcacctcaacccccaccccccacattccctttcctgggacatggagtctctaaagaattaggtgtatcctctcccactgaggaacttttatacccatttttatgtgtttaccatgtagagtttctgggagactttgatatgaaaaggaacaacccattgaataaaaacagtaccatgtttgagaaaatatgttttcctgagtgcaaatgttagaaaaaaaatacccttttattaaactagcctgtaagcttaaccaaagcagcaaacttatctatgttctctgtttatattaagcacttttaagtaaattgaacacaatcagtaaagataaaaatgttatatgtattacataagtgtttttgtttttctctatgtgtattcattcatttgttaaagaaatactggagttccttctgtatgactaattgtttcaagctcagagaatatgttattaaacaaactcacacacatttcttctcaataaaaacttaaactagtggagaaaacaatcatgcaaatatgaaagtattgtttagaaaacaggtgatacagaacctatgctatgaacaatggaaacaattaaagtgctttaaggaagagtatagatgtcattagggtggagaatggttttgagaaaattccaaatagatatatcttttctagtctatactaagagaggtaattttaaatatgagaatcactgctatgaagacaagataattgatttgagggctactggaagaaagtacaatcattagtattttatgatgttttagatatattttagatataaatacatgtgttgtcttgatttctttaattttgtatatatgtgttgtggatgagcctggtgttgcccttgtgaaccaatcccctaatgagtagaggagccaatcactgggtgactaggcgggtcttctgaattggagaggggaagagaggaagcaggagagagttaggtctttttggacagggatagcatggggacaagatgtaactacatgtctcccagtttcaatggctgatctgtaaggatcaccactggaagatttttatttaataaggcatacaagatcaagattttagttgctgcacagaatgattgagttaccttcatagtttctgaactaagtttgtgttgtgttttccttcactcagcagcttgtctgggttcaagagagaaaggtactgaggcaaaacatgggtttgtctgaggtgcaccacaaccacaaaagccatgggggatttgaagcatagggttggcttggtagtgactcaccagtggaaacttagcaaactgagtggagagattttggagctctgaggcagagtctccacgagataaaaacaagttggcccttgcctgacagtgcttggatggccaggcctcttgagcagagtgttgccagcacaagtgtgggaacgtggcagttctttttgaaaaaaatatttcccacagcatatgtgtgtttctctttgtcagtacaggtgcatataatccatgatgcatgtatggaagttggataacagctctcaagagttgattctgtcttgtcatcttacagaatctagttatcaaactcaggtcctatgtatggtatgagtgtctctacctggtgagccttttcatagaccctttattctcctaagtaatgcttagactttttctcctttcagcatgtatgtcatggtgatttaaacagagaaagactaggtttggtaaagtcctttcagccacagataattttatgtgctattttgtgccaagaaccatgctggatgttggaaagatagtaaataaataaataaataaataaataaaattttacacacacacacacacacacacacacacacacacacacacacacacatggtttatatccacaggaagtacatggtcagttaggaaagaaaatatagaaaaataacaggcagttgcaatataatagtaaactttttagataggcatatgcccatggtagtgaagactcccagatttggaaaatatccaggaagatggactcatctgggaagtagagagagaagagctattgtagagttagggtttaatgacccatgcatttgctaaacctgtctaccagataataagcatggaaaagaaaatgacattttttgttagtttttccttttcctcttctgtttagtataatgagcaacttggctgtttattatgtgtgtcagagtcaagaggcaatttccagtgtcactggatggatggtatctcatctctggtggaacaactactatgtttgtaggttttaaagataatatacacaattgtccagaaagtctcactgataaagtggtacttaataagaacttgacagaagtaaaggacatagcaatgctgatatttcaggaatgatatttctggataaaaaggtaagaaatgtaacagctacaggaagaaagaagcctttagattgcaagaaacatcaaggaagccagagtgccttagtgagaagtgagatgaagttaggagataaaatcagaaatatagtgaaggtaggatttcagatcttccaagtgtgtataccattgcatgatttctgtcatttactcttagctagacagccattgaaatgttttgaggaaaggtttaaaataatccactatatttgtttggatctcattggatcctggattaaaaatatactgaagagagtaaggactaaggcagagagatcaattaggctctttctcaatggaatatgaaggctacctaaaaaaagagaacttaatttgttaataaaaaaagatgaaattgattttgatcccaagacattgatttgtttcatattctataaaacaaatgcagataaattagaatgtttttagccagcattttgctgtccagtgttttgcttaggaattgcattcacagattttattttcaatttaatactgtactatgaaatgcatgtatagattaaatgcttaaacacaagttactataaataatatcaaacatattgtacatgcaactatgtttttaatgtatgatttaactagaagaaacagtaaaaaaattagtaggttattgatatatttttacaggaagtttcaaattttcaaacagaacttggattatcatatttagattttttaaagctaagctggaacaagatggtctctcttctaatgctttcttttataattttattattattttcattttttaaaattttgaggctataatgtaattaataatttgcccccttcctccccctatactctcctatatatttctccttgcttactttcaacttcttgcatttcaattttaaattaatatttttattaaatgttgctatatgtatacatgtatatatatacatacatatatatacacaaatatacatacatgcatgcatacacacacatgtctaaaatataaatacaacctgctcagtctgtaaaatgtttgtttttaggactgacaaaccaagcaagctcagttagtcaacagggtcgtgaggaagggagagaggattgaaaagaaaaggacaatcagacaacactataccataattctagccagttctgaagctaaagtggtctcatttctatccagtctgtttttatatcattctaagtatatacaaaaactatgaccagtcctagataatagacaaagtagtcaaagaacaaacaaggcaataaagaaagtcctgtagtctctgtgttttatcaggatgaccaagatataaggaatacaatatattccttggctgtatttaccttgagactactttcttatccttgtgcaatgtcaaattcctgccaaattcctagaagcagccccaaaggctctctacaactgaccatttggtaggggataaccagtgtgctctttcttggggaagacaatttctccaggtctcagaattccttagttgtctgcagtttttgtgtagggttgaggtcttgtgggcttccacccagtaatattagcattcttattgctgtttttcttgttcatctaaagttgaggcagacttgctggtgagattttatggctatacttgatattactagaaggcagtctcatggtaaactccctgatcttctgactcttacaatctttcttctccttttttcaacaataaacttttaatatattaattaaattataattttcaacaataaattttaatatattaaggaatatggaaaaataagttacaaatgattttgaatattttggcccatataactagaaatacagtgactaattattgacgtgatgaaggctagacctcagtggtttcttttttggtaatggtgcatttgaaatgtctttcatgtatcttacatatgaaatattggatatacagttgcatatgtgaattccccaggaaggactaccaaagaaaaacgtactttggaaacaaacattatataagtgctaagaaaaatctatatgatcaactgaagactgttgaaacataatgatgacaagatgacaaagtctttatcataagaatcaaatccttgttccatatccctgccttacactattttctcaggttctttctcttgcagctatgtatctcttcattctttagatataattactaagagattgttgtgaattaggtattgttttaggtaaaaaatatgaataaaaatacgatattacctctgtttctatggaatatatgatccagtggaaaggtgagttgccttactaatcataatcatactgaaacattgacacactggagacaagtataaaatattatataaacacgaaatttaccttggttagatgtcgtgagaagctgatagaaaggttttcaaaacagatgacttttgacaaaagtatttcaatgatgagttaatatctaggaaataatcaacatttccagaaatatgtcacaaagctgcagtgtgtgtattgttttcaagaagtagttctaatttataaggcagatacattggagaagacacaaaataaggaccaaggaccagttcattcaggaaattagacaacatgctattgggttttgattttatcttagaaatgaccggttgtcattgaagtgtttttaatcaaatggacttttttattttagagaagcttatgatgacaaatggaaagagataagaaaaacacagcaaatagtgtctggtctcttatttgggtgagtgagttaatggattgatcaaagcctcccagatcattgaggatccagttttgagattgccatagaactatgagtctgttgctcaaacacaattaaagttgagtgtcttggcactagaaaggtaaatcctgatatttgtttacttcactaacagttggtagactcatattttcctttttcatgatccatccaagtttataacatttcactttcctaacaggaatatttcttctttgcaagtgcaaaggcagattaagtgctgggacacatggctctgaaggaccatcaaatcagatctacagctgtgttctttgtccttcataaaggccttttctgactatttaaagcttccactgggcttgatcaaaataaaaatcatttgaaatataattaattcttacattttgtgctgaattgctacttgtcaatgcctcttaacacagaacagaatgcttgggaactgagttcactgggacctttacaaaaaattgtgctttttattttaaatgttattttaacaaaatagctttggaagagatataattgctcaatgataagagggtcatttatatctcttaactactgaccatcaattgtttgaaagaaacacaagtaaaggaagaattaaatttaaatgtgagagttgtgtccaaatgaataaataattttcttcaaataatcataatatgtttgcaacttttctgatatggtaaaaaaggtcaccagcaatatgaggcccaattctaaatagtaaactttcattctgataaaaatgttattagtggataaacttaacttcattaagaaaaaacaaaagtgaaaactcatgtgaatcttgatgtttgaatttacagactcatggaaaaatccagacagcaaaaaaatactgtacattgaaaaatatcctttattttactaactacctagatatagtaacctgtccattttcttatatagtagtccataagcaccctattgtatgaaattatagttatttctagaggccacaggaacttttcattggatgcataattttaaaattattttgttagtaatgccaattgaattaatacacaaatactttattttgaatgttgaagagtggtaaaatataccaacattcacatggcctcgtgaagcagtattttctaagcaaccaatgggtattaagacaaatgatgcatgaataaatatccattccaagcacaacataagccaatggattttaatgaggtatgatataaaaaattgttatatctgatttcacgtttcagctaattcttatgatgttattacttggtgttttatcaaagactacctatacttttttgaaatgattaataaaatttctgcagtttcaactatatatcttggagccacattttttcatatatttcaaacaaaaatacatctcaaaagactggtcaaatatgaaacatcatccatcttctaacaagccaggaactaaaaaacaaatttttgcaagtagaagataatagcaatcttctcattgctttgcttttgaaaagaaagtttttgcttttggaaaatatgttactagcattatgctatgtggttttgtgattttattatttaaatgtaacattaaatattttaaattttctcaattttagttataaatataacacaacatatacactctgtagaagctctttgggaacctagataatttttaaatcttttattgttgtgattattattatctttacttatttattttatattccattcactgccctctcctggtaaacccctcccaaaatccttcccctactcaccttctcctctgagcaggtaggggcccactggttattctctaactctgaaactttaagcctctgcaagactaggggatcctctcccattgaggccagacaaggaggcccagctcccatgtacaggaacttagataatttttattttatttatgtttgtatgggcatgtgtgcacatgcttattcattttataacactcctatgaatgttaaataacaacttctaggagtcagcactctcttatgaacacatgggtaactgggatcaaactcagatcttcaggatttgtgttaagtatgtactttcacctacggaataatttcaccatccatgagaccattttcaagttttaagaatgaaacttttcatgtaatcaaataggtcaataatcgcttcagtgtaaaagaactggttattttaaaaagttgagtgttttatagaggttacacattcatctcctggcagatgggtaagagcgaaaatgtctcctcatttctgtctgtttgccatgctgattatttcttttaatgtgcagaagctttgaaacttcatgtcatttcatttattagttcacgggattgtttcccctactattggaatcattttcagaaaatctttgcctctgcctatatataatttccccattttcttccttcccacatattctcaccttctgctatcatatatattttattattatttctttcatccttacctatcactatatactttccttcttcatactttcatgacctacatacaaaaatctacattctatccctgagatgaaaggtgtataacaatcctaggttccacccattttcctgcaaatcccttgacttcatttttctttatgacatgataaaatcccattatgaatagagtatgttttcttgaccgattcaatttatctgttgatgaatctgggttagttccattttctggccattgtgaataaggctgggataaatgtgtatatataaatgtctctatattatgattagaatcttttgtgtatctatctagaaacagctaggaagaaggataatgtatggataatgaaggcaaataggagcaagtataatgataaatttatatgacaaaaattataaatgtatactggtttttacatgcatttgggtatgtatgttcccatatatttatttttacctattcgagtgttgggggtatgtttaactgctatcacctttaccagggattggctgtgctaggagcacctcccggcttcccttttgttcaacctgcttttgattcccggaagtgaacaagctaccagtcctctcccagcttccctgaatcttcagataaatgacacacatggtttgttactttacaatttgccttcgaggcacatttgctgggtgttaccatctcccaccttggaaagcatgcctttaatcaatttattatctgtctctccactttccctgaacttcaatggccagtcccatatagcccctgccaaatatccttggccacccacctgtagcagcggccccaggccccagctccctctgcccccagacctcacatgattgctgcattcttcttccaaagcatggcagaaagacctttttctccttccatgcatctgtcttttcctcctgggacccagaagtcccacctataccattaacccagcaattagcccccagctttctttattgacaaatcaagaaccaattggggaacaagatcttagcatcaaaactgcctccttcacctagcatgacttttcatctggcattatatcttattgtttcagaattaacattgtttggacatcatcattccatatgagaaatcatgggtaatttggaatagttgtatattattttaatatgtaaaaaatgataattttattaacataaatatatacacaagatatatgaaattgaattactaagtaaaaaaaaatatatgtatttgttttccttggcatggtggcacatacctttaactctaacacttaaaaggtagaaagaggcaaatctccatgactttgaggccagcctgacctacatagtgagttccaggatagccagagctacaatgtgagatcaggtctcaaaacaaaaaacaacaccaaaacaaaaccttaaaaatagtatatatatttctagtctcataaaattgctaactttttctcaagtttatattcacaccaacagtttctataaataactgcttcctaaaatctttgtcagtatacattttcctcaaatccttcattctttcccaagaagatcaggaaaaaatttgtatcttattttatctcacaatgatcagttctgaaatttgtctcaagattgtaaatatattctgatatatatataatttacctttatacagctcacacacacacacacacacacacacacacacacacacacacacatatgtgttttcatttatttacaaaggatttgacataggcaacctttaaattaaaggttaaattgcaatagatgatatttaaaactctaaatacattttttaaaataatataaaacttgaactatgaatggaatgctcctgagaaatgagctcagttcctcaaattgtaaagtacatttctactctgtcattctgctttaaaaccttatcagatatattttgagctatgaaagaaagttaggttataactgttagtcatataactaaaactaaaacgttgaacaaaagttgtactaacatatcaaaatgtaaaacaaaacaaaataagcatcaaaacactttagtgctccatataagtgaaatgctgcttcctttacctgttctttgttgaatactaaggggaatggtatttctgtatctgttatcaatggcaaccatggtcaaattcctcaatatcttactttacatgtttaccagacttctgtttttgaatgagaaaaaaaggcttttctgtacattcttattaaatatcttgagcttagacataattgcagcattttcagaaatgaaaattttctgctatagatgagaaatacattggaattcctaccttgttaatgtgatgggacagctcattccacttagatgcaaatattttctaaaataacatggcagcctcatgattgccttgtttgttttcaatttcttgtcccaatttaattagcagagaatactgaaatgacacttagtatgtaaaggaagagtctcagaaaggaataaagtaagaaggggcaactaccttttaaaggtctgactcctgtacttcttttgcaaagaaactatggaaaactcccactcatttttttcagaaatagtaagccaaatggaaaaaaaaatgcttgatatttgttctgggtgatatgcatagagttgtttgtgctgatttggaaatatttacttactttaataatgagctgtatgagggtaaactgatcaataaatcaactagattttactaatcctatgttagatgctgaatcaaatatgccacctttttaaaaggaaaaaaaatcattgcacacatgatcaggagtaattctagatcctgcagacattgactcctaataaggctcataataattgttgtggtttggatcatgtctgttcccacaaaggccatgtgttcaaggcttgtttgctggaacatggtattactgggtcatgatgaaaggaagtaacatagttggcaacatagtcttacaggaatgttggaacactgtgaatcctttcacactatcgctctgtctttttctctctgtgtctctgtcttggtgtgtctttgtacgtctctgtctctctgtctttgtctctgtctctgtctctctgtctctctgtctctctgtctctgtctctgtctctctgtctctctgtctctctgtctctctgtctctctctctctctctctctctttttgcttcccacttgtcatgaagtagctagcttttctcagcatgtgcagttacagtataccaccgttttttctaaccctaactatcagaggtaagggacaatccatagactgaaattctgatgaaatgagccaaaataaatctttattccttaaaacttgagtaccttgagtattatgcagtgccataaagctaaccaacacagtaaacttctaaagttggtcactatgaagaccaagttggcctcaaacttgtgacagtcatactgtgcagccaaataaatatttgggttttgtatgtgtgtaccattagggtctgttgtgtctatacaatttaatgtttagtgaaaagtaatatgtcatgtataccatggttgactagtaactagtacattcaggattcaaacttaaatcacatctggattgagtttttatcttttccactaatcatgtcaaacacaataaaatcaaacacactgatttgacatacatattgatagcatttggtgaaaatcagagtactaagcagcacatgtctcataaaataagagtattgtgattattggatcaagagaagttattcaaaccagaattgactgtgtgagctcaccctagagggaagaataacagtatgtgcttgtaggattaaacaatgcactagcaattgtaattttgagttatgtggtaaataaggttgaatagaagtctgtaactaatgctaaactttgaaagtgaggtcattataggtcaaaattttgaagtaacaatggagaatcatgaaaagtcttgatcaagaacaagagtgagggaaggaaaaacatggcatgcaaattactatgaagacagtgaatttagtgattggatgttattataacaatacgagttactgtcttttcaaagaaaacaatttataagagataggcctctaagtttgcaatttttactggccccagttatttgctattattcacaataactttaaattttgtctattagataatttcatgtatatacaaaatgtattttgactatattcaccccttctttcctctccaactcctccaggacccttcctagcatgtcatctttctatcttaatgtcctttcttttatatcccaatgaatcaaattagagttgcccctttgtatatgggtatacagctatatgtggacaaaatatgagagattatacaactgacaaaacttgaatcttcctccctattggctgccaatggctcttcgatagctgtaaggccccatgggtcccttttctatccatgatgagaggctgaccgatttgatcttatgtaggtcatgtgcaggcaggcattagtgctgtgagttcatgagtacattgccccttcatatccagaagatactctttctcaattgtcctcctccacttctgtcttataaaatctttccactcactcttctgcaatgttctctgagccttggttttatagatgtcccatattaagctgggcacttcacagtcacactcattcttgttttatgattaaactagtggattagaggcccttgccctagacatccaaatcactgggattatatacgtttatgcttcttttaaaatttgaatatggcacattagtatctcataagtttaatgtccaaaaatcatgactggtatttttaaataaaatagaagtatagtagaaaatgtcaaagtacttatcatatatgagaaattatgtttgtgatcattgtatttaacttgtttatgtgctcacacattcattaatgtaagtaaatattataaaatgtgcttgttacgatggcttctggcagcaaaacagtgcaagtttggttttgtttttttgttttttggggggttgtttttgttgttgttgttttttaaatcaagactatagtactgaagcagcccttttgcttcccatataatttattagagtttgcgtgctctatttcaacattaacggaatatttcaccaatgtagcagttattacatttttcttagcccatttctaaacagccacactgatgaatataaattgattctttccctatcagtccatcttttgccaaatcattatttaccaaatcatgaacacttctcatatgacattcccccccttccaggagatacagtggtcattcagtcacatattttaattgtactgagcaaattgtgattgagtgtgtaactaaagactaaacacccatagtcttatttgaaagatcttttctaatcttttttttaaatttttatttttctctcatacaatatatcccaacttcaaccttcactcccctactcctcacagtcctcatccatctcttctctcaccatgatccactccatccataaaacccccagaaaaaaaggaggactcctagggacatcagctgatcatggtctgtaaaatcaactaagtagggcacatgagggcttacaaagaattaatctgcatgtgtctatgctatgtcctgtgcatatatgttctggtggctggtttggcgcttggcagggattcttgactgtgagttggagtacctctgcttcttttgcctgttcttgggaccctttttaccctactgggttgctttgcccatccttgttgtgcctagtcctattgtaccttgttctcctttctatttttatttatttttttaaaaagcaatttcaatcagatgccgatattcagagccaccattagtggtcagagacccctatggaagagttagagtaagattgaaggccctgaaggggatgacaactctattgtcaaataacctggacccccttggagctcccagaaactaagccactaaccaaagaatatgcatggcctggtctgagcccccacccctctatcacataggtggaagagggcttccttgtctggcctcagtgggagaggatgtgcctaaccctgtaaagaattgaagcctcagggtagggagatacctggggtgggggtggcacccaatcagagaagggcaggagggaaaactctgcaatggggaaatgggaaggggcaatatttggtttgtaaataaataaaataattaataaaaaattgcaataacactaccagagctcggaggctcttaactgttcttatacttaaagggatttttttctttatttacatttcaaatgttatcccctttaatgattttacctctgaaaacccccctatccgttccccctccctctccctcttcccctccccctcccccttcccatccccctactcaccaacccacctcctcttacttcctggccctggcattcctctaaactggagcatagaaccttcacaggatcaagggcctctcctcccattgatgaccaactaggccatcctctgctacatatgcaactggaaccatgagtcccaccatgtgtactctttggttggtgatttagtccctgggagctctggggtgttgggttagttcacattgttgttcctcctatggggctgctgacacctccagcttcttgggtcctttctctagttcctccattggagaccctgtgcatccacttctgtatttgtcaggcactggtagagcccctccggaaacagctatatcaggctcctctcagcaagcatgttttaataatcactttagctggacaacataagatcctcttctagagccaggtgaatttttttttttttttaccattcatttcagacatgatttttcttgtgttgaattatttggatttattccttttgcatatgcaaataaaatttatcacaaagactacttctcctttaaatgcagcctaagccatgtagtgcatattttggcagttagtaaatacaagtgaataagtgaacaaaaccttcctttcacttgaacatgatacagttcagtaaagtatttttctgcaggttttgcccagtatagtggacaatagaaggcagaagggatcagcaaaaggatgctgggctaggaatcagaaagcatgctgggctaagaaccagaaaatctaaaatgaactttggctctatcaccagagaattctgtcaccttttatatgccatttgatccctctggttcctgaggctttccatgctgcttcgataaaaatagtggactgatctagttaacataaggtctttcctaagtgcttttaagacaagaatatttactataccaatttcattcactcaatttcatttactagtagcagtgaaataaatctaagtagatattttcatggatatcatattacgggggtgcagacaaacaataaacaaccatagcatctctccctctgtgtgtgtgtgtgtgtgtgtgtgtgtgtgtctgtgtgtctgtgtgtgcctgtgtccatgcatgtacacatgcatgacatgcatgggtgtgttaaaatagtggtacttgtgagattaaaaataaaatagtgaaagatttggcttgggagttatgtctaaggatatgatattttagcagaagtctgtatgaagaaactcatcaggatagaataaattgagaaataggagtagatcattgcatttagcaacattgtcactcactgggcaccctgacaaatggtaacattgatgcgatggtttggaaaggaccagaactagaagaagaatgaattgaagacaatgtagaaatagagcaagggaggaaatgtctgttgaagagcttaacccctcactcaggaggcagaagtaggaggttctctgtgagtttgaggccaacctggtctacagagtgagttccttgacagccaggggttatattaaggaaccctcatctcgaaaaacaaaacaaacaaacaaaacaccaaaacaaacaaaaaacaaaaaccccaacaacaaaaacaaacaaacaaacaaacaccttttcctccgtgaggccagtgcagagtagaaagaacagtgggcagcaaggccactgctcatctgtgtgtgaggaaaagttaacaggaagaacagattaatagcagactttaagaagtggatacactgacatcagtttcaagtacatattagattagctttttacattattatattgagtttttatcaatatataaatattttatatgtttaatataaatattttgttacatttgaacgtataacatcatgcaccatacacaagttttacctccaaaacaaaaacaaaaacaaaaaacaaaccaaaaaaacaaaaaactttcccatattgttcagggtagaaaatttctattatatgtaatgagtaatttctacaaatatgttgtataacatagtacatataattaacattaggttattgtgcattttaaaacatttggtaagcatagatcccaaactcaatgcttttaaccataaaaatacacataagacatctacttaagatatattttctgacttagatatggtcaataaaaacttgctattctttttaaaaattaattaattaatcatttcattagttaacatctcaaatgatatcttacttacctgttaccctccacaaacccctcatcccacatctgccctttacctctatgagggtgctccctaaatgcactctctccctcccagcatccccctaagctgggacatctaacctcccaggaacccagggcattccctctctttgatgttagacaaggccatctctactacctatgtatctggagccatgggtccctctctatccactccttggttggtggtccagtccctgggagcactgggttgtctggcaagattgatgatgttcttccaatgggtttgtaattctcctctgttctagtccttccgccaacaaccccaccagggaggtcagtctgatagttggctccaagcatccacatctgcatttgtcagttgctggaagcattccccaaggaacagccacaccaggttcctgctagcaagcaccccttggcaacagcaacagtgtagggtttggtgtctgcagacaggatggatcctcaggtgaggtggtccctggatgactcttcccttagtctctgctccattttttgtccctatctttccattggataggaacatttctgggttaaaaactttgagatgagtgggtggccccatcccttcaccggggaccttttctctcactggatgtgatctttacaggttctctctctctttactgagcattttggcgaaagtcatctctgttgtgttttgggagcctttagcttccctggcatctgagacccgccagtggctatccccagttcctcatcccccactactacatattttttattctatttcctgacctttctcctgtcccctccagtatccgatactgcaccccctcatctctccctcccaccccctccctctacctcctacgatcatcctgttccccccttaacgcaggactgaagcatccacaccctagtcttctttcctcctccatatggtctgtgggttgtatcatgggcattgtgagatttggagctaatatccacttatcagtgagtacataacatgtgggttcttttgtgtctaaattacctcactcagagctaaacagggaattctcaactgaggaatctccaatggctgagaagcatttaaaaaatgttcaacatccctagtcagcagagaaatgcaaatctaaatgaccctgagattccaccccacaccaatttgaatggtcaaataaaaaaccacaggtgacagcagatgttggtgaggatacagagaaagaacactcctctccattgcttgtggtactgcaagctgataaaaccactttggaaatcaatctggcagttcctgagaatattgtaaatagttctccctgaaggcccagctataccactgctgggcatataaccaaaagatgctccaccattgtaggacacatgccctatgatggtcatagtggccttatttataatagccagaagctggaaagaattcagatgtccctcaacaaaagaatggatacagaaaatgtgggacatttacagaatggagtactactctgttattcaaaagaataacttcatgaaatttgtaggcaaatggatggaactagaaaatgtcatcttgactgaggcaacccaacttattattcttatctttctcccttcatttttcttgacattccccttttcatctcttttttttgctctgcttctttttttttttttttttttttgaactggggaaaaaaaaagccactcaccagtattctcatctggaaagtctacaacattttcttttcttttttttcttttttggactaaaaacgttttattcagcagcatacacccctcctccaccctcatcccatttccaagcctacctcctttgtaacttcatagagtgcctcgggtgagcagaagcccacagatttcatttcatcactaaccatggttcactctattcctacccccagtcgttgatggatccctgtctcccggtgggtgagagacattatctctcttccacccgtccaatattgttgagtgtgttacgtcagtgtgtgagaagagtctgagacctcatgggactgatgactgcttagattttaattttagggtcagagaagaatacaacattttcaaatgccttctatacccctttgaactaaaatttcccacagtctactatggacataacagatttatttaaaacacacacagaaacacaaatagcaaacttctattgctatataacagaattgggtctatcttgaaaatgtactctacacaggaagataaagctttcagtttatgaaagttatatatcatttatagaggtctagaatatagaattaaatggtatatttatgcaagattgcaacttgagtcatagcctttatcctccccccatcttctccattataattgtactttcaaaaattaggagaaaagttttattttcttttcttaataactcaagctctttttaaaatttttaaatatttttctttgtttgagaaattatgtggcagtctctatgattacaaaggttcacttcttaaaccatcaattataactacttgatatagagtgaaaggtttcaaacataattcaagtaactcccacacaccatttatccaggtgcactgattttgttgaggagcataattataacatacatgcatttttcccctctgaacaatttgagaataaattggagatgtcatgcccctttaaacataagtacttccatgtatatttctaaagaccattaatattctttttactagagcatattactagtatgaaaatctatagagactcaactaattcattagctatcttttttttaaaaaaatctatagtccatatacacatttgtttaattggccccatcctatatttcagcattttggggggggggacaagatcacattgtatttttgtatcttcttatttagtattctttaaggaaggatgagttttaaagatttattttccttggctgttgtggtttgaatatgcttggcccaagagtggcactattaggaggtgtggccttgttagaggaagtatgtcactgtaggggtgggctttgaaacccttctcctaaccatgtgggagccaatcttctcttagctgcttttggatcaagatgtagaacccttagttcctccagcaccatgtctgcctggacactgacatgttcctgccatgatgataatagactgaaccttgaacatgtaagccagctccaattaaatgtcattataagagttgccttgatcatggtgtctcttcacatcagtaaaactctaactgagacattggccttgacatttagaaagtatagatgaaccactttacagaatgccattctaactaggctatgataagctctaaggacgatttctagttaaacagaagttacctccttctcaatgcatgttattggatttttaaaaatgcctttaattgacatggaattacttccacctttcctctcattcctccagtcacacacaaagcaaataagacttaacatgtagtttagtggtaaaatgctggtactgcatttacaaggccataccaacaacacaaaacaaatacaactgagaatctcaagcatacaaataaatacattaaatggaagatatcattgatagcccaaattatgtgattcaaataacttaccataagcaagaaacagttatggattgtctacaaaaatgtattgtaaatacagaagtaccagcagtttgacaatggaagaaactaagatagctaatttagcaacaatagctatcatgatgcactaatgcaaagatatttgttattgataaagatgggcatttcgtaactataaaatgtcaatacatcaaatagatatggcaattataaatatatacacctaataaaatctaataagttgaggttttctgtgctgatctctatcacctgtgaaaagagcttctttaatgaaggataatagctaaaaggataagatttagagtgtggtaaggatttatgttggtctatttcaatggcagcagtagattattttctcaggttcatagttttattagaaccagaaagcttactagatttccagtactaggaatgatttccctgtgattaagtggcccttaagcgcaattagattgctgttgtttgccaccaacatgtgagtgtcactttctgcacctatatacatatctttctatgccagtaatcattatgtttcatgtgtgttactgggatcaatgtattttagggagcccagttccagtaggtatatctaccttattgctcctgtacctatggcttaggcaatactgcagtaaatgggatggaaaaaatcctaagagccagaatctgaagaagtcatccatgaaacagtccctcctagaaatactcacctaaacaagaccagaagaattgcaacaaaaatggaaatgttaatgtcaaagagaaagaaactttatggggtcccacccttagacaaagaactataaacaaatatcaactgctggaagaagaagaattcttctccaaggaagagttctcttattggttatctaattctgcatggtcagccttgaaaccatataacacacacacacacatacacacaaaaaaattcatgtgctcatatatatatatatatatgtattgtttctgctttctcttgaacatgctttcatcctttcattttggaaaattaaaatcaaaatttttagagttttattccaatttctctatagccattgtagtatactccttcacattctttctaactatatttgaatattgtaatacatacttattttagtttagagtcactagatctctctctttatctcttactatgtctttcaggctggtcttgaccttccaatcatcctgcctcagctcctaagtttacattataggcatgtctggctagaacttttttttttttggcttcttataaaatatgccaattcagtcacagtatggatattcatcttccatcaacctttgtagataactatatatttttaatttttatatattgttttggggattatgtttgtgaacttttattatatgcagcccagtacaggagaggatctcaagcaagtgtaggcagcctctaaaaattgcaattgatgtaagttagccatattggagaaagattctgcaaagacctgagggagaaaaggaatatgatcaaaatgaataccatgaaaaaattaaaaataaaaattaacaagttataagtaatatagtgaaaaaagaaggaattagaaaatatttataatagccagaagctggaaagaaaccagatgcccctcaacagaggaatggatacggaaaatgtggtacatttacacaatggagtactactcagctattaaaaagaatgaatttatgaaattccgaggcaaatggatggacctggagggcatcatcctgagtgaggtaacacaatcacaaaagaactcaaatgatatgtactcactgataagtggatatgagcccagaaacttaggatacccaagatataagatacaatttgccaaacacatgaaactcaagaagaacgaagaccaaaatatggacactttgcctcttcttagaattgggaacaaaatacccatggaaggagttacagagacaaagtttggagctgtgaagaaaggatggaccatctagtgattgccatatccggggatccatcccataatcagtttccaaacgctgacaccattgcatacactagcaagattttgctgaaaggacccagatatagctgtctcttgtgagactatgctggggcctagcaaacacataagtggatgctcacagtcagctattggatggatcacaaggccccgaatggaggagctagagaaagtacccaaggagctaaagggaactgcaaccctataggtggaacaacagtatgaactaaccagtaccccagagctcttgtctcttgctgcatatgtatcaaaagatggcctaatcggccatcactggaaagagaggcccattggacttgcaaactttatatgccccagtacaggggaatgccagggccaaaaagggggagtgggtgggtaggggagtgggggggtgggtatgggggacttttcggatagcattgaaaatgtaaatgaggaaaatacctaataatttttttttaaattgacagaattataggcaaataagaagatgcttttagatactgggagagaatcaaagaaaatatgtttatagaacttcaaaaataaagtaagagtgaggtttcttaaaaaattttaaaaaagaaaaaactgtgaaaaatgcatataataattaaaattgacagcttactgagaccatctatctttgagtaaaattctttgacactcatgtgcattgtgctttatgccaaaacaactgtttatttttaataacattgtacgtaaaaatttgaaatattatccaccaataaataaaactttcaaaggcaaacaaatatataataagctttatttaggactttatttagcataattatgtggttcttgttatttcatggcaattcataagtttctgttagtgttcatgtgtttgaatatttacacataattgtgactgaatgtgtacactttgttcaccaatgttcacaagaaaagtggttaaaggagttatcagtttaaatgtctcttgtactattgctggtagtgaggggtaagtgacctattcctagtatccgtcatctcaattccctgtttgtaaaatgaccacaaaaactttagcagttactcaacaactagacaggcttgtgagattaacacatatttcagcagagcataacacaatatatgcctagttgcaaaggaagagttaaggcttccctggaagaaaaaaacatgagataaaacccacagttcagctgaagcaccaatatgaagcctactcgctttattagaagtatgtgccatctaaagagtcagttacacgtattggtgaggtacaggtcagtagagtagagatgtcaatggtccaaagtagttctataatggaaaaacaactttaatttccaactttatgtcatatgtttacattacttataattcagattactgttcatcttgagacagaatattcttttttttttgtaagctgtatcttctttattgttttatcccagaataggcatgaatgtaggcataccatttctaaataaatatacagatatttttgcatagagtggttctcaagtgtgactctgatggattgtgcacaatttgacagtattaattgagttttcacatgtgggcaagcttgctgtagcatacaggtagaagacagaggaagtcttgagttggttttttctttccaccatgggaattccagagataaaagttaggtcatcaggtttaatggtgtttacctttactaactgagccatcttactttctgaactcaccagaccctggtacataattttagtgatttagtctatggagaaaaatagcaaagagtgtctgacagcaaggcccgaagctttgctgcactttgttttagtggtattttattttgttttgttttgttttgttttgttttactttgttttttattttgatcattttaatcaatctaatttttaggagaattaatacagtcactctacctctgagccatagtttttcattcctagtattcagactttcatttggtcagaatgtctcagtattgaatgaactgcgagatgattttgaaaatcaggttatacgaacatctttggggttttaacactttttcatcttagtcatttgttttcactgtatttttcttttttaagtagatattttctttatttacatttcaaatgttaccccctttctaagtttccccttatatcctcttccgactccccctcctcccctacccaccaaacatatatataaataaccctataaaaatggggtacagagttaaacaaagaattttcaaccgagaaatcctaaatggctgagaagaacaaaaaaaaaagtgttcaacatctttaatcatcagggaaatacaaatcaaaacaaccctgagattctacctcacaacagccagaatggctaagatcaaaaactcaggtgacagcagatgctggtgaggatgtggacaaagaggaacattcctccgttgctggtgggattgcaaactggtacaatcactctgaaaatcagtttggtggttccttagagaattggacatagttctaccagcagatccagcaatacctctcctgggcatatacacagaagatgctccaacttgtaataagggcacatgctccactatgttcattgaagccttgttttttaatagccagaagctggaaagaacccagatgtccctcaacagaggaatggatacaaaaaatgtggtacatttataaaatacagtactactcagctattaaaaacaatgaatttataaaattattagacaaatggatggatctggagaatatcatcctatgtgaggtaccccaatcacaaaagaacacacatgctatgcactcactgataagtggatattagcccagaagctcagaatacccaatatacaatttgcaaaacacatgaaactcaagaaggaagaccaaagtgtggacacttcaatccttcttataagagggaataaaatacccatggaaggagttacagagacaaagtttggagcagagactgaaggaatgactatccagagactgccccacctggggatccatcccatatacaatcaccaaacccagacactattgcagatgcaacaagagcttgcttataggagcctgatatagctatctcctgagaggctctgtcagtgcctgactaatacagaagtggatgctcacagtcatccattagatagagcacagggtcctcaatgaaagagctagagaaagtacccaagagactgaaggggtctgcagcgccataggaggaacaacaatatgaactaagcagtaacccccgagctccctgggacttaaccatcaaacaaagaaaacacatggtgggactcatggttccagctgcatatgtagcagaggatggcctagttagtcatcaatgggaggagaggcccttggtcctgtgaaggttctatgccccattataggagttgcctgagacaggatattctatattctttgttggacataaatatagtggatatggtaatttgtaaaggtgtgtgacagtataaagaagcttagacataatagtacaggttaaatttttactaccacatttaggactttaagccttataaagatactctcagaattatttttgtttgaaaattgtattacaatttgcaaaacacatgaaaatcaagaagaacgaagaccaaagtgtagacactttgccccttcttagaattgggaacaaaacacccatggaaggagttacagagacaaagtttggagctgagacaaaaggatgcaccatctagagactgccatatccagggatccatcccataatcagcttccaaacgctgacaccattgcatacactagcaagattttgctgaaaggacccagatatagctgtctcttgtgagactatgccagggcctagcaaacacagaagtgaatgctcacagtcggctattggatgggtcacagggtccccaatggaggagctagagaaagtacccgacgagctggggggatttgcaaccctataggtggaacaacattatgaactaaccagtaccccggagctcttgactctagctgcatatgtatcaaaagatggcctagtaggccatcactgcaaagagaggcccattggacacgcaaactttatatgcaagtacaggggaacgccagggccaaaaagtgggagtgggtgggtaggggagtgggtgggagggtatgggggtcttttgagatagcattggaaatgtaaatgaggaaaatacctaattaaaaaaggcaaaaaaagaaaattttatgcatatgtactatttttagattcccccactcttatctctcatctgctccctctaagcccttcttcacagcatgtctgcctttggctttcctgaccttttttattgttattttattaacccatttggtataattaaggtaacctgcatgcacataagcatggtgctatttactggattgtgagcaacttaccaacgcctgtactcatgaagaaaagtgtgttctccctttgcaaccagtaattgccaatagttccttggctagggatgagtccttgtgtaatcattccccattcacacttttatcgggcaggctggatcttatgaggttattatagctgatgttctcgggtgcaacagccctgtcatgtctaaatgtctttttgcaacacaaatccccatcctcctacccatacattatttctgcctcctcttctggtatgttccctgagccttggaggaagactgatatgtatgtttgctttagggataatgcatgatacatagtgaaaagggtgaatttgcatgatctcacacagttaccatcttttctgtgaccacacttaaaatctactcattgaggtaattaatgcatgtgtttatagccaactccctgagatctaagattcttagttttagaccttttgctcatattttgtattgctccagattggataagagacaaccagaaatatgccagtgctattatattatgctcacttattaattatacacagagaataagacatttaataaatgattggaatgatcttcttgaaaatctcagtagacttcctgttgcagtcacttttaagagattccacttaagatttgagaatatagatgatttcctgtgcagtttaataataacacaagtgttttatcactgttcaaactttcaataagtaaaatgcacagtgttcaagatataaaaaaaaaaaaaacagaatggtgaggagactcagatttcaccagatgttcacattcatgagggcatgcttatgacataggaaggactacattaccaatttatttattaatgaataccttgtcctgggtaaattttaatcaaaacttatgtgagacaatataccataatttatttaaaatgtcctattcattgtgtcctctgaatataataaatcaagatcattaataaattatatctatttgaaaaaccttatactcttaattagatcttttttttttttttggtttttcgagacaggttttctctgtatagccctggctttcctggaactcactctatagaccaggctggccttggccttgactcaaatctcctgcctctgcctcccaagtgctgggattaaaggcgtgtatcaccatgccaggctcttaattagatcttcttatatgtacaaaataataaatgtcacaagaaatatttctaacgataacagggcagatcattacttcaagcatcattgccccctttagtggcttcttcttagaaaaatttctatgtaatttactcccattttcttgggaaaaaaatcgctgctattggtgttatttgggagtgaacttactctgtcgtggatcttgataccttaagtatggtggtcaccctgattgaatctgagcttcaaaaagatgtctttttttgtatgtacccatgcaattatttgtttctattgctgagaagagtagaaaagagtcaaagtgttaaagcaggtggtttagaagcagatctttattttcaacccggtgttctcttcggatgttttagatgttcatccatttatttttatcacatgtttgtattccccacctaattcccccaaaggcttaagccaacttatgaaaatacacgggatatttggaaatggggaaaatgaaaggaagggtgagtaaactgatattaaattaggagaaggtcaatatgcacataaaagacatgctgctgctggattcaactgcaaacacagaagaacctgtttaaatagcttcaagagagtagagtcaggatagagtgaaatagaagggggaagcccatctaatattcacagcatttcagtggccttcttccacttgctctccagtaaagaacacctgccagtctggaaagagtgagcaaaagtgcaagatgctgaaaacatggctttacgttcatgtttttaaatgttcaaatgacagtcctgatttggaacaaaataattttgcagaaaagaagcaaccatgttgatgttttcatttctctgtgttgaaatcatgctatacccattattggaaaggaaaaatgaccaaaatgtcaactgaattttagcccaaatactttcatctgattgtggaaatagaaggtctatctgagctagtccagggtgataattgttatcctgtgtgattttgctcatacaaaccagattcatgcaaaaaggaggagaaatgcttataagggtcgaggatttgcaaagaacaatacaccagattcaaatgtgatgcaacagcaaagagtgtttattctgtagagaatgtgaatgcaggggtccacaatatttctggatggaagatggaggtaggaacactgcaggatcaatttagagcccgttaaggtaggagtgggtgagttttaccttttgttcccttcactggttgcctctatcttcaggggtataggtgcctttgttattggttaaggtgctgggggattttgagggctttttctaattaattatacttggattgagctaagtggttgggcattttctagaggtccttaatggctgcctgtgaggttggctcagactaggtggtggggcatcttcttgattggctgtccatgaaaagtagttttttctggaattgaattgtttcagacttttcctgttcaggggaaacagaaaattaggccttttgtctcaaactgccagtttgtagactgtcatggagtctgcctggttctggctaactctgtcctttcattatctcagttaaagaacattgctatgcttacaaaaacgttaggttttcccagtctttgcaatgtgccttaatgtcagacatgagtaagtttgaagaaatggtattctggatgctctgggatcccaagacatgtgtactcatactcttcattctccagtgagttctgctttgaaaccatgtggttagatccttcaatgtcctcctcattatttcccaaatttccatgttgtcttctttgaaaagcatttttaaaattatattgtctggggatgtaagtgttactatgtgtttagcaaactcaaggctcagtgttaattcttttttgtttgtttgtttgtttgttgggttttttttgtttgtttgtttgttttcgagacagggtttctctgtgtagccctggctgtcctggaactcactctgtagaccaggctgacctcgaactcagaaatccgcctgcctctgcctcccgagtgctgggattaaaggcgtgcaccaccatgcctggtgttaattctttatcacactgctgctactactattactacactactactactactactactactactactaataataataataataataataataataataatttgatcacctttataaggtataagattgctcctctttttccctgtggttatgagtacctttttaaaaaacaatctaatttacttttctatttagattattgttcaccttatatatataaggatatatatatatactgataaggatatatatatatatatatatccttatcagtagaatcactgtattggacaattattatcagtgcctagttctaaaatagtttcagaactaaagaaaagatgcctcatacacatcatgccttggtcattgtatgcctctgctatcccatggatgacacggattctttcctgctgcatactcccttttgactgtgtgctatttgatgaggctgctgagaaacagatggaaccaaaggctgggaaaattaggtttgtagaataacaaggtgattaaaaataaataagctggtgatgggctattatagaaaattcagctggctaatcaatgaaaataaggcatgaaatgaatgatggctaagattgtactcactagttatctagcttcaagaagaaaaaaaaaatgtgaagcaaacataagcagactatgtagttgtaagaaagacattgaccaaaaattcagctcaacaatctaggctgggaaaagctgtgaaattggaatatttaaatatgtgggctttttaccttaaaaagtgaaaataaattggataccacacaatacaaagaatctatcctttaaaacaacaccagagtaagacaaaatcaagaaacagtgatggaaggaaagcattcattagaagcagaagcagattaatcacatgcaaatatttgagcttgttatttggaggcaaggttaaagagaagcacaaggagaatagactggagagaccattcaaatacaagattaagcccagcctgatgtagaaactgacctttttctgttaagtatcccatgagcctactggtgttaaacacactagaaacactaaggtgggggaccactgatgtgcacagttaattttaacctgtaattcaaagcaaaatcttcccccccccccgaggcaaacatatatctagaaaatcaaaattgaaatagctagattagcaatcattagtggctctcctctagactcagtagtaattagcttattgactttacaccactaatttgaccctgctatccaattttcacttatcattctatctcatactaatttttgaaggtagacctaggctgtttgttcaaaaacactttgaaacagaattggaaaacatgaactttgactattttcaaataactctttgttgggtctgtaaaaataagaaataaccccttacagcaggacataaatatttattagtggtctaatcagcagcattgaattcttctataaagtatagtcattaatatttcaaattggtgttttgatgaggattgcaagtatgaaacgatactgattatgattatccatttgaactgtatttctacttacttatttctacttactgagtttctgacctattttctcttgaaattcccaataacttcttatttactttaatgcaaagcactgtaatttttactcatgtatcctaatatttcagagtgactgaagaatgcttgtagagttttttttaagggttcttagtttggaatctgtagttgagaatgtattgtcctcataagggattaatcacaagagataaactatgcacgacctgaaggatccattatgttaccaatctgattaagatgtttacttttgtatcattaacacactattaggccagttaaaagtaataggcaatggttgctattatttttgttttcagaggtaaagttaagtttttatttttaaaacagagggtatatgatggagaacaacccaaatggatctttctctcttttaattttattgtatttttatttttcattagttctttgaaaatatcatacactcagttttggagttcaccctctgccaagtcttttcaaagctattccttccattcccacccaactttgtatccttttcttctcttttgtaggccaaagtatgctgcccaaatattcttgaaatgtggttgacttatcagggtttcactttcacagaaaactgacctttccttttttagcaactaagttgccaatatcttctgtacagagaaagacaccataacttgaatgaaaaagtcaacagaataaggaaaagtatttatcagctacatatagaacaacaacaaaaaaagaatttctatctagaatatataaagaacacaaaaaatttagcactaaaaaaatcatgattacaaactgagtatggcagtctttgtgcatcatcccctgactataatgttctttttagttatgaagatagttttagtcacccatactcctgtaaggaactcttcatatctatacctgtgaataacttcagtaagctcaccagttgacaaaagcaaaacaaaactgagtatggaactgacaatagagttctcaaaggactcaatatgaatggctgagtagttttttctaatgttcaacatttttagacattcacgaaatgcaaattaaaactacttcgaaattctaccgtaccctagtcagaataactaagatccaaagtcaacttataaagaaaataaatgacaattgatactggtacggatctggggagggggaactcttactcactgctggcaagagtaagtactggtatagccactatggatatcagtgtggagtttaccaaaaaaaaaaaaaaaaaaaaaaaaaagttttaactcattttccagctttactatgcatgtgcatatacccaatgtactctatacccacaatgagatacttgcttatctatgttcattgctgcaatgtgtgtcatgccttcaagactggtttgcttccaaaacattagaaaacattaatctaacccaatgtgggaaggaaagcatttacatcatcttaaaagttacaatccatcattgtgggaagccaggacaggagatcaaggcagggacccaaaggaagaaaatgaagcagaaagtatggaaggatggtgtttactgttttactcctcatggtttgatcagctatgtttcttatatgactcaggactacatgcagaatggtagcaccactcacagtggacagaattgcctatatcattcattaagaaaatgaccctgccacaggcatgtccatgtacgaatttgatggaagcaattcctcaactgatggttcctcttctcagattagtctgacttgtgtcaaattgacagaaaatagcacaggaggatagtagaaatttggagtgaagaaaaggggtggagatttgatctaaatccaatatatgcatgtgtgaaactctcaaacaaccaataaataaatgagcaaacaagtaaaatggaaataaggataatttttagcacatagaaatatagggcatacaaggtaatgttgcgcgcgctcaactggccaggaagaacgacgctgcaacaggatccttctgcacacgtttattcagtcctgtttcttttttctccatatatctcccttgtttatatctcccctgtttatatatcgcccctgtttatatctcccttgtttttatatctcccctgtttttatatctcccccgaaccctgggcctctcactcttttatactctctctcatccacgcaccgcaggccacaccccctcaccaggcacgcagcttcagctaatcagggcagcaggggcatatctccatcaaactggattcacctgtatcctggtacacctgcgcagcactcaagatgtttgtgtcttatatgaggaagtcaggtacaagtcatatgacttagctgcagtccctggcgcctttgggactgccgccacacccgctccccacaaggtaacatctacatgagatatggaagcatagattattatattttacatatcatttgattctttcccctaaaatatatgtggtaaacacatcctgattgtgaagcactatggtgtagaaccaatctacatgcagtgtttagaggtgacactatgagggctattatgatgagttaaatttattagggcagggtctgcatgattgaattctggcattttgagaggatgagaacacaaaaatataaacatatgtaggtctatattcttcatgtcttgttatgatacactgaatgaacctggtatgctgccaacaagactgtcatcaccagaagtggtcccttgacgttggaacagaacaataagccaaaataaatacatgtttctcccattcaaacactctgtggtattgtattattatcaacagaaagtggacatgtgtgttaaaaataaagtttacatagatacagaaataatatttaataatttggcaataaaacatgccaaattataattgcaagctagtcaacgtagtcattaccttacataattaagaactgttttctgtgttttgtgtgtacagtaaagctatgctttacaccatgagaatgtatattttacacatatctcaaactttctaccatttgtttttgttcttgttgttgttttgattacccactttctagctcccatcaagcagtggtctactctatgtctgaacacaactttttaagattctacatgtaagtgaaaatattaaatatttgccatgaagtcctccagcttaccatggtgttttaaatgagaggatttcaatctttttttactgcataacattccactgtccatgtagatatacagctcaatagattccatatcttagctgttgtgaacaaaaaatgtgtagatatatttttgatatattcatttcatttcctttggacataagccaagaagtagaagtgatagctcatgtgatagctccattttcacattttttaaaggaatatccatactcttttctataattaccacactaacttatattttaaccaacagtgtgcaagagatttctttcccttacattctgaaccaatacttctgatctttcaaatatttgacattcacctttctgacagctacaagatgaaacctcattggagtttggattggtagtttattaaagattggtgatattgaatgcttcttcgtatactattggtcatttatttgtcttttggagactgcttgatgctagtgtttttagggagattggcctagggtctgtattcatagtaccagaattgaattccaaatccataggaaccaggagcctttggagtcaatttgggcttgagctaggaatgaatgtagagagaggaaagtgatccaagattgtggttcagtgtgctggggctagtgttaggaatcgagctgacatgtggactcacttctttcttgctcatgtggaacacatctctgttttcatgatactttgtgtttctcaggcttgtgaaagggataatgtagatcatgtgaaattacttttccagctcttctgtcttttcttgttgcattataaagctgaagtgtggcaagacctcatttgattagcgaaaatacgttcctatgtgcacagttgttaaaacccaatcttactatgaggggctgagatctagaaaacaaaaccaaaaacataatttatatcttataaataaaataagaggatatggctcagttatgtaggtatgatacttttttttctcatttcacaaatgtggaagcaaaaggatgataaagtaacatggctttgcctctagtcatacaggcagtattaagttcaggattgaaagaccacacttttcattgctataatttactatgtactgagtactcttatttttgttgttgttgttttgttttgttttttttttttgttgttctgaaactcactctgtagaccaggctggcctcgaactcagaaattcgccttcctctctgccttccaagtgctgggattaaaggcatgcaccaccatgcccaacagtactgagtactcttaagccactataaggaatgtgtctctgatcttcaagaggttcatgacagaggacaatgttaaattatgtgaaagtaggggcctggttacatgatgctattagtactataaaaataagtggaaggaaagcaacaattaggaaggcattggtctttaaccaacactcagaagatactataggaaatttcattttaggttggaggctggaaaatgtgttaattcaaacagattctagaagagattaaacatagagagcatgctgttgcatgggaaactaaacacatagaaggccttccacattaactttcaggatttatatctactttcaaagtttttattgagcaaacaaatttcttcttatcatagaaagaccattgttatccatcaagctgaacatagggtgcatttagttttcaaagtgcaattctattttatgtttgtaagggaaaatgtaacaagatgtgttaaggcaaacaaggggaattagagctattgcccacagtgcaatacaaaaccccatacactgaggctgctatgattttcatgcatatcagagacccagagattcattatttgagacattgagctaggttcttcatattctctttttcctaactggccttttgtttcttccattgctcttgccacttctagcagctccagctgttgctgtcacacttaataaggactttgtggagcttagatactgtgctgccgtagcaactttcccacagctcagcagaggagcttttccaggagctgtcctttctttgttggctgatgtttaggtttgaacctggcaaagactccaggttgacctgcactttattctgttatcagtaacagggtaagaatcagtaaacttacctctctccaatgccaaagttaggtcacatacagaatgaataccttgttgaattgcatgaaatgatccaagctagtgtaaaacacccgatgtattaaatgtctgtgcctgcatttgcaaggccaggagtttaaatttcctgtggtatgaagtattaggcagtggttctaggaaattgagctcaagggtgggaacatcataactttggaattattggcattgatatagcaattttcacctcatggcgataagaatgcattcttgaaagaagcaagattctgaaaaattccattaatatggaagattgaaaaacagtgcctcttatgctccctttcttgatactgatttttattcctcactctattttataatacttatgtatcagtcaaatcaaacataattggttcagtttattatttgatgattttatttcaccacacaacatacactgctatcccaaaatatgtcagtaaagccattatatgatgagtgacgcgcatgtgtaacagaaataactccatgcttactcccacactcataaacacagaagactccaattttgatacattcagagaatccttaacaggcaaatttaataggcagtcacaggaaagaatttcaggacggtaggcaaagttcatctttccactgactaacagaatggcatagtctcaaaaatgaaagtataactgaactctggggacatttgcatatgtatgcatatatgtatatccgtataatggtaaagtttggttatataagcagcaagtcagttatagcaaatagctactatatgaggagaaatgaagggtttagcagcctagtcacagtttgctaacagtgtcttgagctagaagacatagggcagcattagtattgaatgacagatgttagggaattggattaaacagttgtgatatgaatgaaactttttgaagtgagctgagatattacccttggtttttatgcttttatgaatatttttgaagttatttcaagaggtacattttattaagtccttgactaaaagtaaatttcttttttctttttagaagatttttagaagatttatttttaatggtgcatatgagtgtgtgtgtgtgtgtgtgtgtgtgtgtgagagagagagagagagagagagagagagagagaggttgagagagattgagagagagagagagagagagagagagagagagagagagaaagagagagagactttgtgtctatctttctgtctgagtatgggtttattcaattgagtgttgagtccaaataggccaaaagaaagggcatggccttctatggagctggagtttcagacttcaaacagtccctcagtcccacaaagtaactatcataatagaacaatgaattcaatctaattgaaagttggtagttgtttcattaaggtagttggggataatgaggagatgagatgcccccatgctcagcaaatgcacatttataataaagtagaggaaggtaagaagacactggcaatcttgtccaaagagtggagactatttactctgaccttcccctgcccccaacacacctgtaaagtgcatgtgagaaagatattctgaagagctttctctgagagtaaacttcagagtatgtgtatttatgaataagaggatttgagtgtgtgagtagaacagggtttgtgaacttcatacagagcgagaaaagaactagacgtctttattcaatgcagttggtgcttagcttgatttgaacccagtctcgtggacccagattcacacttgtgcactatcgttggctttacatataaccatcatctgtatctgggtacttttctatccctccatgcatgggaattactgcacattcctaacagtctagctcatgtgctatttctttctatattgctttaagtatgacctctactatgagtgtaagttaggaatgctacatcaggatgagagtgtaaggaagtattgagagtactagactacagataagctcataggaatgataacagttttctctgggagaatttgtactttgtattcatagcatgaatcctcagtgattctcattagcaggttttgtaccatattcttttagtttacagaaatatttgaggcttagagacaggacatagtcttggcaatgaccacagaatccttttgtgacaaaaccaagaccagcatgtagatataccattgtctttttatagaacatttctttagttttcaaattttcatacatgtatataatgcaatgtgattatatataatcctagttctccttcccactttatccccctatatcttcttcagatactattagatatttagtccagctatatttccatttgcattatatatcctgagcagggtcagctacacaattggcagggccccagtgcaaaatgcgaatgtgaatctctgttcaaaaatgacaagggattttaatacagcaaaaatagagcattaaatcaagtccagggtggtcattctacatttagaaccctgtgcaaatataaacaccacttacttgtaaagctggctgtattccacagagagttgactgcttttggtatgtggtaggtcattctctaaatacttctttgatgaattagtagattggattgacacctcatatctaccagtgatccatgagagtgagtttctagagcaagatgttctggtagaaccatagggaaagaaaagaagaaattgatatgatcataaaatttgaggatactgatatttctattgagatttttttctttttttttcttggatattttctttatttacatttcaaatgtttcccccatcccaggtctccccttcagaaaccctattgcaccctccctccccctgcctcaatgagggtactcccacacccaccgactcactccagtctttctgttctggctttcccctacactggggcatcgatcaccctcaggcccaatcacctctcctcccactgacgtccaacaaagccatcctctaccaaatatgaggctagagccatgggtccctccatgtgtactctttggttgctggtccagtccctgggagctatgaggggtctgatcagttgacactgttgctccccccatggggctgcaaagctcctcagctccttcagtcccttttccaactcttctatcggggaccccgtgctcagtccaatggttggctataagcattcgcctctgtattgggcaggtactggcagagcctctcaggagacagctatatcaggctcctgtctgcaagcacttcccctctattgagaattttaatgtacattttatgcacaaattatggttgctacaagggatgtccaatatatacaattgctgagtcaatacgtgtttctgacttgaaagctacaataaatttcaaactcttaatgaccatttcacaaaatggaataggggaaaaacagtaaaaattgctgcctaaaggacaactacacatgcttaattaatagcagtttgagtacaaataaatcctctgagtttattaaacctgttctacctatgtgatttataaataatttcctccttcaatatagattaaaactaaagaataatcaaagatttactcacagatctaatatcatctgcaatcataacccttgaaagacacatctgctatggaatattgcctagagacatactatattgtttagtcacagtttcttaatttatatttgtattacttttctattgctacatagtacattactgcaaatttaatggctttttaaggcagttaattattattgtacagttagtttctgttgatcagaagtgtgagaatagtcttcctgctctcctttaaatattatctattaattcacaatttgaagtatatatatatatatatatatatatatatatatatatatatatataatatattatattatatatataatatttttgattaattaagactgctggtcctgctacagaatcaccctgctcctcagcttctttcagccttctctaattcaataacaggggtcacttgcttctgtccattggttgggtgcaaataactgtatcttactatttaagctgcttgttgggtcccttttttgtgagcattacatagcctcagtaatagtgtgagagcttgggacttggcccttgagctgtattccactttgggcctgccactggaccttctattcctaaggctcctctccatttccatccttgtaattctttcagatagaaacaataatgggtcagaggtgtgactgtgggatagcaaccccatctttcacttgatgtcatgtcttcctgctggaggtagactctataatttccctctctatactgttggcattttatcaaaggtccctcctatgagtcatggtagtctcacctcccagtctctggtgcattttggggggtctcccaaacctcctatttcctaaggttacctgcgtacattctttatgctggccctcagggttctgtccttttctctcatccaatatcagatcaggttcctctctacacccacactgccctcctaccctgtccacaattcctccctagtcccccctccctctcccccccccccacttgtgattgctttcttttctctcccaagtgggactgaggaatcttcatttgggcacttcagcttgttgagtcttttgaattctgtggactgtatcttgtttattccatgtgggttttttcttttttctttttcttttttgactaatatccacttattagtgagtatatactgtgcatgtccttttaggtctgagttaactcactcaggatgatattttctagttctatccatttacctgcaaaggtcaggttgtcctcattcttaatagctgagtaatattccattgtataaatgaaccacattttctgtatgcattcttttgttgtgggacacctagtttgtttccagcttctggctatcacagataaggctgctatgaacatagtggaacaggtgcccctgtggcatcatggggcatcttttgagtatattcccaagagtagtatagctccatatttattggaatagaggagaacgaatattcccagctcaaaggacatgaaaatgtcttcaacaaatcatagaagaaaaatttcccaacctaaataaagaaacagacataaaggtaccagaagcatgtagaacaccaaataaaacagtaaagaaaaccttctcatcgcataattatcaaagcagtaaatgcacagagaaaaaaattaaaagttgcaaggggattgcattgaaactgtagattgcttttggcaagacagccatttttactatattgatcctgcaaatccatgagcatgggagatctttcaatcttctgagatcttcttcaatttatttctttagaaacttgaagtccttaccatacagatctttcacttccttagttagagtcacaccaaggtattttatattatttgtgactattgagaaaggtgttgtttccctaatttctttctcagcctgtttattctttgtgtagagaaaggccattgacttgtttgagttaattttatatccagctacttcaccaaagctgtttatcaggtttaggagttctctggtggaatttttagggtcacttatatatactaccatatcatctgcaaaaagtgatattttgacttcttcctttccaatttgtatccccttgatctcctttttgttgtcgaattgctctggctaggacttcaagtacaatgttgaataggtagggagaaagtgggcagcctggtctactccctgattttagtgggattgctttgagtttctctccatttagtttgctatgtattgcttttattatgttaaggtatgggagagggaatggggtaaagaactctgagaagggatattaggatggggggtcaatatttgggatgtaaataaataaaataattttaaaatggctaccttgccaaaagcaatctacaaattcaatacaatacccatcaaaattccaactcaattcttcaacaaattggaaagggcaatctccaaattcatctggaataacaaaaaacctaggatagcaaaaactcttctcaaggacaaaagaacctctggtggaatcaccatgcctgacttaagctgtactacagagcaattgtgataaaaactgcatgatactggtatagtgacagacaagtagaccaatggaattgaagacccagaaacaaacccacacacctatggtcacttgatctttgacaagggagttaaaccatccagtggaaaaaaacacagcattttcaacaaatggtgctggcacaactggcagttatcatgtagaaaaatgcaaattgatccattcctatcgccttgtactaaggtcaaatctaagtggattaaggaacttcacataaaaccagagacactgaaacttatagaggagaaagtggggaaaagcctcgaagatatgggcataggctaaaaattcctgaatagaacagcattggcttgtgctgtaagatcgaaataatcaacaaatgggacctcataaaattgcaaagtgtctgtaaggcaaaagacactgtcaataagacaaaaagaccaccaacagattgagaaaggaactttacctatcctaaatcagataggggactaatatccaatatatatatatataaagaactcaagaaggtagactacagaaaatcgaataaccccattaagatggggctcagagctgaacaaagaattctcacctgaggaataccgaatggctgagaagcacctaaaaaaaaaatgtttaacatccttaatcatcagggaaatgcaaatcaaaacaaccctgagattccacctcacaccagtcagaatggctaagatcaaaaattcaggtgacagcagaggctggcgaggatgtggagaaagaggaacactcctccattgttggtaggattacaagcttgtacaaccactctggaaatcagtctggcggttcctcagaaaattggacataatactaccagaggatccagcaatacctcttttgggcgtatatccagaagatattccaactcgtaagaaggacacaagctccactatgttcatagcagccttatttataatagccagaagctggaaagaacccagatgcccctcaacagaggaatggatacagaaaatgtggtacatttacacaatggagtactactcagctatttaaaacaatgaatttatgaaattcctaggcaaattagatggacctggagggcatcatcctgagtgaggtaacacaattacaaaagaactcacatgatatgtactcactgataagtggatattagcccagaatcttagaatacccaagataagatacaatttgcaaaatacatgaaactcaagaagaacgaagaccaaagtttggatactttgccccttcttagaattgggaacaaaacacccatgaaaggagttacagagacaaagtttggagctgagatgaaaggatggactatctagagactgccatatctgggaatccatcccataatcagccttcaaatgctgacaccattgcatacactagcaagattttgctgaaaggaccctgatatagctgtctcttgtgaaactatgtctgggcctagcaaacacagaagtggatgctcacagtcagctattagatggatcacagggcccccaatggaggagctagagaaagtacccaaggagctaaagggatctgcaaccctataggtggaacaacaatatgaactaaccagtaaaccccctcccccagagctcatgtctctagctgcatgtgtatccgaagatggcctagttggccatcagtggaaagagaggcccattggtcgtgcaaactttatatgcctcagtaaaggggaatgccagggccaagaagtgggagtgggtgggtggtggagtggatgtgggagatatgggggacttttgggatagcattggaaatgtaaatgaaataaatacctaataatattaaaaaaaaaaagttgcaaggggaaaaggccaagtaacatacaaaggtagacctatcagaattacaccagatttctcaacaggggcaatgaaagccagaagagcctgttcagaggtcatgcagactttaagagaacagaaatgccagcccaggctactatactatactattgaatcgacatagatggagataccaaaatattccaggacaaaaccaaattcaaacactatctatctaccaactcagccttacagaggatcctggaaggaaaactccagcacaaggaagatgcctgcaccaaaaaaaggacaaaatattaaacatctcacaacaaagtaaaaaagcagaaagccacaagcacataaagccacctacaaaaacaaacttatcacgaacaacagtcatctctctttaatatctctcaatattgatggactcaactcacctataaaaagacataatcaaacagactggatccacaaacaagatacagcactttgctgcatactagaaacacacctcaacaacaaagatagtcactatctcagagtaaaaggatggaaaaaggtcttccaagaaaatggtccaagaaaaaaagcaggagttgccatcatactatccaataaaatagaatttcaaccaaaagttatcaagtgtgatgacgaaggacacttcatatacatcaaggggaaaattcaccaagagaaagtcgcaattcagaacatatatgcctgaaatgcaagagcatctaaattaataaaagaaactttactaaatcccaaaactcacattgaaacccacactataatagtggaggattttaacaccccactctcaccaatggacaggtcattgaaacagaaactaaacagagacacagtgaaactaagagaggttataaaccaaatggatttatcagatatctacagaacatatctccataaaagaaaagaatatacctttttctcagcacctcatggtaccttctccaaaatcaaccatataattggtcacaaaacaaccctcaacagatacaagaagattcaaataataccatgcatcctattggaccaccgtggcctaaagatatattttacaattattttatttatttacatcccaaatgctgaccccccccccatcctaatatcccctctcagagttctttaccccattccctctcccgttagccactgagagggtgcttcccttaggtttgattgcatgatcatgtgtgtgagggttatttacctggataaaaggcagtttagtcgacattaaagaatacaattctctctccctaccacaacaatcaactacccatagtccttcagtgaaggttgggatctaatgagtgccccttccttgcctcataaatagcaacaggtttgttggtttgcatgcttgcgaaggtaaccacagctcaggtgagtttataaatacagtggtcatgctatccacatccaggaggtagcacttcaatgaatcctccctgttcttgaactttaagattttttctgatctctcatccataatatgtgaactgtggtgggggaataggatataaatattaatttaggctgagaacttgaagtcaattattccttgatcctcaactggttatgagtctctatataaagtgctacacatgcaaaaagaagttcttctgaccaaggttgtgagcagcacttgtttatggatgtaaacatagacattaagaaggcaatttgacaatgtatctagttggcaaacccagctgtggtggtttgaataagaaagtctcccataggctcatgtgtttgacttcttggtctccaattagtggaactgtttgagaaagatttaaggggaaggttctttgttggattagccaagggcttgttgtaggaagtgtatgattagagtggtgggctttatggtttcaaaagcccaatatgacccaggttctatctctctctctctctctctctctctctctctctctctctctctctctctctctctctctctctctctctgtaacttgctgatatcttttcagttctttgcaactgctacaataccactatactctttaccatgataatcatgaactaaactcctgaaactgtaagcaatctccacaataaaatgctttcctttaaatttgccttagttgacacacgcctttaatcccagcacttgggaggcagaggcagacaaatttctgagttcgaggccagcctggtctacagagtgagttccaggatagccagggctacacagagaaaccctgccttgaaaaacaaaacaaaacaaaacaaagcaaagcaaagcaaagcaaagcaaagcaaagcaaagcaaagcaaagcaaagcaaagcaaagcaaagcaaaacaaaacaaaacaaaacaaaacaaaacaaaacaaaacaaagcaaaacaagaaccatttgccttagtcatgatgtcacctcatagaataaaacaataactaggaaatcacatatgggattctgactaggtttacagtaccacccatgaatttatcctgtgaaataagcttcacatataacagaaagccattggttacccatacaacagtcataccaatattatatcagggagaatactttatcagaaagttttgtattatatctttactgttaacatctgggtaagaccattgatgacttttctctaccagtaacttccatggcacattccagcactatgaatggtagccatccaaaaggaagtttccagatcacttgtagaataacttttctgtatcttgcaaccaagatatatgatatcttcagtataagatcttatatctaattcgggaagttaacaaataagaatggaaggagcttgtattgttttaggtggttactgtgagtctttcctaacaaaaacttagaaggaagcatcctacacctgacatttgaattttcatttcattaattatgaccactgtggaggcattatccatgcacaacatgctgtctttgatcagggtatcagaagtctgaaatggtgttattggcttcccacttcctcttttttttaattaggtattttcctcatttacattttcaatgctatcccaaaagttccccatacccacccccccaatcccctacccaaccactccccctttttggccctggggttcccctgtactggggcatataaagtttgcaagtccaatgggcctctctttgcagtgatggccaactaggccatcttttgatacatatgcagctagagacaagagctctggggtactggttagttcatattgttgttccacctatagggttgcagttccctttagctccttgggtaatttctctaactcctccattgggggccgtgtgatccatccaatagctgactgtgagcatccacttctgtgtttgctaggccctgacatagtctcacaagagagagctatatctgggtcctttcagcaaaatcttgctagtgtatgcaatggtgtcagcgtttggaagctgattatgggatggatccctacatatggcaatcactagatggtccatccattcgtcacagctccaaattttgtctcagtaactccttccatgggtgttttgttcccatttctaagaaggggcaaagtgtccacactttagtcttcgttcttcttgaatttcatgcttttagcaaattgaatcttatatcttcggtatcctaagtttctgggctaatagccacatatcagtgagtacatattgtgcaagttcctttgtaattggcttacctcactcaggatgatgccctccagatccatccatttgcctaggaatttcataaattcattctttttaatagctgagtagtactccattgtgtaaatgtaccacattttctgtatccattcctctgttgaggggcatctgggttctttccagcttctggctattataaataaggctgctatgaacatagtggagcatgtgtccttcttaccagttgggacatcttctggatatatgcccaggagaggtattgctggatcctctggtagtattatgtccaattttctaaggaaccaccagactgatttccagagtggttgtacaagcttgaaatcccaccaacaatggagggctgttcctctttctccacatcctcaccagcatctgctgtcacctgagtttttgatcttagccattctgactggagtgaagtagaatctcagggttgttttgatttgcatttccctgatgattaaggatgttgaacattttttcaggtgcttctcagccattcggtattcctcaggtgagaattctttgttcagctgtgagccccatttttaatggggttatttgattttctggagtccaccttcttgagttctttatatattttggatattagtcccctatccgatttggaataggtaaagatcctttcccaatctgttggtggcctttttgtcttattgacggtgtcttttgctttgcagaagctttgcaattttatgaggtcccatttatccattctggatcttacagcacaagccatggctgttctattcaggaattatccccctgtacccatatcttcgaggcttttccctactttctcctctataagtttcagtgtctctggttttatgtggagttccttaatccacttagatttgaccttactacaaggagatagaaagggatcaattcgcattcttctacatgataaccaccagttgtgccagcaccatttgttgaaaatgctgtcttttttccactggatggttttatctcccttgtcaaagatcaagtgaccataggtgtgtgggttcatctctgggtcttcaattctgttccattggtctacttgtctgtcactataccaataccatacagtttttatcacaattgctctgtagtacagctttatccttgagaagtttttgctatcctatgttttttgttattccagatgaatctgctgattgccctttctaatttgttgaagaattgagttggaattttgatggggatttcattgaatttgtagattgcttttggcaagatagccatttttaatatattgatcctgccaatccatgagcatgggagatctttcaatcttctgagatcttctttaatttctttcttcagagacttgaagttcttatcatacagatctttcacttccttagttagagtcacgccaaggtattttatattatgtgtgactattgagaagggtgttgtttccctaatttctttctcagcctgtttattctttgtgtacagaaaggtcattgacttgtttgagttaattttatatccagctacttcattgaagcgtttatcaggcttaggagttctctggtggaatttttagggtcacttatatatactatcatatcatctgcaaaaagtgatattttgacttcttcctttccaatttgtatccccatgatctcattttgttgtctaattgctctggctaggacttcaagtacaatgttgaataggtagggcgagagtggacagccttgtctagtccctgattttagtgggattgcttccggcttctccccatttactttgatgttggctactggtttgctgtagattgcttttatcatgtttaggtatgggccttgaattcctgatctttccaagacttttatcatgaatgggtgttggattttctcaaatgcttcctcagcatctaaggagatgatcatgtggtttttgtctttgagtttgtttatatactggattaacgttgatggatttccatatattgaaccatccctacatccctggaatgaaacctacttggtcaggatggatgattgttttgatgtgttcttggattctgttaacaagaactttattgaggatttttgcatcgattttcataagggatattggtctgaagttctctatctttgtggggtctttttgtggtttaggtatcagagtaattgtggcttcatagaatgagttgggtagagtaccttctgtttctattttgtggaatagtttgtgaagaactggaattaggtcttctttgaaggtctgatagaactctgcactaaacccatctggtcctgggctttttttggttgggagactattaatgactgcttctatttctttagggtatataggactgtttagatcattaacctgatcttgatttagctttggtacctggtatctgtctagaaacttgtccatttcatccaggttttccagttttgttgactatagccttttgtagaaggatctgatggtgttttggatttcttcaggatctgttgttatgtctcccttttcatttctgattttgttaattaggatgctgtccctgtgccctctagtgtgtctggctaagggtttatctatcttgttgattttctcaaagaaccagctccttgattggttgattctttgagtagttcttcttgtttccacttggttgatttcatccctgagtttgattatttcatgccttctactcctcttgggtgaatttgcttccttttgttctagagcttttaggtgtgttgtcaagctgctaatgtgtgcgctttctagtttctttttggaggcactcagagctatgggtttttctcttagaaatgttttcattgtgtcccataagtttgggtatgttgtggcttcattttcattaaactccaaaaagtccttaatttatttctttattccttccttgaccaagttatcattgagaagagtgttgttcagtttccacgtgaatgttggctttctattatttattttgttattgaagatcagccttactccatggttatctgataggatgcatgggacaatttcaatatttttgtatatgttgaggcttgttttgtgaccaattatgtggtcaattttggagaaggttccatggggtgctgagaagaaggtatatccttttgttttaggataaattgttctgtagatatctgttaagtccatttgtttcatcactgctgttagtttcactgtgtccctgtttagtttctgtttccatgatctgtccattggtgaaagtggtgtgttgaagtctcccactattattgtgtgaattgcaatgtttgctttgagctttactaaagtttctttaatgaatgtggctgcccttgtatttggagcatagatattcagaattgagaattcctcttggaggattttacctttgatgagtatgaagtgcccctccttgtcttttttgattattttgggttggaagtcgattttgttagatattagaatggctactccagcttatttcttcatactatttgcttggaaaattgttttccagcctttcattctgaggtagtgtctatttttttctcggagatgagtttcctgtaagcagcaaaatgttgggtcttgtttgtgtagccagttttttagtctatgtctttttattggggagttgggtccattgatattaagagatattaaggaaaagtaattgttgcttcctgttatttttgttgttaaagttggcattctgttcttgtggctgtcttcttttaggtttgttgagggattaccttcttgttttttctagggtgtggttcccgtccttgtattgttttttttttttttctgttattatcctttgaagggctggatttgtggagagataatgggtgaattttgttttgtcgtggaatactttggtttctccatctatggtaattgagagtttggctgggtatagtagcctgggctggaatttgtgttctcttagtgtctgtataacatctgtccaggctcttctggctttcatagtctctggtgaaaaatctggtgtaattctgataggcttgcctttatatgttacttgacctttttcccttactgcttttagtattctatctttatttagtgcatttgttgttctgattattatgtgtcgggaggaatttcttttctgatccagtctatttggagttctgtaggcttcttgtatgttcatgggcatctctatctttagatttgggaagttttcttaaaaaatatggaatgcttcacgaatttgtgtgtcatccttgcacaggggccatgctaatcttctctgtatcgttccaattttagtatatgtgctgccgaagcaagcaccccacctcctcttttgcaatggttcttttattatttagtatacctatgttcattcctgtctcatcttttctaccaacatacctagagaaatcttctttttggattatactttctatttaaagcaagttttgtgtattgttctgttcttttcttgattgaagatgaaaaaataaaaactgagagtccaaacaggatctttaatgcaagcaagtagtggaaccagttgtgtgtgtttgtgtttgtgtttgtgtgtgtgtgtgtttatgtatgtacatataaacatttctttgattccaaaaatctttccttaatatctttcaaattcatgggttctttttcaattgttgttatatacatatgtgtatatttatatacatatatttctaagtacagtctgcataatatgactacaaaatatatgtgtgcttaggggtgatcatttgatgttttataactaatggtgtagttttcactggggaagttgaaaataggctctatattgtctaaaatttactttggcataatgtctcatgattatgtagcatatattagtactacattgttattgccatatatgtgtatatatatatatatatatatatatatatatatatatatatgtatgtatacacacacacacacacacacacacgtgtgtgtgtgtgtgtgtgtgtgtgtgtgtgtgtgtgtgtgtgtgtaattgttgcattcaatattggatgaacttttatattttccctttttggttatcataaattatattactgtgccaggtgtggtagcgcatgcctttaatcccagcacttgggagagagaggcaggcggatttctgagttcgaggccagcctggtctacagagtgagttccaggacagccagggctatacagagaaaccctgtctcgaaaaaccaaaaaaaaaaaaaattatataactgtaaatatcattatacaatttttatgcaaacatattttcatttcattgaatttgaatctatgtgcaggtgtagatatattgtttcatattgtagacctctgttgaacatcttaaaaagctgtcagatcattttccaaaatacctttaccattttatattcatatcaatgatgtgcagggtttccattttctccacatcctcactagcatttgtcatcagtctattttgtcattagaaatagctttatacttttgctgctctcataaaagttggaaatacatatacatctctgttctgcacctgaaatcctagcatttggttggtaatggcaagaagataacaaattctatgctagcctgagatacatagtgaaagcctgtcccaaactttttaaaaatgaaaaatttgagaattggatgatgttcactagaattctcagaaaatagattgaataataaagaagaaatgtaaagtgattggtactaactacagtaaaacaggagcaaaaattattgccatagaatttttaaaatataattatagataaaaattattatatattttaaaagctagaagacaggaccttgaaaactcttgccatatttttgatatagattccaatcatttaaacattaaactatgcatacatatctcaaaagttgtataatacttagtaaacataaatagtcagtataggggctgcagaaatagctaagagggtaatagtaccaagcctaggtttgatttccagcaccgatatggcagctcacaatcttctttaactccagtcccaggggattctgtgcactcatctggcctccatgggcaatgtatacatatgttttattgacacgtgtaatctatactagtattacactgacataattattgtacttttatagtataattataacttggaaagtctaagtactctggcttcactctactgtttggaagactattgtttctgtaatatcaaatatcaactgtccattaaattatatcttctctaatagtccttatttcctacataaataaattaggcactttctatcaaatagcaaggtgtacaattttgttttagcaaagggtgtctgtatataaaaagggtaatagagattatatatgtaaatacaatatttgttagggtttattatatttattcaaccatttattaaatggaattctgttaaatatttaagcatgtattagacaatgcagattttaaaaagaatatagtttgtctatattcaaaaagtttatagacacccatattaagaaacattaataatgagtgcattagaagtatggtctgaatgaatctcagtaaagacttacatatgtatacctgtgaatatatacgtgcatatgtgtgtgtgtgtgtgtgtgtattcacacacatgtattatatatactagactaattcctcttaaatgctgttgtcaaagaaaatcaaatatgcaaatatagaattttattaagcaaaatatgtatgtgagaaaaaaaaacccatgagattaggaaagactatcagagccatcagactacaaagccaagctttttaatgaaaaaaaaatacataaaaagataaaagaatgttgaatagaattgttccaaacttcctggcattctaatgaaggtataaatactcaaggcaagatctgctaacaaagtcttttttatctaccagtaatggacttgcctttgtgtctctgccatactaatcattaattgagtgttgcctgtgtggtccacgcatgcttcaaaacctggttagtgatagatttcaggacacagaaggtagatgttctgatcacttttattccctgtggttggagatctaggagcctcattctagtgccacccctaagataccaccaaatgaaagtcttctcattttcctggtaaactttagaagtagaatctggcatagaccagtttttctgaaaggtcaatattactagctttccaaaaattgtacagtgtaaattctcttacattcaaaagatgtcactgtgttcaattgcctggcaaaatcattgctattcctagagcaagtaccaaacagattaagagcaggcccaagaacactagttactcttttgctaacatctatcagtagatcctgcttcaaaagtgttcagatgaataatgtctaagattacttctagatactcatttatcttttgcttttatagcatgaggtcttactgagtaggaagaccatagagatttttattattattattattgaatattttctttatttatatttcaaatgtttttccctttccaagtctccccttcgggaacccttatcacatcccccttcccctgtctctatgagggtgtccccacacacacctacccacccactaccttcctgccctggcattcccctacactggggcatcaaacaccctcaggtccaagggctgctcctcctactgatgcctgacaaggccatactctgccatatatgcagctggaggagccatgggtccctccatccgtatactttggttggtggtttagtccctgggatcttggggggggggtgctggttgtcacatattgttgttcctcctatggggctgcaaaccccttcagtgccttgggtcctttctctagctcctccattgtggaccttgtgctcagtccaatggttgactgcaagcattctcctctgtatttgtcaagccctggtagagcctctcaatagacagccatatcaagctcccaacagcaagcacttcctggcatccacaatagtgtctggatttggtgactgtaaatgggatggatccccatgaggggcactctctggatggcctttccttcagtctctgctccacaatttgtctccatatttcctcctgtatgtattttgttccctcttctaagaagtactgaagcatccacactttggtcttccttcttcttgaccttcatatggtctgtgaattgaatcttgggtatttggaacttttggactaatatacacttatcagtgagtgcatactatgtgtgctcttttgtgacagagttgcctcacttaaggacttggagaaagaggagcatgcctctattgctggtgggattgcatgctagtacaactctggaaatcagtctggcggttcctcagaaaattggacatagtactaccttaggactcagctataccactcctgggcatatacccagaagatgctccaacatgtaataaagacacattctctactatgttcatagcagccatatttataatagccagaagttagaaacaacccagatgtcttgcaatagaggaatggacacagaaaatgtggtacatttacataatggaatactactcagctattagaaacaataagttcaagaattcgcaggcaaatggatttaacttgaaagtatcattttgagtcaggtaactcagtcataaaggcttttggaaggccatatgacttaatttcagaagctgtggacttatgtttattgagaaaaatgctatgacaaaaactagtttcaggagataaatatgaatcatgaacttggaaacaatatgaaagaagacagagtactatgggcatatattctatatatttgggccttcagagttagccaacctttaaagaatgtaattgtgagttttgtacagaatattgtattacataaggacacttcaaagcaaatatatataaactgtatcttgagcatttccatctgtcctgtcctattctcacccctccatttccccatttgttcactttgttctcctggttttgttttgaatttcatgccatttctatcttcattaagtacatttgtatagtatatgtattcatttatccatttaaaccagcaacatttaggagtgtgtattttctcagtgatgttttcatatctctatatttctaataatcttcttgtaagtatatatatgtatcgatttaaaccagtcaccattgggagaccatatttcctcagccacatttacatatgttcatatgtctaaaactctcttcttgggaataacttaccagtaacatctttgctagtacatgcctttgaccctcttcctattatgatagcttttcttcactctgtcagagaagaagatgagttgtgcagtgaaacgttttacttagattatgataataaaaaaataaaatatgaaacttgggagtagtatttggggtaaagagttaattttgctgggcagtggtggcgcatgcctttaatcccagatcttgggtgggagaggcaggcagatttctgagttcaaggccagcctggtctacagagtgagttccaggactgccagggatacacagagaaaccctgtctcaaaaaaaaaaagtaaaactaaaacaaaaaacaacaacaaacaaaacaaaacaaaagacttaactttacctaaatagagtatctggtccctttctcaatatccttattgaatcctggagaaagccatcagatttctttgtgtcttataaacctgtctaccatttcaaaaatactgttaatcttttatgaaagccgctggagaacctcatcatgataaagtaatattatgctttatgttatatgattccaattaccttgattccagtaaaggtcataatttttcaccactctaacctaaccagatatactttgaagccatagctagtagatagttttaagtaatattttacctattttaattggaaaagagttttgaacttaccatgattttgccatcagataaggtgtagtaaatgtagcaatgttctatttcatactggttttgttttgttttgttgtttttgttttgttttgttttgtttgtttgttttgcattggcactgcctattccaagcagtaaaaccttagaggatttattggagaatttagacagttaactatgattgagttattgcatagtgttcagcacaagttctatttctggcacatcactgtttctgtggtaaaggctatttttcaagattgactggatataggttcattcactaggaaatatttcagtatggattattctcaaaagctcattaatcaacagaattgatatagtgttgagatgacctaaggcttggaaatgttgtcatagcccatttgttacttaaattgttagcttgtaattagaatatgtttgtcatgtgaaacattagatacagtttagtagaaagtaagaactgggaagagccttagagataattttctaccacctacttacatcttaccaggaaggaaacttaccatgggtcaaatcagctagaaagtaaatgagccaaaaactcttacagacctgattttctatttccaggtttctactctattgctgatgatatttcttatttaatttcttaagtggcttggtttaaaatgagattataatatattgggcatcttgtatcaaaattggaagtgaaaacagagctaagcaactgattaacattacattataaaccaaggaaataattacaaacagggtaagataaaaaaattttaaatgcattataagagactgaggtctctgcataaagatggtttctgactgttgactcaagacaaataatttggaactggatatctaggtctatatttttctttgcatgtgactcttacacacttaagatgcgcatcatccaaactgaagtagatttgttgacagggtaaagtatgtactggttgtctaatagttgatataatttgaaatagcccattagtactttagtatagtgcacacagaaattacataatttttattttgacataatttactatgttattataatcactttaccagtatctttttctactttttgatgtgtccactcacaaatgcaaaaaaatattgtaaacattgtatttttatcatgcaacacttacctagactgttgattccaagtatggaccatgaaaaaaaaaacaacattggtatctcctgagacttcagagtaaacacgatattatgctttacagcagacctaccagtgttttagcaagacccccaaagtgatgcttgtatacactaatgctcagtaagtactgagctggtatttacattcccctttctggtgctttctagttctcagtggagagcttgttggatattatctgaaatggcatgcaattgttagtgatagatcatcttaaaatattgtgactccatttgatgtaaataaagaaaatatctaacaaaaaattaaaaaaagaagatactatgactccaagttctggtagatttttaatctgactcatgaactggatttctagtcttgaaaacatgctaccatattttttgttaacatatcaggtagtgataatggaagtgggatctctggtagtgccaatagggaggttacaaatgctattcacacccaagggagctttttcttctaatctttctgtatcctccagcaggtcagccaagcaactggtttctagttacttttatgttcattaccttacttaaaacagtttctaaaaacattatcactttcatttatttatagatgaggtttgtgaaacaatacctaatcttattcactatgctgaaaattcctgctaccctgaaattcaactcatcaccataggatggtcatttccatatcagacatctaatgttcttttgttttgtattcagccttgactgaaccattagcatctttcctaaatttctgactatgtataaggcatatcagaaatatatttctgaaatagaaatctgatgatttataataatcatttcattggtccctagtaacctaatcttcttgtaaaagaggttcagtgatggcagtcaggttaatgagttgtggaaacttaatacatcagtgtgtatggagtatttaggtcactacctgtaacagagtaaattttatgtagattatggcccatattatgattactattcaagatatgtacccttaatccacctttctagtgagaacagtgttctatatatttcttctccctcttcgatttcataacacagaagatattcagtatgttatgtctggtcctcatactattttttccctagaatagctatgcattaatcttatacttgaaaaaaaatccctttctcatttagcacctaaattgttatctggcttttaaggcttgatagcaaattgtcattgataagaccatcaatgcttatttacttgtatatgatttgggagtttgtaatgtgataagcttatagatgccacttaataatttcatgatgctgtccaaatggaatgtatggcaacatttcagatttcattcctttgtgcattcaaactaaggtaaccaaagcattcccagacagtgaactgaagagctaatttttataaacagactgaccatcaggtggtctcatcattaactacaatgcaaagggaaacaattatttttgtaaactaagtagacactgacttctaagaaaatgatttggaacagccctcatagatataaaaaatcaaaacacacttgctttatgttttctttgaaaaattaattccaaatgtaattgtaagcataatttgcttacaaagtatatccattgtaaaacagatgtagttaagtagacttacttcaaaatgatggttatcaaagcagctttaagcagaattagaatgtaaagaaattcagtagtgaatcctacaagtataactctgaactcatttctttaagtgtggcttctagaactctaagtcattatccattgcaggtgctattaaaagttctgccaacatccccaagaaaagacagagagctgggctagggaaggtgcccaagactcaatggggatgaccttaactggaactcactacattcaggatatagaaccagaagaggccaattcctgtagccaggcaggaactccagtggatagatagggacacaagcatacatataaaactcttttttggtggggggtgattttttaaaaatttttaattggatattttctttacttacatttcaaatgttattctccttcccagtttcccaccatctggaaactttctatcctatccccttccccctgcttcaataagggtgtaaccccacccacccacccacccacccactcctgcctccctgcccttgcattcgcttacactggggcatcgagccttcacaggaccaagggcctctcctcccattgatgaccaactaggctatcctctgctacatatgtagctggagccatgggtccctccatagctaccccttggttggtggtttagtctctgggagtatgggggatctggttaattgatattgttgttcttcctatggtgttacaaactgcttcagctccttcagtctaactcctccactggggaccccatgctcagtccaatggttggctacaagcatcctcctctgaatttgtcaggcagtgacagagcctctcaggagatagttatatcaggatcttgtcagaatgccaaacctaaggataataggtatagaagagagtgaagattcccaatttaaaggactagtaaatatcttcaacaaaattatagaagaaaacttccctaaccctaagaaagcaatgcccatagacatacaagaggcctacagaactccaaatagaatggaccagaaaagaaattcctcctatcacataatcaaaacaccaagtgaccaaaccaaagaatattaaaagcagtaaggtaaaaagatcaagtaacatataaaggcagacctatgagaattacaccagatttctcaccagagactatgaaagctagaagatcctggacagatgttatagagaccctaagagaacacaaatgccagcccaggcaactatacccagcaacactctcaattattatagatggagaaaacaagggattccatgacaaaaacaaatttgcataatatctttccacaaatccagccctacaaaggatagtagatggaaaactccaacacaaggagggaaattacaccctagaaaaagcaagaaagtaatcttctttcaacacacccaaaagaaaaatagccacagaaacataattctacctctaataacaaaactaacaggaatcaacaaccacacatatttttttactcaaaattcatcctgtctacaagaagtgcagacatgggtttggagcagagactgagagaatggccaaccaatatctggtccaacttgagacccatcctatgggcaaataccaaatccctgacactattaatggtactctgttatgcttgcagacaggagtctagcatggctgtcctctgagaggccccactcactagctgagttagacagttgcagataccaacagttaaactgtgggtgaagcttggggtctcatggaagaataggaggaaagattgtgggttcagaaggtgataggaactcagcaaaaagaccaacagagtcaactaacttggatccttggggctctcagagtctaaaccaccaacaaaagaacatacaagagctagacctagacctgcctgtacatacgtagtaaatgtaaagcttggtcttcatgtgggtcccaaacaactgaaccaggggctatcccaaaagctgttgtctgtatgtggtatatattcttctaactagcctgccttgtctggccagcttctgtgggagaggaagagcctagtctgaaggagacttgaagtgctagggtgggtcaatacctggggcatcccacatgctcaggagaagtgggaggggtttactgggagagggggcagtgagtgggatgtaaagtgagtaagtaaagaaaaaaatctatgcaataccaagtgccccagtacagggtaatgccagggccaggaaacaggagtgggtgggttggggagcagggttggaggggggtatagggggctttgggaaagcatttgaaatgtaaatgaagaaaatatctaataaaaaattataacaaaaaaatctacaaaacgtcagctccccaacctcttttgctggccatagtgagtggctcatacctttaatcccagtgctcgggagacagagcagaaggatctagttgaggccagtctggtcaacattgtgaattccagggcagcaaggactagttagtaaaatcctgtctcaaaaatccaaaaccttcgaggccagcctggtctacagagtgagttccaggacagccaggactacacagagaaaccctgtcttgaaaaaacaaaaaacaaacaaacaaaaaaaaaccaacaacaacaaaaaaaaacacaaaaacacaaaaacaatctttttaaattatcagcagctttccaaacatataaaacagaatctatgagaataagctcccaatcataaacatataggtctgcaagtaatgcaggcatacatttttgaagtagtgtttgaaaactacttcattaaagctaagtttattttatagtatttttcagtgtcccacaacaagagcctgctttgatttagacttctagaatgattctttaactgtggacatgtgttgtttctttccaccaatctattatttcttatgctgattcatgatgttgccactccctgctttcctttttcattctgcaaatattctctagacaaaaaatggtttcatggatcctactcctgaaggaatccttgtttgttaaatacatagtgggcaagatttatgaaatatgacatgtattgaatactagaatttgaattagcagcttcatcttaactcttctatgatgaatcccagtatcttaaaactcaaacactgcatgtaaatatgtgcatagcaaaagtaaggaatacagtgatagggcaagacagtacagaggttcttttaccttgtattcttactgaggtcattttaggtctaacaaaaatttgatctccttaatggagaatcccatgaatgaattatcaaactctattctagcagcccaaggtcatgatgcacaagctaaattaccttagcttctgttaaaatgcctgtttgtgtggaaccacctcacttccagcgaacagtttactttagcttttgttaactgcttccttatgtaaaacaaccccctccagctaactcctttttttttaacatttactgtttttgtttttccattttattaattattttatttgtttatatcccaaatattacacccacatccttccctcacatagttcttcctccccctatttcctgcacccccatctcctttgcttctgagagagggttatccctgtatccccaccaccaccaccatgagcattaagtttttacaggattaggcacatgctctcccactgagtccagacaaggtaccctgctgctatatacaagtcaggacctcaaaccagcctgtgtatgtatggttcctggcttagtccctgtgagctaccaggggtccagattagttgacactattggtcttcctatatggtaccatccccttcagttccttcaatctgtcccctaattcttccatacaggtcccaaaccttcgttcaatgcatgtatgtatctgtatatatctgcatctgttccagacagcttctgggtagagcttctcagaggacaaccatggtagactgctttctgcaaatacaacatagcatcagtaatagtgtcggggctggtgcctgcccataggatagatcccacattgggccaatcactaaatggctttttcttcagtctctgctccatgtttgtccctgtattttttatacaggaacagttccgggtcaaatattctgaacttgggttggtgtcccaatccctccactagaagaccctgtttaactcctggatgtagtctcttcaggttccatatgcccactgttagggattttggctaaggtcacccacattgagtcctgggagcctctcctattccaggtttctgagactttatatatgttcccctcaccctttacccactgcagctacatttttccattcattcttgtggccctctgggcctctatcctgtccacctccacacctgatcctgcctcctttccctcatcctccctgctcccacctagctgagaaagaaattaaggaaataacacccttcacaatagccacaaataatataaagtcttggtttaactataaccaagcaagttgaaatatctgtatgacaagaacttcaagtccctgaagaaagaaattgaagaagacctcagaagatgaaaaaaatcttccatgcttatagatcagtaggattaacatagaaaaaaatggctatcttaccaaaagcaatctacagattcaatgcaatccccatcagaatttcagcatttttatagaccttgaaagaacaattctcaacttcatatgaaaaagctaacaaaagcccaacatagccaacacaattctgaacaataaaagactttcagaggactcaccatttctgacctcaaactgtactacagagcaatagtgattaaaaaccacatggtattggtacaaagacagacaggtagatcagtgaaatagaactgaagacccagaaataaacccacattcctacggacacttgaagaaagaagtcaaaaccatacagtgataaaaagaaagcatcttcaacaaatggtgctgttctacctggtggtctgcatggttggtccatgtttatcatctgaataaaactgaagtccaagtggatcaaggacctcaacataaaacaggatacagtaagtctaatagaggataaagtggggaatagcgttgaacacatggatgtaggagaaagtttcctgaacagaacaccaagggctcaggctctaagatcaaaagttgatgaatggcacctcttgaatctgaaaaggttctgtaaggaaaaggacactgtcaacagtctacagactgggaaaagatcttcactaaccctttatccaacagaggctcttatccaaaaatacataaagaactcaataagttagactgcaccaaaacaaattcaacaattttttaaaaatgaggtatagagctaaagagagaattctcaacagaggaatctaaaattaccaagaaacacttaaagaaatgtccacattccttagtgaccaggggaatgcaaatcaaaaggaccctgacagcaatcagaatggctaagatggaaaactcaggtgatagcacatgttggtgagaatgtggagagagaggaacattcctccattgctggtgggattgcaaacttgtacaaccactctggaaataaatctggaggttcctcggaaaatttgaaatagttctacctgaaacccagctatactgttcctggccatatacctaaaagatgctccaccgtaccacaaggacatgttctctactatgttcatagcagccttattcataatagcaagaaactggaagtaactcagatgtctctcaactgaagaatggatacagaaaatgtggctagttaatacagtggaatactagtcagctattaaaaatgaggacatcaggaattttgctggcaaatagaactagaaaatatcatcttaaataaggtaacccagaccaaaaaagacatgcatggtatatactcactactaaatgaatattagccaaaaagtacagaatacccatgatatactccacagaccgtatgaaattaaacaacaagaaaggtccaagtgaggatgcttcaatcttacttagaaaggggaataaaataatcatgaaaggcagagggaaagacagaccagctaacttcttagcttccattaacctgtttgcttctgaagctgccaggacatggcttttgccttcacaaaccctgttcttttcacacttggggctatacctatgtcctaaatacatgagtatagccctagttgactggaatattgacatttttacctggctataaactgtatctgagtggagctccccaaaataatccaacctgtaagctagtctactaggaacactttattggaatctacacataaaagtcggccctgcacctcagacccccttcccactccatttacatatttctcatataataaaggagactgtgttgcttctatcagtttcttgacattacattgttttgttcaagaatgtgacttgtcctcaagcctagcttctttttttaatttaagatttattttatttattatatataagtgcactgtagctgttcccagacactccagaagggagcatcagatctcattacagttggttgtgagtggttgctgggatttgaactcaggaccttcggaagaacagtcagtgctcttaaccactgagccatctctccagccccttgagcctagcttctaatcatgacctagaatatgtgtaaaggaactcttcattaagcacagtagagaaagaaagaagtaggctgaaaatatccagcagactgaatatgtgcaggggtatctgccaaaaagagagaatagcagagtcgcctgacacccgcaagggcccacaggattccacacaagatcctaagacctctagtgagtggaaaacaacttctgccaggagtctggttcaaacaccagatatctgggtacctgccctgcaagaagagagcttgcctgcagagaatactctgcccactgaaactaaggagagtgctaccctccaggtctgcttatagaggctaacagagtcacctgaagaacaagctcttaacagtgacaactaaaacagctagcttcagagattaccagatggcgaaaggcaaacgtaagaatcctactaacagaaatcaagaccactcaccatcatcagaacgcagcactcccaccccacctagtcctgggcaccccaacacaaccgaaaatctagacacagatttaaaaacatttctcatgatgatgatagaggacatcaagaaggactttcataagtcacttaaagaattacaggagagctaaagagttacaggcccttaaagaaaagcaggaaaacacagccaaacaggtagaaatcattaaagaaaaacaggaaaacacatccaaacaggtgatggaaatgaacaaaaccatactagaactaaaaagggaagtagacacaataaagaaaacccaaagcgaagcaacgctggagatagaaaccctaggaaagagatctggaaccatagatgcgagcatcagcaacagaatacaagaaatggaagagagaatctcaggtgcagaagattccatagagaacactgacacaacagtcaaagaaaatacaaaatgcaaaaggatcctaactcaaaacatccaggtaatccaggacacaatgagaagaccaaacctacggataataggaattgatgagaatgaagattttcaacttaaagggccagctaatatcttcaacaaaataatagaagaaaacttcccaaacataaaaaaagagatgcccatgatcatacaagaagcctacagaactccaaatagactggaccagaaaagaaattcctcccgacacataataatcagaacaacaaatgcactaaataaagatagaatactaaaagcagtaagggaaaaaggtcaagtaacatataaaggcaagcctatcagaattacaccagacttttcaccagggactatgaaagccagaagagcctggacagatgttatacagacactaagagaacacaaatgccagcccaggctactatacccggccaaactctcaattacgatagatggagaaacaaaagtattccacgaaaaaaacaaattcacacaatatctttccacaaatccagcccttcaaaggataataacagaaaagaagcaatacaaggatggaaatcacgccctagaaaaaccaagaaagtaatcattcaacaaaccaaaaagaagagagccacaagaacagaatgccaactctaacaacaaaaataaaaggaagcaacaattacttttccttaatatctcttaatatcaatggactcaattccccaataaaaagacatagactaacagactggctacacaaacaggacccaacattctgctgcttacaggaaacccatctcagggaaaaagacagacactacctcagagtgaaaggctggaaaacaattttccaagcaaatggactgaagaaacaagctggagtagccattttaatatcggataaaatcgacttccaacccaaagttatcaaaaaagacaaggagggacacttcatactcatcaaaggtaaaatcctccaagaggaactctcaattctgaatatctacgcaccaaatgcaaaggcagccacattcattagagacactttagtaaagctcaaagcatacattgcacctcacacaataatagtgggagacttcaacacaccactttcttcaaaggacagatcgtggaaacagaaactaaacagggacacagtgaactaacagaagttatgaaacaaatggacctgacagatatctacagaacattttatcctaaaacaaaaggatataccttcttctcagcacctcacgggaccttctccaaaattgactatataattggtcacaaaacaggcctcaatagatacaaaaatattgaaattgtcccatgcatcctatcagataaccatggactaaggctgatcttcaataacaacataaataatggaaagccaacattcacgtggaaactgaacaacactcttctcaatgataccttggtcaaggaaggaataaagaaagaaattaaagactttttagagtttaatgaaaatgaagccacaacgtacccaaacctttgggacacaatgaaagcatttctaagagggaaactcatagctctgagtacctccaaaaagaaacgggagagagcacatactagcagcttgacaacacatctaaaagctctagaaaaaaaggaagcaaattcacccaagaggagtagacggcaggaaataatcaaactcaggggtgaaattaaccaagtggaaacaagaagaactattcaaagaatttaccaaacgaggagttggttctttgagaaaatcaacaagatagataaacccttagctagactcactaaagggcacagggacaaaatcctaatcaacaaaatcagaaatgaaaagggagacataacaacagatcctgaagaaatccaaaacaccatcagatccttctacaaaaggctatactcaacaaaactggaaaacctggatgaaatggacaaatttctggacagataccaggtaccaaagttgaatcaggatcaagttgatcatctaaacagtcccatatcacctaaagaaatagaagcagttattaatagtctcccaaccaaaaaaagcccaggaccagatgggtttagtgcagagttctatcagaccttcaaagaagatctaattccagttctgcacgaactatttcacaaaatagaaatagaaggtactctacccaactcattttatgaagccactattactctgatacctaaaccacagaaagacccaacaaagatagagaacttcagaccaatttctcttatgaatattgatgcaaaaatcctcaataaaattctcgctaaccgaatccaagaacacattaaagcaatcatccatcctgaccaagtaggttttattccagggatgcagggatggtttaatatacgaaaatccatcaatgtaatccattatataaacaaactcaaagacaaaaaccacatgatcatctcgttagatgcagaaaaagcatttgacaagatccaacacccattcatgataaaagttttggaaagatcaggaattcaaggcccatacctaaacatgataaaagcaatctacagcaaaccagtagccaacatcaaagtaaatggagagaagttagaagcaatcccactaaaatcagggactagacaaggctgcccactttctccctaccttttcaacatagtacttgaagtattagccagagcaattcgacaacaaaaggagatcaaggggatacaaattggaaaagaggaagtcaaaatatcactttttgcagatgatatgatagtatatataagtgaccctaaaaattctatcagagaactcctaaacctgataaacagcttcggtgaagtagctggatataaaataaactcaaacaagtcaatggcctttctctatacaaagaataaacaggctgagaaagaaattagggaaacaacacccttctcaatagtcacaaataatataaaatatcttggcgtgactctaactaaggaagtgaaagatctgtatgataaaaacttcaaatctctgaagaaagaaattaaggaagatctcagaagatggaaagatctcccatgctcatggattggcaggatcaacattgtaaaaatggctatcttgccaaaagcaatctacagattcaatgcaatccccatcaaaattccaactcaattcttcaacgaattggaaggagcaatttgcaaatttgtctggaataacaaaaaacctaggttagcaaaaagtcttctcaaggataaaagaacttctggcggaatcaccatgccagacctaaagctttactacagagcaattgtgataaaaactgcatggtactggtatagagacagacaagtagaccaatggaataaaattgaagacccagaaatgaacccacacacctatggtcacttgatcttcgacaagggagctaaaaccatccagtggaagaaagacagcattttcaacaattggtgctggcacaactggttgttatcgtgtagaagaatgcgaatcgatccatacttatctccttgtactaaggtcaaatctaagtggatcaaggaacttcacataaaaccagagacactgaaacttatagaggagaaagtagggaaaagtcttgaagatatgggcacaggggaaaaattcctgaacagaacagcaatggcttgtgctgtaagatcgagaattgacaaatgggacctaatgaaactccaaagtttctgtaaggcaaaagacaccgtcaataagacaaaaagaccaccaacagatttggaaaggatctttacgtatcctaaatcagataggggactaatatccaacatatataaagaactcaagaaggtggacttcagaaaatcaaataaccccattaaaaaatgggtctcagaactgaacaaagaattctcacctgaggaataccgaatggcagagaagcacctgaaaaaatgttcaacatccttaatcatcagggaaatgcaaatcaaaacaaccctgagattccacctcacaccagtcagaatggctaagatcaaaaattcaggtgacagcagatgctggcgtggatgtggagaaagaggaacactcctccattgttggtgggattgcaggcttgtacaaccactctggaaatcagtctggcggttcctcagaaaattggacatagtactaccctaggatccagcaatacctctcctgggcatatatccagaagatggcccaactggtaagaaggacacatgctccactatgttcatagcagccttatttataatagccagaagctggaaagaacctagatgcccctcaacagaggaatggatacagaaaatgtggtacatctacaccatggagtactactcagctattaaaaagaatgaatttatgaaattcctagccaaatggatggacctggagggcatcatcctgagtgaggtaacacattcacaaagaaacacacaatatgtactcactgataagtggatattagccccaaacctaggatacccaagatataagatataatttgctaaacacatgaaactcaagaagaatgaagactgaagtgtggacactatgcccctccttagatttgggaacaaaacacccatggaaggagttatagagacaaagtttggagctgagatgaaaggatggaccatgtagagactgccatatccagggatccaccccacaatcagcatccaaacgctgacaccattgcatacaatagcaagattttattgaaaggacccagatgtagctgtctcttgtgagactatgcaggggcctagcaaacacagaagtggttgctcacagtcagctaatggatggatcatagggctcccaatggaggagctagagaaagtagccaaggagctaaagggatctgcaaccctataggtggaacaacattatgaactaaccagtaccccggagctcttgactctagctgcatatatatcaaaagatggcctagtcggccatcactggaaagagaggcccattggacttgcaaactttatatgccccagtacaggggaacaccagggccaaaaagggggagtgggtgggcagggaagtgggggtgggtggatatgggggacttttggtctagcattggaaatgtaaatgagctaaatacctaataaaaaatggaaaaaaaaagaaaaaaagaaaatagagaaaccatggcgaagttagcaggaaaagggagagggggagagggagggagagggggaggggaaggggagagggatggggagagggagagaaacatctcgattgaacatatccagggatccatcccataattagcctccaaacgctgacaccattgcatacactagcaagattttgctgaaaggacccagatatagctctctcttgtgagactatgttgtggcctagcaaacacagaagtggatgctcacagtcagctattggatggatcacagggcccccagtggaggagctagagaaagtacccaaggagctaaaggaatctgcaaccctataggtggaacaacaatatgaactaaccagtaccccccatagctagtgtctgtagctgcatatgtatcaaaagatggcctagtcagccatcactggaaagagaggcccattggaattgcaaactttttatgccccaatacaggggaacgccagggccaagaagtgggagtgggtgggtaggggattgggggagggtatgggggacttttaggatagcattggaaatataagtgaggaaaatacctaataaaaatatttaaaaagaagaaaaaagaaaagagaatgaatcgaatagctgaggtggggagtctatgggctacagggggttttgggtggggagaagatgagaactgctaggatgttagcatgaactttgaaatgtataacaggtacctgtgatactgaaggagcctggaacccaggagaagctttaatatgctgataggttccacaggtagccataggtccctgctgcccgaggtaaagggaaatgacttcttttggcagatcagaaccggtttcacaagcttctgagaattgggagtgctgcttttatctaagcatggaaatccttctatagtctccattgagctcaatcctatgctcccttttagagttggggaattggaaatttctatggacctaccagttccaatctacaacagagaattaaaaaaaataataatgttatatttattattattaactaattaattattttaattatttgcatcccaaatattgcccccccacccgcttaatctctcctttgatttcttcaccctctcccccttccctttgctctgagaggataccccccatccctttccctggggcatgaagtctctacaggattaggcccatcctctcccactgaggccagacaaggtggtcctctgctacatatgtgcttggggcctcagagcagactaagtatgctttttggttggtaactgggagctccaagaagtctaggttacttaacacttaaaattgtaggttttcctatggcgttgctattccctttagttcttcaatccttaacataactctcccatagaggtccccaacctcagtcccatggttggctgtgagtatcagcatctatctcagtcagcagctggtagactcttcagaaggcatccgtgctaggctccttacaacagattttaaatggatttctgcagtatggatgcaagtgaggatgttatacatacatacacacataaatgtgaacctatccacaataggtatgagaatattttatgtaactaatttagacattcagattcacttttactagagattatactcatttgtattaccacctttaactagaggccagatatgatagagtagtatgaaagacatgggactagaggaagccctaggaagtacaactgagctttaacatagctttactacagcaagtcacagaatgaattacatggtaaattttggtctcgctatacaacaaaaacaacaggcagcataacttactaccctttacttttctatggagatggcttttcagtaataaaaatgacacctaagtaaatacagttattggttataggtaaatatttctctttttctcaatttagcattattaattcagtctttgtatacatccctagttggcctggaacttgctatatagaccaagctgtccccagactcacagatatatacttgtttttgccttccaagacataggaataaagtgtacatcacatggctggataaaattgatttatttagcatgtgatttgtggcacgtatgcagtggtattatgtttgttgcatgtccatcagacccttgtataacctggttctcctcttccaccaagaatctcaggggtcatcagtcttgacctttaccctctgattctatttttcctggacctgtttttatttttattttttcttatttgaaacttttatggttggtccaaagaaattttctgtaaccccgtgcaaactttgaaactcaatggagttaaaatagttgtgaatagcccctcattttccactttgaaaatataagtgatcagagaaccattcagctcaaaagaaaatgatagtcatctatgcaggaggtatgttgagctttgcagaacaaataagagaaagttgtaaaataacgctactctgttacatgctgtggttatatttgggctgctcagttggtggcagctcagatgcttgtgttctgaagagtttgatgtggtctgatttacttgtcctctatgctgtagagccttcatggcatcattcattcgttcagccagtctgaatcccatgcattcttatgtggcaaacattttgtcagtctttcaaaatcaggctattctttccaccttcaccttactttgtttcctgagatactgcatcctactgcttggagtccttcatcgtactttcactcacttttcctatttaatttttgctatctgtgtttcccagggctttgtttcctgttcttctcttgttctgtcctgtttcctttggcatggcatattcagcatgatttctatacttaagacttgtatattctacatctctaactctgatttctgctcctgttttcacttcattccctacaactgaaatgaagatggctccttcatgatccgaaatatattatcttcttcctagccccagttttctttgagaattgtctgtccttcctcagcttccccaaagagttctgctgtctaccaaatattgaaatgcacaaaaatatggggactatttcctccaagccactgcaagtcttcacaaaactcaattcaatatggatcaaagactttaatatgtgacatggaatcttaaaactgctagaggaacaactcttagacattttaagatacttaagaaccttctacataggattcctgttgctcaggacatgatgtcaataatcaacaaacaggatttcaaatattatgtattttctctcattttcgatttcatgaaatcaaatcgcttctacatagaaaagaaaacattcaagtgaggagacattctacagcttaaatatgcaaagagctaaaaaaaaaaccaatcaataaataagctaatgaaatgaagaaaagtactctttaagatgaaaatacaaatgaccaataaacatttgaaaaaattagcagttctactcatcagagaaatggaaatcaaaactctactgagattccatcttaacccaatcaggatggcagtcattaagaaaaacaaacaacaaatgcttgtgaaaatacacacagaagggagcccttatacactgctggtagttacatgaatttgtccagtcacaaatgtgaaagtcaatatggagctttcacaaaaacaaaaacaaacaaaccataaatatagaatctgtggtattacccagttatgcccttcttggccatttacctgaatgatccaagccaaactaccaccgagttattttcaggtcagtgtttctagcagcactatttgaagctgtggaattatctagggtatagaatcaacctagttgtccagtgctatctctccagacctaataccagggctatggataaggcaaatgtatagatacacacttgatatttttaggccataaaatacagtgaaattattccatgtataggaaaatgaatgcaacttgagataatcatatcaggtaaatattttcattctcagaagtacaaatattatgtattttctctcatttctagacttttatatagacacactaaaatcatacatgtatatgtatatatatgtatatatatataattatacatatgtgacataacaatagaataaaaaaaggagcataatgggaaagcaaagggttaaaagagaggttagtagaatatgaaagaatatattcaatactatgtgtgtgtgcgtgtgtgtataaaagttttcaaaagtgccatagaaaatatattctctagttgatcatatttccgttagagctcttttcccaagaattgaactggtatcttgcatgcattagagagtaaagcaatatcctcaaaatgtctcaacctggctagaaaatattacatatacatatacacatacatatacttatttcctaatatgttaaagcatagaaatttgtgtagagttgaggttttgagagttttctcccatacacacaggttggcatgttcattggtgtcttctttgttcaggtcatgtttgggtgacaattattcatgtctgccatctttccttttgaaacatgtactttatgacttgaaaagaaacgtggtcagtaatgcatctgttgtctttccatactgaactgtggccccaaattgaatctaaacataaatgtactctttaaacaaagtatgctgtttctaatatgcttcagtataggatcattgaataagattcctggtgcttcttttgttcaaggggagtactgctctggaaatgactcctgtgatcgccttgtctactacatgtaataagtctttctccacattttaaattctggttgtacttttggcttcacattcaccaaaatgcaaatgtcttgagttcaataacaatcaaagaatcctcacaggcaaaaggattttatataaatgatgaaggttggtgagaatacacaaaataggaaatagagttgcttatacagaaatcaagtactttcttgcaggtactgtgggtgtagacagattattaagagagaacaagtagttattgaaactctaaacactgcaacaagtgaagtgaaacaatccatcagtgactaaaggtggtaaatatgaaattgaaaaatggagatgttatttttgaatttcatgtatacctgatatatatatatatatatatatatatatatatatatatatatatatatatatatatatatacacaaaaccagctcacagaaataagaagaaaatgtcagatcccctgaaagtagagttgccctgtgactggtcgcatgggtgctgtaaactgaactcaggactactggtagaggaaatcagtaatcttatcactgagccatctttctatcaccagagacgatattttaaatatttctgagcatatacatagctcataatgatttttgaattctcaatgaagtcacttgatgaagttatgaatcatgaaacagatttttaaaagaaactacattaggggaagatgaagctttctgaatcaggtgcagcatctagaatagtgtgattacatagaaactggccctcttcctctttggatggaatgcctgtggctaaacctaaaggatcattcaggctttcttccttagtgagcaaattttactctagactcagagagtaatttccaatttctactcttcattgttctctattctctagacccaacagtcttctgttattttgcaaacttctttaattatatcatcatagcattgcagccattttggtggtgtaggaaagtcaaaggaaggcacttgaaattggcctcctctcgatacaatcctgtaatacattccgagtcaggcctcctaagaatgacttttaaatctttcctcaggtccattaacctaacataatatttaaccatacctcctcctacaactgataatctgaagcaatttatctacatagctttccataaaaagaaacccaaaacaacaacaataacaacaacaacaaacatctaacacatggcccacatgagggagctaatatctagccaattttttttgctagggtaaattctagatttgtttttgtttttaatccccaaagctactattgttcttgtttatttatgttagtaacacttgccatttatcatattggttcttttttggaaaatcagggagtccttcaaaacatgcaaattaacatgtattaacagagactctatgttagcaatcaatggcaggttttagctactgaaatttactcactagattcagctgtggatttggtcgaatgcagtttgtattatgttaatatggtccttaaaattgcataaaaattagcacatctgcatgtaagaaactggcggaaccctgccccaagttggttttgattagtaaaaaaaaaaaaaaaaaaaaaaaaaaattgccagtgactgggtagggaaacaaaggtggtacttttaggattcctaggcaagggacctaggtagcaggagagaaacagctgccatgccaaggaagaaagagagacactaggccagagtggtgcagaagacagagagatagtcatcatgtaggtcctgggcaatgcagccaaaggggctgcagatctgagtctggggctgcaaaaatagaatatagattttaataagtaataactcgggaatatcgaaggagggtacatcagccatgtgaaagttcagaagtggcccagtcattgagctgtttaaggcatataaaagtataaaggctgtgtgtgcgtgtgtgtgtgtgtgtgtgtgtgtgtgtgtgtgtgtgtgtatttcaatcatgaacccagaatactggggcaggtagcgaagaaagtgtgcatgcagctgcctctgggattgatttgagtagcattaatcaggttcagttacaagttaacatcttcacaatcacagggtgcaatgaccttgtaaaagaactgaaattgaagaggtgatggggaaagttgaaagtacactgcatgtacaagactaaggaatgacacaattttaaaacatcaaaacaaatcaaactgccagagttttgaaattattaattacatttatgtttaagaggtaattatatttatagtaggctacgcatgagacagatttttttttttttattttgaaaggcacctgtttactcaaaagtttaagaaacttgttgaagacacttctacgtacaattaagaaaactcaaagtagattaccatcagatgaacaaatgccacacagaacaaaagccaggttgcataatttttacaatgtcaattagaatatacattaagggtagactggagggcaatggaaatagttcactctagttacaggaagtagaaaagtgcactgtctgtggaggtataaaaaatttgagtcagatggactgtactttgggttttatgtctaccacttgtcagtaattttaaatattgctactcataataaaagagcccattgctatttgaatgaacttttccttaactcatctcccactactttacctggtccataccaaccactaaaacacacacacatgcacacacacacacatatatttataaacagacactaatgcatctatacataaaatgaagagaagatagagtaggaggtaaataagaaaaaatggattgggaatccaagaaagatatcattttactgatggccttgtatcatttattcctcattttcagttgtttctttccaatctttggggcttggagtatactaagcttaatactttcctttgcttttcttctctaattatccacttaagtaaactttgcatctagtgaatctctactatcactatttgtattcaattgccaactctaaatctctagacaggagtctcacacattctccaaaggtaacctttccaccattgacttcctgatagctccactaaccataccacatttctgtaccaacttggttgatagaaattgtatcagtctatttagtcaaactaaaaattttagatgcatctttgactcaattctacttctctcgaacagcattgtaagttaatcataagatcatcttttctttaattccaaatatatccagaatcataaatgttttcatcacaaacactgctgctcctctgatcagaattatcatcttcttttgcttgattttctgcagatgtaaactgataaccataggaattaccccctcattccttctaaatctttgatcccatatcaccttctcaatgaggcctctcctcctttgcttataataacaaaacacattattttataaatttgatatacagttataaaaggtccactagaattgaaatgtgaatatgaaattgttcccattccattcccatctctccatcctctcaagccaccttactctgaagtaggctatcatttattaccttgtaatagtctatgatgtttacttttaattttgtcccacaagaaatttagcacagttttgtttcttttactcacacatatgacatgagtataaactatatattgggcatcaatattaatacccttccttatcctactctcaaggctcacagaacctgtcagaataaggcagaaataatgtaagagccagaggacagagaagatcattatggaatgttatcctctggatatggcatgaattttgcacacatgaactcatggtagcgataatttcctgcataagacttgcacaagatcaagccagtggtggtggatggatatgagtaatatgcattatataaatgaataaaatgttcaaagaataaaacaaattattaaaataaccccatcattgagaggagacaggctcataatggcccatgcctagctgaggaactgatgtattttgataactactggggcaagtagagtcatttttctttgactgacaggctccccatacccaattggatgtctctgcacccatgaacacatgaacagtactcaatggactcagtggattattaaatatgggggaggtcatgaagttggaaaaaaaagatgcgttagttggctaaattaagttggataaattggttgggaaggtaaatatgatcaggatagtgtatacatatatgaaactttcaaataatatttaaaatataataaattagggaataaactagacattttgcagcaggaatactgtgtgcagaaaaatttgttgatgtgtgttcttatgttatttagattatgacctcatttcttttgtttattgttttttatttttacctcattgttttttattatctcattgttgacaaaattgttttaagcagacctggagttccttactccttgctatcctggatgaggattattttgcaagaataattactttggttcaacctatatattatttactacactttatcttacatgcttccacatttggtttttgttgtttatgctgacaatttactcaggactgatttgaatgtaattatgcagggattctaaagaataagtataatggatgacctactctctcattcattcacatatttctagtgataatgaagaaatccaaaagagagacatcaagaaacttaccagatgtaactctccattcattgatgatataaattaggtttaattacattaatggatttttccttgtttttgtttgtctgtaatcggattttttttgttatttctcttttttattagatattttcttcatttacatttcaaatgctatccccaaccccctatagcctacccctgccctgctccccaacccattcactcccacttcctggccctggcattcccctgtactgaggcatataccaaggcaataccaagggcctctcctcccattgatggcctattaggccatcctctactacatatgcaactaaagacacagctctgggggatactggttagttcatatcgttgttcctcctatagggttgcagacccctttagttccttgggtactttttctagctccttcattgggggtcctgtattccatccaatagatgactgtgagcatccatttctgcatttgccaggcactggcatagactcacatgagacagctaagtcagagtcctgtcagcaaaatctttagggcatatgcaatagtgtctgggtttggtggttgtatatgggatagatccccgggtgcagtagactctggatggtctttccttccatcttagctccaaactttgcctctgtaactccttccatgggtactttgtttcccattctaagaaggaatgcagaatacatactttggtcttccttattcttgaatttaatgtgttttgcaaattgtatcttggatattctaagttttggggctaatatccgcttatcagtgagtggacaccaagtgtgttcttttgtgattgggttacctcactcaggatgttatcttccagatgcatccatttgcctaagaatttcatgaattcattgtttttaattgctcagtagtattccactgtgtaaatgtaccacattttctgtatccattcctctgttaagggacatctgggtaccttccaggttctggctattataaataaggctgctatgaacatagtggagcatgtgtgcttattacaagttggaatattttctgggtatatgcccaggagaggaattgctggatcttatggtagtactatgtccaaatttctgaggaaccactagactgatttccagagtggttgtaccagcttgcaatcccaccaacaatggaggagtgtccctctttctccacatcctcaccagcatctgctgccacctgaattttttatcttaatcattctgacagttgtgagatggaatctcagggttgttttgatttgcatttccctggtgattaaggatgttgaactttttttttttttaaggtgcctctcagccctttagtattccttagttgagaattctttgtttagctctgtatcccattttttaatggggttattttattttctggagtccagaagttctttatatatattggatattagtcccctatctgatataggattggtagagattctttcccaatctgttggtggcctttttgtcttattgacagtgtcttttgccttacagaagctttgcaattttatgaggtcgatttttcaattctcaaacttacaacacaagccattactgttctgttcaggaatttttcccctgtgcccatatcttcgaggcttttccccaccttctcctctataagcttcagtgtctctgtttttatgtggagttccttaatccacttagacttgacaaggaaataagaatggatcaatttgcattcttctacatgataaccgccattctacatgataagcaccatttgttgaaaatgctgtcttttttccactggatggttttagctcccttgtcaaagatcaagggactataggtgtgtggtttcatttctgagtcttcaattctattccattgatctacctgtctgtcattgtaccagtatcatacagtttttatcacaattgctttgtagtacagctttaggtcaggcatggtgattccaccagaggttcttttatccttgagaagagtttttgctgtccttggtttttttgttttttgtttttgttttttttttcagatgaatttgcaaattgccatttctaatttcttgaagaattgagttggaattttgatggggattgcattgaatctgtagattgcttttggcaagatagcaatttttactatattgatcctgccaatccatgagcatgggagatcttttcatcttctgagatctttaatttctttcttcagagacttgaagttcttatcataaagatctttcacttccttagttagagtcataccaaggtattttatattatttgtgacgattgtgaagggtgttgtttccctaatttctttctcatcctgtttatcctttgtgtagagaaagacaattgatttgtttgagttaattttatatccagctacttcattgaagctgtttatcaggtttaggagttctctggtggcatttttagggtcacttatatatactatcatatcatctgcaaatagtgatattttaacttcttactttccaatttgcatccccttgacctctttttcttgtctaattgctctgactaggtagggaaagagtgggctgccttgtccctgattctagttgatttcttcaagtttctctccatttaatttgatgttggctactggtttgctgaatattgtttttactaggttaaaatatgagaattgaattcctgatctgtttcttttttttgagaaaatctacaagattctttgtatagttgtttttgtttctacttggttaatttcagctctgagtttgattatttactccagtcttctcctcttggttgaatttgcttccttttgttctagagctttaaggtgtgctgtcaagctgctagtgtatgctctctctagtttctttttggaggcactcagagctataagtttttctcttagaaatgctttcatagtgtcccataagtttgggtatgttgtgacttcattttcatttaactcaaaaaagtctttaatttctctatttcttccttgaccaaggtatcattgagtagagtgttcttcagcttccatgtgaatgttggctttctcttatttatattgttattgatgatcagccttagtccgtggtgatctgataggatgcatgggataatttcagttgttttttttttgtttgtttgtttgtttgttttgtgtgtgtgtatctgttgaggcctgttttgtgaccaattatatggtcgattttggagaaggtatcatgtggtgctgaattttaatggatttttttaaaaatcatttttgtcagcaaaaattaattctttacttctctagatgaattttaatccagcagtatggatgctgtggaaagggatcatatccaaggacttctaggtctatatgatctggatgaactacaaacaggcccttactaccctactttaatccctaatgattagtttatagaagaaagcagcagtatttgaaagtcttgtctaattgaagaaaagacaatgtgatgaatcagagaaagatttggtagaatgaatcagaaataggatatgtccaaatctcaagagaacatctcaggaaagggaagctacttaagagcagctcagtgaccagaaagggagccagtcagctgggactcagtccagtaagtgaagtattgcagagttaagattatgcagtccagtgcaggtcaacagaagcagttggagtcagagtataacaaggaaccagaatattagaacaaagtgctagaataaatttgatgtcaagaagagcaattcagtaagaagatgagaaaagccatattggatcagacagcttggaatcaagtttgagccagaacagctaagttgaacaaaaccatccagagatcagaaagaactagaaaggatgaacttaatgagcagtaagcctctaagatgataattccatcgggtaaataaaaacaacttttgcatactcctttggcttacatagaatttttttttgttatataaccttatgagacatgtttaataccctggaaatcaatgttaattgttctttccattttgcatgtggggactgtaacacagtaacttcacagaggggtctatttggaaatatttcattaaaatatttcacttatcctaacttttttgttttctatcattactggtcattttatctctacttttcttcatatcttcttatagcttaatgctgatggtgcttttaaccatgtctggttcagttattcctaacagcttttcttcaagagattggaagtcaactgggtagcttttcggggaagaatataatagactggaagaaactcagagcaaactaaccctattgtcctttaactattgatgaaccagataatatagttatagttatagaacctgaaccaggatataagacagaatgtacatttttaccatgaaatgtttgaagtattaattacatattaatgttaaacttgtttcttactcaatataaatgaagttccaatatggactgaagtaaagaaaaattagaaacatgtaacaattaaattcatcttttaaagtcagggggctctgatagttgaatatactattatattactttcatcataaattttataaatatccattccatcataaggaagatctcatttctttcttaccaaggtctagtatgtcatgtttcatcttttttaaaaaagcaggaaaattatagcaattggttttatactggaacctaggtaatagatctgacataactacttgcctggaaaaaaatgaggaatcctcaatgatagaaaagatgctatacaaggttggtcaggtagctatgttgacgagacacagtccttggaaggcttatttatcttcagaaagtcattagatacagctagtgaatttctgactctctatcaagtatgacaaggctaaccttacctgtcagtgacatgctctttgaagcatatttttatttactgttgtttataaagaagacagttaatgagaatttttagcaagtacttagaaaatacatgtttttaactgataattctattgttataaaattattccatattttattatcattttaatctttttatatcctaaaaaggttacatattttaatggtattgttttatggttttgtagagtgatacgtagaacttatattgtgccataaatatttccaaacttttgtaaagttttgataatcaagttttttacagttatctaactaacccactggaaaaaaatgtactaggatagatgacatttagattatttccaacttaatccttcacaaatagctatttagtgttcccataccatataatcatttttgtataactggatattttcttgagtacagacatccacttcagtgactggttttatgtctacttgacacaagctagagtcattatgaaagaggaaacctcaaacgagaaaatgtcccattcttttcaatattaaataattgcacaatgaagttctattatgaagtggataggactatttctttaccagtgattgatgttggagggctcagctcactcttggtgttgccacccctgttctgatagccctagatgctataagaaattaggatgaacaagctgtgagagagtaagccaataagcagcactcctccatgactaccttagttcctgcctccaggttcctgccttgcttaagatcctatcctgacttcccttagtgagaacctgttacctgtaagcatcaggtaaaataaacactttcatcttcaggttggctattggtcatagtatttgagcacagctttaaaaaccctacctaagatgcccacaaattgacttaaagaagaaaatatgcattcggctgatgacttcagaggtttcactctatctgaggcaactataatttttgtagactggttgtaagacagaagggaatggtggaacaaaaatactcacctccatattcgatggttaaagggttggaatattgttttcaatgacatatttcaatgactgactttatccaggtagtctcatacactaaagttttcactacctacccaaaataccagcagcttgtgaataagccttcaacatgtgattctttgtgcatacattccagatctaaatggaaacagctagtgagttaatctctgtcttcctagattgcttatagattggaagaataacagtgtatgtgttgtaaatctgtctaacttacatctgtattgtaaaaagtcatgagttgcatgtaaactgctgagaacaatgtgtgccatacaataaacaccccatgaatgtcacctaacattatttaggataggaacagtactttatgtgtcccaaacctcatactgatttaatgttgacaggcattccagtgtagtctactccaaggacaaacacgtttgatttaactagagatgtgaagtgacatgagatgcaacatctgatccttttgctatcccatatgtatatgctgtcctttctgcttcccagaagaatttctctgaaggagaaattatgatgccttgaaagccctaattaaattccttaattagtctttttttgaaaataaagaaagtgtaaagcttaatgactttcaaaaacaatctttgtattatttaataatttgattgacattgaacttgagtatggtatgaaatatacacctgaaattttcagtatctaattgtgtagtatgtaagtttgccgcgagtctctaacattctcaaagatggctctatcttcaaagcagaactgattagcctgtgttgcttctagttcttccagctactgtcattttgattttaaacccaggtatatatcagagaatgtatcctcaagggccagttatgagcactatttgcctactcttctaacttgaattaaaagagatcaactggtggtatttctagccacagcttaagtacctaaggtatttatctgcataaccagtccaaggaacaaaacaaaagcacagaataataaggcatttaaagctcagggcaaattgttgtctgctttgtaccatgcttccaataagaagttattatctgatctgttaagtcagaaatgacatcaatcacattctcaaacctgcttgtatatttctgtaaagttaacacacacccatacacacacacacacacacacatacacacacatacacacacacacacaccccattgcttattataaaaggagagaccactgagtataaagcccacaaggcttttcaataatcttcttctcacataggcctaataaactctgattgtattaggaaatgcagtttattaactcccataaaccaggactcaatgattccatgtcccaggaaaataaaatgaaatgaaaagagttaagtaattttgggagctttgaacacacaatacaatagatgaaacccagacatttcattttttatttatatgaacagtagtttttttttctgtcataaaaataagtaaaagaaaaaggactggagtgctgagatagttccctgtcctactataacccatgaagaaacaaaagctctgcctatgtgtaagccctaaaatctatcagctaagaaagtaccttcattttcattgttacagaagaaagggccctctgccaagtggagaagtagatgtcatactgactgaggctgcatttttgacagcaggaaaataggatctgacttgaaatgcccccaagaaaactgacaggcctttgtaatgctgcttgtaagagataggactaacactgatgtcacaagctagctggagtagagctggctttcattgaatattcttttctaagatgcattatggcctctggatatcataagcatcttgcatataagaagtgggagtgatgctctagttttaaagcaattcataagagaacttcattgtacaataatttaacattgtaaagaatggtaaatgcaggtattttttctcaaggtagaattgttgaaagggataattttaaacaactttctctacttttagcagagatgatacacaggttgtccttggtgagacagaaggctagctgtcaagtctgaaagggatgtgcatgtggaattgagtttagaatatataaagagtatacatgagtcagtctatggctcctgctacagatgtatcagaggactgccttatctggcatcaatgagaggggaggcccttagtcctgtagaagctggttgcctaatgaagggagaggtgtgagaggagtgagatgggagttggtgggtgggtgacgaagcaccctcttagatgcaaaggggagggttgatgaggtagggggctttcaaaggggaggatgggaagggggacaacatttggaatgtaaataaaaaaataataataaagagaaagaaaatattctcatgaaatcacaaaaaagaaatataaaatagatttaaccatttgtctataaatacttactagaattttatcagtactatttgatgactgatatctatcacatttttccacataaatcttggtactattgagaaaagctggaataaagttggcattggttttcatcataatgtaaaaaatgcttttacctcatgagggctgtctggtcagggctggtcataaaagcttgcttctaggtcacagtttctcaatagatagcacttaagaataaattattatgcatttttatgctataagatacaacttcttaaactgtggggtgtgaccctatatagggtcatgtatctgaatgagatatcacaaacatttggccagcgggaaaaatcctgaacatgcaataattcaaaaataatagtctgagatgggagtgctttcctatattgcattatacaatgtgactgcagccctgagtctgaaaacagaatatgttcacttgaactgggtatgctgccatgctatttgatacaataaccactgcctgaaactccatggcttaggttccaaaatattgtattttattaattgaagagtttttttttttactgtacaaataaaaatttctgctcctaaagaaacaaaagagtttaattatagaaagcagactttcaatattttcttgtccttattccataattgatgagcatcaattagttatcttttgattggattagattagagacttttctgtttaagttgctatttgagttaatgacttgagtttcagaaagatttgtgaactgaaatctgacttggggataaagaccaagtttccaataaccactgaaatggccctacatatacttctgctctttttaactgtgtacttatacagagtaatgtcctcagcattgacaatgataaaatcaaaatatcagtcaactctgaaactgttggaagagtctctacgtcctgcagtatcaaatactcagtctgcagtatcaaatactcagtcaagatttacttctgtaaaataaacaagcatatctatctcattagtatcaaatttccttttatctttaataaaccattaaataatatatgtgtgtcaaacaattatattcaagtaaactttttattatctttaccagaacatattttatttatatgcctatttttatgccctcagataaaaatttcacaaatgactagaaaaaaacttgaagccctgttagaatcacaaatgtatagttgaaaaaatgtatagttactaaattgcagcagcttaataagtcattcatcttagagttgtccattattcctctatagcaagagcaaaatcagaaaactctagatatttgggtccaaataattatgggttgtggtgtgaagaagttgtccttgtatgatattgagtatttagcagcattctttgttctgacccccttaacatcagtaccaggcataccctacacccatcaagccatcttactagacattgcctagtgtcttttggatagagatgagagctactgctttaggaagctaatgattgattgattgattgattgattggtaacaatcttcttttctaccagccatcaagctgttcttcttcctttacttccctttattttcatctggccacttttgtcaagacccatgactctcctcttgttttcaggttccctgacttttgtcttatttttttttttttttgtcttgttacaaaacagaaatttacctgcatctagttctgagctagttctgagccttcccttcaaattgttgtcttaaattggggcaaaatgaagactctacaacagcagttgtcaacgcaaatgtagcaaccaacccctttggggttgaatgataccacaatgaatcacatttcagatatcttgcatatcagatatttacattacaatttataacagtagcaaaatttcagctctaaagaaaaggaaaacaaaataattttatggttggggtcaccacaacaagagaatctgtattaaagggttgcaacattaggaaggttgagaaccactgctttggagccaagtatcctgaactttagttcctgtattataattgtttatctaactttacatttgctttcatttataaaacaatactaatatggccactgtttatagagtcattgtatgactaaattcttagaaacatacacttaacatgttggcaatgttgaccatgatattgtataaactattattataagaatacacatgggagaaaatatgtaaaatgaggtaacttctatgctttacttgaatgttccagtaagccatagttgccatagtactatagttcatatttaattatttgtcaccaaactggtataacactagctacaatcacttgatgactgaggaaatcaaaatgactgtcttagccatgtcattcatttttgccacatggtgttgcagagtactctgtccttgcctagtgcaatagaaggagaaaggttctaagtggtaactcatttagaaattctaatttgttgtctggacagtttaagatctgacacaatactaatttcacagatctatcaatgtctatagctagtctatgattttactggttgaacaaattaaagtaaaagaaagacaaattgtgttgagtagcatgagtttatgcatcttcacacacacactcacacacaacacacacacacacacacacatacacacacacacacacacacacacacacacacacacacacacacacacactctttaagctcagaatagtgcagttccaacaaatgcagagttagaattttaaccccaaatgttggagagcatcagctcttcattcaagtttcacgtggccctactacttctttttctgtgattttatttgcaaaggattgaagcaaaaatagtcctggatataaaaggggctattttttctctgatattgttggaatcctccagctttgattttatgataggatggggactgttttcatttgtgacctctccaagtactgattttatataactcattagcatatgcttcctctgtatgattcatcccattgaagcaattaattcttcttccattcagcaaaatataaataatatactatcttcctttcaaaggcattaacacttgtggtttagatttggtgagtcagaaaaaagaaagtgtttttgagtccacttcctgaaaagcctcctaaatgagaggatggggcaaatagatattctgagataaagcaagcatttgattaagaagttaagccttcctggctttcacagtatcttttcaagactcccagaacccagagtgccatgtgcattcattccaacttaccatgattgaactgcatgcttttatactacaaagatcgtccatataactctctgaaacagttttggtactgtcattttaccttcctaaaatttcagtggttcttgatgcctgttaaataaatttctaggaattatagaactcatagaatgatagtgttggaaggaatcttggagtacatacacttaagtggtaaacaaactttgatttctagacaattttcagaagaatattacaattcttagtgagaaaacaaaacacaacaacaaaaaataaagacaatgaagtaataattttatgaaagataatatactcacttaagttgtttgaagctgtctctcagttttattttgcaataacctttattgtatgaagggatcgcatcaaccatgactaattgactgatgatggtaacaggagaatgcaaaccttggggtcatgtaatatttaccatgctactcaaaatgcttagcatgtaaatcccgttatcatttgacatcttgatcacaataatgccctaagtatcatcctatattcttcagtcactattccttgctgtctctcaaatgtaccttacagtttcttctaaaatcttcctcagttcaagtgctgccacttttacaatattgtcctgtcagaacaaatacatctttatactttgctttcagaaatttacatcgcttaccatttataccacatactgtatccagattgtcacaaatttatgacctatacactctcctgtgcttgccatctcagtaaatgacatcaccatgtacccaactgcttaaactagggaccctgaagacatctcttaccttatttacaccaatgtataattgatcatagttccctgtcacttttgcctccaggattcatcctccaagtgtatacttgaatcctttcactgcacaattgaacagatcacattgcatctccttgttctgccttgaagtccattcttggtgtagcagccacttttaatgataaatgcacttccatggatttttgtaacctttaagaccaagcccagaatctttaacagttatacaagatatgcgctgcctattctgctattctgcctagactgctctgtctcatttcttgctgttctttcctttgtagacttttcttcagatctactgaacttttaaccattgaatgtgtatttcttactgctgtatgcttttgcttgctgactttaatttccatgtctctgaatcttcacacatcctagttacattgcctggaacacattcatgagaggaagcattctttttttttttaattacgtatttatttcatttacattttcattcttaagtccctaaagtttcaacatgttccccagagcaagtaatctttctacttattattatactcaagacatagttttgtaatttccatttaaattaatttcttcaaaaactgtatgtatttactacacttattagtgtgatatctcatctcatagcactagatcataacatgctctcaatgaatgtatgttctaagaataaaaatcttacactatacattctcagttattgagatttacattcctgtattatctcattgaatcaagtaataaatatatgtataacatataacatataatatattattaaactgatatatatataatataatataatatatgatacatatatgagataagctgatttaaaatacttggtagataactgataaactttttgtttattgaggcaccagaacatagataataccatgagaaagaagtagattgtataataataaaaagtgaggatgaagtataagcattgggctgtataatctaagcattttaagctgacaagagtataggttgcttttattcattttcttttgttctgttttggaactgggtctcatgaaactcagcatggctttaagcttggtatgaggatagccttgaacttgtgaaacttctgcttctaactcctgtgtttgaggatcgccagcagacgccagcacactcagttttctactgctgtgctgaaggtacatgcattctaggggagcactctgtgaactgagctacattcatagctcactgatactgattatgtttatccgtggatttgagtttctcccaccataaaataacactaatttgcctgatttaaattgtaaattatctggtaatttcatcaagtaaaaagaaatgttttcttcgaataatgatttgggaacattttaaggtaataaaataaaattgcttaaagtagcctaaggagtgtgtgtgtgtgtgtgtgtgtgtgtgtgtgtgtgtgtgtgtgtcttaaagacttagagaataactcaggttgaagtttccaagaagctatctatagtcatggttattacttcttacttaaagcaagcactttacttcaaacatccaaaagctattgcagattcagatgaggtagggtgataggtaattccgtatattgagaagacatattcaaacctactagttattgattctcttttcagcataaaaaacatacaaagaagtcatttttcacagacacttcatattgacatataatttcagtctttttggcagtctctttgtatataatattatactaacattggtcaatgtataatagtgggcaagaagtttctcttcttattttcattctgttttgttttaacatacgaaacatatagtgtactttgtaaaaagtgagcaaactatgagttggtgttatttattttataggctatgtcatgagcttggcttaccccattttgtttatacatggtcttaatattgagatcattcagatgtaatgagttaagtgtacagtgaaacaagattgatgaaactattatagtgttaagtcacctatctgagtggcaatacattttccatgacagaagacagccccccccaaaaaaaaatgtttagtaggagtagaaattctgacaagcttaagttcctgtcctcaaagaagtcttctctgaagctgagtagtattccattgtataaatgtggtacatttacacaatggaatactactcagctattaaaaaagtgaatttatgaaattcctaggcaaatggatggacctggagggcatcatcctgagtgaggtaacccaaacacaaaggaactcgcacaatatgtactcactgataagtggatattagccaagaatcttaggatacccaagatataagatacaatttgctaaacacatgaaattcaagaagaacgaagaccaaagtgtggacactttgcccttcttagaaatgggaacaaaacacccatggaaggagttacagagacaaaatttggagctgtgacaaaaggatggaccatctagtgattgccatatgcagggatccatcccataatcggctcccaaacgctgacaccattgcatacactagcaagattttgctgaaaggacccagatagtgagacttgtgagactatgccggggcctagcaaacacagaagtggatgatcacagtcagctattggatgggtcacacggcccccaatggaggagctagagaaattactcaaggagctaaagggaactgcaaccctataggtggaacaacattatgaactaaccaataccccggagctcttgactctagctgcatatgtatcaaaagatggcctagtcggccatcactgcaaagagaggcccattggacttgcaaactgtatatgccccagtacaggggaaccccagggccaaaacgggggagtgggtgggtagtggattgggggggtgggtatggcggacttttaggatagcattgaaaatgtaaacgaggaaaatacctaataaaaataaaataaaattaaaaaaaataattcaatactgatctctaccatatttatgatgctattccaaattcaataggattatctatagattagaagaaatgtgtgaggaaaagtaagggacaattagtcttataattcctgcattattatttggattatgctccatgctccaagaacacatagattagaagaatgaagagctggaaattatatgtgttatcttttgctataatataaaactatcaaatgtatagtgtgtggttgcatataaatataaaactgattgttattaagaagtcactgtgatcatagtttaaaggtatgtaggtcagatatttagtcaagtgacaatttctgttagcaaccatagattgagttttgaaggtgggagtgggtgtgtgggtggaggaacaccctcatagaagcagggggatgggatggcataggaggtttctgggagggaggtacctgggaaaggggataactttgaaatgtaaataaagaaaatatacaataagagaggccagcacagtttttttttgtaagtggaaggttatgggacagtgaaagagtaatattggtgaatgggtcccaaattttacatggacatgaggaataagttatttaattctattacataatgtcttaattaattttcaatagctatgataagacattatgaccaagacaacctatagaaacaatttttatttggggcttacagttttagaatgttagagttcataattactgtggcagagaaaacagaaggaggaagtcaggcaggatgacagtgtagcagtagctgagaattaatattttgaaccataagcataaggcatagagaggcagagataagtaactgtaaacaacatgggattttgaaacttcaaagctaactcacagtgacacacctcttccaacaaggccaaacctcataataatttcagtctcaaactatctcttagatcttcctctgataggccttcaatggtacatgggaaactaatttccatggagctttctttacctgttgcccctaggactaaactgtatatctacataggagcaagataaatagattcctaaaaaaaatatttttctcacatgtccataacagtcttggcttttgagatgaacatttgaaggtagcaaacaaatttcccaagatagtctgtcatcctctacatgggcctctttaatatggtacccataaactttattttttcactctgaatacttcaggattttactgaatatgtaattagattactaaatgctaaacaataatgtcatttgccgagtttcttcaccatacacataatcatctgttaaaaaacaattatgtgagattctcattgatctttagaatatctttggagcttttcaacttgtaatgagcacatatatctgtcatttttgctttagcatttgtatcattctctagtctttgtttatatgtttgaacatttaaagatggattgatgacttttgctgtacaattcactgtgataaaacctgcagcaactgttcaaaagtttgatttaatttaaaaagaaaatgtctgctttcatttcaagataagattttttagcatgcacatgacaggtgaaattgcataagttcattaaaataggtaataacattttaagacatcacaatttttagtgttatatataaaacatagatggctgtacaacatgaatgactagcaaatctttttgttctgttagggtggagctgtggaaacatttataaaaatcaacttcccaagagatcataatttttatccttaacaatgaataactctactctgtcatcagtgaggaaaaatatttttactaaacagacatattactttactaaagtacttcacccattcttaaccctccagcaaatgttctttatacacaggcaggttatggtaaaaaataaaagtagttatcaaactaaatatgattatgattgatgacataaaatggttagttattttgaacaggatgagttacagctttaaatttcagagcaaaatcaacaagggtttggtgggattttatttctcatgaggctaatgggcttacattaaaatgttcccaaatgtagaagaaaaacatttttgtctaccctttagattcagaagctaagctgtacaaattaaactgacaaaagacaaattaatagaacaaaaggttggtttaatatacacatgagggtttcatacaaaaaatttaaaaagaaagaaaggaggaagaaaggaagaaagcaagcaaacaagcaagcaagcaagaaagacaagagaataaccaaagtaataggcttgtgagtgcatctactatgttaacaaaagtgaataaagagtggagataatacatgacaaagaaaagggggttttaggtttgaaagagtagtaaattgtgggaagtaacctaatatgtggaaaactagtggatgagcaggattgttttagtaaggtttctttatacaggcacagcatggtgtcagttctctgtctttaatagtagttgttcttgtttttcctcatgtgggaaagaagagggaggatactatcacaagtcaaaatttatgcctgagttttatgaaaatagggaaagggcagcaacttctctgtctgatccttgttacttgttatctgtttaaagtaacccttattaaaaagtggtctatttatggatatcatatttgggtccagactattagtggagtcttaattttaaatgctatatatttcaatattaccaaaaaatttataggttgaaacctagtcctcaatattatagtattaaaaggaagacactcttaccaagtgaagagatataaacagaagctgccctcatgaaggccatctgtcctgcaaaaaaagatcccagagaactgactgtgtaagtacagaaggaagtactctctgtgaattaagaaatggaaccaagctggatattgaggacacgtgtgcactgtatttaaaagttctagtctgaaaagtgtgaaaattaataatttctgttgtttataacttgattagtattaggcaaattttatattggccttcatgaaacaagacccaaagatactcaaacttgcacatctcaatggccttcccaagataatcaataacctctcccacacaaataaaagtctcaatacaaataaaagttagagtatatttattctttctctttacaccttctctttacaccttctccaataagtcttatttccttgcatgtgaccttgagacttcaagctaccttaaattaaataaaatataataacataaggaagatacaactggatagcatttttaaattgttctatgttaagcatttacttcttatacttatcctttactggaggcactatcacaaatcagttatgaaaaataaggatgggagaactaacatgtatgcattttcttattattgtaacaaaatctctgacaacaaacagattaagaagggagggctttaattttggctaatagtttgaggatatagaaggcacgacagtaggagattaaaggaactggtcgcactaaatctaatcaagaagcacagagtaaaagatattgttactcggtggtctttctctttttttccatggagtctgatgccgtgcatgtttttatcgggcggttcaataaaattaactaaatctagtgtctttcattgacattcccagagagttgtacctgtggtgattacaggtcagagtaaattgtcaatcaagattagccatcacttggcagagcctctcaagagatagctatatcaggctcctgtcagcaagcacttgttggcatccacaatagtgtctgggtttggagattgtatatgagatggatcaacaggtggggcagtctctggatggcctttccttcagtcactgctccacactttgtctctgtatttcctcccatgagtatttggttcccccttctaagaagcagtgaagcatccacactttggtcttccttcctcttgagcttcatgtgatctgtgaattgtatcttgagtattccgaacttttgggctaatatctacttatcagtgaatgcataccatgtgtgttcttctgtgacagggttaccttacttaggatgacattttctagttttatacatttgccttcatgaattcattttttaaaatagctgagcaatatttcattgtgtaaatgtaccacgttccgtatccacttctctgttgaggggcatctgggttctttccagattctggcttttataaataaggctgctatgaatgtagtggagcatgtgtccttattacatgttcttacccgcgttctcgcgaccggccaggaagaacgcaacaaaccagaatcttctgcggcaaaactttattgcttacatcttcaggagcaagagtgcaagagagagaaaaagaaagcaagaaaaagaacaagaacaagaaagcaagagaagagagagaaaaagcaagaacaagagagagaaaaagaatggcaaaaccccgtcccttttaaggagaattatcctccacctaggacgtattactccctgattgactgcagcccatcggcccagttgtcatcacgagaaaggcagaacacatggcgggaaaactgcccctgcacgtgtgcagattatgtttattacttagaacacagctgtcagcgccatcttataatggcaaatgtgagggcggctcccaacatctcccccttttcttttaataagagcaataggccacccatattaatgagagtggagatagaggtcaaatccccagtgtgcaggtaaaggagccatgtacaggattagctcttaggctcacaggcttttacccagagcaaccctgacctgctcccgtgtcgtttttcctgggggaagggaactaggacactgaaccttcatgaaagatgacatgtctccctagaataggctcatatatgccgcagagcccttctactgcagtgcttagccgtgcaactctctcgggctgctgaagcacactcactctatcccgtgcaatgagactagcctcgtggggtgcaagagctgaatggccagcgacctattgcttaagcatagataaccatatatcaggggaagcaccatgttctagagctgcaagtgcctgggcaataaccaccttgtctctcctagtttgggccttaagcttacagaccaaccaaagaagcaacactaatccacagcaaagtgtatctccaaataatatcaatcccacccattctttaaagaaggaaaatgctgaggagatccaatcgggtaatcctttgatcagggacaggtccaagcgtgtggagttgacctgaagtctcaattcccgaagggtctgttcaaattcagccgtccaattctgtaacatatactgagaaagactttttaacaaattagctaccctagtaaatttctcatactgaatggaagtaacgcacaatcccagaaacttttgttcacatcccagctgagctatttgccataatacatctagttgttcctggacaagatctatgcgttgattcatttctgcccatggagcatttttgggattggaggatggcggccgctaagcctgcattggtgagaggtccgccaagctcctgacaaaccctgagccagtcttgtaagcctttgttctttcttggggctatggccgctctgcattcctgcgtggcttgctcataaataagctattctaccagaggtgcggcttgctctgaatctccaaaaatacgctctgctgcctctgtcattctggccacaaaatctgagaatgactcctgaggtctctggacgatctttgttagttgtccagtggcttcacctgcttgggagagcgccttccaggccctaatagccttttcatctgattcagaactattaagaactggctccttgagctcacctagtgatgagtataggctccttctcctagagacctccgctaattgatcttttttcttttcttttttcttctccttccttccaatctctccccaggtattcttacctgacctaaacttttcctcaggttcaagacccgtggaaaggcctgtatacttattttgtgtaccatatttcctctttgctcctactctctttccccgctttacttctgatagattgccctgaatttcatccagaattttcagccctgccttaaccgcttgataacatgtgaaaaggaacaaaaaggctcctaacactggagaaagttcaaggccaaacataccttgtaaagctatttcccactttacttctgatagactgtcttgaatttcgttagaaagttcaaggccaggcttaccttgtaaagctatacttacgggtaccctgttccccagatgaagagttctgaattcacacagttgaatccttctcaacagtctgttttacgggaacacttcattaccaccgttccccagctgaagagttctgaattcacgcagttgaatccttctcaacagtctgttttacgggaacacttcattaccatgacccgcagttctggttccggaatgagggatcttccttgcgctggtgatggtaaccgtcccaggtcttctcatcccaggtcttctcgtcccgggtttcggcaccaactcttacccgcgttctcgcgaccggccaggaagaacgcaacaaaccagaatcttctgcggcaaaactttattgcttacatcttcaggagcaagagtgcaagagagagaaaaagaaagcaagaaaaagaacaagaacaagaaagcaagagaagagagagaaaaagcaagaacaagagagagaaaaagaatggcaaaaccccgtcccttttaaggagaattatcctccacctaggacgtattactccctgattgactgcagcccatcggcccagttgtcatcacgagaaaggcagaacacatggcgggaaaactgcccctgcacgtgtgcagattatgtttactacttagaacacagctgtcagcgccatcttataatggcaaatgtgagggcggctcccaacaacatgttagagtatcttctgagtatatgcccaacagtggtggatgctctcagccaaccattgtactgagcccagggtccccagtggaggagcttgacagtggacccaaggagctgaaggagtttgcagctccataggataaacaacaatatgaaccaaccagtactcccagagctcacagggactaaaccaccaattaaatgtacacatggagggactaatggctctagccgcatatatagcagagaatggccttgttggacattaatgggagaaggcccttggtcctgtgaagacttgatgctccagtgtacgggaatgccaggacagggaaacagaagtgggtgggttggtaagcagggaaagggtggaggggatagggggttttcagaggggtaaccaggaaaggatctaacatttgaaatgcaaataaagaaaatatctaataaaaacgatgagccatcaaaaagctcaagttcattgtaaaagccattatgttagaaacatagaagaatacatttgcatctttccacaatgaatttatagggcttaacaattttaataacagaaaattgtcaaataatccatttatcttggtagactggatggggtgaacatacatagttttattctaatcttaattactaatattaactctcatataacatgtggcatatcatatatatctataaatgtgtatgcatatatggattactgaattaatacaaatttaaaaggctgcagcagaatcaatgaggttaagaagtagccttacatagagcctgtgttgataggggaattgaaccagaccagtactgcaagggcttgatgttgctgtagatgatggtgttaagtttgagaatgaagccttagatagagttcacctgctaaatgaaaagttgaaacaggtctggaacagaagcaggagaaggtatatcaggtccaggtccatacatacaaatagtctagtaggctataatagaacattggatatgagagtggacaaggacctagctgagctaaagcttcaggaacaattgtagaatcatgagttcttgaagataacatggtgctagatgacaagtttgaggaatgcaattccatcacagtgttcgaggtgaggaagttatactatttacttcatctggcatgtctggtaagttcttcgttctggtttctctcatacgattgtaaaatacttatgtgtctctacagtgtgaattcatctcaagtaaacataaaaggtggttccttttttagtcctgggaatcagtcacttgtcacttagatggatggtttctgactcatggttcaggctctatgtctacccaggggacacagacatccattgtggtaaatcttcaacccaaataagcccagacaatgaaaacacaactcaattaatatgaatacatgctgtgtgcctagattgggcagttctaccgctacactaccatcttccccttagaacttgaggtttcaccagaccaggtgcttctgctatacttcctcctcctccatcattctctctctctctctctctctctctctctctctctctctctctctctctctctatctgtctctctctgtctctctctctctctctctctgtctctctctgtctctctctctctctctctctgtctctctctgtctctctctctctctctctctctctctctctctctctctctctctgtctctgtctctctctgtctctctccccaaaccttcagctccaccttccccattttctttgtccagtcaccagctctagcctttatttataaattaaggtgggaagcaggtttacagaaaatctcctgagtgctgactcattccttgttctcagcccctcaaaggagaacagaattaacataaaatacaattagccccagggctatccacaacacttcccccattttgtccaattaaaagactattttagctcagatataattgaacataactattactatttagtaatttataaagtaaaagagccttaacacctagtccatcatcattgttaattaaatagaacctctgtcatctatcctatctttttatcatttttttaatttaacaactttttattagatattttcttcatttacatttcaaatgctatcccaaaagtcccctatacactccccctgtcctgctccccagcccatccactcccacttcctggcgctggcattcccctgtactgggacatataatctttgcaaaaccaagggcctttcctacaattgatggctaactaggccatcttctgctacatatgcagctagagacataagctctgggattagttcatattgttttttctcctatagggttgcagaccccttcagttccttgggtactttctctagcttctccattgagggccttgtgttccatccaatagatgactgtgagcatccacttctgtatttgccaggtactagcatagcctcacaagagacagctatatcagggtcctttcagcaaaatcttgctggcatatgcaatagtgtctgcatttggtggatgattataggatggatcaccgggcagggcagtctctgaatggtccttccttctgtctcagctccaaaatttgtctctgtaactccttcaatgggtattttgttccccattctaaggagggatgaaatatccacactttagtcttccttcttcttgattttcatatgttttgcaaattgtatctttggtattctaagtttccactcagcagtgagtacatatcatgtgagttctctatcttaaaagatttataattatataccttactcatcccctggctttagattgtaagtaatctgaaaatcatcctttcaaatttatattatctttctcaatgctaaacagcttggttggctatgagactatgagtcttcaaccccatcagaaatccaagaacgactaatataatttgaaaatatgagaagcacaaaatatagcttctaaacttagccaatttatagagactactgaccacctggagagtcccttattcttaaaaatgttgaagcatcagtctttagccttgaccagggtcatctgacagacttttgtaatgtagaattttgaaggactgattaccctgtcttggcagagattatcagtcaactattccacacagtttatttttattctggacaatattttgtctgcagatgaaatgaggcaattcttgcctagtggctctcttgccacaactagagcaactccaggtgatgctcaattttttatttgaatccaagaaagagaattctgtcaggagcagacttgtctccacaacaagtgaataaataacattaaatgtcacattctatggacttctgacatttttgaaaaccaactatctatgtgaagtaatctgaactgtcctctgttagcatatataattaaaataactgaaagcaacctaacaataccccagagccatggatttcctatttggccttaactcacaggctgaaacatttcagatctgtttataataacagcaatagaaggactgggtctaatccctgcacttcaaaatttttagtatcactaaaagaattttataccaatggaaacccttgattttgcatcaaattatgtaccatttaagaaattataatttcagcttagtaataattaaaaagatttctaccaaatgaaattatgactttgcaatcaattctacatattcttccctattccaattatgtccattcctacattccctataaagacaacctataataatcactcccagtcccaaagcctagggaactgggacaatgactcttcataactccttcaagctgaatatgggcattgagatatttttgaacggatggggaagggtagtgaaaatggggtagttggttgggcttaagaagtctacactgattgaattagtctctgatgtctgtgtcctgactggatccagatgaaaaactaagtgtggagagctgcaatcgccattacaagatggcaccagcttctgctgcgcctgcaggaattttccagtaaacaagcattgtgcgcatgtgcgaaagagtattggcgccaagtcacagcccatcccggggtgtgtcaatgggatcatgagcaagcagccaatcaggtgtggacacgctgctctaaggggtatataagcagtgcctgtttggggctctgggtcttcctcttcattctgaagctagcgtaataaagcattgctgcagaaggatccggttgtccgcgtgtgttcttgctggcgagatgatagcacgcgggacaactaagagagcaggtgttcaggtaggtcaatttagcatgtctgatgatgaaatttaccaaggctatatattctgtaatatataaatctcaaaacaaaattttagtatcatcaagataacctttttgtttaattctctggaatctagttcttcagagggagtcttcctctatcaaatctgatccatataactctggaagttgtaaataccttaatcaccttttccaaaaacacagacaaaaccttttcctcaaatcagcatatccttcaaccagtaaccaggaaaactgtatgtagcttgccctctgtaccagaggaataataaaacacaaacacagtactcaaaatcacacaaattttagcctatttaggcctttctaatttttcatgtcaggatattaaaccaaaattcctgtggagtacacattagagaatatgagtctcctgcagactttattatagcctctttaaaacaattgattcacactcctatctatacctgcttataagaggcagcttgtcaaaccaggatttaaacccaaaattcccatggagtccacgttagacagaatgagtaccctgtaagacttattagaggaaaatatctttataccatctttaaagcaattaattcaaacttccactaatatctgcctataggaagtagatagtttttaattgttaagctctctgcctagagcagccatctgtttataccatctatctgttgtgctctctacctggatccacagacatttatttaattaatatctattataatatctacctgttattctctctacctggagctacagacttctattaattaatatcagttcatagcaggtgattatcactgctctctctactatctagtttttaagcgcaggcaaaatttcccatctttaaatatcaaagggttatatttctctatatatcaatgaattacctggtctgggaccctttgtacctttgtcttctgattctttattcacaggaaggagctgagtatagaaagacatgcgttgtgtgtgtccctgtttttgggtggggaaggcagggtggggagtgaaggatatggggaagccaacacagaaaggctctctcgggcatagatgcctctttgccattctctgtgagcccctcaaacccaatcagcttcaaatccacagtgcttcagcctagatcactgcccaagcccaattcagggtttgaaggtcagtgaatttttatctcaggttagttgaattcaaatcagtatgttgggctccaatttgttgtggtaaatctccaacccaaataagcctgggcaatgaaaacacaacacacttaatatgattacatgctgtgtgcctagattgggcagttctaccactacactaccatcttccccatataagagaccccttataacttgaggtttcaccagaccaggtgcttctgctccactttccttcttcctcctcctcatttctctctctctctctctctctctctctctctctctctctctctctctctctctctctctcccaaaacctaccttcagctccatcttctcctctttctgtgcccaaccacgggctctagcttttatttataaattaaggtgggcagaaggtttacaagaaatcacctgagtgctaatttattccttgttcacaacccctcacagtagaataggatcaacatcaaacacaattagctccaggactatctgcaacagacatccttctccctcaaaatagagtcaaaagttggagtctctaagggcaatgaacctactgtttcatgcaatatggagtaacttatagtagggtatagcctattgacagccacataagtagttagcaagatataattgtgacttaattcgaatcttcccagcatttggttcattataccttccattatattgtctaatctctaaaatgggacaagttaaaatatcgtaaatgttggaagcagcataatcagtacagggtcccagacaacattagaagtgtgactttggggatataacttaactttttgagattaaatgtcctaatcttgcattcttagctgtatcaaagcatcaggctaattattgtgaattattaattcaagactcaaaatctatattcatggatcatactttgtcactgtatttttattcaattctctgaatgagaatatgtgtgtattatatgatactaagcaaagaaccataacctaataattttattggatttattagtattttgtcattttaaagtggtaaacggaacatatgtatatctacttacctgttttgtctgaccttcaatattgaatattttcactacttgccattatgtaagcatcaaataaaaattctgaacatctcatgccaacaatattgcaatcatctcactttggaaatgccatgactccttagaccttgtggtttctactaaatgaattcagaaaaacagagaagaaagtatagagaacaagcagagtggaaagtaagtagagtttaccacaaaatattatattgtcaaggtatgagaatgaatgatgaacagaaagtctctttatcaagaaaactcacaggaggtaagagtagaaaatggctcaaaaggccactatgtctactagccaaaaagtacagaattctcatgtacaacctacaatcataaaaagtttaacaaaaaggaagttccaagtgaggatgcttcaatctcacttagaaaagggaacaaaataatcaagggaggcagagggagggagggaactgggtgagagagaagaaggagagggaaaggggacaggatcaggtatggagagagacagcagagaagcccagaggaccaagagagtgagtggaaatattcagatgctggaggggagggtcatggggggcaggaatcctatacaaagttccagagacctgggatgtgtggaaataatatgatgtcaagggagtcatggtgggtggaccctctacaaagtcccagaaagctgggatgtgagagactcccaggattcaatggggatgatcttagctgaaatggccaacagtagagagacggagcctgaagagaccacctccactagacagtgcccccccaccaccaccagtggagggatagggtcaccaacctaccttcaaaatctttgacccagaatgtttcctgtcaaaagaaatgcagggaaaaatggaataaccagcccatcttgggatccatcccataggtgggcaccaaaccctgacactactactgatgttatgtcatcctgtagacagcaggtagcatttagcatagctgtcttctgaaagtctctaccaacacctgactgagacagatacagatactcctaggcaagcatgaactcaggttgaggaccccaatgaaagcgttaggggaaggattaaagaacttgcaaccccataggaagaccagcagtgtcaactaacacagactactcagagctcccagagactaagctaccaaccaaagaacatacacaggctggtctacggccccaggcacatatatagcagaggactgccttgcctggcctcagtgcaagattgtgagcctaatcctgtagagactagatgccacagggaagggggattgcttgggggacaccctctcagaggcaaaggagtgggtgtagggggtgaaaaattctgggaggggagaccaggaggggacaaaatttggaatttaaataaataaattattttttttaaaaggagaaaatcccactatgtcaacctatctatatgcttaaatatgctaaaaactcttttataaattttcataaatagaaagtttcttccgagatattttcctgttcagataattggtaggtccatttggattaactcttatgctaacagacaaaaatatctttgtattgtgcaagaaagccttaggttaaatagtaattatttttaaaaatacttaattctttggcattctaatataatatatttggatcatactcaccaccctttcccataacttctctaaggttcactccaactaaactcctcccaactttatgcatggactttcttattttaataataacatagtccaatatgctcgtgctatggggtctttcacttaagcatggttgacctagcaggtgacgcatgcctaatgaaaaatggactgtcgctcagaaactattaactgttagctcctcagttaagaatgggatcttgtgaggtccttcccatccatggtagaatgttgactggcttgatcttatgagtcttgtgtaggcaaccatagctgctgctgtgagttcatgagtgcagctgtcctgtcctgtctaaagacatcgtttaacttctgtactcctcaaattctatgagtcttacagtctttccacctcctcttccccatggttcctacgccttcccaggctggggggagtaatagagatgtgtcatttatggctaagtactccacagacacttattctctgaactttgacaaattgtgagtttattggttcaccaccatccaccacacaaggtaacttacataatgagttctgagagctgcagtaatctgtgaatatagagatattaatttagagtcagattggaactatatctttgtaatgaatagtagaagtgagttcacccatgggacctgggatcttcctggccatgagttctttgccatgttgcaatataaaacctgtatttccttacgtggagaaggctttaactctaatcagaaaatggttcattacctttctaacatttctggctctgttgcacccataagcctctcttgccacagaggccattattgtagttcacaggttcacagcagagtaacactgttgatgaccatcctgtccccttgctcccagttgcttacatagcatctccagtattaagaaagggccatgtctatttttacactactacattcatgtagtcttatgctgaaactaatccctgcactattagagatctcttaaaaaattcttgcataatccaatgtcttgaagaacattccttgtatttttttcctagcactttcagcactgttttaaatctgttgatccatttcaaatgaatgtttttgcaaggcaaaagagttttaatttcattctcctactactagatgatcagttttaccagcaccatttattgaataagcttcctttgttcaactgcatgtttgtgccacctttgtaaaaatttggaaagacatatcttcgttggtttgtttccaggttttccattctatcctattattgaccaagtcacttaaaatctttatgatcccatctggttatatctgagacaattgactgttgtattgcatttcacacttctgtgatacaataaccgacaaaattaacttaagaagggaagagtttgttttggctatgacttaaggagtgatacaatccatcaaggcaatgaatgcatggcagtgggagcatgaagcagctgctctcattatccattttacaagcaaagagagaggaatgtagtgctcacctctttcatttttattcagccttggaacaaggggatagtgctgttaaaattcagcatggggcttcccttctcaactagcttttatggaaacacatagagtaactcagagatgtactcccaaggtgattctaagtgcaggaaagttaacagtggaggttagctatttcagttcttctggaaattgttgaatctggaattctacaatagattgttattaaaaaccagacatctcctacatctattcacctaaatttatttgcctgcatgtttcctgtctaatgattatcattaaaatatcatttccaggagttttttttaattgatagctgattacttccaataataagctactcattacctgttggagatagagaatatgcctcccaatattggaagagaactgtcttagctttaaatatttcttctttccattaaacttctgttccttcagtagtgtccttatatttgtggtgtatattttaaacctttggtcaccttggaacacccctctgaaaatatagtaatctggtaatactttgtaaacaaccatagtgaaaaatattaaaattttaataaaaatagtttaaaaatggaaccagttgctgcaatcctgtttaggatagtggtattgaataatataacattttatcgacttttcattgcatggtatatgctatagtcatagttcgggggatattctttaaagttaaatattttactaaatattggggagggacatcgttattttattttcaaatcaggtatttaccaccttttaggctaacttaatgtatagggacaatatttgtgactattttcctactaggccagtcagttttagaatgtttggaaagacaaagtaatttggaatatactgcttgaaaatttgctttatccatgacagtgtcaggttccaaaatacccatcatgattgtgccaagtgggctaaagaaaaagaacctgtccctactatatatttcagagtattttaacaaaagacaatagttatcagtcgtgccttaaaattagatttgggcttctgggaattagcctgcttcttttggaggaaatatgttaaccacttattgccacattgcttgcttttgaaataagtgacatcagcttttatttattagatgttaaaagccagcctagtttgttgaaattcactgccagtgttttgaattacaattctcataatgttctttataacctggcttttggttacactttaaaactcattatcttctgcttgttttcatgtgccatgtctttctctgccaactgtttcgtaagcgttttgaaaccaagacatgtatcttctacttcatttgtgttcgtggtttttgtttcttcccaatgtctagtacaataagcacttaataattacttcttaacagaaaatatctgcatgtggtctgtgtcacttggctctattctaacaatccaatctgtgccattaacctcacccagctttctaggaagacttaagtcacatggatcctggtctgggtactccagctgattttgaggagccaagcatcatggatggaaataacgatgctgcttgcttagatatgaggaactccagcttatccagatagtttattcactctggctccttgaccctaggaagttttaaggctctacttgtaaatttaacatgttctttgtaggccattgataagaagtgctcacaaattaggccaagtcctcccccaagtcatggcttacatgtttactttgacagatttccacaacctcctggcaagtattagttcttttccctcctgtaagaaatatgaaatttgtctctggtcatgaggattttatattaacctatttttcaatctttactgaagaaaatccattttccttctgctcttgctcgactggctcagaaaaaggcagccaccgtactctggtgcttctaagtctactgctcagcacttttcaaattacttcagattttgttgttcttcatggtagaagataaatccttagaatcttttctcataaattatcaccactttagaagagtcactaagatgttcctatcctggatatttgaaaatacacatcacaaccattatattccaagacatatttttttctaagacatctgagatgtatactaaactcaaacctgaagaaaatagacaagatttgaaggagtgtggtcctgattttatctctgagaaataatcttgcaaaacataatgaaacctgaagaaaagactacaaagtgaaataacatttgcctataacaaggttgattcgtcctcagtgagggtgaatgaatttctttgcaaagtgtgtgggcctaccatatagatgcagtgtgtaccatatgcatgtgttgtgtatacaatatagatgtagtgtgtgtactttatagatgtagtgtgtgcactatatagatgtagtgtgtgtaccatatagatgtagtgtgtgtaccatatagatgcagtgtgtgtaccatatacactgggattcattttcaaggaggcagctttcttgtttcactataaaaaatgatggctgtaaaagaatgatctccatttcagaaaagcaaatgaaaaatgactgttattagtcaattgcaaatctgtgaagtttggggtagagagtaggttgttgagtttacaagtactgtacaatgaaatgaaagtttaagcgagatataaggtacaatttgcaaaacacatgaaactgaagaagaacgaagaccaaagtgtggacactttgccccttcttagaattggaaacaaagcacccatggaaggagttacagagacaaagtttggagctgagacagaaggatggaccatctagagactgccatatccagagatccatcccataattagcctccaaacgatgacaccattgcatacactaccaagcgattgttgcaaggatatagctgtctcttgtgagattaggccgaggcctagcaaacacagaagtggatgctcacagtcaactattggatggatcacacggcccccaatggaggagctagagaaagtatccaaggaggtaaagagatctgcaaccctatcggtggaacaacattatgaactaaccagtaccctggagctcttgactctagctgcatatctatcaaaagatggcctagtaggccatcactggaaagagaggcccattggacaggcaaactttatatgccccagtacaggggaacgccagggccaaaaaatgggaatgggtggataggggagtgggggggggtgtgggggacttttgggatagcattggaaatgtaattgaagaaaaatacgtaataaaaaagaataaaatatatattaaaggagggaaaaagttaaagtttaaataatgataattttgcaatagggaagcttgaaactttggggaacaattgtaattcttgattctttgtgggacgtggttattcttttgaatttgatatggcaatgattgtacaatgtctttttttttacctgcttttggaatatcaataaaagactggggcaagagaaaaaaaagaaatgaaagtttaagagaagacactgaaacaaaaaaacaaaaaacaaaaaagggaagacacagataatcatttttaatatatgaagaatgttatgttttacctatgtccttcattttaaattttcaaactgagagtttaagaatttttggaggatataaaacaaaatccataatccaatatttggtgggtcatcagctgatattattcctttgttatcacagtcatttcagcaagctggcatggtgataaaatatgataaaacacatttaggagaaagtttgctatttgatatttattattttgcaaaatatgttgtgatagcagaaggaatgagcagctttcagagaacatttacttaatttgaaatcactgattgtgaaaaagtaattgttctctaacacgttttgattctgaagtgtaaaacatttagtgaaatttattttttatccaaataaatatttcagtctgccatttataatgtatcctttgtgaactaatacaatacttagtaaaatataactgtgtcacagttttaaaaatgttttcttttcattaagatttttgttccataagtattttggaaaactcctatctaaaatgtatcatggaaggcattgtagggaaagcaagctcaaggaacactacactggtcttttatttaagaatattcccttctattctcagtttaacaacttactagctataagatctagacatttggttctcatgtgagagtggagagaggccctgcattcacttatctctgagttatagttttgcttaatgtactcattaagcattttctatctgatagaaatggaaaggattctatggcagtgaaaactattatagaagtataataatgtaaaaataataaaacagaatatgatttgaaactcaaatagacctgtagttttggaggttttgtttttggtgattttggtcttttttttttttttttgaactttgtcacttgccataactggtgcaatcttgggcaatcccttcttctcatgtgcccaagttagttaccttatttataaagctaatataactataatcttattaggtaaatacaacttaaaatagaatcaattatataaagtgcatagctttacatagtacacatataatgttcttaaagtgatcactataagatagtgtggcaggcattgttattcttcgttaacagaaagctgaaaccaaggctttgagaacctgtgtcatttattagaatgcagtattctttgtagtacatcagtaacttctagcctgaacgatttctgcccacgccctctccctgaggggatctgaggagataataatgagaatctatgagtcattttcaatatttgaaaggagcctaacagagagtgttcatttactttcgataaattacacaacctgactaaaatgtcaagtttctttgcttttgcctgaaattatatccactcattttgataatactggatatcccatgctgatgggaaactgattggcagttttatatgtctctgatgaatagaaatggagaaactaaatttgaaatcataaatgttgttgatctaggtttttttcttaagttttagaaactggaggaaaagtaaaattcccctttgatgctaaaatgattgaagagagctacattacaccatgcttcccattctgactcatgatgattgcaagatgggagatgtataggaagtcatggtcagagggattttcaaagtttggcagcctaaggataaattgtttttatataataagcactcttgaaatgatggtgcatataacatattctttctgcctatgagataaggaaactgaagctcaaagcagagttgtaagggattgatcaaccttggcgatcaatagggtgacagatgttgcagcagagtatagggagggatccatggctccagttacatatgtagcagaggttgtcctggtctgacatcaatgggaggggaggcccttggtcctgtggaagtttcatgccctagcgtaggcagatgctgaagcagtgaggcaggagtgagtgagtgagtgagtgagtgagtgagagtagaagtaccctcacagaggcaaaggtaaggggggaggggtggatgggatggggatgctgtagaggggtaactgtgcagggggatatcatttgagatgtaaacgaatggaatgattaataataataaaaaaggaactcatcaaactaccagaatactagatagtggaacagatgaggattttattctagtgttgtggatcaatatttcatagcctcttgatctctatcacagagaaataaagccagttcatctttaggtcttcataatgtccacaaagacattttctcagtcttccatttactattgattggctccagtcaacgaaagtaaacacttgttaaaacctgaacgaacatgcaattagagaattacagagaacttacagctgcttctttttattgatctgattacttattggcctgacagtgtacatcataatttttgttgtgatgctctactaaaaattctctttctacttaatgttatacaattaacacaaataccataggtacaaaaggagagatgtgactacaaacaataataggcatcatcgctaagtgatcatggacagaaacattgttaatgaatctctccattcatttactgtttagtataacctagatgctattctgagtagtgatataagagtgaacaagaccaacaaacaggcaaattttcatggaactcacattttttaaatcatttccctatctgttctctcatagcagtctcataatacagacactcttaccattctcagttgaaaaggtggacagtagagatacagtttataagtcacatgttcaatgtcatagaaccaagagtttttaatttaaaacttaaactaaaatctgctagattcctgggtgttcttttttttctaatagtcttttctagttttcttaccaactatattacctcaccacataacttcatttctgccatgactttccaaacctttatccctactaccatactatccatatttgggggagagataaggcagggatcatagcttttattgactattcattatagattttaatacatttatttcttctttttaaatttgaggcagagtctcatgtagtctaggctggcctagaacttgctatataagtaagtattatcttgaacttttaatcttctgacctctgctgggattagaagtatgtgttactatacaaggttgtgaggttataaacattggctcagatcttcgtgtatgtaaggaaggccttctactgattgcaccacaaactcagccaattagtacatccaactgtttaaaatatttttttcccttccttccttccttccttccttccttccttccttccttccttccttccttccttccttccttccttcctttcttctttctttctttctttctttctttctttctttctttctttctttctttctttctttctttctttcttccttccttccttccttctttcttcctccctccatccctccctccctcccttctttccttccttccttccttccttccttccttccttccttccttcctttcttccttccttccttccttcttttcttcgaatgtacatatgtgctgcatgagtttacatgcaccacatgtttataggtgtttatggaggccagaagaggaccctggctatcatagaactgtagttccaagcatgtatgagctgtgctatcagagtgatgacaactagaacttggtaactttgaaaatcattaagtgctcttactgttgaaccatgtctccagcatcaataatagtttaaactcttaaagctacaccatagcatagctattgctaatactatctccattgcctagatagtgaaacaaagcacaaacaggctttaagttttcctatagtgaaacatagataaaaccacaggaagattccagagtttttgatttttattgtccagggaagtacttataacattgtgccttacaccaaaagttaacttttttcccctttaaatccacatgtgagaagataaaggtgtaaactagggcagtaacaatgagaacagatcggaggacatgtgaattcaataggtattttagagaaaaggggaattggatttgctaagtatcagattggagtgacaatgagactgattggactattgataaagtttttttttttttttaagagatccaatacttgtgagaggaaatagtttcgtttctgacattccaggattgaattcttgataagatgcccaggttcggggaggtgttaagcaggtgcaatataaggctaaagctaagatttcaaaagggagccatactttgtaccagaagagatggaaaccacagtgagaaactgaaaaggagcaaagacttatgcgatgtagatatttctctgttttatcatagtcctaatattttataaggtccaatcttctacttcatttcttcccttgtttcctgagagttttgctcaccaataccaagccatgacagtatgtaatctgatttataaatggaatcagctaacaaattacacctttaaaaggcgatagcttcctacaaattatacctctactttggtctaattaatttacacttattatgcttgttaaaataaattctaacacattactgatcacattttaaatgtcccatagaaccttaacttttgtacatagatttataaatgaaatataaataagatcacaaaactgataaactaatatttaatgtcaattacttagttttaataaaagcctgtttaaaggctgatatagggatagaaacaactcagctggtcaaaagcttccatagcattcttttattttcttttaattctctcatatattacatccctaccagttttcccaccctccccttacccagtctcttcttccaccctccttcttccctagatccaacctacctctacctgtcctcagaaaaacaaacaaacaaaaaacaaacaaacaaacaagcaaaaaaccccaacaacaaaaacaggcctttcagtgtcatcaactaactacagcatacaagctccaataaaatcaggaacacaccatcacatcaatgctggactaggcaacccagtaggacgaaaaagttactacaaataggtaaaagagagagggatagcccctgccctgactcttaggattcccacaagaacaccaagctacttagctgtaacatatatgcaaaagacctaggtcagacctgtataggctccctaatctctgagatcttgaattccagtcaattgatttggtgggctatgatctcataatgttcctgacccctctgcttctccaatccttctccctcctctttctgaggactcccggagttctacctaatatttagttataggattcagcatccgctttcagttgctggatgaagtcttgctggtttctttgatgacagttctcggttccaatccgagagcactcatatatgtacaacaaaatgtaaatcaaacacttttggctgggttgatgtcccaatccttgtacatgagaacttgtctagttacagaaaattgtcagttcaggctccttgttcccattattaggaatctgttctggggttactctcctagattccaaggagtttccattgtactacatttccacctaaaccatgaaatgcccccttattcccatcacttcaaatatcatcctgagtgatttattccataacattcttaaaggcaatgtttccatactccataaaacagaggattatggtacataccttcagggaggagaatcagagacttatggtcaatatccaccaagtagtgaattcaaaatcagcctaaaacacagaagactcaaggagaaggtaaagaaaaggggagaaaagaaaagagaaaggaaaggaagggaagggaagagaagggaagtgaagtgaagcaaagcaaaggaaaaagaaggaaaggaaaggaagaaaagaagaaaaagaaaaaagaaagaaagttaattatgtactgatgattcataaattcaggttcttttgagagatatatgattagtttagtatgtgttaatgattgactcaattttcacattgtattttattactttcttttggtagaataatttattaattcattgagaatattataatattttataattatatttaatgcattttgtcataatcaccccactctgattcctgtctccttccaaatgtactaccgaaagcctcttctaacttcatgttaccattcccctttttataaacctctggtctgatttgtgttgcctgtatactacatgtttggagccatcccctggaatctggtcacccacaaagggccatagccttattcccagcacccatcaactgtcaatggtcatttctctaataggatgagggttcttgaaccattccctagtccatgctgaaatgttgactgtatttattttgtacatacaaaccataacttccatgagttcaaaagttcatcagacctctcatatcaagaaggtactattatcaccaaatcttacctgcattatggcttttataatcgtatacttgttcagctctttctcttttaaagtgctttctgagctatcaggaaaagagagatatctatcattaaggatgtttgtaaaagccatgttcctcatagaatctgtagtatgccaaataaaaaatccagtgccaggaatgaaatactttattttcagttattgatgaaagaagtcatgaagactccaaaattaatgtagttattgacattgctcttagctgcccatgaggaactatatacaagactctattgctaaagatactatatactttgggcacagacatggagaaataaaacttgtacttgcctgaaaggtccctctctgctgcctaacattcatagatccagaagtcttgaataaaagtttaggggaaaaaagctggggaataaaagtcaccaattgtcttaaacagctatcaaccctgtgaactataataactaatgatttacttaggaagatatgcacataagtgcaatactggcatgaatattatgagggtaacaattcacattctgattgcattaaaggctcactccatagtagaaaacatgtatctggtactgaaaatatggccatgaaactatgactctgaagttcttaggcccctgagcacatgaactgctataagagccatgttttaatattttcactactgtgttttgtaatatattcgactctcattttaaaaagatatcatttatatatgtttgtatgcatatgtttatatactacccaataccagtaaaatcattactgacaattgaaatatgctgcaatacttatcaattggctatctgttatattcaaagtgtattgtcttgattagttttagttgaaaaacagaagttaaaacacattatcatgtaaaagtgttatcctagcctggcatggtgatggattctgagtacctgagagactgaaacaggaataagcaagttcaaggctaccctggattacttagtgagactttgtctcaagacaaacaaaataaaagactctgtattgaaatgaatagatttgatgcattttatttatgaaatcatagtagtaatgaccatttatttgcactgtttttttttctagtttttttttaaattaggtattttcctcatttacatttcccaatactatcccaaaagtcccccatacccaacccccccactcctctacccacccactccccctttttggccctggcattcccccgtactggggcaaataaagtttgcaagtccaatgggcctctctttccagtgatggccaactaggtcatcttttgattcatatgcagctagagacaagagctccgggatactggttagttcatattgttgttccacctatagggttgcagttccctttagctccttgggtactttctctagctcctccattgggggccgtgtgacccatccaatagctgactgtgatcatccacttctgtgtttgctaggtcccggcatagtctcacaagagacagctatatctgggtcctttcagcaaaatcttgctagtgtatgcaatggtatcagcgtttggaagctgataatgggatggatccctggatatggcaatcacaagatagtccttcctttcgtcatacctccaaattttgtctctgtaactccttccatgggtgttttgttcccaattctaagaaggggcaaagtgtccacactttggtcttaaataaactttcagttatagtatataattattaatcatggcatgtatttaattaaaagtgtgtgtgtgtgtgcctaatggcatttcatttcatatgactcaattgtgaagactctccttttaaaatattttaaattatcctcatataatgttagcccatgtatttgtcaaataccaaagaaattttggttttgttttttggaaaactcaaaactattgagtttatcaaaaggttagactttttcaatctctaaacatttcagattaatttgcaaaacgaaatgattgggttgtatttaaggttctaaaaatagttcattgaagaaggcacatgctttttaaaagcatgtcagtaactgataatattagatgacataatttggcatgcctgttaacaacatgtaaagtataccttatcatattcagagatggcacaagatttggtgaaaatcttcacgtcaaacctcttgcaggacaaagttgagttcaataccagaggacgcacatggtcagttccataagtttgatctctacccatgtgctatgccttgaatgtactcatgcccccacacacaaaataagagaacggataattaattaattaattaattaattaatagtgataaaattaaaaatatgcaacaagtgtcaagtcaaaacaaaaatttcccaaaaacagattttattttttttattaataatgaccccgttactttcatgaacaagacaaaagccaatacttgtgacaacagatttttctgcattatttattactctttaaattggcatattcatgtctattgatagaaacatctttataatttatagcttcattttggccactgaaaaagtaaaaagaaggaaaatgagtatgatagccagagtccccacgagaccaatttagtaacattctaactcactctctaaactaatatagggtttgactccctcagtctctagtcggtgattagtttgctctttgaaatcattctctaattaggaaaatactacgttttctttggtctcgatttatcagagttgtgtatagctctcttatccacactttggtattatttaatacaacttgattgtaccttgttatctttttgtcttgattttgtttctgtcttatataaaaggggtgctaatctttaagaattagtttcttattagtgtccattgagattaggaacttgcaatgaaagattgcatttttattataagtaattggcaacacactatggaaatcattatggcagtttctacaatttataagcatagggaaatgcctcactccataaaggacttgctgtgcaagcatgacaacctgagtttgatccccataataccaattaaaggcaaatatggtgatacatccttgcaatcccagtgctagagaggtgcagaagaaagttttctgagaataactgaccagccaatcattgagccccaggtctaggtgaaatatcctgtttcacaaaagaaaactggttaatagccttcctaaggaacaactcaggttgatatctggccttctcagctgaaaacccatatataaacacacacacacacacacacacacactcacactcacaaacacatgtacccacacaagcaaacacaagaacaataatattaataagactacagctatgatttgaccaagctataacactctttggtgtataccggatagactgcattctaccacagaaatatttctacatccatggttattctgtccaagttttctttattcacaatagccatgaaataaaatcagcctctcaattcagcagatgaatggataataaaattataatatatacacatacaatggaatttaattcatccataaagaaaaatgaaattatgaaatctccagcaaatcttgtggatctgtaaattatcatattaagtgaggtaaatcaaagacaaatactatatattcagttgctctgtctccattcttcaatctctccctttcccagtctcactctgtgtgtgtttgtcttgaaactagaaaccacaagagggataatggcagttttgagggaagaagtcaaaagaacacatgtgtcaaggaaagagagctacttgggacagaaggacatgagaagttagcaggtggatgtgggagaataggaggggaaggacagcaaaatcaacttatgtgtgaaaatgccactgtgatatgaaccttttcactttgtacacccacttaaaaataataattggctgtaaaaaattaccaagtatattagtataaaatataattttatttatttaagaattataataatatgaatggatattccccaacttggttttggtaaaatattattctagttccagaaagacaaacatggtatgtattcacttataagtggaaagttgctataaagtacaggataactatgctgcaattcacagacataaagaagctaatcaaccctaaagtatctaagaactcctggaaggatgcttgaatctcactgaaaagagaaaataagataaatatcaggggtggaggaagggaggagactgtgtagaagaacaggagatatcaagtgtggggacaaaggagggagggagaacttggagagagaactgaaatcagtgacaggaaggacatctctgggacaatctagaaacttaagacaatggaaactcccaagaatttatgggagtgaccctagctaagactcctagcaataggggatatggaacctgcagtcttgcaatgaagaaatagggacaccaacccagccacaaaaccttcaaaccacatatgttcctgcctacaaaatgtgcagggataaaagggaagcagaaatggcaagaatagccaaccaaaatgtggcctaccttgagatgcattccatgaaagagaacccacacctgactctactaatgctatttcgctatacttggagacaggacctaggaaaagtatcatctgagaggcttcacccagctgttgagggaaacagaagcagacacccacagtcaaattaggggctcaaggaaactgagggtggggtgggggtttgaaggagccagagaattcaatgacaccagaagaaaacctacagaatcagctaatctgacctcataggtgctcactgagactgaaccgcaaaggagagagcaggcataggacagacccagcccccttacatatgtgtaatagatgtgtagcttgatattcatgtgggaattccataaaggtaggagcagaggttgtatctaactacaatgcacgcctttggatcccttttctctaacttggatgcatccactagcctcactaggctaaaatatccctagtcctagagcaacttgatatgccaaggcgggttgatatccttgggaggcttaacctttttctgaggagaaaaggggaggtggaatgtgaaagggaggttaaggggaagagactgggagggggagggaggagagactatgatagggatataaagtaactaaattaacgaaaaatgattataatgctttctcactccttttctaatgtgaattcttggtattgctataattttattagcactggcatcttacagaagactttataattttaaagtttctttgacataaagtagattatcatactgagtaggattctatttatttagagataaaattgattttaatgtcaaccactatttggtatttacgggcctgctctacatataatccccccaaaagattttgccacgttgtggctaccaaattctcttctatttcccagacctttcaaggcattaagctgtgttttcttcctaaaacttgatccacttaatttctctctctttgttaccgtatgtgatcggaaatgcttcagttgtatcacatgcctcaactctgaagttttaaacatcttacagatatttctttaagatttttctcaatttttttagaataataagaaaagacattggcatgacgaattctatcatgtgtggcttgccattgctctttataggtcagaagttgacattaccatgattgttctttttacagtgttttacatgttgattaatattggtagaataatcgcctttaggagaccatgtaataaataatacaagtgagaaaattatttaaagtgacaataataattgtgttacaaaaacaaacataaattgaggctactcctgacaaaataaaactcactcaccttagctctacatggaaatttgccttcatagtactttctctatcctccagatccaacctgtgggaattttctgtggtacacacatagctcaaagtatcttaaatcaatcataatgatttatgttcagctgacaaagatcatctaaaaaataagcatgcctttctcattcggtttcaaatcaatcaaaccaaggttttcagaatatattttcatgtcctccctcatttgtggttgtaccctattatcagacagactttcagagaaaaagtagataacactatgttctttctaaggtgcaagtctaattttattattaaattatataaaacactttaacaggtccacatttacccagcctttctgattcagtctctgctgcaaatcctgccattcactgctacccttcttttaccaattagtgttcaatttaaacaacatgcaattatttatcatcatcatcattattgttgttattgttgttgaagatgatgttatttttctaggtgctatggaatgtgataaaatatcaaaattaccttatcatcatatatatgtaattgatattttgtaaatgtttgataaagggaggaagagtaaaatgtcctgacaactttatttaatatactatattgcttgtataaattagtacgttgcatatatcatccttgtaaaattagataagaattctctatattgttgttttaaagtaaatcacataaagtgtacttcatgacataacactgttttataagaccttgatataacttatggaaatttagtgcattaaatataggaaagcattttagaggcctttattaactaaattttattctttataatgttttgtgaaatgtcttaacagagttaaataataaatggtataaaatttctccttggtacttttagggcaaaaatctcacttttaagatacaaataccatccagatagccaaatggaacacatattaattatttcacaagttctaatcagtaacaaaaaattaggtgaaacttcatttatgactatcaataatgaaagctaattcatggtgaaatacagtattggcatcactgtcattaattgcaatgatgctttatattgtagtagataaagtgtttttgcaaatattttcttcatgtaatccccccctttaaacacaaaaaataagggaatggttgattaatgaataaataagtgatatccatttttcttgacctaagttaatgaaaagttagtagacctccaaaccagatgcaattgctaggcattttccagcatttgaattactgaattgtaatattaattgtaatatattttgtatataaaatacataatattatattattatatgattttttttttattgtgggattgtgaaaggcagcctggtttctggttgagccaggtttgaaaccccagtgacacagcaggtgaccctgcaagggactataggagttttgccactctcctggacactaggtccatgatgtacgaggcagcatctctccagaattctgtggacatcagccatataagggaaatgccccaagcccctccacaggtagaggacatgaccacagatcatgtagcctcaagacagatatctgttttaatgagggacataaaggcccagaagcttagccaataaaatccccttaccagatactcctccctgcaaaaggtatttaacttcagacctgccctgtgaaaatagggtagggttttactcatcgccactctctgccatgaaaataaatgctttaataataataatgaaaataaatgtcatgaactgtctgtctcttttcattgaatcctccatgggaagcaatggaacaggctcttgtctaatgagctggggtctagtctcccacagaaggcctttcagtgtgctcccagccatggcctctgccaagccaatttgcccaccaaacaagccaaggactcacctctccataggacctagctggagcgcccctcatttcccccttcgcccagggctagatctagcccatgaatccccactgtcttctcagctcttctctggcatccagtggtccctgagtgcccaagagcttgagaaccagatggtcctggcctttctgcagacccggggacccctgagtcagctctggcagttcccgggtatctcagtggggtcccacagcttctcatagcccaatgcccacccagcactggcttgaggtaagcacagttaaaactcccaagtcctgcatcccgtcttcacgagtggccctagccctgtggcaggctggatgcagaccaccatctaaaccacagtccatcttgagaattatgcatggcaaggcacatgcagttctctcaaagttatatttatatatgattataagtttaaagatatgtatatatatgtatatgcatatctgtatatatctgtatatatgtatatatatatatgtatatctttagtttaaacactggtcatgatgaaaggttgttgaatgagcatatgtgtaggtacagtttatagaaaagaaaaaggttttcaagatttagttgatgacttaaattaataaatacttattttctaaaaatatatttagtataacattgtatgaggttagtgttcattggtaacttgatgaagtctagaatcacctgaagatgaatatgttgacacacttgtgagggaaggaatactgtaaagttagctgttgaaagtgtctgctagggattatcttaatttcaatagttgatgtaaaaatacacatcttactcttaagcagaaacattcccttgtgaatttaccttttatttccacataagccagatgtaaaagtaacttttattcaccagatttaattgtttcagaggcttactgttagttctttctgaactgtggctggctggttcaactcagctcttctggctcaaacttcattccaagatgactgattcaatctggcttctcttggcttcccactgaatcactctgcttagaccctagcaagttgttctaatcactggctccttcttattctctggctttaactgcctctgctaacctgcattgacctgcatgaactcatgacaaaactcaataccacaacactgcacccactttagtgactctcatctcatagatcctctctttatgcactgtgcttagcttctcttttctgtgttgttctcatgagagttgggcatcctatctctgaattattgtggcaaatatatctctgattcattactttatctgcccctcaactagacattactttcaaacatcgctgcttccttctaaaaattaattttgtgtgtcatgtccagaagagagcatttcaagggaatcctctcaatacccccgctgttatctcctctttctgcctcttctttctacctcctcttctagcatattctctgagcattggtgagaatggatatcaataggcatcttattttgacactcaatcttttattcacatcactaactgctgaccaattcaaaaagaaacttctgtgataatggttgacacagacaggactatggatataaacatgaatatttacaaagaaatttgaaagcctgaccatttagaaaaataataatagtaggttctaccctatggtctatgacccccttagtcatgggcttttgactagtattatagtaccaagaatggaattctcccctatggagaaggctccaaacaaaatcaggaagtggttagttaactgacaatattcatgccactcttgtatcactatgcacttcctgcttggccagtcagtattgcagtatgcaaccctgggaaagaccattgctgtcttttctcttccagcatggtgaatagaaccttcaagcattatgaaagtctggcagcaaaggagaagttcccttattagtttgaaattcatttctctatatctgtagtcaaaatatatagtgtctctagcaatagttatggtggatgaacaagggcaattacaattacaaaaagctcttttgttttggagacctctgaatcttccctgatcaaaaactcagagaggtatcctatgccttgtattgcaacttttgtttaataacatatgtcttctgtgaatgacacagactacccacatgagtaattttgttcaaaaacattcttttgtcttctctttctctgttttaatggtacactttttaaaatagtgggttccctttaagttttgtcatagagtgttactgtccattattattattctttctctctccctcacatctctttctcaatccccatttaatccttgaccagtcttctttcatttgatatattttctatccttcattttaaaactgggtttgcttaaatatgacttcctattacatatatgacttcaggtgagcccattcctcttcccttcctttctccatgattaagcctttcttcctggtattgcatgtctacttgcatttttatttataatctacaatcctgttcccatcatatctccgtctaagtcccatgtttcctgtcttctcattgtactccaaattaaatgtattaaaaagaaaaggtaggatagacatatgggagagaatatatggactttgtctctctgagcctgagttaccttctaaatatatatatttttccagtttcacgaacttactggtacatatcaagatttcatttttctttacagctgaatagtattctgttgtaactatgtaccacattttctagtccattattagttgatgggcatttaggttaattttgtatgtatatgtatatatatacatatacatatatgtatatatatgtatatatatatacatacatatacatacatgtatatgtatgtatatatatatatatatatatatatatatatatatatatgtaatagagtagcaattaacatggatttagaaatttctgtgtagtatatgtctagaaatggcctagctggtagttggatcttatggaaattcttttttgaattttgtaagaaatgtccagattgattttcaaagtgattacaccactttacactcttacaaagtgtataaaagttttgcttttgtcagggattctattttcttaacatcaaggatgttttccttactggatttttgtttccaatctaatatcttccacctagagaattaaccctaaaatcattcagaaacttctttggtgatcagagcctccaccgaaagcagataaatttctggcatctctgacaaaaacaagtctaccaagagatataaagacatttttggattttagccaagaagaatctagtttattatatttggagtcattttagctaaacggcctagctagtattcacctcttattctcataattctctctctgaagaaataaccctaattgtcattatggaattgattttattaacaatatggcttcttaaagcatggtagttgggtaatcctttcatggaaccttttgaaaacactcctctccaaagcatcaatgatttaaattgtataaccctttgatacaaggactccttcactggtcgttgtaaagatgtggaagaagggtaaaggcaagagtttttattctatccagccctaggtgtggaattatgagaatctagaacaggattttttaacttccaaatcaaagttcattagaatttcctgattggaccataacagtatatattcaacaatagaatagaatcggtgttggggtggacacctagcagtttagttgggccagatcaacttaggaaccagactttagccatgctaaagaaacaggtggaataattggtcctttaatgaaataatgaacattttctactcagaatcctttcccctagcatgttagtttactaggctatagccatgcagtgaatatttcctggttataaaagtcataaattaaaactgaaaaataagggtaaacataaagataatttaacatctattagaaatatttttaatgcttagctatttcatcaaaagcagaatgtggtctaaagacttaatcatgaagatggaagaacctaaagggtttaacagattgctattttatgctcattgtgatgtattaataattgtacatcagatataaacaggctctctccctgatttttggcagtactcagacagatatcaaacaaaaacttgctttcctagcttggtttcaaaacacaaattttcaggagcaaaggggaacccttaagaatatgttattacagatattctttgaatatattttaagactatttttcttaataaaatctgtaataggctttttctgcatttattaagatcatctctactgtctttgtaaaagcttctcaactaatcttaagtatatctcttttaaattattcaattaatcttataagacctgatttaaagtcacatctcatgatgatgattgaggaatttaagaaggacataaataactcccttaaagtaacacaggagaacacaggtaaacaggtagaagatcttaaaggggaaacacaaaacacccttaaaaattacaagaaaacacaatcaaacaggtgaaggaactgatcaacaacaatatcaacaacaacaaaaacaggatctaaaaatggaaatagaaacaataaagaagtcacaaagggagacagccctggagatagaaaacctaggaaagagatcaggagtcatagatgaaagcatcaccaacagaataaaggacattgaagagagatcacaggcgcagaagatactatagaaaacattgaaacaacatttaaagaaaatgcaaaatgcagaaagatactaactcaaaacatccaggaaatccagaacacaatgatcaaacctaagtacaataggtgtagacaagagcagagattcacaaattaaagggccagtaaatatcttcaacaaaatcatagaataaaacttccctaacctagagaaagagacgcccttgatcacacaagaagcatacactactacaaatacactggaccagaaaagaaattcctcctgtcacataataatcaaaaacaccaaatgcactaaacaaaaaaagaatattaaaaacagtaagggaaataggtcaagtaacatataaaggcagacctattagaattacaccagagttctcaccagagactctaaaagacagaagatccagggcacgtcatacaaaccctaagagaacacaaataccagcccaggctactgtgcctaggaaaaatctcaattaacatagatggagaaaccaagatattccaggaaaacaaacaaacaaacaaacaaatttacacagtatctttccacaaaaccagccctacaaacgataatagatggaaatctccaaacacaaggaggaaactacaccctagaaatagcaagaaagtaatctttcaacaagctcaaaagaagacagtcacacaaacataattccacctctattcacaaaaagaacaggaagcaacaatcacttttctttaataccttttaacatcaatgaactcaattccccagtaaaacaacatagactaacagactagataagtaaacaggaccaaagattttgctgcatacagaaaacacctttaagtgacactacctcaaaataaaaggttgcaaaacaattttccaagcaaatggttccaagaaacatgccagagttgccattttaatatggactaaaatagactgttaaccaaaagtaatcaaaaaatgtaaggaaggacacttcataatgttttatgaactctctactctgaacatctatgctccaaatgcaagggcacccatagtcataaaacaaattttattgaagtttaaagcacacattgcaccaaacaaaaataatagtgggagattaaacacccactctaatcaatggacagatcatgaaagcagaaactaaacagggatacagtgaaactaacagaagttatgaaatgaatggttttagtagatatctatagaatatttcatcctaaaaacaaaagaatataccttctaaacgtcacctcatggtacattctccaaaactgaccatataatcagtcacaaaacaggactcaacagatacaagaaaactgaaataaacccatgcatcctatcagatcacgacagactaagactggtcttcaatagcaacaaaaataacataaagcccacatacacatgaaggtgaacaatgatttaatcaatgataacttggttaagaaagaaacaaagaaattaaagacttttttttataatttaatgaaaatgaaggcacaacataccaaacttatgggatacaatgaaatcagtgctaaaaggaaaactcatagctgagtgcctccaaaaagaaactagagagttcatacactagtagcttgacagcacatctgaaagctctagaacaaaaggaagcaaatacacccaagaggaatagactgaaggaaataatcaaactcaggactgaaatcaaccaagtaaaaaaaaaaaaagaactatagaaagaatcaaccaaaccaggagctggttctttgaggaaatcaatgagataaataaaccctaagctagactaaccagaggacacagagacattatccaaattaacaaaatcagaactgaaaaggaggacatagcatcagaaactgaagaaattcataaaatcatcagatcctactacaaaagcctaaactcaacaaaacttgaaaatctagaagaaatggacaatttcttagatacaaggtaccaaagttaaattaggatcagataaactatctacacagtcccataacctgtaaagaaatagaagcagtcatcaaaagtctccccaacccccccccccaaaaaaaaagcccaggacattataggtttagtgaagaattctatcacacattcaaagaagacctattatcaatagtcttcaaaatattcgacaaaatagaaacagaatgaacactatccaattcattctatgaagccacatttactctgatacctaaaccacacaaagacccaacagataaagagaattccagaccaattttccttatgaatattggtgcaaaatactcaataaaataattgcaacccaaatataagaacacatcaaaatgatcatccatcatgatcaagtaggcttcatcctagggatgcagggataggtcaatatacagaaattgacctatgtaatttactacataaacaaactcaaagaaaaaaaataacatgatcagttcattagatgccgcgaaagcatttgacaaaatccaaaaccccttcacgatatgtcttagaaatatcaaaaactcaagcccatacataaacatagtaaaagcaatattcagcaaaccagtagccaacatcaaacgaaatggagagaaagttgaagaaatccactaaaatcaggatgcttcaacaaataacaagaacatatgctccaccatgttcatagcagcattatttataatagccagaagctggaaagaatccagatgtccttcaaaggagaagaatggatacagaaaatgtacatttacacaatggagtacttctcagctattaaaaacgactttatgaaattcttaggcaaatggatggatctagaaaatatcatcctgagtgaggtaaaccaattacaaaaggacatacatggtatgcactcactgataagtagatattagcccccaaaattcagaatacccaagatacaattcacatgtagctcaagaagaaggaataccaaaatatggatgtttcagtccttcttagaagaagaacaaaatacccaatgggaagtgttacagggacaaagtgtggagcagatactgaagaaaaggccatccagagactgccccacttggggatccattctatatacagacaccaaatccagacactattgtcggtatcaacaagtgcatgctgacaggagcctgatatagctgtctcctgagaggctctgccagagcctgacaaatacagatgtggatgcttgcagccaaccattgaactgagcacattgtccctgatggaggagttagagaaaggactgacagagctgaaggggtgtgaaaccccataggaagaacattatcaaccaaccatacacccccagagcctccagggactaaaccaccaaccaaaaattatccatggagagacccatggctccaactgcatatgtagtagaggatggccttgtctgatgacatcaatgggaggaggggcccttggtcctggctagatgtccgcaatgtaggggaataacaggttgggaaggtgggagttgatgtgtggtagggggcaccttcatagaagcagagggagggataatgggatagggggtttccagaggggaaaccaggaaaggagataatatttgaaatgtaaataaataatataaccaatataaaattccaggtattacctctaacttcctaccttacataaccaaacacacttctgataaatacaatttaagaaagaacattgtcagaattgcaaattctggagcccagtaccacccactaaatccaaagggaattgaacataacatggtttttttaatattttttattattatgtattttcctcaattacatttagaatgctatcccaaaagtcccccatatcctccccccccccacttccctacccacccattcccattttttggccctggaattcccctgtactggggcatataaagtttgcgtgtccaatgggcctctctttccagtgatgaccgactaggccatcttttgatacatatgcagctagagtccagagctccggggtactggttagttcataatgttgttgcacctacagggttgcagatctctttagctccttagataatttctttagctcctccattgggggacgtgtgatccatccaatagctgactgtgagcatctacttatgtgtttgctaggccccggcctagtctcacaagagacatctatatcaggggcctttcagcaaaatcttgctagtgtatgcaatggtgtcatcatttggaggctaattatgggatggatctctggatatggcagtctctagatggtccatccttttgtctcagctccaaactttgtctctgtaactccttccatgagtgattgtttccaattctaagaaggggcgaagtgttcacactttggtcttcgttcttcttcagtttcatgtgttttgcaaattgtatcttatatctcaggtatactaattttctgggctaatatctatcccgagcttttgtccccaccggcaagaacacactcaggacaaccagaatcttctgcggcaaaaagctttattgcttacttctcaggaggaagaccccaaacacagaaaatggcgctgcttatatagcccgcagcgtgatgtttcagcacctgatggcagtgactaggcgtgagttcactgttgcacttgcgcataaggcttgtttactagttaggctcagtggaagccagcaccatcttataatggtgattgctcacggcatggctctccacatctccccctttttattttattaaaatttgaggctggtctaggcctctgcagtcatgtccatctgctgtggctcctgtcttaggtcattcctccaatgtcacagcctttcctttcatagggtaaccctatcgccaccgggtcccgtgtcttaggttggtctgtacatgaggaaagttgcccgtctctggataccacagtactgtgtgacagtaactgctaaatgacctagggcgaactctataaaagaggccagccaaaaaacgaattagtaaacctcagcgaagtgcaagtgctgagcaatgaacgttgagtctcttacatcccagtgcaatggatccacaaatctgtgggacacaatagcagagaactcagatgccatttaggtcttaagcatggacagccaaatttcaggggaggccccttgttcaatggctgcaagtgcttgagcaataacgaccttgtcacggttttgttgggttctgagcttacaaaataaccagagcataaacacaagtccacagcagatggcagcagcaaataaaactacccccacccattccttaaaataagaaaatgtagataaaatccaggaggagagaccctctgtcaatgacaggtccactcgtgtcgagttgatatttagaacagccgctctcagggcctcaagggtctcattgaatatttcagaccaattttctgtaagatacaaagaaagcttccttgacagattagacagaggtatagagaaagaagtctttaatatctatgattataatctcccaattttttggtaaggcagaaagcaatggcagtcctcgctgaactggcccaaacaggtgcttttgtgctttaattgctctgagatcatgtaataagcgccatctgccagatcctttcttaatcacgaaaatgggtgccatggagacaactactcttggcactgagggcagagtctcatcaactccccccttttgttttataaaataagacttgagtgtgcggtgggcacgttccacaatgccttgtccttgaggattatgaggaaggccagtcagtagagtgacatccatttgatgacaaaattgttgaaattctgcagaagtatatgctggcccattatccgtttttaggattgtgggcttgccccaagcactccaggcttctaggcagtgctgtacaacatgagaggcttttcacctgttaaaggtgtggaaaacattacaccagagcaggtgtcaatagaaacatgtaaatattgatttctcccaaaggagaaaatatacgtgacatccatttgccagacctgtaatggcctgacaccatgggggtttacccctacatgaggagtaggtaaaatttgacaacaatctaaaggcattattaagtaatcagaatcatttccagtagaaccaatccctctgggagctcgaggaataccagaggagggaaaacagccatgtaggcttggcaaaattattagttgagctattctacccccttgtgatatagaaaagacacattgagggcaggaacagagaaattgaagttccccttcataatgttgatctacaactccagggtggacaataaggccctgtaaggtgagggaagcccggcccaaaattaggctgaaactttcagatggcagaggccccttataatcagtaggaattggctgcactcccagctgaggcatcagcatgaatcgggtggaagcacggaggtccaatccagccgagccttctgttgccctgcggaccgtggtgtccacctgttgcccatcggagtcccatatgttttggggccctgggacttgagggcccgaaactcgttttttgaaatgctttcagtctcattttctatcacttgagggggccttggctgcaagagcctgcctcttatatctctaattgaacgacagtccttagcccaatgatatcctttcctacatttagtacacaatcctggtgctgtcctttttatgggggctctgcagtccttttttaaatgccctggtttgccacaattaaagcaaagtttgagctccgctgagtccgagcgcctccgcccctgcagaatggcggctgccaatccagcattagtcagcggccctccaagctcacggcaaacctttaaccaatcctgtaaccccttaatctttctaggtgtgattgctgacctgcattcctgcgtagcttgttcataaaccagctgttcaattaaaggcatagctgcctctggatcaccaaatatcctccctgctgcctccgtcattctgaccacaaaatctgagaatgactcctgtgtaccctgggtgatttttgtcaaatgtccactcacctcccccttcctagagagtgccttccatgccttaacagcggcagctgagacctgagtgtacgctccccaatgataatttgattggttagcagctgtccctgacctgtaagcaattcaaacgtccatgttctttggtcctcttccatggtggcattggcccttgcctgcatctggcaggagtcctgccacaaggctttccactcaagatacattcccatactgggggctgcagcttttactacagtctgccaatcaccaggtgtcatagcgtgattcacaagcctttcgacttgtgctatagtgaaattagcgctgattccataattgcagactgcttctgcaagctccttaatctgtatatactctaccggaacgtgaacatgcccaccctcagctccctcaaaaactggaaatgcctgttgcattttcctctgttcctcttttggaatgaacgagtctgaatggtatctctgcacataaggttctgaatggtacctctgcacataagattctgaatggtacctctgcacataaggcggaggtgcactaggaccctgaagctgacagtctggaggccaagcagcaagctggctttcgccagccggtttttgcctttttctggattgagtagcttgcattttatcttgctggtttttctcccttataacgaactgcttcctcctccaagtccgtttcttcagaggagctaagtccttcatctgattctgagctactaagagctagccgcttaaactcatctagtggccggtataggctccttctcctagaaacctccgctgattgatcttttttcttctctttttccttctccttccttccaaactctccccaggtattcttccctgacatgatcttttcctcaggttcgagacccgtgaaaaggcctctatgcttaattggtgcaccatgtttcctctttgctcctgctctctctccccgctttacctctgatagactgttttgaatttcgtccagaattctctgccctgccttaaccacttcttgacatgtgaaaaggaacagaaaggcttctaacgctggagaaagttcaaggccagacatacctcataaagctataacttgtccggcagttctggttctgccccgcgaatgatggatctcccttgcgccagtgtgatggtagttcctgggtttctgcaccacttattgtacgagcttttgtccccgccagcgagaacacactcaggacaaccggaatcttctgcggcaaaaagctttattgcttacttctcaggaggaagaccccaaacccagaaaatggcactgcttatatagcccgcagcatgacatttcagcacctgatgtggcgcgacagctcctgattcgttgctcgcccatcaccccattaatatgcaccgagatgggcagtgattagccgtgagttcactcttgcacttgcccataaggcttatttactagttaggcgcagtggaagccagcaccttcttataacggcgattgctcacagcacggctctctacaaatatccacttatcagtgagtaaatatcatttgagttcttttctgattgtgttaccccagtcaggatgatgccctctaagtccatccatttgcctaggaatttcataaattcattctttttaatagctgagtagtactccattatgtagatgtaccacattttttgtatccattcttatgttgaggggcatctgcgttctttccagcttttggctattataaataaggctgctatgaacatagtagagcatgtgtccttcttaccagttgggacatcttctggataaatgcccaggagaggtattgtgggatcctccggtagtactatgtccaattttctgaggaaccaccagactgatttccagagtggttgtacaagcttgcaattccaccaacaatggaggagtgttcctctttctccacatcctcgccagcatctgctgtcacctgaattttttatcttagccattctgactagtgtgagatagaatctgagggttgttttgatttgcatttctctgatgattaaggaggctgagcattttttcaggtgcttctcagccattcggtattcctcaggtgagaattctttgtttagctctgaaccccattatttaatggggttatttgattttctggagtccaccttcttgagttctatatatatatatattggatattagtcccctatctgatttaggataggtaaagatcctttcccaatctgttggtggcctttttgtcttattgacggtgtcttttgccttacagaagctttgcagtttcatgaggtcccatttgtcaattcttgatcttacagcacaagccattgctgttctattcaggaatttttcccctgtgcccatatcttcgaggcttttcccaaatttctcctctataagtttcagtgtctctggttttatgtgaagttccttgatccacttagatttgaccttagtacaaggagataagtatggatcaattcgcattcttctacacgataacaaccagttgtgccagcaccaattgttgaaaatgctgtctttcttccactggatagttttagctcccttgtcaaagatcaagtgaccataggtgtgtgggttcttttctgggtcttcaattctatctattccattggtctacttgtctgtcattataccagtaccatgtttttttttgtttgttttttttttttttttttttttttttatcacaattgctctgtagtaaagctttaggtcaggcatggtgattccaccagaggttcttttatccttgagaagagattttgctatcctaggttttttgttattccagatgaatttggagattgctctttctaattcgttgaagaattgagttggaattttgatggggattgcattgaatctgtagattgcttttggcaatatagccatttttacaatgttgatcctgccaatccatgagcatgggggatctttccatcatgtgagatcttctttaatttctttattcagagacttgaagttcttattatatagatatttcacttccttagttagagtcacgccaaggtattttatattatttgtgactattgagaagggtgttgtttccctaatttttttctcagcttgtttattctttgtgtagagaaaggccattgacttgagttaattttttatccagctacttcaccgaagctgtttatcaggtttaggagttctctggtggaatttttagggtcacttgtatatactatcgtatcatctgcaaatagtgatgttttgacttcatcttttccaatttgtatccccttgatctccttttgttgtcgaattgctctggctaggacttcaagtactatgttgaagacgtagggagaaagtgggcagccttgtctagtccctgattttagtgggattgcttccagcttctcaccatttactttgatgttggctactggtttgctgtagattgcttttatcatgttttggtatgggccttgaattcctgacctttccaagacttttatcatgaatgggtgttggatcttgtcaaatgctttctctgaatctaatgagatgatcatgtggtttttgtctctgagtttgtttatacagtggattacgttgatggatttccgtatattaaaccatccctgcatccctggaataaaacctacttgtcaggatggatgattgcattaatgtgttcttggattcgcttagcaagaattttattgagtatttttgcattgatattcataagggaaattggtcggaagttgtctatctttgttggatctttctgtggtttaggtatcagagtaattgtggcttcatataatgagttgggtagaataccttctacttctattttgtggaatagtttgtgcagaactggaattagatcttctttgatggtctgatagaactctgcactaaacctatcttgtcctgggctctttttggcttggagactattaatgactgcttctatttctttaggggatatgggatgttttagatggttatcttgatcctgatttaactttggtacctggtatctgtttagaaatttgtccgtttggtccaggtcttccagttttgttgagtatagccttttgtagaaggatctgatggtgttttgtacttcttaaggatctgttgttacgtctcccttttcatttctgattttgttaattaggatgctgtccctgtgccctctagtgagtctagctaagggtttatctatcttgttgtttttctcaaagaaccaactcctcatttagttaattctttgaatagttcttcttgtttccacttggttgatttcgcccttgagtttgattatttcctgcagtctactcctcttgggtgaatttccttccttttctttcaagagcatttagatgtgttgtccagatgctagtgtgtgctctctctagtttctttttggaggcactcagagctatgagtttccctcttagaaatgctttcattgtgtcccataggtttgggtatgttgtggcttcattatcattaaactctaaaaagtctttaatttctttctttattccttccttgaccaaggtatcattgagaagagtattgttcagtttccacgtgaatgttggctttccattatttatgttgttattgaagatcagccttagtccatggtgttctgataggatgcatgggacaatttcaatatttttgtatttgttgaggcctgttttctgaccaattatatggtcaattttgaagaaggtcccgtgaggtgctgagaagatggtatatccttttttttttttttttttttttttttttggataaaatgttgtgtagatatctgccagatccatttatttcataccttctgttagtttcactgtgttcctgtttagtttctgtttccacgatctgtcctttaatgaaagtggtgtgttgaagtctcccactattattgtgtgaggtgcaatatgtgctttgagctttactaaagtgcctttaatgaatgtggctgcccttgcatttggagcatagatattcagaattgagagttcctcttggaggattttacctgtgatgagtatgaagtgtccctccttgtcttttttgataactttgggttggaagttgatattattcgatattagaatggctactccagcttgtttcttcagaccatttgcttggaaaattgttttccagccttttactctaaggtagtgtctgtctatttccctgagatgggtttcctgtaagcagcagaatgttgggtcctgtttgtgtagccagtctgttagtctatgtctttttattggggaattgagtccattggtattaagagatattaaggaaaagtaattgttgcttccttttatttttgttgttgcagttggcattctgttctagtggctgtcttctttttggtttgttgagggattactttcttgctttttctagggtgtgatttccgtccttgtattgtttttttttttttttttttcagttattatcctttgaagtgctggattcgtggaaagacaatgtgtgaatttggttttgtcgtggaatactttggtttctccatctatggtgattgagagtttggccgggtatagtagcctgggatggcatttgtgttctcttagtgtctgtataacatctgtccaggctcttctggctttcatagtctctggtgaaaagtctggtgtaattctgatagtcctgcctttatatgttacttgacctttctcccttactgcttttaatattctatctttatttagtgcatttgttgttctgattattatgtgtcaggaggaatttcttttctggtccagtctatttggattctgtaggcttcttgtatgatcatgggcatgtctttctttatgtttgggaagttttcgtctataattttgttgaagatatttgccggccctttaagttgaaaatcttcattctcatcaactcctattatccgtaggtttggtcttctcgttgtgtcctggatttcctggatgttttgagttaggatctttttttccgttttgttttttctttgattgttgtgccaatgttctctatggaatcttctgcacctgagattctctcttccatctcttgtattctgttgctgatgctcacatctatggttccagatttctttcctagggtttctatctccagcgttgcctcactttgtgttttctttattgtgtctacttccctttttaggtctagtatggttttgttcatttccatcacctgtttggacgtgttttcttgtttttctttaaggacttctgtttggttgtgttttcctgtttttctttaaggacttgtaattctttagcagtgttctcctgtatttctttaagtgagttattaaagtccttcttgatgtcctataccatcatcatgagatatgcttttaaatccgggtctagcttttcggttttgttggggtgcccaggactaggtggggtgggagtgctgcgttctgatgatggtgagtggtcttgatttctgttagtaggattcttacatttgccttttgccatctggtattctctggagctagttgttatagttgtctctggttagagcttgttcctcaggtgattatattagcctctatcagcagacctggtagactagctctatccttactttcagtggtcagagtactctctgcaggcaagctctcctcttgcagggaaggtgcccagatatctggtgttcgaacctgcctcctggcagaagttgtgtttcactcaccagaggtcttaagatcccgtggagggtcctgtgaggaccttgggggtgtccagaaactctgcgcataaggaagtcagctgctggagtgaaccggaagggacttgtgcccctgattaagccaggttatctgcttccttaattaatgcagtctcaggtccccagtggttggattggagcaaatgatgtgttccactcaccagaggtcttaagatcccatggggaatcctctgtggttccttgctggtgttcggagactctgctggcaaggcaccctggtgctggagtgggccggaaggaacataacatgttttaaagcaagttcccaggtaatttttaagcgtacaaagcttataactaactttgagagacttgaaacaggatgctgacctaatagggtgtaacattttcaaagatttgttctacttatctgaaacatgttttggaaaagaataaatctaaaaatatcaccacttagcagactaaggatcagcataggtaaagaaggccagagtgggggcttagcagttaaaagtacctgccactaagccttactatttgtgtttaatttctgggacttacatggtggaaaaagaaaataaactcctccaaattatgtggtgaccttcacataagtactataaaatatgtgtatatgcatatgcatgcatacacatacatgtgcacaaacctatctgtacaggtatacataaatataagcatacttttaaaaaatagaaagagaatattaaagagttacctttcgttgatttgttcccatttgcataaacaagttgaagaggtagaaatagtaactaaattgaactgtaaataaatatgttggttaacatgttgaaaaataatcaggaaacatttttttctttctgttttcccacaaagtagaggtcacttaaatgtaattaggtaaaaatgttttgaaaagttgggtatttttcttagacctgaggagagaggacatagctacaggtaaagattttggaatcaattgcatgctacctgtggatgaattaaatggactgaacaacacagaagactgttgaggattaaaaagaaatttaaggatggtgtgctacataagccaaatttaagagaggcatttacagtatgaaaagtggctacagagaaggagatattatagagacacaagaaggtcatagtttcaaaaatgagcactgtcaaataccataggtagatcaagaaagaaaagcaagaaacattgactcaatgatgtcctgaaccatcacacatttggagaagattttaatactagattacagcaaattgagtgaatatgaatggagagattaaaatgtgaaatacaagttataaatgaaatatagtaaagagggcacagtccagtatgattgaggcatatcagttacatttttaaaataaattatatatgtttgcattctgaaaaattaaagtgatgcacaaagttttgtatatgcaaagagaagagaacttggtagaaaaatatctcagagtataggcaagaagagagaaacatggaacagggaaaagtagtattaaatagtgcactcttcttgtctttgtttaaacaattgtttaagattataatataattgcatcatttctcatttccttttccttcctgcttgaatgcagctactcttttcagaccctcagtaaaagataggaatgtttgttgaatgaatgaaaactatttatgaatttctttccatgattctttctcccagttcctcattattacccccaccccatttttccctcttcatccatctcctcttgtaaatatattaaatagcttgaagacatctcatcaatctttaacaggcaaggagatgttctgatatacctctcacactcagagtaatatagaatgatcagttatagtgtccctggcctcctctttgtcttcttaattatctataggaagcacaattggaatgacttggagagttatgttcctgaatatgaatgaaggagatgttcatagaagccctttgacatcatagtcctgcctggattctccccaactcttcaacctcagggattttcactttccatacttgcttccattttacccatgacaacgaatcttgaacctgggcatgctatctcctgagactgtagttcagctcttcagaacctgaagcaggagtattgcagtgtaaggtcaacctagaccatatggtagtaccaggctagcctgggaaactgtgtgagactttgtctgaaaccactaagagttaccttgttgctcaccttctacatctgagaaaagttttagagattattgatgattttcatacctattgccacatattttgatttcacttcattttgactttgccaacttttttcccaaaagatataagcagcttcactgtgagagaatattatatataggttgaagcagaattactatttttattctaagtgaaaaatctgaactagagatttattttattttcttcatgtatgcaattaggaatgaccatttgaaatagaaacagagttgcccaagagcccaatttccaaagtggtaatttactatatttatgtcaaagtaatgcttcatggctaattttaggaaaggcctgggaaatgaaccaatgtgctttggaaagtcatggatatttaagttttaacccttgcactcttggcttatgactttctattttggtgtatgaatgaaatatatttcaaataaaaggggaaaggatatttccccttgatttcctgaacactagatttgaattccagccattagaaaggggacagcatcatcccttacagaaagtcagttcctttcattcatcttgttcacagtgtttaacacagttcaggataaacagcaggaaatttcaaacctgttgatctgaaaaatttagagacatggtgtcctctagatcctcattgagtttatccctgtcaaccctatatttagagaacagattcctgtctgagtctggagacaaggttatatctgtagaacagatgctcattatggttcatatgcatgttgaagaaaaaaattagaaaaatcatgaggtactttgtataatctccagaaatccctttgaaaggcataaaaaggcttggtcaactcatcatcctagcttatctatttcagttctgtgaattttgttcctcttctttttaagtacatttatcttttcttttctctcttataggagggtaaacactaaagattgaaacatgggccttgtatatgctaagagagggctctaccactgaaccacacaacaccccccttttctgttttaatttagggatggagagagagggggaggagagagaaaagagagagaggtattatgtgcacaagtgtgtgcagctttgcatacccctgcattcattcagaggccagagagagatatcaggcatcctgttctacaattttttacattctctctctggggggggggggtgcggggaagatgttccattgaacctgaagtgaactcttgtctctgttccctgctatattagggtttcaggcacatgtgatcatcctcagattcttatgttgagaataagaatttaaattaaagtcatcatgttcaaatagcaagtatccttatttatgaatcatctctccagcccctgtttggaccttgagtcagggttaaggaaatatgtgtgtgctggacttaaaggtatgatttttctacttcagcctcctgagtaagtagaattcctcaatcttttaaaataaatttataaactttaaaaaccactttgttattatatacaatggcacttaagtagacactgtgattgtttctcacgtttttgtcgaccatttctttttttttttattagatattttcttcatttacatttctttttttaaacaatttttattagatattctcttcatttacatttcaaatgctatcctgaaagtcccctataccctgcccccaccctgctccacaacccaaccactcctgattatctattgggtggaacacagggccctcaatggaggagctagagaaagtaaccaaggagctgaaggggtctgcaaccctataggaggaacaacaataagtttttcactttttataattgttcaaatttatttatttatttatttatttatttatttatttattaggtatttatttcatttacattgccaatgctatcccaaaagtcccacacacgctcccccacccactcccccacccacccactcccacttcttggccctgaaattcccctgtactgaggcatataaagcttgcacgaccaatggggctctctttccactgatggccaactaggccatcttctgatacatatgcagctacagacatgagccccggggagtactggttagttcatattgttgttccacctatagggttgcagatccccccagctccttgggtactttctctagctcctccattggggaccctgtgatccatccaatagctgactgtgagcatccacttctgtgtttgtgtcacagtgtgtgtgtagatcagagaacaacttggaggagttggttctcctctaccatttgggttctcaggttcaaagccttctgcaacaagaacctttacccactgagctatatctctagccctggactttttcttatcaacacagtgggagtcatgtaatacacatagtagttgtatacacaatgcactctcaccttaccattgtcatcatttttagaagtccatttatcaatggtcccaaagctctcaatacttctttctatcttagcactgattattctattttattcacaatagttttttctctatcttccacattttgaattatagacaaatgcttcctcaatgtttgtatctcctatacctttcacaaacaaagtctatcatatccttgactaaccagtacatatgtgttagactaaagaatataaaggatatatggtgctctaatatagtcagagctctcaagttaattttcaagggatatgttgataggatctttttatcctgaatgaggtaacccaatcacaaaagagctcacatgatatgtactcactgataagcagatattaacccagaaacttagaatatccaagatacaatttgcaaaacacatgaaactcaagaagaatgaagaccagtgtggacactttgcccaattgggaacaaaacacccatggaaggagttacagagacaaagtttggagctgagacaaaaggatggaccacctagagactgccgcacccagggatccatcccataatcagcctccaaatgctgacaccattgcatatgccagcaagattttgctgaaagggccctgatatagctgtctcttgtgaggctatgccgcagcctggcaaacacagaattggatgctcacaatcatctattgaatggaacacagggccccaaatggaggagctagagaaagtacccaaggagccaaaggggtctgcaaccctataggtggaacaacaatatgaactaaccagtaaccccagagctcgtgtctgtagctgcatatgtatcaaaagatggcctagtcagccatcattgggaagagaggccccagttggtcttgcaaactttatatgccccagtacaggggaacaccagggccaagaagtgggagtggttgagtaggagagcggggggggggggagggtatggaggactttcaagatagcatttgaagtgtaaatgaagaaaatacataataaaaaatttgggaaaattattatttcaatttatttattcatgaataacctatcatattttgactctgggaatatgatagttaattaaaatggttcctactctacatgactgacctgggcagaaaaatagttatacaaataagtgtaaaatgacaactgtgctaagtgtcttgaaagatcacacttatcaaaataagaactaatatacttggctacttgagaacctgacctgaattgcagggaaaacttaatacctaaactgagatttttttttccaaatagaaatagaacctgtgtttttatgaatactagttgaatacagtaccactcaactacaagcagaacccttaaacttagattatagtgataaatcaatatttcttatgtaggaagcaaaaataaataattccaagaagttagaagtccctatgaagttgagccaaagataaaaaagggggacagatggaactagaggattacacaagtagtaaatcatgcattgtcaggcaagccatgttaaagtacttttgtctttatgataaaagcaacaagaaatgaattctttcacatgcttcactgttctattattctcctacactataaatcttagtctctgttttttcctagtcatgtgattctcaactatttatgaccacaattcctttctaaatgttctaatcccatttgaggtttagttgtatattcagtcttatatcctccaagaatactctttgattatatcagtctaggtagaataaatagcctttcaaggagaataaaatagatttgtaatgacatgtgtgtgtgtgtgtgtgtgtgtgtgtgtgtgtgtgtgtgtgtgtgtgtaactttttgcttaagatactctgtactatttcccttctgaattcctcttaaatactcacatccgggcagtttattcatgttgaatccacaagatacatagagcccccaaacaaaggaaaactcaatcttggaatggtgatacaaatgcttttactggtgacctaagggtaatcattcaaaaatgtaagatacataaggagtttcattcgtgctgtaggtagtatgtcagtctcataaaaatgtaagatacagctataacaatgaatatcacttgctatatcctggcaattatttcactgtgttgacttgtctttcactacatttatcaaagctttactgattcacaaaaatatattgactgcacaatataaaatagtcaatgtaaagatgtgtaatgggggctcaacatgagtaaaacacgatcttgaccattgtcttagttttctaatacagtgataggatatctgagattgagtaattcacaatgaatagaaactgcaggctgatagttctggagactggaaaactcagtatcagagcatgagatgatttaggaactctgcttccaagacaatgtcaaaaatgacacattctcttgccatggcaagaagaaagaaggttaggtttaatcctatccataagtagatagatagataggtaggtaggtagatagataaatagatagatagatagatagatagatagatagatagatgatgatatagatgatatagatgatatagatgatatagatgatatagatgatatagatgatatagatgatatagatgatatagatgatatagatgatatagatgatatagatgatatagatgatatagatgatatagatatatatatccatttcatctgccaaaaagataatgtagtttatgttgtcagtcagtcagtccataagcaaatggtgcttttcattttcattagagaatgtaatgtcaccgtatgtctagtattgcaaagttggaatattttaggatgtgttcatcattaaagtaatacagcaaaaataattttccctgcatcattgtagttcttgacattaaacccttaggcactggataggtaatattaaaagggaagttttatggggaaatagctcatccacatattgtaatatagcctatcaaatttgcttccaatttcaagacaatccatatgcagtactccctgaggttcatggcatgctttgtgataacactttgaaaattatgatgaaatctaaaatagacatcattgaccagctactgataatttacattaaaaaaagacttggcaaagcaggtagaattctgattattcattataaatttactttcaggaattgtgttttaaactgaaaggagctgtggtcataaagtagttgagaatcacaggacttcaaaaaaaaaaaaaaaaaaaaaaaacaaagaccaagatttatagtataggtgaataatagaagagtagagcatttaaatgtgtgccaactggggggcacatattcaagtagacaagactgtggaaagttttctcattcaaaacaccacactctactccctggtgccataggcttgtgtccacataataatgccaaatgcagacaaatgtcaaaagtccctgtagtctttcagtctcaacagcttaaaagcccagaatattttctaagactcaaatcaatctctcaagtataaccctttcttaaataaaaaataaaataaataaaatatgttcttccaacattcattggcatagaatataaattaccatcctaataatccacttgttaccagcttctgccgtagttactgttttatagttgttataacactccataaccaatggaacttatagaaagaaaacatttaatttggggcttacagtttcagggcattagaatctatgaccctcttagcagtcatggtgttaaactagaagctgaaatctgacttcttgatccacaagtaccataaagcagagaaaattaattgagaatgtcaagggattttgaaacctcaaagcctatccctattcctctagtaaaacctcccaatcctttccaaaaagttctgccaattgggctctgagtattcaaatatatacgtgatcaccccattcttatttaaactgcagcaactctcatttagaaaccatcaactaaaattgcaaaataatgataagtataataacttattactattgaaaaaatagtgtatttattctctcatattttacatctagacaacaattatcccaccctccctctgctcctcacctcttgtatctccccacctccccatctactcctgcatcatttccccttcattcacaatgagctcctatgggcctaggtttgttgattctatagattttcttgtatcctgactccgctggcttctacaagccttccttctcttcttcagtagtccccaaactctgagtgtttggctgtggatctctgcatctgtttatatcagatgctacatgaagcctctttcatgacaattggagtaggaacctatttatgagtataagagaatatcattaggcatcatttcattaatgtttgccagttgtatttggttctatcctaagactctgggccatttggcctctagtttctggacacccaagcagtgccaggggtgggatccctctaatggcatgtatatcaatctggaccactcattagttcatcacccccacgttttctgttctaccccaacatattactctctcaagacaaagtttaggttgaaggttttgtgacttggttggtgtcccaaaccttccactggaagtctgtcttggttattggatatggctgttgcatggtctgtatcccccattactaggagtcttagctagggcgatagcaatagtttcctaggagttctcattgaactggatttctaccttgtccctgaactgaaccccactccagctatctcttccagtcctctctccccacatcatgaaaaattatacccacaaaatgctccattctacaccaaacacacttgctcaactatgttcatagcagctttatttactatagccccaaactgaaaacaatctagatgtccctagctgaagaatggaagaaaaaagtggtacatttacaccatggagtattatccagcagattaaaaacaatgacatcatgaaatttggagacaaatggatggaactagaaaaaaattatccagagtgaggtaacccatgctcagaaggaaaaacatgatatatactcacttatgagtagatattaaatgtaaaataaaagataatcatgctacaatctacagacccaaagagggatcaaaaaggagggagaggagatccatagctatccttggacatgagaaatagaatagatattgcaggtagactaggggtaggtaggaacaggaacagcagagagaaggttaaaaactcttttaatatttggctatttgaactgaagcaatatgaagtcaaaagacattatcatgaaaatagataaatctaaagggtgtaacagcttgctatttaaaactcgtgatgaagtattaataaatataagacagagcttttataaataggatgtcctctttgcttgtcggaagcactcaacaagataactgtaacaaaaatttgcttttcatttataaaattttaaaaaccgtgaaggggagcacttagctatgaattagagtattcccttaatgaacttattttaggtctctttttagtatatttcatatcttcaccataaaattatattataacaatgtgaatataggaggaagaaaaacaactatgcctgtctccattttcttttgtatttggtggagaacagatggacatcctgagtcagactttgattaaaattattttttttacacatttagcagggagcatatattttgaactctatgtgcccatgatacactatattcacaatactttatttaacatattaagaaagtaacagtgcttttgtttcctgtgaagggaagagtaaattattttgcttagtcgtgaaaagaccagatcaagatgcaaatacatcccaatagctctaaatcccactataattctttccaatttaaggcatttatgaattcataacagaggctcaagctcttcatatttctagcttattttatttctctttcttttattgccttctcaaagctttcggttcttgaaaaatcccacaaacgttaaaggaaaaactttatcaattaaactgcactgcaacataatgggaaaaaacataagtactggtttgtggaggaaaatatgacacatgggtttattgatacttctcagccagattctcttcctcatgcaacacctagatagttcttaagatcttttattatttatttatttatttatttgtttattttatcatctccatatatatgttaaattagatgaagagaatgtcatctttttattctttgagaatttcatgcatgtatataatatgttttgatcaaatctgccctttattctctcctgttcattacttcccttgttacctcccacatctcccttccaacttcatgtgcttttttgttaatctactgaattcattttttttttttgctaccagtatatgaatggatatgtggcaatccaatggagcatagacaacttactaggggcgacattgctgaagaatactgactcttcttccttcaataattatcaattttaagtagcttcttagcttgtaattccatcccttattcatgctggaattttagcagacttaaccttgtgcaggtcttgagcaggtagccacagcctcggtgagttcatatgtgcaagttcatatgtcctgtattattttgagaaccttattctgtagaagtcctccaaaacctctagctctaacagtcttttagcttgtttccttcactatgatccccgagccttggtatagaaatgtccacacaagttattgccattgatcttggttacccaatagtactggcagggaagtcccttttgctgaggataccatatacttgagccataggatatgcagacaagaaagatagcctctccagtggctagctttcaccctgctggatggtgctaagcaggctgctggaggaaaaaagaaatcagcatttattgctttaaaaaatgctggggattttatcaaatacctgaactttaacactttgcattccaaatgccttcaaagaccaacaactacagttttgcaatttattagagattcaacaatgtcattttcctggtgtttctccaacaagaagatggtgatttgaagtattattttttaagtatgaaaaatccattcagccattatataaaatgaggaaaatattcttgctgtgttaacattctcaattcactgggaagctgttttatgagatttactggtgtaatttgtttgtacaagcttatgatttataaaaaaaattcatggaaaaagacagaatctgtgtaaaaaaaaacccaaatgacttaggtataacatggtacgcatgtcacattcatcatgctttgtcatttttgtttaatgctaatgctatggtaagtatttgaatccttgtgccttctgacattccaatatatgtggagtggatatatcaaactcccatattttgattattcctccttttatcctgtaatatagcaaactggctcgacatcctattcctgactaattatttcaaacctctataaaaaaggaattaactcttaagattagacaggcttttcgttatctttgttccctgccccccatttttccatttctatttcttctttgatttttgcttatgtatttgtttatttttggtcatatcatttatgttatgcttttccctttttaaaaaaaaaaaactagcaaatgcaactaaacattccaaagtttacatttaaactaaactgcccaagtccacatttttacatattttgaatttctgcaataaatttttaaatgatcgatttatttttatcctatgtgcactggcatttttcctgaatatatatttgtataaagatatcagatcccttggaactggagttacagacagttctcagatgccatatgggggctaggaattttacccaggtactctggaagagcagccagtgctgctaaactctgaaccatctctacaggcccctttaattagttttaagtggcttattataagtatttatgttaatgagccaagtaatgtcaattcaatacatgtacacaatatgtaataaccagttaaacataattagcattttcatttcaaatattcatatttctaagcattcatagttttgtcttgctagttgtttcaaaatacattataaattgttgtacactatagtgatcttgctgttctatagaataccaaaaataatataatttgtattttaattatttgtaatttggtattaattatctaatctctgtccctttcccaattttagcctctgctttcctcctttgttacataaacagttaactgatttgcctttggtgagacaaagaatgtattgttgcttcctctgatatcccaagcacgcaatgattttagataccaacctgttcttatttgtttgttgttgttgttcttgtttagcaattgtatgtgcaagaaagtgctctatcaacaagaaacttcttatgatgaaatgtagaattttatgcttctttattcccatgtgcctataatagtgttagttataaatgttatccatcaattgacatatctattgattgattattgtatccactcactcaactagtcataaattacacttagaagataaatagagcagctaatttatcattcagcttcacaattcttccagccagggagacatgagctgcaaatcggaggaggggtggatgggggcatattgtctgcttcattcttctctgtcagagcatgagagtttttgaggtgagtttgcctaatggatgttaacacaggcttatttgttttgatgagctattcaaagaaactatattagaatactgccatgatgtgttcacaaatttatagcgcccctagattattgttatcccactttaatggctcagaatattaattttcattgtctttgttacagattattttagcatcatttgtagatataataataatattgcattgtatttagtttgtgaatgtatttaacttttgcattttttgaaacatgtgttggttggttcagaacagtaaaaaaaaaatccacaaattttcaattgtcataaaacttgtactgtacatgaaaaatttcaaaacatcttttctttaccacaatattccactttggtttgatttttgtagcatggactcacagtgatataaacgtaggtttctagagaaagtgaagtgagtgattaaaatcttatattaacatcacacactttcatgataacatagaaagtgtcagaaaataaagtgcagtctaataagtgtaaaacatcatgtatcatgtatacagtgtttcattaacttcaaatgttgaaagaaaattaggaattatataggttagcttttttttttttttagttcttctgtcatgtattaaatcccgactgctgttttgcctccctcaactccctcaagctctttgccccctctgctttccatctcctcctgattcacccctcctctgtctccactcagaaaagagcaggcctctcagggacatcaaccaaatatgacataacaaatgacaataagaccagacatacatcatatatcaaggctcctatgagggtgctcccccatggacctcctactcccacctcactgccttagcattccccctatgctgggactactttggttatcaggagtcttttactgttccatataaatttaagttttttttccctttttttattgggattgtagtaaatctgtaaattgaataatagttattttcacaacattaattctacaagtccatgagtctaggagttctttccattgcctaacattcttctctatttctttcttcaataattaaaagttttcactgtagagatcttttacctccttaaactgtaaacaacctagatgtccctcaactaatgaacagataaggaaaatggggtacatttacacaacggaatagtattcagttatttttttaaaaagacatcacagattttgcaggcaactggatggaaattgaggatatcatcttgagtgaggttactctgtccccaaaggacatgcatggtatgtactccctgataagaagatattagccataaaatccaggatacccatgctatcctccacagacccaaagaagtaaaacaagaaggaataaacagaagaggatgcttgaatcttatttagaagggcaaataaaatagtcataagtggcagatgggagagggagggaactgagtaagagaggggttgaggagaggaatgggtaggttcagggtcaggtatggagagggacaggagagatggccatgagaatgaatgtaaatctgcaactgataggaatgtggaggtgagaagtaccttcaagataagtcaaagacgtgggataagggaggtgcccaggaatcaatgggggtgactgtccttcaacccaaaatgtatcctgtttacaagaaacacaagcatggggcctggaacagagactgagagaatatccaaccagtcttgggtccatttttgttcctgtagttgctgtagacaggacaaattttgggtgaaggttttaggggtgagttcgtatctttattcttctgtgaatactgcctggcgatagaaggtagccacttcaggctccatatctaccactgctaggagtctccggtagagtcatcctctttgactctctgttaagtctttttttttttttaggtattttcctcgtttacatttccaatgctatcccaaaagtcccctatacccaccccccaactgttaagtcttagagatgctccctcaccctgggctgttgataatttccatttactctcctggcttgctctgtcccaggctctccctctacctgatcccaactcccatttccatctccatttcctctgccacttagctctctacctctgtccacctctgatgactattttattttcccttctgatctgagtgaaattcaaccatcctcctttgagacctagttaattaacttctttttggtctgaagaatgtagcataggtattttacactttatagataatatctacttatcagtgagtacatataatgcatgtccttttggaactgggttaccttactcaagatgatgttttctggtttcattcatttgcctgcaaattttatgatgtctttgtttttagtagctgagtagtattccatcatgtaagtgaaccacattttctttttctgttcaggtcactgacagaaacaacctaagggtggaaggatttattttactcaacagtttcagtccactatggtgagaatagtgcaatagaatatctcatatcaacaaacaagtaagcaaacaaatacgacaaaacagagaaagagagaatagaggaaatggccaaggcaatatacagtcctgtgatggtttgaatatgtttgagtgtggcactattaggaggtgtggccttgttgcaggaagtgtgtcactgtgggatgtgctttgagaccatcttcctaaccacatggaagatagtcttctgtttgcctttggaacaagatgtagaactcagctccttcagcaggatgcctgcctgaatgctgccatgctcctgccttgattataatgaacctgtaagccagccccaattaaatgttgtcctttataagagttgccttggtcatggtttctcttcatagcagtaaaaccctaaaacatatctttgtttggtttggtttggtttggtttggttttttggtttttttcgagacagggtttctctctgtagccctggctgtcctggaactcactctgtagaccaggctgtcctcgaactcagaaatctgcctgcctctgcttcccaagtgctgggattaaaggtgtgtgccaccactgcccggcgctaagatatatcttaagaccctattcctatcaatttacttcctacaactgggctggatattgaactcatcaagctaaaaaactcttcaagaaagcactgagaaataatccttatcagatttagcaatagagaaattaaggagtgaaacaagaagcatcataaatgttcattgagcagaggctatggaatgagattgtggaattttaagaaagcatgaaggaaaaggaaacaagattctaccgccccttcaataggtgggattttgtttatttcaggattggagatacaagagtttgaccattgtggctggaagcaacttggtgcacagagatatttttatcctggaagagaaaggggagttaattgtaatgcaaatgcttatgaaaatctgaaagtagtagggtacattgcacaaagagtttaggaagacttttatatataactaaaagaatgaaggaagaatatggaagaataagcatgctttaattttctacttataaaactccttactagttactattattttctcagtaaagtatatcatggtctcaaccagggatctctccttgcacaaaaaggaatagataagaagaaaacaatgaagctatactcatagtctatgaaataaaggacctactaaggacagcagaacagtaagatacttagattttggacagattatttcaactgcctaggtttcagcatcctttgtcattaaaagtgtatcataggatattgtttaaagtttaaattgtgaaatttgatgtacaatagcccaatcttcaatactttgaaagaatttataaacctcagggacaaaatttacaaattaatgcatgttttggtggagaaaaatacatgaaaactcaataattcatcctaattagcttttatttgtgttctctttgtttcaggtcaaagtattaaatgtataattttatttttataatttctatcttaattagtaattatgtaataatatctttataaaattacatttactccatcttcatatttccatctctacacagagagatggataaaatgatgcttaataaatattaataaaatattttatgttatgaagtttaaaattttagttgtttgaaaattatatatataaatgaatatataatttatacatacatatatttgtatatatgtgtgtatataaagtgcatctcagttatattcatttgctccttctagattctcccaaatatatccttttttaaatttaaattattttatttacttatattccaggcattgccttccctcagtcccctcttccacagttcctcatcccatttctcctcccctttgcctctgagagggttctttccttcaccaccactagacatcatccttgtctgggacctcaagtctctagaggattaggtacatcttctcccactgaggccagaccagatagacctctgctatatgtgtgccagggacttgggaccagccagtttatgctcctggttggtggttcagactctgggagctccctgggctgtgggttagttgagactgctgatcttccttcctatgggtcactctttctttcagcatttttaatactttcagtaattcaaccataggggtcccagatttcagtccaatggtaagtatctgcacctatcttagtcagtgctggtagggcctctcagaggacagtcatgctaggcttctgtctgtaagcatgccatagaatcagtaatattgtcaggccttggcacccacccctccccctatgagatgaatgtcaatttgggccagtcattggccctcctttccttctgtctcttctccatttttttccctgcagttcttttaaacaggaacaattctgggtcaggaattttgactgtgggttagtaaccctgtcccactatttgagaccctgccaatctactggaggtggactcttagaattccctttctccgatgttcagcattttgactaaggttgcccccaatgagtcctgagagtgtctcacctcttctgcctctggtattctctagagggtcccccacctcccactcccagaggctacttatttccatttattctcttgaccctctgagcttctctcctgtcccctcccaccatatctgatcctgtttccctttcctctccccctctcctctccctccaaggttcctcccttcctcagcctccagtgattatttccttccaccttcaaagtgggattgaaacctcctcacttgggcatttctgcttcttactcttcttacagtctgtgagttgtatctgtacacttttgcctaataccacttatcagtgagtacataccatgcatggccttttaggtctgagttaccttcctcaggatattttctagttacatccattgcctgcaaaagtcatgaagtcctcatttttaatagctgaatagtattccattgtgtaaatgaaccacattttctgcatacactctttgattgagggacatctgggttgtttccagcttctggctattacaaataaggctgctatgaacatggtagagtccatgccattgtggtatgatggggcatcatttgagcatatgcacaagagtagtgtaactccgtcttcaggtatatctatttccaattttctgaggaatctccagactgatttccagagtggttgtaccagtttgcaatcctaccagcaatgaaggagtgtttgtcttttaccacatcctccaaacatattattttaacttctcttcctttcatgtgtaacctacttggatcaattggtgcttcccatatgcaaatggctgtgggagtcatccactgacctatacgaagcctatcagtcaccatatcctcaaagaaaagtcagaaaaaatatatagaatgtttcatgaacttgcatgtcttcctttcccggagccatgttatttttctctttatcattttaattttagtgtaagttctgcgaagtgagcatatgatgaagtattataggaatatgtttggtatttaatttttagtttgcatttttttctgtattttaggagttttgtcataagatagttcttctatagaacagtaaccttttattgtttcttgtttagaatgacaataaacaaaataaagccacgaatgaaagggacctgctctattccttagaacatatgaacatgttaggttacataggtgacagtgaattacagtgcctaaactacacacctgaagacatagagatcacaatagcttacaaagatgattccagtgagtttataagaaaaaaaaaagcagaagtgagaagatgagaaagatagcaaaaggaaatagatttgacctgataagatttgctttgcaggcagagtaatgataaaataaaagcagaaaatgtgcgtggaagctggaaatgtaagggaatcaattcattcctagaggttctagaaggaaaatatcctagacaacaccttggtattaatccactgagcctcatcttagaaccctaacatccacaactatagcataacatatttttgttaaagtaactggctttgtgatgacttgctgtacagaagccataggatataaatacactttcttttgctcattcttctataatttatttttctacccacctggcaaagttagttttacagacttggattggctgttatgataacaactagacacataaggcaaatgaacacataaaatgtgtatatgatcttctatccatgtaaaaatatatgcaggatcttgtaacctttgcatagaaatgtcaaaaagatatttcttcattttaaatgttggctttatgttagaatagtatttttaaatatattaagtaaattaaagtttaatttcatacatcccatttttatttatttttttactgtgggttagagaactcaaagtaatttatgaaattcacattatacttatattactcagtaccaatataacagatgagtagaatactatttctgtatatcaaatccttcaattttatcctaactatatccaaaaattagtttgaactcttttacttgatcatctatggtttttgtatcttccttcttctgacgcctgccatagcattttgccttttctactctatcattataggctaaactcatttctgctagggtctttctgaatgttgttcaagaggttcaagagatccctcatttcactctatatctaactgcaacttcacattcttctcagcttaagtatgatgcagtgacatcttttgtgttcccccattcttagcactatacttctgtatttaattgtgcttttcataaataatgaggaatcaattttaatttttttctttaaaaatgatcagtttggggctggaggatacctcatcagttaagaacactggctggtgtaccagaacatcttggtatgattctcagcaccaatgcagtagctcagaactttagttccaggtgatctggtatcatcttctgccctctatgggcacttcacaaatatggcacataaattttcatgcattacactcatatccataaaataaatatattagttaacaaataatcagttcagtgtctactttacatacaattatgacttaagactatacatggcataactatttgggtaaatattaaaaattgtaaaatgatccaatcagatgttgaataaataaggagattgtaaattataataaattacacaagaattattagtcttaaaatagtagcaggcaacaaattgatgggttatttaaagagaagatcgtgaaggtgagtgtgggcaagtaaggagatggatccacgaataattaggaggataagaagggggtaaatatgatcaaaatatccctaaaaattaataaaaatctttaaaaataatagaaagaaaagagtgaggataggaaggaaaaagagaaattaaaggaaaaaataaagaagaaaaggaagcaatttttagtgtcctggttgtgttttgtcaactcaacacagcctgaggtctctgtgtaaaagtaaacatggttgagaagattgacctgtggcaacatttatgccacccctggggaggctgcagtatataagaaagcagactgaacaagccagggggaacaagccagtaacttttactcttccatagcttctgtttcaattcctgcctccagacttctgccttgattgtctgctgtcttctctttattatatattgtaacctcagaggaagaataaaaaccttacttccaaaaattgcttttgatcactgttttatcacagcaacagaaaacaacaggatacccagaatctgcagtgttgcttttaaaccattggagatgaatagcccaataatgtattgactttataacagaaaacaacttctttattagaagttatatttcaatttcttcttgttaaacagtttgctggtcactcaggtttatatttgtcttccctaaagcacaatttcaatttctacagagaagggacatgtggcactaaaataaaagaatgacagagaaaggtaaaatgttaattgacattactatattttgaatgtttcctgtattcttttttaaaaagaaattatttatttaatcactttacatcacaatcccagatccctcatctcctcccagtcccgcttcacacacagctcctccttccattcccccatatccttcttctctatgaaagggaggatccactctgtaccaacccactatggcaccttaagtcactgtaggactaagcatatcctctcccactgaggccaagacaaggcatcccagttagaggaacaggacccacagacaggcaacagattcatgggaagcccctgctccacttgctgggaaccttcatgaagacgaagctgcacatctcctagatatgtgaaggaggccttggtccaacccatatatatatactttgtatggtggttcagcctctgagagtctcaagggtctaggttatctgactctgttggtattcttgtggagttcatattccctctgagtccctcaatcttttccccaactcttccttaagatgccctgagtaccaccaaatatttggacctctgtatctgttttggggagctcctgagtagacccctcagaggacaattatgctaggctcctgtctgcaggcataatggagtatcattaaaagtgttaaggattgattcatgcctgtgggatgagtctcatgttgggacagtcattgtttggtcattccctttgtctcagctccatctttgtctgtacagttgctataggcaggacacattatggaagaaggttttatgggtaagttatccctctactgttctatggcgaatactgcctggatacaggaggtagtcttttcaggctccatatcccccactgctaggagtctcagatagagtctctctcatagactcaatggaggctcccccatctctaggctctagcaagttctagagttgcccatcactccacagctggcctcagattttcattctctcctaagctatccctacacttgatcccccacctactttttacctccctatcccctctcccatccagttccctccctatacactacccacttccttttctccatccatatctgatgtctgttttatttactcttcagagtgagattcaatcattctctcttggaccctccttatttagcttcttttggtctgtggattgtatcatgggtatcctgtactttgtggctagtttcaacatataactgagcacataccatacatgactgtctagtcctggattacctcacttaatttcatacatttgccgaaaattttcatgatgtctttgctttagcttagtagtattccattatgtaaatgaaacacattttctttatccattcttcaattgaggggaatctgctttgtttccagtttctggctactacgaacaaagctgctatgaacacagttgagcaagtatggaatggtagaacatctttgggtatatgcccagaatttgtatagctgtttcttgagatagagctatttccaattttctgagaaactgccaaattgatttccagagtgattgcacaagtttgcattccgaccatcaatggaggactgttccctttgtaccacatcctcgccagcatgtgtggtcacttaaaattttaatctaatggctgtaaggtggaatctcagagttgttttgatttgcatttccctgatgactaaaaatgttgaacatttacagaagtgattattggagtacatatagagtatctggtggaacttgctgctgctgggtttgctctcatctgttcttaaaactgaaatttatttatttcccattgtaaaaatattaagaggtgacaactttaagaggatataaaagctagatattgggaggagaggcccttgttcttgaaaagattatatgccccaatactggggaatgccagggcctatagactcatgctgctctgctccccaacccacccactcctgcttcctggccctggcattcccctgtactggggtatataatcttcacaagaccaagggcctctcctcccagtgatggcagactaggccatcctctgctatatatgcaactagagacacagctctgggggtgggggagggtactggttagttcataatgctgttcctcctatagggttgcatacccctttagctccttgggtactttctctagctccttaattaggggccctgtgttccatctgatagatgactgtgagcatccacttctgtatttgccaggcactggcatagtctcacaagggacagccttattagggtcctgtcagcaaaatctttctggcatatgcaatagtatctgggggtttggtggttgtatatgggatggatcctcaggtgggttagtctctggatgttccttccttccatctcagctccgaactttgtctctgtaactccttccatgggtattttgttccccaattctaagaaggagcgaagtatccacactttggtcttatgagtttctaataaaaggttaactccaagccctatcaaatcccttttgaatgtatgcccacttaccattctttaaaaggatctatttttttttgtatatgagtattttccctgtatgtgcatttgtgaaccatgtgcatacagtgcccacagaggcctaaagaaagtgatggatcccttggaatcacttttctcgatggctatgaagtgtcctagaaactaacctaggtcctctggaagggcagccagtgctcttaactgctgaaccatctctccaagtcccactaacctttctcatgatgctgtaatgcatcatagaaacacttacctgatgctaaacccacagttttgaagttctcagcatctagagtcaataaagtcaagtaaatttctgttacttataaattacagtttataatattatgtcataggaccagaaaatatactaaggctggaaaatatttttaaaaacacaaatggaccaataggaaacatttttttgacattctattggtaactttagtttcctagtggtcatgttgttcttatgagttttacagcccaataagtcactccccagtccatgcctagctgttaatcagcccactctttggaagatccaatgcacagctctggaaggtcatcattgctgtggcttcttcttcagaagttggtgttttgtatctcttcagttcttctggctcccacagtttttcctatctctattccccagtattagtctgagctattgaaataggattcatgtctttcttagagctaagtgttcaacttgttctccataatatcaagaactttttaagtcatttagccgcatatcttataatcatggattgatagatgtgagaatgccgttacaaagcacgaggttgaaaaaatagtgtgattcactatttgaaaactggttgctgcaaaagacaaagcttggagagatttcaggcagtctcaaatctatctgcagtcattctgtgtacctgtcttagggtcttgtgcaatccatcacattctagtgagtatttgtacaatctgttatttccccctccctgctgcaggtgaagctgtccagagattcaaatccactcaagaatgttagtttttgcaacaccaagttaaaatattatttcccttagtgtaatgtttagacacacacacacacacacacatataattgctccaagatttctgcatatttttttctaataagaaatgtagggctttttttttttcctgataaaatcttaaatgaccttaaagtgaattttcctaccttcctatctttccaataatagattctgacgtaaagttaaccttctcattagcattttaatagctaaaaaatctatcatccacttattagtgaattataatctgcatttaagtaggaaagttgtaaagaaagcaacataaaaattacatttaaaaagttgtttttcttgcttttgttattgtgtttccctgtggcataaacattttatgtctttttaagaaggctttttagaaaaagcctttccttttgaagttactgaattaattctcaagcaactgttaacagcatcagttctctaactggagcatgcacagtctaatgtggtattagaaaaatgctttacatgatatgatgctttcaggagcaagacagatttgcttatttcaacttcaagaaaacaacatgataagccttttagcttctctatgttaataatctttagatatgcatatagatacagatgtatcaggcaggatagtttaagagtagaagagtgtcattgctaggagatgctttgtactcagtaagccacatggcagtcctatcacatggaaaattactgtcttctgcttcattggtcctcttagcccatgcatatataccattttgtttctatcatgacagccaaagtgttttcgcctttgcctctctacctgctctactcagggtgtttccaatgacatagctgaatttgcatgtgtcttttatcatatgttaaatctctagccttatctagacattcaatttttttctgtacttcagtatttgtttctggaaaggacataatgataggattgtgatgaagatgaaaagtaaccagtgtatgaagatgaaaagtagccagtgtaacatacattttgtcataattgctagtggtggttgcaagctagtcttttaaattgtgctacgaatgctagcttttctgattttctaataccagccttctaaatcacttgtgtttattaaagcaattccccaatgcatcctccttccatgtccttactagattaaatgggagagtgtgccatttctgcctcagcttcattagcttctcattgttatgaggaagatacctttgattagtgctatctaaattctaaatataatatatcttaaaatgcagtagtacatcaaactgttttcttgaataagccctctatttccattaaacatcaccacccaagccactatttcttaagagtttgttctcagtttcctcccctaacctaagtcatgctatctaacctccaacttacaagttgtaccactggttttcttctttcttccacatctagttcatttcattcacaattagcaagtccttcatgagcaggcacccctatactaagaagtcagaagtaaagagagctcgtaagaaacaaaagcattcatattcacgtgctccctccaaccaataaaatcatgagtcgctgcttctttttattgctgatacagaaattgtatttctatgagatttaactgatactattacaaagtcctgcaagaagtccctcaaccacacttgtggaagctgtccctgaatctcttgcctacctgtctgtggatctttttttttaatataacctatctttcattttatatatatatatatatatatatatatatatatatatatatatatatatatatatatatatacatacatatatatatatagacatatatatactttatctttacatttttaaatatttttattaggtatttatttcatttacatttccaatgctatcccccacacgctcccccacccactcccccacccacccactcccacttcttggccctggcattcccctgtaatgaggcatataatgtttgcacgaccaatgggcctctctttctactgatggccgactaggccatcttctgatacatatgcagctagagacatgagctctgggggtactggttagttcatattgttgttacacctgtagggttgcagattcccccagctccttgggtactttctttagctcctccattgggggccttcaatagctgactgtgagcatccacttctgtgtttattaggccctggcatagtctcacaagagacagctatatctgggtcctttcagcaaaatcttgctagtgtatgcaatggtgtcagcgtttggaagctgattatgggatggatccccggatatggcagtctctaaatggtccatcctttcgtctcagctccaaactttgcctctgtaactcctttaatgggtgttttgttcccaattctaagaaggggcaaagtgtccacactttggtctttgttcttcttgagtttcatgtgttttgcaaattgtatcttatatcttgggtattttaagtttcttggctaatagccacttatcagtgagtacatattgtgtgagttcttttgtgattaggttacctcactcaggatgatgccctccaggtccatccatttgcctaggaatttcataaattcattctttttaatagctgagtagtactccattgtgtaaatgtaccacattttctgtatccattcctctgttgaggggcatctgggttctttacagcttctggctattataaataaggctgctatgaacatagtggagcatgtgtccttcttactggttggaacatcttctggatatatgcccaggagaggtatttccggatagttctatgtccaactttctgaggaaccaccagacttatttccctaaatggaacaccttgtctggcctcagtgtgagagcacgtgtctaaaaacctgcagcaacttgatgagcctacaggtggggttatagggaaaagagtgcggttttatagagggaggctccccttctaaaaggagaaggagtagaatggggagattatctgtataagggggtactgtgaggggggcttgtattaggatgtaaagtgaatcaattaataaatttaataaaagtaaaaatgaaacaaagaaagagagaaaattccccaagaaagagtagttgttcagttaacactggctacacactgccactagtcatttttacttttttgttcattaccataactcctttcatgtacattcagggcctcattaatagtatctactcgagtctctgtgttgagtagaagcacagatgtttatcagctatgcacatgtggaaggataaaggaaggaaactgggatttgatacctaagaatcttagagtttttgatggagagatgattcagcagcagagggagttcaatgctcttgcagagggcctgagttgtttctcagaatccatgccaggaaactcaaaactacctgtaagtccagcttcaggggattcaataccgtcttttggcttttacagccacccatatacatatatacatagagtcagaggagactacctgtgagtatgaataaatagcaatgatgtcaaatcctattttctcttctcttgcactctgtaagtagccagacagacatacagtctatatgcttatatgtttactctataggtttttaatacctagaactctctgtctctagttttctgctttactcttactccttttgcaaagaataaactaataatgtcttttcattgacatactctctgatagtttcctcccttgcatatgtttttttagtatttatacatgtctcccttagaaaaattacactgagcaaaatgtttttgtcatccttccagttttaatgtaagcttcacactgatcaaagtgttaaagcacttctgaaagggacaatactgtctagcagggttatagctacgcagcacttggttaatggaaaaagaataactggatcaactattcaactctaaagagagcaaaagcaaatatatgaatgattcttaaatgtacaaggttctcaagtgccaagttcaaaccctgtttttcttggttaaaattctctacactttagtcaaactcctcttttgttttggaaagctagtataccatttgactgtccttgaaattgtcagtatcattgcctgttacgagaggtttcatgagaatatagcaaaatatttatatgaaaacagttgaaaatattcatttgaaacaatgtaaacatgcataattattcataccagatatgagttaattgaatatttttaaaagtattttgtagaaaataatcattgatttttcagaagtacaggactattgtgcttggttaaattttcactaattatactagaattatttaagattatatctgtttagtcattccatagtaattaatggaataacatacaagagagtccattaaaacaattgtcaagggaataatcataatacgcacttgctcaagcatactgttttgctaaaagtcatgctgaaacaagaaaattttggtgttttatgaaatttggcttgtattattaacacgctacatctttagaaatgtcaatgatattctttgttataaccactaggaattcattcagattttcctggctttctaaaaaagaaataataataatggatgaattgtgatagaaacatcattcagtatagcaagaattttacagtcaccacataatcagttacttcagtgtttgtcttcattctctatgaaggatgccacatctatttacataagcctccttcaaaaccagaattctactgaattgagattggggatgttgtttgtagtgttccagaaataaacttgcatgctactatattttgagcaaatgctcccaaacacatcctcatgtgacggcaacagatgtaaagaaaaatgctatatttatttcaaacccagagaaaaatgcaagtatcagtgcaagtgtgtgccaatgattatgcacattcttttgctgacagcttggtgtacaaagctgctgaagtgcagagtcagcaagtttcacccagagacagctccacattgatagagaaaatttgagtcaataaatgaaatcaactaggagtttttgggtcagttacagctttcagcagatgtttcttcaccttggtattcgcttttttttttttttttttttttttttttactttgggagacaatcagcattaatataaaatgttattgtcaaattattcacttctgttcttaacttctgtaaagcaagattgttgtggaaagaaggaattttgggggtattattttatatgttttttgggttcttcattttgttaaaaatatttacattctgaatatctatttatattatttttttcttcatttttgagaatttcacaaatgtatatacaatgatgtacaattatatctatactccatttttcccctctcactcccttcatatttctccaaaatgttccctcccaaatacatgtgttttagttttggtaacccaccaaagtgtggaaaacctaccagtggccataccttccattagaacaaccaaaagtaaaacaaacaaacaaaaaaacccacatgattctgtcttcctcagcaactaacaactgctaatatctcctcagtaaggaatgtgtgacctggagattacttctcttatctatgccaaaatgttagctgtcttgatgttatacagatctttttcaagtaaccataattcctgtgagttcatgagtgtgataggcttcaaaaattatatatgtgtatgtatgtatatgtatatatatatatatatatatatatatatatatatatttgaatataatagcatattaattggtattttgaagtcttgtgttaaaaataattccaggttgtttttgttctatttattgagtgtctcaaaaaagaaaacttgtaattttagagagattaactcatttagtcatttgctccactgatcctcaaacctgtctatgtattatatacaaattaagagcagttgttaacaatttgatcagccctagactctgatatagcttcagtgccctggccccagatctatgtacttggaggtttttctatattgtggtggtagtaggagatgcattgaaaccttaaaagatggaaactactaaatctttgatcagtaggaaagatgccctcaaaagccattcagatgtttgcgatatgactcttgaatcccaacaggaagttcttataaaaggactgaccatccaacccctgcatcctggttttgcatggccttgcatagtttctacctgatatgaattggcacagtaaagtaataactagctatcctgttgtatgccacttggacttaacatttaagaagggcagccccatgggaagactagcagtcgcaactaacctggacccccaagatctctcagacactgagccaccaaccaggttgcatacaccagctgagatgaggcccccaacatatatacagcagaggactgccaggtctggcctcagtgagagaagatgaacctaacccttgagagacttcaggccccagggagtggggaggtctcgtggggtaggggtggggatatggacatcctcttacagatggggggaggaggtacgggatagggagcagtcagggagtgtggactaggaaagggatgaagactgcactgtataaaagaattaaataatagcaaaaaaatgaaaatatgcagtaaatgaacttcccatctctaggtatttcactgcagcaatgaaagctaataaaagtctctgtctgaaatttctattttatagacctgaaagtacttccagagtatttacagtaattttttggattcatcattccagggttactaagctattacgaccctttgaccattaccaattccttaatgtggtcattgacagcccactccatctgcacaaaactttactttgtagttctttaaaaatctatttttaattatttacatgtgaggttgtggctattatgtgtgcaggtgccatgagaggccagaaattgaccttagactactttggacctaaagttacaggtggttgtgagctgtctcatataggttctaggaactgaacttgtgtcctctagaagaacagcaaaccactcttttttttaattaggtattttcctcgtttacattttcaatgctatcccaaaggtcccccatacccaccccccaatcccctacccacccacttcccctttttggccctggcgttcccctgtactggggcatataaagtttgcaagtccaatgggcctctctttgcagtgatggccaactacgccatcttttgatacatatgcagctaaagacaagagctcccgggtactggttagttcatattgttgttccacctatagggttgcagttccctttagctccttgggtaatttctctagctcctccattgggggccgtgtgacccatccaatagctgactgtgatcatccacttctgtgtttgctaggccccggcatagtctcacaagagagagctatatctgggtcctttcagcaaaatcttgctaatgtatgcaatggtgtcagcatttggaagctgattatgggatggatccctgcatatggcaatcactagatggtccatcctttcgtcacagctccaaattttgtctctgtaactccttccatgggtgttttgttcccatttctaagaaagggtaaagtgtccacactttggtcttcacctgaggaataccaaatggcagagaagcacctgaaaaaatgttcaacatccttaatcatcagggaaatgcaaatcaaaacaacactgagattccacttcactccagtcagaatggctaagatcaaaaattcaggtgacagcagatgctggcgaggatgtggagaaaggggaacactcctccattgttggtgggattgcaagcttgtacaaccactctggaaatcagtctggcggttcctcagaaaattggacatagtactaactgaggatcccgcaatacctctcctgggcatatatccagaaaatgtcctaaccggtaagaaggacacatgctccaatatgttcatagcagccttgtttataatagccagaagctggaaagaacccagatgcccctcaacagaggaatggatacagaaaatgtggtacatttacacaatggaatactactcagctatttaaaaaatgaatttatgaaattcctaggcaaatggatggacctggagggtatcatcctgagtgaagtaacctgatcacaaaggaactcgcacaatatgtactcactgataagtggatattagcccagaaacttaggatacccaagatataagatacaacttgccaaacacatgaaattcaagaagcaaaccactcttaaaccctcagccacatctcccttctcaaattgaaagttctttaatgttaaaccaaagttccagaactatcccccaataatagacacctatccatttcattgtaaacaatgcatatttacatatatacttgatccatctaggattccttctttttcttgtctcaagaccaaaggagtgtacgtaacatgcaacacagttgcagtgcaaagctacattcatatcagaaatataaaatcagcagtttccttaattcttgggcatgcggcatgagacagtcctttcaccaatggcttcctataatttgcatcacagttaagtatttaacatgaacgtgttttaaatcattgatagcaaatttctctcaatatcgggactcttaagaaatgtgattgaaatggcccattagcctgttatcagtgtttcaaccacgctgagccactgccccaggcttttgctggacagaaatggcaccatctacctgcaggcagatatggctcagaaatccttgtcaaaatggtataactgaggaaacgagcagttacatgagtggcattggtgggaggaataggatcatacagagcatttagattgaaactgggagaaaatatctgggggcaaatttggtaaacagtgaatgggaggactgtaaagtgacaagctgttgcttcccacctcatcttcccttccagtaagcttatctcttgcttaactctgttcacagcgctgtcatgcctcgtgatactttgggaaaccacccaggggtgtcctattttagtgaccagctgggtgtggagagacatgctgtttactctgagtctctctccaactgagccaccagaacagggtcagacttgaaagaaatccagggcagcaaatagtctgccctgacagataaaccggagtcctcagttccagagttcagccagcctggctgtgagaaatttaaacttcagcttgttccagagaaatgtcacaacccagagccctaactgaagacaacaatatgactcatcccaactcttcgctggccatcccagattggggtttagtgtgaaggtgaatttctaggttcaagtcctaacaacattctgtgcagaataatactagggaggtagatgcttttttttttttttttttccttaagcacccagcagactcgtgacaaagacatgaaggagaagaaaaatagtgaaatgggaaaaactggtgagagcagggaagaataaagaaaagggaaattgaggatataggaaagggaaggaatttaatttagaagactggctgcctcccctctaggaattgtcagaactgcagctgcactcttaactattttttcctgtccttaagcagacttttgtggataagttgcaaaaagtttgaaaagaaatgtcactaaccagctttttgcttccacgggactatccttgcctccattcctgtttttcttttgctattctgtgagcatgcccattatctagaggaacggcagctgacagagccaactgaccttgtctcctccaactcctaattattctcatgagaatggcattttgaatttattatgtcagggaggggaaaacaagaatgaaagtttgctgcctgtgatcatcaataattttctgctcataatttagatcatttcaataaaaaatactaaaaaaagatagattgtttgagagggtgatagagatggaattactagagaaggagtggaataggaaaataggggaagtgtgtggaatgtaaaactttatatgtgtgtgtttgtgtgtgtatgtatgtatatataattaaataagaaacttcttttttttctttcttttatttcttaaaatttgagtgcatcgaaaaagagaacttttaattttagagagagtaatttatgtagtcatttgctccactgatcctcaaacctgtctatatgttaatatacaaattaaagacagttgttagcgatatggtctgtcttagactcttttagagctcagtgccatggccccagatctatgtacttggaggtttttccacatggtgctggtactaggagatgccttgaaaccttaacaaaatgaagatagaaatataatgcatctcctgaaaggcatagactatgtagcagaaattccagtgctattttcagttgttggcgaggggagttcagtagactcctcaaaaaatacagtctattgccattgtacttggttgaattgcagaagctattaaaagtaaggcccagcaaacatcaatgaagggggggggggcatgtggaaagactgtaagagccagagaaccaggaagtctactgtgatattgaagtgacaggaaaactgtagcactcaacaagacttgaataatgataataacagtagacatgctagtgctgaaggtggaaatctcatggggccccaaccctaaacaaaggaagctagcttcagtaccccaaccccagatctatgtagcttcaagaaactaagaactggttacagacgaagagttagttgtcccacagatgaggctattagacagcctctaatagactatctaattgcaagggtcagccctgaaatcatataaaccggagtaaatggattcatcaggttgtatttgtatattgatacatttgtgaagaaatgtaggaggacctggaaggagttggaggagggggggaagggaagacaagagaatagtgtagttatatttcaattatttctttttttaagggagcaacaacaaaaccataactaaaccaaaaatcccctcccccaccttcagtcaagagatctctactacccgtttctctcagtgacagcactagcaaaagctttgagcatctgtctgtttttggtttcctttttatttatgggatgcatgtgtgccttccagtagaacggaagatcagttaggacagggattattgactgtgttagtcactgttttctatttaatggtctagaagagcacctggatatcgcaggtactcaagaaaatgtactgaatgaagggctagtaaaactccaggagcagccagacggctcttaagaaagacagaaaccagtagtgtttaaatctccttgtcatttgatgctttcatacctcctcaacttcacagtctgttcttcctcagtcgtcgaattcctttcctgttctgtgtcctccctaccccctctacctcagggagttacaagctctgcagcattccttttacctgagttgttctctcatggcctagtaacctctactgttggaggtctcagacaaatgaatagccaagtgagaactgctggatgattacatctagttgcaccaaaataatctacatagattaactcctcaatttttattctttcatagtactgtgtggttgtcttcaaacaagctgtggctgataatctgtaattatatattcacttccttattatttgtgctccagtgtgatgtccacaaagactaagactctgcctttttcttttctttggtatccccacaaaacaagtaccatctttggtacaaaactaacacctgaatacttgctgattgcacagggaaaggtgaatgatttaattgccactgttctttcctaaactctcaccttgaagcctgatatgcttattaggctgtctcttttaccttagtgtaccttagaccccactagcggaaaccttgaattagaaaggcctggataacccgagtcacactagggtgatcggaactgaagattacaaaataatgtatttttaaaggagaagaaacacttttagttttatttgttatcctccaaatcgtttctgtacaaaggtggaatttccttataaactcattactcttgtaacaacaaagacaccctctttttaaggcatttcttttaattaaatattttcttcatttacatttcaaatgttatcctccaaagccccctataccctccccctgcgctgttccccaaccctcccactcccgcaaagacacccttttaaaaaataaaatcacaaatagctaattccctgatggttgccacagtttgctttaggaacatggctagttaggctcagtgacacacttgaattaggtcaccttgggttagttatctaggctctaggatttcccttacagtgttgagagaaaggccttttgcagggtcctgctcaggcctactgctgcctggctttttaaccttttacctgttttggaactgtgatactctgactttcagcagctgttgtctctgcctctaagtgaagcataagtctattgagagtgaggaggctctataactagtaggttggggggaatttccccaaatgtagccacctccagagctttgttttctttttaatatgtcctcttgactttgtatccatcctagcatcacgtctctacaccttctggagtcctgtttataactgcaaccggtctgtaggcagacattgctgattttacctcctgtcaaaatccttaggttctgtactgttcagtatcattgatttgaattgaatcaaacctaaagctttattgatatcattagcaggaataaatcccccaagatatattttcctaggaataaattgcctttatttttttaacttgtttattttgagacaaagttgcattctgtagcccagactggccagagaattactatgtagcccagactagccttgacctcacagcaatactctttccgcagtgccctgagttctacaattgaggtctaggctatcattcctgataaattcatggcattgacattttgaaaattccatttctttgggccacatataaagatgacgagaattggtctgtggcctgagacttaagcactaacaacttggcctatgtcaggaacaacaaggcacatttatcaagtctgtagctgagtttttgcttcagtttctaattaaaataatatatattcaaaattatcagaagtagttgttggaggttgggaacattacacaaaaggtctggcttaaaatattgaaaattgcatcttagaaaaatgaaatgaagtgaagacttatgaacaaaatatttttctgttagaaaacgaaatacaacagattcatctagtgttgtgtggagctggtgactcagacacagtttttagtcaattgaaagtcttcattactgcagattgggattgcactcagaacataagtgtaccactgaatatccagagcatgggatgtttgaagggaaaaacctgccaccttgctctgaatttttggggtggagagtggttcacacaagtaagcaatttaacagaagctaagataagcagttagctggagggaggattctatacaagcaagacgtttaacaggaagctacaataagctgttatctggaaaggggttatataagcaggcagtttaacagaagctaagttaagttagcttgacctaaggctcctagaataaagttggataaatttccatgggattctccatcaaggagatcaaatactatgtatatgtgaagttgcctcagcaagagtacaagtttgagaaacttctgcactatcttggaccatcacattattagtatctaaatttctttatttttagaaaatagcataaaaataaaggaatcatgaaaactgaaagacaaattctcagagtagaaaatgggttctactttacaaattaatcatgtctctatgaacccttaaagtttcttacatattgacaatcattttataagttataaaaattatctagaaacagaccccagggacacaaataaatatggtaatgtgccttttttagagctgaatttcatcaaatctcagatttattctcatttacaggttgagatttcgctaatacacttttctttgatcatctaagaatctaattccttctgagtctatgacaatatccagatctagatgactcaactaggtctctaggggtcatcagattctaccatcaccatccatctcctgttgcaatgagaggaatctttgcccttttttatttagcaagtgaaaagcaaccaatagtacttataattttcaacataagtagttgagagacaatgcagaaatggttcaaagtagacttgcaagatttaagtcagaattaaatctgtattacatatgttcttgtattaatatgagtacctcaaggatatacatttgatagaactagccatttatgctgtttagccccactttctttctttttttttattacgtattttcctcaattacatttccaatgctatcccaaaagtcccccacaccctccccccactcccctacccacccattcccattttttggccctggagttcccctgtactggggcatataaagtttgcgtgtccaatgggcctctctttccagtgatggccaactaggccatcttttgatacttatgcagctagagtcaagagctccaggatactggttagttcataatgttgttccacctgtagggttgcagacccctttagctccttgggtactttctctagctcctccattgggggccctgtgatccatccaatagctgcctgtgagcatccacttctgtgtttgctaggccctggcctagtctcacaagagacattagccccactttctgattcccaggatcactacacttaattatgtaaaataagtgcataaaaatcagctgttttgagaactccaacctgattgagagacttggaaattgggaaatttgtgcttggtttttactttcttaaaactgaaaaaaaaaaatctatgattttcatctcctagaagaagtcttttgtattaggaagtagaatgttctgcttcaaagacagaaactccagagcacccacaaatatctagatctaaaatgagcatcattttttacttaactgaacaaagttttagagtgtaaaaataagattaaatgagaacccccccagtgttacactaaatcttactttaaagatgcttaaaataatgctttcataaattatttaagaatttcatacaataaatattgagcatattacctcctcccctatctactcctcccttcctctctatctctctcgcctctttttcctgtgtgtgtgcatgtgtgcatgcgcgcgcgcgcgtgtgtgtgtgtgtgtgtgtgtgtgtgtgtaagtcagagaacgatttttgtgtacttggtctttttccttctactatgagggtcccagagatcaaactcaggtcctcagatttgtcaacaagtatctctatctgctaaaccaccttgctgttccgaatcttacttttttgcacaaagaatgcacaaagatgcatattataatatgcagattcttaataagaactgggtgccataatatgcagattctaaataagaatggggtaggagaaattaatacattgatgaaaattgtaaaaattgaattcagggtactaaagagcttcattgagcctcaactcaggcagaatacaacatttaacaatgcactttctgttggatggcgataaaaacaccatgtctagatcaagtcaatgtgacaaattaaatatatgacagacattgttttttattgggagatttaataatgaagcaatttggtgatataaaacagtggttttcaaaatactacatgcttcataatcaactgtcatacttaatatgtatggatcgtcctaggtatcagtattttcacagatgcaggattccaaagctagctaaacccagattactttttggcaaacaagagttagcagatattttctgcaaaggaacacagaaaataatttctgcttgctaagtaaatgattgatctacaactaatcagctcttctactgtaacctgggatcaaccatagacaataaataaacaaacaggagtgattttgatcaaataaaacttttttgtaaaaagggggattaggcaggatttgacccatgggatgtatagcaagcacagttttccaacccttaagtctaaagaattaacctgtcttatgaatctaaaccctccagtctaatgattctttaaatatctgttacaatttatgaattgttgaactgttgctttgaagtttcatttattattctgaataccaaagtcagggttctctagagaaaatgacccaatagaatgactggcttataaaagccaggcttggtaatttaaaaatggaagctgaaaacctagtagctactcaatccagacgtctagatgcctcagtagttccaattttgctctgaaggtctagagaattactgcacagatgctggtatttggtctatattggaaggctaaagaaactggtccccaaaccagagaaggatggaagcaaccgtagccaaatattagatgtccttaccagcaagaagtgaagggaaacagcagaagtaccccttcttatcacttagacctctgtatatcttggctgctgccagaatgtactgcccattgcagtagaaattttgcaagaccatcctctccatttagtcattccttaagaaatcctctcatagatccacttaagacataactcttagttgattccagatccaatcaagttgacaaccaagattaaccattatatcaaagaagtgggtgaacaaaattcctcaagcttttctcatggtccatcttctcaaaaatccttttaaaaggtttattttatttaaatttaattttttaaaaaaatttaatgtgtgttagtgttctgcattgatgtatttctgtacactacttacatgtgtggtgccatatccctggatctggaataatagacagttttgagacatctgattttggtgctgaaacccaaatttaggtcctcttcaagaacagtacatgccccagcatagtctcacaagagacagctatatcagggtcctttcagcaaacgcttgctagtgtatgcaatggtgtcagcgtttggaggctgattatgggatggggcatcagcaaccctataggtggaacaacaatatgaactaacccagagctgtgtctctagctgcatctgtatcagaagatggcctcgtcggccatcactggaaagagaggcccattggacaggcaaactttatatgtcccagtacaggggaactccagggccaaaaaatgggaatgggtgggtaggggagtggggggagggtgtgggggacttttgggatagcattggaaatgtaaaagtggaaagtacctaattaaaaaaaaaaaagcagtacgtgcttttaaccagtgagcagtctttccaaccccaaattttcttatggtaactaaactcaaactccagtataactatcagtattgtcttgcttatgctttcactatagctgaaaagggtagttttaagcatctggataactattgttagttctccaacccaggacaaatggctaactgatgtgcctatttagcaaatcaaagcaggcccagctaccagatattcccagcatccatcagtccccacctacatgtcttatacactatcccaaacttctccagaccaggagttatcctgcccttcttctagctgcccttccacttatgatccagccattttgattacccactcctttggtctaccctttaccctcctggcatcttggtctgactctttcctctccccttaaccttctcatatatcccagctcagggttttgtttaccctgacctgcctcactatgcttttcctcagatctacaataaatgttttcttccatcatacctatgagcagtcatgttcttccttttaatttattttttcaagtaatgtgggtcaacaaatttcaacaaggtaaattttgcagtttaataggaaaattgcctgccatttgtactggcatttcctacaccaaggcaactattggcagcaattcatagtacccactctttctgagcacattatttccatatctggacttttgcaaattatcaagtacaggttaatagattatcagagttggcattgagatgaaaattgtgtttccatcactaataaactaccttcactatcacggtattatattacagggtacatcttatttcttctattatttctatccaggcaattttgaaccttgcttgatagactttcatagaagagatgttaattgtttattattttcttatttgaatgtaaatatgttaaatctggaaactgtctattttatcatgtgctcttttgaggtcattccagaaacatttactgctggtttataaagcatgtcttaaaattaaaatttcagtgttcatcatgattagtatatgattgatatgctgaaaattactattcatcacctaataaaatctgatattgtggccaatatgtaaattgtagagtccttgtctgtattctgttcagagatctataaagctataaactattctttgaaattgccttttagttctatttaggttgatattcactgttaaaacattgtttggctacataatcaaaatgttcgcttactaagtacaacgtagtttatagcgttaaatgaactccattgcacagcatgctactgactctgcaaacatccagtcatctgctagctatttcagtagaacttatctaggaaaacttgaagacaaattaccatttaacaaagcaaagcaattttcaaaacatttgcaattccatcttggtacatacagctcacgtgccacaggactgtatctaaatattcactgatctggtaccaaatgttttatgactagtagtactgaatatgaagaactacatggtattgaaatacaaatgcaaaggactaaaacagtcttccctggttgcttcccctaaagtttctaagccagaacagggataaatggaacatttccactggaatgagatctgagactcaatctctaccagacacctcgaaaacgtgaaagacatgcatataccagagtgaagcagatggatagtagtgactatatctggtattcatgtttctgcaacaaaaccttccttacagacaacctacattctccagacttttcctacatgcctctgttaggccttggggacatgatctgacctctgatatttccaaatctccataacagaatctgactatatttatttttaaccaacttgcttgttttaaaacatggaaaatatcttctagcaactcaacaaaactgccaacagctttaggcaaagagagggcatttgttaacggctctagggagacatctccagaaataacatattccccacatttatacttttgatgtctgtttttgagacaaacatgaacctgtctactttaggtattctctagtctagacatgtcctaatagcatgtgtgaatttatgagcatttgtaagtgaatgttaacaaatgaaacgcatagaatttgtatgaaattgtatggaaagaagaaaaagacagttgaaaagggatattgtggtaaaggatggattagaaaatacagtgtgaattagaaacctactataggaggtttggacacagtgaagggaattagatctcactattttgggagtatgaactggaacaaaaagcctgggattataacattcatatcagcaaactcaggttaccaaaccaagcaacttcatgttctagcattttaccgtgaagattaggccccgaaaaattcaagtatcaaattcagtgttctcggcttatttttttctatacttttctcaccccagtaagttcctactgtgtcacatttgatgctcaatattctctgttgcattcagtcaccctctttggaaagtaacaacatctgaaaaatatttggagtatgattcattgtatcatgttagtgactatcgagttccttcttcattcatagtggctatatttatattcaaagttggaagtcatcaaatatttggctagccccattttccttggcttattaaaactacctcccaagtggaagggatcattagtttattttactgatgaaaaataagccaacacaaaaaactgaatgttcttttttttttttcttagttgctgaatcagtaaaattcaccatttggataacataccctagctatattctcttaatatttctccaaaaccaaatttacgtactgaattgattccacagaaaaattaatacattatctctgctaacattccagtgtccttatatgtttacctgacccttgcatttatcctatgatttgcctatttactgagctcttaccaagtgctgatgtcatcactagttgcagagaatataaagttacaatagccagtctagagtatatcatctcaattttagaggaaaaaaatggaaactcaagcaagtttagagacaaaatgttgcaatatttgtggacttagcatagaatttcaagtttgtggacttaatctgttgatactcccagtctttctgcctctattgtgtaattagacaagacagacatgaaaatcttagcaatgtgaatgtgacaccaaagaagaaaagaagagaagaaaaatgtgtaagttgaacttcagcaaaattttaaactttgttctgtgaataacattaaataatgaacagacaagtcacagctaaggagggaaaaattgcaaattatatatgtatcaatgaccttgattctcaaaaacataaacagctcttaaaacacaacaataagaaggccaataacctgaagtaaaaatagcatgaatagtcacttgaaacaagaatatatacagatggaaaattagcacatgaaaagatgctaaaccagcactagtcattagagaaatgcaaattggaactataatgagcgaccattaacatccattaaaatagctaacattttttttaaaaggcaatactggaaaggatatggagaaaccggaactctcttacacttctactgggaatgcaagtgctcttgagatagctttccatgggtaaagctaaacacacagttgtacaaccagatatcttacattgaaaagagtagcatagtacagcagcactactcacaattaccctcaaaactacagagacatgcagatgtccttacatagtcgaatgataagaaaccggggtgtgggcacaatgaaacactcccccgcagtgaaaacagaacagtatgaatggaagttaaacatactatgcaaagtaaaagaagctaatacaaaaatgttcccaactgtatagctctgtttagatgacattctggaaaaggaaaaacaatatggagagaaaagagactggtaattaccaaaaggttaagaatgagggaaaagaaagacttgaaagaccagcatgaagaaagcctgagatgctttctcttcgttgtgtatcgtctttctaattgcaattacattaacttgtgtatgtggtaaatctcctagacatattcataggcacatgttacaaaataattactttacattaaccctgatataaacttagtcctagacaaaatttgaaataagtgatattggaatttagcactgtttaacacttctgttacttttgtctatcagcagtatccccatagatatttttatagatagataggcaaatctttgctcagttgccacactcagatttcagggtataatttgatgattaatcttcccaaagttcaaaataattgcaaatagccttgtgtgttttctctatggtgttaaaaatgatgcctcatttttaacctaaagacttccatgttcaatagtggatgagaattcaatgactggtcagtgggtaaagaatatatttggagaaagagtcagtactgcctcttttacattattaaaaagaatgtacatatgtttaagtctttaaaaaaacttttaattgaaatggaattacatcagttactccttctccagccctttccagctaacctcccttaaaaccctcccatgcctcctactttcatatttaactacttgtattatatttgttacatgtttttgtgcaaaagcatacgtaaatagaaccacatgagttactttttattgtttgtatacatggtttccagactgaccactaggcattggacaatcaagcagcagggcttgtccccggcagaagctaattcaccttctcctagaagtccatagctgcctagggttcttttctgacgggtggaatcccacaattttttttatcccttctgcagcaaacagagagcactatagataatgacaactggacacaatgcagagatcattgtatcacggcgagccaagtcccaatataaacatttacatccctgcttctgcatctgtggttcagggagcattatgttagagaggaacagaatacaaggatctctcctgttgaaaagtctccctagaaatggctataccatcaagaccagaacaatgacaatagtgacgaactgtttaagttcgtgttttacatcttgtgtgataaaatagcatagtctgtgtggcactacagataaatataaggaaatatatgagaccatgccaaatactgaatatactcagtctaaagagaaaccctatgaaatgatgaaaacaatatctcaaaatctaaacttgttaataatagaaattgtttaaaagattgagttcttacgtcaaaaatctgaaactatccaggctcatttcaagtatctccttataaaaatttattgttactttctgagaaatgattaactatacttgaatataaattgctttaataatgagaacttttggaagatatggtatattaactcatgatttcaagtattttaatccatgtttaaagatatatctgcatgtgagactttcttaaagtgaagcatagccatgtagacttatttacaggctcattgcagtgataaaaaatcccagcaaaagcaatgtttgaaaggaagggtttgttttgactccaattatgagaatacaggttgtaggcttatattttacaatacctacttataaatgctttgattccccttgtagcccacccagagggctctatatcaatagattcccatggtaaagaaggtatggcaacagaactttaatggagcctctgaccaatgatcaagaagcagaaaaagaaagaagaaagagagagaaagagaaagaaaggaagaaagagagaaagagagagagagagagagagagaggaaggaaggaaggaaggaaggaaggaaggaaggaaggaaggaaggaaggaaggaaggaaggaaggaaggaagggagggagggaggaagaaagagaaggagagagggagggagggagggagggagggagggagggagagagagagagagagagagagagagagagagagagagagaatagaaaaatgataatgcttagttcactttttcctttctctatggtcagtctatgacccagctcataaattagtgctgactagagttaatggaggtccccctgtctcaattgacatagctaggcaagccatcctaaggcatttccagaggcttctctcctaggttaatatagaatctgtcatgttaagaatcaatatcaaccagcaaaatgtgcaagaatagtgtttttgagcaccatagaacttgaatagttttcactatgttgacctaaggtacaggtgaattagactttaaaagcaatgtagagagtgtttataattcagtctatatattcatcttcataatatcacagtaaaagtaataaataaccccaaaatacactaaagctgcatttctttctaaatgcaacctgtctgaattggaatattttgtctatattttcacccaaagatgttctatgtgaactttatcaatgcccaaggcatatgttgttaattgtatattttgctactcttggtatcacaagctccagcaacacaggaatttatagctgcacaacatgctgttattgcctagctagaggcgggtagaaggaaatgctactttgagttgtatctatcctattccaatttcactaaagaatatatttaaaagtaacctattccaattgtttatggaaacaacagtaaaatatgaagcattgtagagattaaaaaaaggagttggggtgctgaatatttaattatcaccattagccttagatgattattttgaggaagaatactttggtttcattaggaaaattaactaagtgacttaatcaatatttattaatagagttcaaaagtgtgagcgtagtaaagagaaggaagagcagcaaagctactaaagcaaattgtttccatttgaaagagtataactcatcaaaatcagtagacatgacataccttgatttcccataaaaataaactgtcaataaattccatctaaatataaatgtcatcatttcatcattcccctaatcattttatgtctccctctaactttcagtaacttcttctttcacctactctctgtaacccggaaaaaaaacctaagcaataacacagaggttcatggtttgcttaactgccagctaacggccatgggccaggaattaaagagcagctttggttaggaacagaggaaatattgaattcacataaaacaagttgttgaagtagctagactccaggtaaaaagatacaagattttcaatctgaaagaaattgagacaccgaatatacaagtaaacaaatacctcaaagagatcaaagcgttcaatgattcggttcagggctaactttaggacaaaatttaggatcggatatctatgtgtatcagaagtgatggtgtgctgtggcaaaagagtcacacaaatttaagatcctctttgccaagataatctgaccgagcttgtcttttgttttgatcactttgcttctgttaaatgtgcttctttctgatgaactccaaccattgaaagttgacgtttttcttttctttttctttttaaacatatttgaatggccacactagatgctatccttgttgtatcccttttgttgctttagtcctcacaaccacaaatagaagacaaataagtgctcataagaaagttatgtggtcctcaagttcatatagagtgtcctctctcatgctagtgacctgtcttctgtctctatgctatcgccttttgagaccttgaattgtacctattctgactatgttcttggcttcgctgttgacctagcttttgtctgtttatgatctcacttcttttttagctgcatctgctttccttcagattctaattaaatcctgtgtttctgcgactcaaagcccaaccacattcctaatttctttttgcatgaatggtttgggcattgtttttacgtggactctaccatgattcctattaatctcaccgtagtgactcaggaaaaaggctcatcaccattttcttcaaaatttatctcttgatgaacatgaaaaactgcggtaagggggatgtataggaagtagtcctacttcccgctttacattctatcctgcaggtaacctgacccatttcttctgtaaaacattttagttcaggtcagaacacaaatcacactgaaccggatagataattgctctggctcacagtggtgttatgtatgcctggaaatgagccaggctcagtgaggacagaaagtatcaatgagaacgggataggaagttgaaatccaagattatcatgtgtaatgaaaaacatctggtgaccttagccgactactaaatttaacacgacttaagagatggtttggagttttaagaacaagaattgtcaggtatctttccccgttgatgactatttgtggatgcagaattgaaaaagcctgcctgcgtgaatgtctttcacaactaaattgaaacatagggggctcaagtttgtttttggtttttgttatttttgttttaagtcctggagttttacctttcaaaataagttcatttaccaacccagaaaacatccacccaaatgacatgagaagtggtgtccccttagaaaacaaattcaactttgaattatctgtgctgtagaccttgaaaatctttagccacttcatgtagtcaataattgggatgtttgatttagtaacagacgatcttccctgcatttcctttctttttttgctcctacagttgtatatttgttaaattagttatgattgatgctatcattttacccatgtgctagattttacagcgaaagctatcagagttttattgcatccatagttttaagggtgaatgtagcacaatacatttttatactctttcaatagtgaagctgcaatttatacaaatagattcattctgtcttttgcccaagcgactttgacaaaatcatgtcgtttaaagtaatgttgctcatccttcagtgatgcaaaagctgaaggctacattgcgttgctacgaaataaccagagttttgaacgcctggtaaaatcggtatatgccactaagagtaacttaagaggtttgtacagctgggaccaaatggaggggaacaatcactgacagctataatttcagcataaattgggctaaagaaacagtttttctttttcaaaaataatgtgttctctgaaaattggttatggaatgctcagatgctttcaaggtttgttaaaataattatacacacagtaaaatacaagtaattacaaaatacgtccagtctactgtttggctttaggcagtattatatggagactgatgagcatacgatttagggtgagtacactgaaagttagagaaaaaaaaaagattgtaaaatattttttttcaattagtgtattcctcactggtgaatgatagtctctgtctttttgacttgcaaatgttacagtgaggagaaaattcagggtttgtccctattacttcttcagtgtagctactacatcatggagttagacaatgcttccttctaccagaatattagtagccaagtgttataaataggggaaaagagaacttaaaataaattgataagcgatcaagctgtatctcagggtttttgagtaatgttatattccattggggcataaggccttgaggtgagctactacatttctagtgttaaatgattacaagtctttccaaatacaccccagttcatataaattataagacacaagacattctttcatactgacttatatccttaaactgaccctgactagtaaatgtgctgggagattaatttcattttttaggtacaggatgctctcaggcttaatgtcctttatatgaaatcctttagttctagttttttaaaataaaagagagccagggagagagaagggatgggggagagaggtaggaagggaggcactggaataaaattgattgggtatgtatgtgcatttatccagggctttgttttgtgcataaagtctttagaatgtatatcatatcattatgtatagggaaatagcaggacactgagaggtagtaaaaagagtttcactctaagtaatggctttagaaggacacacccattttgtagtattttcttaatcaattgcctatgtaatatatagcctatgtaatatatattgcctatgtaatatatagcagaaattctgttctccaactgctctgtctgtcatatatcaaatcctaggtctgttttcctttgtgccaaaacaaagtcttctcttcaactatgcacactctgtggctactgcttcgactatccttttaatggttgccagccaaaaataccagttcaacacattaaaccagaactaaatataagcttgtcttcttcaagggctttcttagtccttcaacagtcctcatggactacattagatatagtcaaaatgaagaactctgagaagaaagaccaaaactgtacaaaatcttcaatgtgtttctctgggaattttcaagaatagatatttatgcagaaagatgaccttgtataacattgaataacaatattgtctctgagtaaatctacacatagtgtaaacacacaaattagttgatgtgttttctacaataattttctgggatattttctttattgttttgtaaatcctcaagcttaattaactttgctaatgttgtaaagaacagaacttaatcataggtgtatgtttatctttaaatatttatttttatatattatatgtctctctctgtctttgtctctctgttcctctctgtgtgtctctctctgtgtgtctctgtctctctctctctctctctctctctgtgtgtgtgtgtgtgtgtatgtgtgtgtttgggtgtgtgcacatgcatgagcttgggtgcaaacacctgaaggtagaaggcagtgaatcctctagaactacagttacaggaacttataagctgtcagacatgggtgctaggaactaaattcaggttcttggaaagatcactaagtgttcttaacaattcagccatccctctagcatcctcagtctgtttgtaactacgttttcagaatttccattgtcaacagtaaaatcagttcatgtactaacatgaaataatcaatacaactctttctttttacatctgcattatttcatactgtgctctcatgccaataatgctcacccctttatcttaggatcgtctacttctccatgaagccattaccaattaactaatgaacttttacttgaaaatcaagcatttaaatatcacccaaatttggcaaaagtgaacagaaaatgagatacaaactgttatcttagcataattttcctttagactgccttgtcctttgaccactcaccttatacccatggccttatttgatttatgtttctcttagtcattattaatctgtcaagatgaggataataaattataattctttaaacaatgtgaaaactgaataaaaataaaaattagaatcatttggccttgtctctatcatataaaacaccaaaaaaatcacaggtatttgtgggaaacagacatgaatgtgttaaggggaagaagagaatggaaagacagtattttaaatcctttcagccttcacagtggttctcattggctttagacatgcctgtgtttccactgctccccatgaacatctgtgctttgattacataaacattcttgtttcccagattagtctatccataaaaacatctgtgaaaagatgaggtatgtgtgcaagtttaatatctataaagagaggtcaaaaccacttcggcacacgtactgcttgcaagactcatggcttcaagtcaagtttaatgctgcctttatctgtatgatgaatgaaagatttaaaggtatttagtgattagctattaactacatttaatagacacataagttgaacatattgtaggtactaatcataaacttaaagatatcgccatatgatgctttggtaagttacctagtacatacttactacagcaaatatagacatgtggcctaacgaaaacatctctataacactactagatgctttttgaagtaacattttcaattgcaccttttgccataggagatattggggaaaaactatgcttcggtctctagtgtggaatctttcctgttatgctaaataacacattgaaaatgctttgcatcatctggtaatgatctcaacttaatgtgtatggtaaaaagacagaatggaaaaaccagttcacacacaaaagatgaaacctcagtaattttggccaactctagtacccaaagtgagatttttttttctatttttaagactatcagtatttttaagttcttattttttctaatgtgagcttaaaaacaatacaaatatcagaaaccatagaccactttagactcaaggaaagattgtgaagtgaccttgcccattgttctgccataacaagtgaataaatttattcaactaagtgagtgagagtttagaagcataggttttagaagctacagtaaaaaaaaaaaatctcatgcaaaagtgttgatcttttatatggcaaatcttttgatactttgcactttaggattaccttaaagaattttgtggaagagtcctagctttgttgatgtatctgagatatcttctttttattgggtaacatctgtttacttccaggagaaggacagtgtttctgtgtgattttatattcaatatatattaaaggcgttgttgaatatcctaaagattctgaattaaaatttttattagatttaattctacatgtcatatagagcttatatgatcagttgtccacttcacttaagaataaaaagtaaaggtcaacacagttgtatggtattttatattttagtactcctggccctgcactatatatttagtatttgcattttgaaagtatttttagtatgtaaaacatatttaaagttactctgtaaagacgatatggtggtatatgatatatattcactgtgaaaatacaaaatgagcgtcatggcaagtatttcagtgcatttgaagagaaacattgagatattcaatattatctgtctccactgaaatttcacactggggaagggcctaagtgtattttaggatcccttcatcttgctctccatatcttactttggtgaattcacattaatagacttttttattattgttagatattttcttcatttacatttcaaatgctatcctctttgctagtttcctctctgaaagtccactatacccccccaccctgctccccaacccacccactacctcttcctggccctggcactcgcttgtactggggcatataatctttgcaagaccaaggacctctcctccattgatggccgactaggccatcctctgctacatatgcagctagagacacaagctctgggtggtactggttagttcatattgctgtttctcctatagtgttgcagaccccttaaactccttgggtactttctctagctccttcactgggggtcctgtgttccatccaatacatgttttcgagcatacacttctgtatttgccaggcactggcatagcctcacaagagacagctatatcagggtcctgtcagcaaaatcttgttggcatatgcaatagtgtctgggtttggtggttgtttatgtgatgcatccccgggtgtgccttcagttcatcacaagaacctactccaagtattctacacctcaaactcagggtaaaagcattcaaggcaaaaactaaaatattggctaatggtgtggataaatgtttccttggcttaattctagttgtttttccacatgcaaaaaactggcttacttggaacactaagttttggaattcacatgatttatatggtgtagactccatgttgaccagtcatctaaggcacacacccttctttttgacaattctatagaatgcattataggtcatgtattaagtactgtataataattaaggcaaataagtcaaatgggttgcttatttaaccattagccagtaaacatctaattaaactgagaagaaaaaagtgaagccttggtctgtttgtaataagaaatgtattgtcgttttatcttctcacaattgtcttatcttcctgtctttctctaggacaaaaaaggtgtcatgtagaattgtagactttttctcatatatttgtatgcatactatatttgtaaatgtgcatatcacacacacacacacacacacacaaatatatcattttatttgatcataatagtaccaaactcatagtcaatgacatatcaatagcaaaaatctacaaatgcattcaaattaaacaacataaataattctaaatacacacacacacacacaagcgcacacacacacacacacattgtgttcttgtgtgttgcttaaaaatttttaaaacattatttatactatttgaggtttttaatctattatttaacttttctaaccatttttgttgtgtagtgtaatgtagtcttatgaactatcaatttttgtaacatgttaacagtttaagtgaactaaacaagtctccccttcagttagggcacttttattctcttacttataagattcattgcatttcatataaaacaggattatattactcttatgttccatcatcaagtgttttttaaaactcatgaatatttcctatggtatgtgcattcatagttgcatttatctatttttgtcttctaatgttccaagtaatttaccctttaccaatagtcaaggttagctttactgttttcattttatttttttttattttatttatttacatttcaaatgctatcctctttcccagtttcccctttgcaaactccctattactgatttcattttccttcccttaaaatagtatttttagccgggcgtggtggcgcacttctttaatcccagcactcgggaggcagaggcaggcggatttctgagttcgaggccagcctggtctacaaagtgagttccagaatagccagggctatacagagaaaccctgtcttgaaaaacaaaaacaaacaaaaaatattatttttaaagaattgtaaaatgtttttaattattattttctattttttgaatcgttatttcaatactgttgctttcctactaggattcaggtgcgacaaatatcactgcatttgttgtgaccccataagtctttgagatgttttaattaatacttggtatattttctttgtgctgtttagattatatgcaatctactatttatccttaagcttataggttctcaatagctttcatcatgaatatgattatacccacacagtttgtagagtatcataataccttttatctctatagttttaatattaataacttgatatttatgatatcttgatatctcattctttccatgaaaaaattaattaattttgaaataattttattatgataattgacttataattcaccttaaatagctatagcatgcaatattaatgtttgtgttagtttttaaatttttcttgtgaaagttgaaaatacttttagtccttaatgtgatgggtatttttttatttcctatacattttgtctgttacataatagtagcagcaaggcctgtttaactatttcaccttggcaagaattgagttattaatatctaatacccgaggcctggtacctttgtaaagtcataaatcccaatatccatttaaatttcaaattgctctcatctgcatagttttcctggttctgattaagtgaaagcatgtgtaaaaataaaatacttttacacaaatatttacagtagcacaattcatatagccattatagccaaatgtgaaattaccaatttgttcatcatttgatgggtagaaatagaaaacatgctttaattgtacaaaatttattcactagtaaaaaaagaatcactaatggatgaatggatagacactaaaacatctgattatattataagcaccatatgcaaccatttcctaaatcaattttactatcctttgataattgaacaaagaaacccttgactattagcatatttcatatgtagttttttgggcatgtttataatcttgctcagcccattggctttccaaatgtacaagaacacctcagagcatctcaaagtcaattggtggtggtggtggtggggggtatatctcattgttccagttttactttcttccatttttggtcattgctgttaatccatttggaaatactaccataattataaagtaaagcaattcatagtgaattttttctcccttattttgttgaataaaacttcatctggtcaaagaaattatggcctgagaatggaactttttagacaagtcagataatgatggttctctggggatattgcttttggattattctcagtccatctgtttcttttactggcttctagactatgaatcttgaagctaccatcgttgtatgaagattggttttaggctgctgtggaggtagggtttcagccaagttaaagcagaaagaacaaagctattttctttactgccagccacatttctgaaataatcactcattagattgttgcaagccaaaattaatttctacatttcgagtaaaaagaaaaagatgaatttaacagtttttattttctagtgttgtctttttgtgtgtgtgtgtgtgtaggtgtaaattttgaaggaacttattccaccatcaaaaagttttctaagaaaaattcttttaatttcttcaaaagagagttaatgtatgggtatttgtatgcatgtatatattaatctcttacatatgtgagtatatttttctctgattaatccagttagactatcttctatataagcattctttttaatatttattttaaaaattgtataattttcacacaatctttgtggttttcttggaatatctgtcttttttccatttgtattattatttatgtatctagtttaaatttgaggagccatttttttctagcttaggatatgactataaaatagatcacaataacaatatttctttaagagaccaaagaccttcctgtaaaaatacattaatctacacaaacacacacatacacacacacacatacacacaatattaattgtgtgaacatgtacaaacatatgtgtgaatgcatattttctgttccaactaaaataaactttacaagtattccatgttttgaccctaaattagaaatgtatcaaactctctctaaagctaagaaaaattatgtgaaccaaggacaggaaaagtgtacaatgcagtagttagagaggactactataaaacactgactttcgggactatgcatggccctgtactcatgtatgactttcaaaagcttgcacaagattggacccctcatattctgccatggataaaataggagactcacaaagccccatcacctcttgatgaactataggtaattaaggactgataggggccattaagactgacctaggcactcctcacacattttacatatttgttgcttggtgttcctgggtgtctcctaacagtgggagcaggggatgtgtaggactctgttccctgctttggggaccctttttccctactgtgttgctttgacttgtctaaccttaataggagaggtggtgcctagtcttactgcaactccatatgccatggatgggtgatatccatcagaagtcaagctgctctttttctgaagagaaacagaagaggagtagatggagtggggagtggaatggatagactgggaagacagtgtgtgtggagggggaggggagtgaagttgggatgtaaaaatacaataaaattaaagcaaaacaggagtgctaggagaggagagagactttttttccagcattcattgccagtataagttgtctgtgttcctctaaatagcctgtaagaaattctaattaaactcattgtgtcactaaagtattactaacatagaaagggttctagttcaggagaggaagaggatcaggtcagagactgggggagaaagaactaaagaggaaaatcggaggtgaatgtgatttaaaacattatatccatgtatgaaaatggcaccacaaaacccattatacataattaatatatgctaataaaatttttaggcaccgggagggaaaaacagctttattatcaaagtcttttaaattcccttttctaatttgaatttccaacctatctgagagtatggtacaaaccaagcatacaaatcacaaatatataaaaaaggaaatgcatgctcattaaattgctacaggaaaaccttgttatcaagagtactatccaaaatgtcctctttttttcataataaataggcaatcaggtgatcctggtctgtataaggctctccaagtgagcaccaaaatgtttttagactaagtagcatggttaaagtaaaggcagggcaaagtacaaaagggaaaacaactgatctatagtcttaccacgtgcagatatataaaacagaatccgtataggatgcatccatatctccttcagccctccctcatttcccgctttcttatatacactgctctttcttcttccccttcctctctaacatctttttgtcctttctctctttccctctagtctcatgcaaacaacttttttttattattatttctctcttatatggagaattactcatgcaagcacatagataatggcatattgtgcctctgggaatttttccaagtactggagtttagaaatctagattataaacgcattgtaaccttttctttcactctgaaagcaaatggtagataaactatcatagtactataacagtgaacattccaaatatctgataatgtttgcttatcaataggtaagaagtattcttatttcttctctctttttctgtgtaatctctccctgtaaagcactttgagctaagtagatgataaacttttacagaaatgttcagctaaaattcattctctatgtaaccaaaccagacagcacacaggcatgtactcatttacccagaaaaaaaaatgtatatgtttataaagaagggaaatgtcataaagtaaatttaataaaaataaacattttcctttcttcttaagacaagttttgttttgttttgttttgttttgttttgttttgatttcgagacagggtttctctatgtagccctggctatcctggaactcactctgtagaccaggcttgcctcaaactcagagatgtgcctgcctctgcctcccaagaactgggattaaaggcatgcaccaccactgcccagctaagacaatttttttaaaggaatataaatactaaagatggaaataggcttgtgcccgtgcttcatagtatattcttgacaagtgaaaggtgaatttcctatgttgtattaaagtgaaaagaggtgaaaattattaaatgagataattagtactaagtgtcaatttctgtgtctaccacctagtactaagccattactaccggttgctttgatattcaaggggagttatgatatacccaagtcctgtagattaaattcatctattatcagtagagcatttctggagaaccagcttgtctgtacatggtgaggattaggtactggagcaagaagtagctaggcctaatggtttcattatgtagatattttcctttagttatttgtttgtttgtttgtttaataattaccaaagctacttgggttggaaatgatatttaattgaatgtcaccacaaatgacttgaatgggttaacttatctcaaccatattaggcactaaaagaaatctgaataaaaatacatacacatcttcataaattaaacttagtctgcttttcttgtccccttgaaggctctggctgtctgaacagtaagtctgtagtttctttaaacccatattcctgaaaaccactgaacactgagaactactttctattattttaccaaacaattgtgtactgttcttaaccatcttaaaaggaacatggtaagaagtagcaaaatacaggattaaatggaaagaatggcagccaacatacatgtaaatttttaaggcaacatataggattatgaagtgatacctaggtatatgtggattatgtataggtacatgtataaatgagtgtcttaattacttttgtattggtgtgaaaagataccatgaccttggtaggcagcttataaaagaaagtttactgggacttgcttacagtttcagtaagttaattcctaaccatcatggtggggagcatggcagcaggcagacagacagacatgatgctgaagcagtaactgaggacttacaggttgagacaactatgaagaagagagaaagccaaccgggaatgctgtgggcctttgaaacctcaaatcccactctcaatgacgtagtacctctagtaaggccatacctcctaatactttgcaaaaagttccaccaattagaaaccaaatattcaaatatacgagcctctggggaccattttcattcaaaccaccacgatcagtatatataggagtgagtcagaatatccatatgtgtgtttgtataatttataaggtattcatcttttgagaagaagcactttgtatcttattagagctcttactcttttggttcctaattaaacaggacactgaaaagcatcctccttaatttatactcctggttttccctccaagctaagtgttcctcatgcaggatttccaaactgcatcattaattccttcctgtggatagactccaaatttaaatgatctcattactgggttacttagtgctatcaaaatttgttttattaagaaactatgtatggccttattttccaataatccaagtacagtgaccatctggatggagattaatatctcacttgaggttatgtaatattttctttatttcattccaattgcaatcccctttcctaatttttcaaaatgacaccaaagcccatttcatgaaattgcagtgtaatctgacagtgataaatcactgtttgagagagagaatttgctgaagctatggatttgcattcctcatgtcattttagttaagatgagaaatgcttggaatttatacataaccagcattgtgtttgggtcatatttattacagaagactcctgaaatagctgctggttttaattacacaattgtgttcagaggggaagaaatatcttcttgccctcagcttttgctatcagtttaggagtttaatggactagtttgttaaaatagtgattgaaaaattttaagttcagaatgattgttttcagagaataataataataaaaaaatcaatgcaattccatagtgcctggcagttcatcaaagcgcagcctctgagaaaagcagcccagtttctttaacatcagcattttcccttttttaaaaagaaaaccagtatagttttacagacctagttccaaataaagaggttaaattcttatttccaagcccaaaggacctcttgcccaaatcaggctacactacttaccctgtattcaactctctagaactttctcctgacctactacctgtagctctgatccccatttccttttgtgactagtaaacgccaggaagacagacatttctgaagtttctcccccatggcccacaaccatcacactaaaatcaccaagaaccttcattctatgaagtgagatcctctgctataacaataaataagtgtcatgttaatttaatgagtatggcaagatggaaagtatcatgactccttgtgaaccttgtgtggaaaagttcactttgtgcattttttttaccagtactgcatcaggccacaagggtttttggtgcaatgcactgtaagggatagatgagagggttagataaaggatgcaggtgatgtaagttcccttcttaaatctgtaagcaagcttggattattctgcagacacgaattcactgacaaaataatcttcccaggattgagagaggttaaagtttagtgttgtaattctcattggttagcaatcaagtatttgactttcagtgaaaacacttcttctttgtgtccctgtttatatgaaactgaaccattgggctatatatttggaaatttttattttatgtatttctaaacatacatataatgttatgtacatatacctttatcttaactgtaccttaatattcatcaatcaaccttactccttaggcttgcctctggtgagctgacattctacacttttatgaaagaatgacaatgtgtttattgtttgtttgtttgtttctgtctttatttcttgtgtgagagagaaagagacaatggtagacctagagagaagggactcttgggagtggattgggtacttgtctgctactgtgtctgtatagagatcacaggacaaattttccaagttggttcataccaatgtgcatttactccacactagctggtatgattctactgtcttcacagccagtcctgccatattgccttgagaatgcaagccgttttgtggttctaaggataaaactcagatcctgaagtttgcaggcaagtgatcatacctgctgagccacatcccaaacttgactccttttcattcttctatcaaatcaacctttcctgtctgcttaatctactagaaagattatacagtgcttaattctctctggattttttcacttaaaataatttctggttccatctatgttattgcaaattatgagatttgacagctgcataatatttcattgtacatatgtagcactttctttattcatgcatcagtgtatggatgcttaagtcatttgtatatcttggctgttgggaatactattgtcattatcgtgggagtgtagacatatctcaaatgattcattttccttttggctacatgcctagttgtagaattggtgggtcatctgttaacttgacttttaatttgtgataaaattgcatccagcttttcatgactgtactagtttatatttctaccaatgttgtgtaagggcttccttttctacacattgtcacaacctgttgtcacttttggtgtttctcaccatagccattcttactggattaatctttgtaatctttaatatttttaatttacttattcttgttgtcagtctgtatatattataaaatatatggtttagattgacctcccacttgttagatgaggttagttggtggtattggtggtggtgcagttttgttgttatattttatttgataatttcagtacaggcatttaaaactttaacaatgaatcacctttggagaaacacatttaattcttaggcatgcaaatgtttggttctatttgcctcacttgttgaaaatgttatcctttctccaatgtacattctttgaacctttgttgaacatcagtggatagcttataacctttctatttatttctatacatctatgtatctgattttatgccaatagtgtgctattttgattattgttgctttgtaatatattttgaattcagaatgtatagtacttcttgttttgttcttttagaatgtttttggctcttgtggctaattttgattccacttaaagtgtagaatgttatttttcctcttctatgaagaatacaatgacatttcaatatagattacatttaatatgtaaattactttaaactacatggacattttaacaatacagtttttcttagtacctgaactcatgggtttccatattttaaaatgcttagtaaatattttttcatacaatgtattttaataacattattttccttacctcaactattcttagatacaatcaccatacccatacccagccaaattcctgttatttctttagctcaaaaggaaaagaaatactaccaaaacaaaacttgaaataaaaaaagattaaaaatgattaataagaaaaaatgcccaagcaaaacaaaataaaaagcacacgcaaaaaaaaaaaaaaaaaaaaaaaaaaaaaaggccatcgtgtgtgttagccagctccaaggcataaggcctgccctagagtgatactcccttagaaaaatttttttttcttttccagcaggtgtcatttgcaaatatattttcactaggggttgggcattgtgtccacttccccttcttagcccttggattttgtctggtttaaaaggtgcaggtcttaggcatgttgtgatagcctctgtaagttcatatgtgcatcagtcttgttgtgtttagaagacactgtttttttcaagttatccataactttggctcttacatttttttttctatctcctcttctacacagttccctgagtcctgagaagtggtggttgataaagacatctaatttagggctgaatacttcaaaatctctttagttcaattgcggatctctttgttaattcaagaagaaacttctccatccaatagctgactgcaagcatccacttttgtgtttgctaggccccggcatagcctcacaagagacagctatatcagggtcctttcagcaaaatcttgctagtgtatgcaatggtgtcagcatttggagactgattatgggatggatccccgggtatggcagtctctacatggcccatcatttcatctcagctccaaactttgtctctgtaactccttccatgggtgttttgttcccaattctaagaaggggcaaagtgtccacactttggtctttgttcttcttgagtttcatgtgttttgcaaattgtatcttgtatcttgggtactctaagtttctgggctaatatccacttatcagtgagtacatatcatgcccccaatggaggagctagagaaagtacccaatgagctaaaggggtctgcaaccctataggtagaaaaaaaaatttgaactaaccagtaccccccggagctcctgtctctagctgcatatgtatcagaagatggcttagtcggccatcattggaaagagaggccccttggtcttgcaaactttatatgcctcagtacaggggaacgccagggccaagaagtgggactggcggggaggagagtgagggggagggtatggaggacttttgggatagcattggaaatgtaaatgaagaaaatacctaataaataaataaaaacaaaaaagaagaatcttctctcatggagtcatcttattgctatgttccaaaagtagtaggctacccttagacatatgacctagctagtctcaggttcttgaatacttttagcagtgtcaaatttgggtttcatgtcagagtgagcttaaagtccaatcaaaatgctgttagtttctcccataacatgtgtgccactatttcaacagtatctcttgcaagaaagtctttgttgcagatcaaagagctaatggctagattaaactgattattatttttttcttcttcagtcatgtgcatactatcttgcagtatcatgtacaccagtcagtagggataaagtttctagttaggtaccagcttgatttttccacttttaatgacataaataagttgtgtttgcagcaattgggccttactatcaagttatggagagtaacaagtagccttggaaataagctgtgctgttttggaggaggttttctatgggaccccttgttccatgactcaacaagatgtaacccattcctggcaccggaagttttacttggtagcattacatgtctaattaggccattgtcttctccattatatggtaactccatttatatcccttctacatatgtttatatttttggaagtttctacagtagtaagtttccataaatttgttctaatggctattagtgttagttctccttctccatattccctcatttaattttctattccatctccctccttctttaatcatcatattgtatttcctgctttatctgtttataatattaaatgttattttcccttctttagaggatcccttcatctataggatcccttattagctacctaacctctgtaattatttggattgaaacacacatatctgaaatttaaaagctaatatcctcatataagtgaaagccataagatatttttcattttaggcctgagttacttcactcagattgattgtttccagctctttccacttacctgtaaatttcataactccatatttcttagcagcagttaacacaattctattgcatcaacatgcaacattttcattatcaattaattacttcatggacatttaagatgttgtccatttttatacattataaataggttataaatataggtattataaataatatatagagtcctttgagtatttgacaacagtggttttgatagattttgtggctttccatatttttgccttttgtttttgtttgtaatcttcagtgttgtaagcttttcaatgtagaacactttcacctgtttggtggaagctataaccaggaatttaacttatttttagctattatagatatgctcactttatttctgatccagaacaatggtattgactttatacattaatttttatcctgaaaccttgctaaattaagtgattagtttaaagtaagtgtgtttgtgttgtgtgtgtttgtgtgtgtgtgtgtgtgtgtgtgtgtgtgtgtgtgtgtgtaatgtgtagaatgtttgaggtttttctatgtctaatattataccctcattaaacaatagcaacttaattaattttcttccaactttgatgttcattattgctttctctttatttatttcacttcctagaacggcaagcatgaggatggtgaattataatggtaaaaatagagattcttgtcttgcgccaaatgttggccaaaaatacttcatcttatctacattaaatgtaatgtatactgcttagttcacatggccattattttgctaaaatttgtcttttaatcattttctctttaagagatatcatggagtagatattacatccaataccattttggtaatatgtacagatatcatgggcctagaaaacacaaacacacattcaaatgcacatgtgtactttcatgtaccagcatggaagatgtgccaattaaaaacaccgaatttagaataatccaccactaaatccttctagtaagtgagttttaatttttagatagcctcttaaatgtacagactaatggctatgctgagaaattttaccataattaaatatccagtttagtctatacaatgaatgaaccatgagtgacattgtatttgtatctgcctgtcatcccagtttatttctatatacagaaatatatttaggagagtgttagattatagtattgggcttattttactcattatagatgaatccttcttacttctgccaaagaatatttatagtgttttgccaaaatagtctgcatacttctaaatttgctgtacattccttaaatgtgtggatggaataagtttcatttgtttatgtatagtaccaagcctataaaagagacttggtcaataccttctgggagagaaatatttgaaaagttatgatatagggcaccaatgctctaaaatatttcctgaaattttgtaaagttcgtaatgtgggccaatggcataggactgtggtgataataaaaatcacagcaacagctccaagttcttaagtgattcctaggtgacatacatttcacacattagtttatttaattcttatatcaagttgtcctataaatggtattattttcacttactgaaaaggaaacagaggtaaagaggagttacatcattttcatgacactgtagagcttgagttttaacctaaatctagcttgaagacctaaataattgctaatgtactggctaatgacaatagtggaaaacatcttgctgtgaactcacatactctaatcctatagtcttagcttcttgttttatctacaaagaagaaaacataccatttgcttttattccttatttcaatcctaaaagacattgatttttttttctccttgaaatgtactctttctaatttttccagagaatataaaataaacattttgagaatatgaatgggtaagatatattctcacttgaatttatcaaggcatagaatgcataattatagatctgcatctcaggtcttattttaaaaacagtttactgtttatacatttattggtatattttatccttgtatgacttaaaggcagaattgcattttttactttaaagaccctgaagtaaatgtataaatatgttaaaaaattatattctatacctgtagaaacatagacagacgtccaacctgataaggactactacaaatcctcctaaattgacactgaatctgagtgaccaaaagagcttcactgtaggtatgttgcccatgtaaggagtcaagatatcagcagtttttgcatttattggattactacactgacaatgaaagtggtgtcaacaatttggaaccagaaaactgacctttgttttctgtgtaagagaacttttctctttattgaaggacaatgggcttcctcacaaatactttatctgcacaactctacttttaaagctatgtttggctcctttgttagctgtcaatatctcttgtgggtttttttcctctagcttttcttttaagggcatgagatcccttgagcatgctcagtaggcatattttatccctgacattattgatgttgcacatatatctttttagaacatccaaattgacatattctaggatttgcaagaaatagtagtgtcatcactgaaagcgagaatggatggtcaatgtcacctagccaagcagtgatttttgtctcctgaatcagaaatcagaagtgtgtaagaccacagccatgactaaggtccttaggaagttaacctttgtggaattggatgctgttacttttcagactgactaatttcaagtaattttgacctattattcagctgattttcattgtcaagatatattctgtcaaaatatttttggaaaatacatgctctcagcataaatgaataatgtatcgactcaagttggttggaaatcgtgaattaaaactactctatcttctgcagctaataattcttggcactggtattatgtttcagagtggcaacacagtctggctgagtgttctgattggtcacagaatattaatcggctgcagacatagtgtttagggctccaatttacagatgacaagaatgatagctttcatttgtatgcaaagactccaactatctgttcagaatgatcagatccttctttagtccccactcatcctttactttttaatatggaaaaaaaaggcaaataagagacccaatctccatcacactttacaaaactgccttgaagcaaatggagtgcttcagcgatcttgttgctgctttaatagcacgtatatttactattcattgggttatgacaggtgtgagctggtataagatgcaaactttttaaattaaagtgtagaaaatagagcgtattatatttaatattttgaaacttggttgtgtctcttgccttttatgagattttttttattattattaaccgaagagaattagaggctgagtaagatcttagtgaaatgtacccctgactttgatgtcatttaccttgtcactcaatttattcacaaactgctcagatatcctggttttatttgaaggtaagaagtaagcatcaacatgaggaaatacacatcatagatcccgaaaatggagcattatggttgaacctgagacattttttgaaggttaaatattaagggcttgcttgccaggagatggcatttggaatagatcctgagggctctgatcagatcaatgagtcaatcccttgatagagtcatgacagactagtaaagtagtaggaagagaaagtaaggccttcttagggtaagtggttcattgtatatatgagctggaaaggtattcttcatctcagatccccctctgttagtcctcatagtttcttaaaggccacatagtcagcaaccttctccacagtggatggctttcctccactgtgcttctaccttggcatcagcctagaagaaactgtgatagctgaccgtggactgaaatctctgaaaccacaaaccaaaataaatcatcctttcttcaaattatttctctcatgtgtttgtgaacaccaatgtaaatatctgacacaagcgccaaagttcaatataactctctgagatttggtattataatttagttcaaaacccagcttggagaaagttatgaacctttacttctgcttttcccccatccatcatttgcatataaactttcatcccatatgtataaggagagtatttgcttcaaaaacaaagtctctcttttattgaggaaattaacaaaaacatgagatatgggcctatcgacagtaagttatcggttagggaggaggttatgtgtcctaagcccttctgctaaactattaaatatttgagggggttgaaaggaggaatacgttttccattgctgtaaagagataccttgaccaatgaaacataaaagggtagcatttatttggggctgggttactgattctgaggtgaagtccattctcataatgccaggaagcatggcagtatccagacatacatagcactggaggacccgagagttctatatcctctatatcctgttctttttttttattagattttgttttcatttacatttcaaatgctatcccgaaagtccactataccctcccctcaccctgctccccaacccacccactcctacttcctggccctggcgttcccctgtactagggcatatgatcttcgcaagaccaaggggcctctcctcccattgatggcctgatggccaactaggtcatcttctgctacatatgcagctagagacacaagctctggggggtactggttagttcatattgttgttcctcctatagggttgcagaccccttttagctctttaggtactatctctagttccttcactgggggccctgttttccatccactgtgagcatccacttctatatttgccaggcactggcatagcctcacaagaaatagctatatcagggtcctttcaacaaaatcttgctggcatattcaatagtgtctgggtttggtggttgtttatgggatggattctctgggtggggcagtctctggatgatccttccttctgtctctgctccaaactttgtctctgtaactccttccatgggtattttgttccccattctaagaaggaacgaagtatccatactttggtaaagacaaagagaagactggtttccaggcagctaggaggagggtctctcaaagcctactccccatagtgataaactttctccaaaaagaccacacctcctaatggtgctattccttggtccaagcatattcaaaacaccagaaagtgctactactatcttctgtggtatactctcttaccaactcccagtacattgttctaaacccactctcacatatttgatcctagttaaaaatcccccaaaataaagtgacagtaacagcaacatttattaatgtggtatgggtatatgcaatgaggatgagaagaccatagaaataggaagggcactgtggggtttcataatcagaaagcacatcatatatgcataaaattgacaaacataaaactcagtaatttttaaaaataaaacatattttaaaatctatggctagagcatcagccaaggcacattgtgatagaaaaaatgaaaagaaaacccaagcttgacaaggtctcaaattgcctttgtcatcagaattagctgaaggagggcttgtaaatgtataggtttcttctcactcctcacccactggattcttttttttaatagggaaattgtaaattctcttaaccctcaggataattctggtaatcagacaataaattatttaatgatgctagcagttttaccaagcagattcaaagaagtataataatatacatgtggtatacatttatttttggcttcttttatagcaaatattcttactttaaggacctaagctgtattattcttaaagtttcacagtcttcagcaaatagcttccaaggacattgttatcatctgtatgaaagttgtggaaccaaacatgacaaaaatattacgtgggagaattttttatgagtcaaatctggaagtaatgcttattctatctcccatgtatgttgctttggctagaactcagacatttagtcacacctaactgcaagggaagttggcaaatgtggaggctatgtgctcagaaagaaaaaggaacagattttattgaacagatagctatccttttcataggaattatacaacatcattggattcggattcatttgacttgcacagatgtagggggtctgatatctagagacctagcacttgcattaatattctgtcactacggtcttgaaatccttaataatattttttggacaataggtcttacattttaacttttcattgatactcacaaactattttgttgatgcactttggttaagaatgtaaaacagagtcaacgagacacagcaaagggtaggaatttgtttggacacaaagatctgaacttgagcattctatactgaacccatgttgaccattagagcatcctgtctcagggtgctatcctgttttgcattttttatcagtgacttacatgacatgtaaattgtatttatcactttgccagatgggaggaagttgggagggacagttaattctttagaatacatcattcttattcaaaaagacctcagtagtttggaatgatgggttgaaactaaccagatcacactcaatataaaaaagaaatgcaaaacttttcattcacgtccaaaattccaactgcaaaagtacagtcttgggattttatttggctaagagcatgagcagagtggcttgattgccaaaagtactaattcccctcttagtccagatcacaaaaacttaggacccagaacaatagaagtattggttcaattgcacattagatgacaacttagtattctatctattgtgccatttttaggagggctaatgacaaagtaaattgtatccataaaaggatgtataaaatggacaaaggttttggaaaacatgtcacctaaaagacaatggacaattgaagaaacaataaatgttcaacatgaatagggggtggcagaattttaaggaagacaggaggtagaaagagaaggggctatttgcttagacattactaagaatttattctatattctttctgacaccagtaaaataggtctaaatggtaaagtgtaaaaaatgataaaattagctgaataaaaaactgaagttttaatataactatataacaacttaatcatataatttatatatatatatatgtatatatatatatatattatctaagttagaaagtcggggcctctttagccttccatgtattaggcaagagaactgcagtctttttaaggttatctacaactaaataacatgggcatgctgtaaattcactaagatactgttcagattatacttaacaggaacactagagacatactgtctaaattcttacattagccctgtttcttagtagctatgtcaccttgggcatatcacatacatatgttcctgatatcagtcctgattcagtcttacagatttcagtctgtaaagtagagatcccttataagtagagtttttagaaacattaaatggattaataaataagcctttagaatagtacctggcgcatagtaattgtatattaagtgttgtgcattattttccagaaatatattttataactctccactgtcttcaacaattgtaccttacattccaattaggtcaatttataagatgcataaaacaagagtagttttgtgggaatattttttaaagtactgaacaggcaactgaaaatattcctgtacatattcttagcagcccctaagaatggtctgtggcagcttggtttgttggatgtattgttgaaagttgtgacattaagaagacatttacagtttcataacacatatttaagatctctttttatataccttctagggtttctataatttcttattttatttgcttctcatattaattgtacagctatacaggtaaatttccatccccatcttgaagatgaggacataaaacaataggaatattatctgaaacgcaggaaagtttgggtataaagtactacatgtttcaggattccaaacccggtctcttcaattttatcccagagtcagagacaccataacatagaaagtgagccacttttaaattatctagtctgaggaagacagtatttaagctgatgaaatggcttctgttatcctgccaataatttgcctgtttgcttttcagccaaattgctgacatcttgctaaaactccagtcatccagctgaatttccctgtgattttccaagacccagtggtggaattgggggagggagagtttctgctagctcatccatttccttgtgcattattgtatatgtgtttaagcttatagataaaaagtctatgcccttagcaaggcattaagctagacctctaggcacagagtactataacatctcatggtatgggagacctgattttttttcaagttcaagatatttgctgtgggttctcttcatgtttgtcacatactgccatcttcccatcagcattccaccccttccatttcaacattcctactcacatacctatttcccgtcattcattcatcctcaaataattaactggttttcattcatacggggaaagacaactggatagtctcagtacaatttgctatcatttattaaaagcaaatttatcaattggcccttttcctagcatcttataagcacaatattatttaatcctcacaattccccaaattgggtgcatttcttatccttagttttgcattaaggaaacagtctcatcagaggtaaagaaaatgattcaggtcaaaggacaagtggcagagcatgaatttaaactcaagtattctttatctggagagtatgctttcagcagcaatgctataaagttttgtgacctagataagtgggtggcaggtgtttttgaaagttgggagagactttccttataaaatcctaacctacaagctgccatctgctctgaattagggtgcgatcagctagacgctgatgaacatcacagacatttccaaggtctggatagacataaaacaggcaagggtgaggagagttctgatgtcctgggaactgaatttcccttctcaagaactaagcagtgtcattgtcttctttaagactgtgtgagggtaagtggctctgtgctcctaagctccagctgtcaggctcatgttaaaatactgatggactagatgtccttagatgaagattctaaaggtctgattttcactcagatgtgtaactagcctgtcaggctaaaagcaaatcagcacacactaattcacctaaggcaacaaataccacttgcaggattttctctggtttgtaaaagcaagcaacccccccatccccccaacacatacacacacacacacacacacacacacacacacacacacaccaagaagagtttcctaaaaagccttttgttctctcacaaatgacctgatcacttcttgactgcagacattctcagggaaagcttatgttagctgttgaaacatccactggcatcaggacaactgggcagaaagccagaacagccttgaacacctgggtttctgtctatactggaccattctacagaggaagtgttagtctctagaccaagggatgaaaaggtcagatggcatggggaaaatgtacagacccttaggtaaattcagattacacttagaagttatttcatttaactccttataaggaaggctggtggcaatggcttacctgtcaaagcattagcctgacttataggatttcagacactttttctaaaacaagcaggcactttttctgagctttgaacccaatttcttatcaaagctatgccatggaataactaatgacagcttaggagatgccaatcttataaaataaaaatctagggccatcttcaaaattgtatttagtggacaatttttatataaggttaaattcaaataagcaaggcacctgttttgcaagagtttcatcctagttagaaatattgtacatttccctgtttcagcttctaaaggcaattcttgcctctggagttttccagttggacttaatatgagaagactagagagtcgaaagtgctttgtaagtttagtttagtcccccacattgatttttctacatccactaatcgcatcttcaaatcacacagcttatattttcttcttggaactgttgtgagcagacataattggcttcatttgaaaatcaatttcgacatcatatatcaacagcttatatttgattaattaaattagtgttcatcagtgttatgaagacagggaacatgctttgggacctcccagagagcttctatcatgtgggaaaaattaatcaagatttctaagggctgggtcttgacttcagtgatgaaaatgattttcagatattttagtgtgattgagttcaattaaaacactattgcatattcatcctagagagattaggagcaaagattctagatttaagttcaaacagatgagcttcaatgactgttctgcacattttgctagctacatgactgttgaatttacccaacctccttgaaaattttttctatcataagacaaaagtagcccttacctcatatcactattataagactcaagtaaaaataagattccacaaagtagttgtcagtaaaatgagacttaaatagtggttctaaccattagagtctagaagtgagttcttaggtaaaaaattaacttctccaagtctcattttctccatctttgaaatgtaaaaacaaaaacaaaaacaaaacaaaaacaaaaacaaaaactttcaatttataggtctatcttaatttagcttttgttttatttagtgacagggtctcaccatatgacctatactgattgtgaacttgtgatccttctgtgtctgccatccaagtgaattttggtgtcactgctaccagaatttttagggtaaaacaattgactctggcagctccaacgagataagcacagctaccaattcccagttcacccattaaaaggataagtagcagtgaaaagcacaggaaatttattcactatgataacattgataaaagggaaacacgaaaaaatggatccagtaactcccatctggggaatggacagaatgttgaaggtttagtagcagttaagaggtatacataaggaaaatgtcctggtcaagatatggtcctgtccaccattgatccacaattgcctgggcttcaggctctcctgcaaggtagtctctgaatctttcagaaatttgagaaatactttcctgagagctaaggttgctctctaaatgctctcaaacttaaggcttcctcttccaaaagcatgacatacttaacagatattttaattcttgtggtacattatttcagtaactcaatagccaaagggataggtatgaatgtctctctttagagagcatcttccttcctgccaaaatggctgcatcatcatgcctgacaacattttatagggtttgatgattatgcatttggctttctcttacgcaaacaaattagttactgacagttgtcaaaaataaatgcggaaatagctcacatggagaaggcgaaaaggataatgtctgtgattgacaccagctcgatttccacttcaaatcctgaatcaaataactctttatgttagaatggttctacacttaggaaaatttcttcctgggttctaaatatgacatttcgtttatgtactccaaaagaacattctgtgaatcacataatcatttttgtcatgaaacacttgaatctgaagatagtgtttacttaataccaacacttgtcttgtcatcctcattagggactattaacacatctacagagctaaacttgcttaagcggtattctctttttccggttcttttgcattacaaaccattacattgacaggctatgaatgcctaatgaattttggcagccataaagaaattaggcattaagctgaaaacaaaagttttaatactagcctgaaaataaaagtattaataattgtcttcatggatttttatttgaaatacaaacagtatatcaacaagttaatttggttgtaatgaaacctgtaaacaaaagtccatttgacaactatataaaacatgcaatacacatcttactatgtgtcagccaaaacacaacatttcttttccttacagtctatttaggcctgggaatgtagctcagttgttagaatgattgtctagtatgaatgaagcccttgacagactggttgtggttggatatacttctaatttcaatactccaatgcaggggcaggaagatgctatgttcaaggttatctttggcttcctacaggttctgaagcttacccaggttacacaataaccaatctcaaaagccaaacaagaaaaatcctactgatatttaatttgattatttcgggtggcatggagctaggctaaagaatgtcccttttcaaagagaccataatctcatctgctatgaatacattacatggtgttgaaaatggataataatgctgaaaatgaaattatggttgctacctacctggaaaatttatttgggagatccagacaaggctaatgcagtaacttgttgctgtaacaaaatagtgagaaaagcaacttaagaagggagtgtttacttttgctcacagtttgcagttacggtccctcatggtagctctggccacattgaatcagcactgtggaagaggggagagatgatttcttgtgcccagctcaagttttttatattcatccctgaactctagtccttcaaacagtatcacccagttttacggtgaatctttctacctcaattaacctaatcaagagactccctcaagagagagagagagatggccagagattcacttccatcatgattctaaatcccatcaagtttaaaatcaagattatctataaaagagaggagtaagagaaattgagtataaaatgatgaggatttagcttgcctttgctagcattgaggatgaaaggggaacaaacctaaagaaatgtggagtgtagaggaattctaatacagcaacatggctgctctggcaaggtatcacattcaaagataggatccaactagaatgcagacacaccacacacctttaatcccaaacaatgatgtctaattgagggggtagacaaagtgattaaccagagaaaaacttaacagaatgaatcagagataagatacatccaaatttcaggagaacagacaggaaagagggactactttatgagtactgagggagagagtctggaattcagttcagatcagattagttcagttcagtctatttcagttcagaccagttcagttaatgaagttcagaggcagtcttttcaaggggagcgattcagtcagaagccaagagaagcctatttgaatcattcaacttggagaggagtttgagcaagaacagctgagtttacccagctaaccagagcttagaaagagctagaaagagtgattttattcagcagtaacacttggagactgaagcattctaggcctatgttatcagagggagtctggaaaatgaagccttcaaggtccagccttgcagaagattagattgtacagaggctagaagcttccaagcctaggcctagggatggttagatagaaatgccgtgggctcagcccaagctatgtattcatatagcttaggtatggctctaatctcatcccctcctctaaggaaataaaatcaacacatttacagttgttactgtatggaatctagaaaacaaaaatgaaggaatctcactcctaggtatagtttatacacccagccttacccttgatttaatctagtgggaactatagcagaaaactaggacagcatacacaatgtcattaattccacaacatatatggtgatgttattttttttagacagggcgtcactatatagacacatcttgcttgaaacacactacatatttcagagtagcttcaaatagagactgttctgtctcaattatagtgcaattacaagtgtattctgccacatctggctctaataagctatatttaaaaaattaaaacaaaagaaccagtcttaaatctaagaacaatgaataatggtgacagtgtagtataatggttaccagcttgaactcaagggtaagctagatttgtgccctagagctatagtatatttactagctgtttaactttgggcaaataatttaatcttggtgagcatacttttttcttacttttcaaatactgataatcataaaacttgctttatgtaatgttgtatttaatgagaaaataaaggtaaaaggtaactttttttctttttacaatctatgcttaatgaaggttacccattgtgcagtgataaaaatattggacttttaaaatcttggattttaattctttgaggactaatgtgcaacctgatgctgaacatatccatttcttttctggaattctatttcttcatctgtcaaaactttaatgattggtctagttctcaaattacatatctttgagtgtcttatattcctatgaattgaaattctgagtgaaatcctagaacttcacagatcagcaaccataaaagaaaatgataatcttattgcaaggtataaaatgtcccaactccaatgtttaacctttcatatttattttaattctaactacatcccagattctgtgtacagacagaatgtatactatcctattaatttctttgataacaaccatggaatttctttgacatcagcaatatgaaaatcctgggagtattattttagagaaagaaggcacatatattacccaagaaagaaaaggcaagaacaggcaaaaatacattgtgaaggaaaagggtaggggctaccatcccaaactctgtttaaatttccatttctccccaaggttgttttttttctttaagtttgaagaagttgctttatgtctgagtagatttgtgctgaataaacaatcttctctccagagaaagaccctgtgtcaaatggcattgagaagaaattgccctacttttgtgctaaatcttttctcaagcttatgcattgctcaaactcaaatattagtagaaataaatatgggatctagagaaaaggtcatctcagggcaacttcacagcagccctgaccattcactaccctcagggcacatcttctgagttgcaaggaaggacacaggcactgagccagttgccagggaggctctgagctgtacaggggcaatgtctaagtaaattgcatgttatttgtccaggaatgtatcatagccctgctaaagggttgtttgtttattaaatgagataaccaaccttatgttctatgctggaaaaatatgtaaaggcttgcagggatgttaaattgtgtcagggatttttttttatgcaacaagaacgtgcttttcaaaataatttagtcctctaaatatgacttcctatctgcttctatattagttgttagttgacaattttgtctttctaacacacatataaaagatatgagccattttcatccataagttagatagtaaagagactttctaatgggagatagtgaagtgtgtgacacaactaactgaatggtttgacaaactccaaacaattatgagaatcactgcagaggctttttcttgtaattgaaacatctagagaaagcacccatttttgtaagtggacttaataaacagtttgtattattttgtctgcggttacaaataaagcagggtatacattagtttgggaagctgaatgtaattataaaaattaactgctaaagtagatatttgaagaaggtaataacaggatgaattgaaaacaaagcatgagttttcatggattatttttctttcttattaaaggacaacatttaattggggctggcttatagactcagaggttcagtccattattatcatggcaggaagcatggtagtgtccaggaagtcatgtggctggaggaggtaagagttgtacattttcatctaaaggaacccaggagcagactgtcttcaggcagctaggagagtctcaaaggccacccccacagtgacatacttcatccaacaaggccacaactactccaacaaggccacacatcctagtagtgccactctctgggccaagcttatttattccactccatggtccacataggcttgttcaaacatgtgagtcttttgggacaatacctagccataacataatgcaatatatttagttcaatttcagaagtcccacagtctatactagtctcaacaatattaaagatccaaagttcaaagtctcttctaagactcatacaatatctaaagtctaatagcctaaagaaatcaaaatccaaataaatatacctctaacaatatgtaggatatacattactattccagaccatcatgatgaggaaatactggagcgaagcaagacagaaaagaagctgggcaaactccaaactctgcatcaccatgactggagtcaaagtagtattctgatatccaaatcctttcagctttgttgacaacaacacagtactttgtctttggcttgttccactctctcttagcagctttccaagggaggtatcccatgcctctgacatcttggggtatacaaggaaatttcaactctacggttttttgttccagggtttgagatccacatgtgatctcctagactcctccaaatggtttacgtcacttctccacctctgcctcctgtagtactcaaggttctggttgactccacttcattgctgctgctgttcttggtggctgtcccacatacttacagtcacttcatctttgacaatgtaaaaaagaaagcatctttaataaatggtgctggtctaactggctggctctatgtagaagaatgaaaatagacctatatttgtcaccttgtacgaagttcaagtccaaggggatcaaggacctaaacataaaaccagatacactgaatctaatagaagaaaaagtgggaaagagccttgaactcattgccacaggggtaaatttcctaaaaagaattccagtggctcatgttctaagatcaacaattggtaaatgggacctcatggaaatggaaagcttctgtaagggaaaagatatagtcgataagacaaattggcaatgtacagactgggaaaaaaattcactaaccccccccccccacatcctatagagggctaatgtccaaaatatataaagaactcaaaaagttaatatcaaaaaaccaaacaacccaatcaaaaaatggggtatagaactaaaccgagaattcacaactgaagaatcttgatggctgagaagtagaattgggaacaaaacacccatggagggagttacagagacaaagtttggagctgagatgaaaggatggaccatgtagagactgccatacccagggatccatcccataatcagcctccaaactctgacaccattgcatacactagcaagattttgctgaaaggaccctgatatagctgtctcttgtgagactatgccagggcctagcaaacacagaagtagatgttcccagtcttggatggatcacagggcccccaatggaggagctagagaaagtatccaaggagctggggggatctgcaaccctataggtggaacaacaatatgaactaaccaatacctcccagagctcgtgtctctagctgcacatgtatcagaagatggcctagtcggccatcagtggaaagagaggcccattggtcatgaaaactttatatgccccagtatgggggaacgccagggccaagaagtggaggtgggtgggtgtgggagggtgtgggggacttttgggatagcattggaaatgtaaatgaaataaataccagcattggaaatgtaaatgaaataaacacctaactaaaaaaaagaaatgttcaaagtccttagtgatcagagaaatgcaaatcaaagcaaccctgagattccaccttacaccaattagaatggctaagatcaaaacctcaggtgacaacacatgttggaaaggatgtggagaaagaaacactcctccattgctggtaggattgcaaatgggtacaaccactctggaaatcaatctggaggttcctcagaaaattgaaaatagatctacctgaagatccagctataccactcttgggaatatacccaaaagatgccccaccatgccacagaggcacatgttccactatgatcatagcagtcttatttgtgatagccagaagttggaaacaacctagatgtcccatgacagatgaatggatacagaaaaggtgattcatttacacaatggaatactacttagctattaagaatgcggacattctgaattttgcaggcaaatggatagaactagaaaatatcatcatgagtgtggtaactcagagccaaatggacatgcatggtatgtactcactaataagtggatattagccaaaaataaaaaaaaaaaaagtatagaatacccacgatacagttcacagaactcaaaaaggtcaacaagctgaagtgtccaagtgaggacacctcagtcccacatgggagagagaagaaagcaatcactagtggggagggagggagggacctgggagggaaaatggacggtgtggggagagtcagggggagaggggaacctgatctggtattggacgagggaaaagaactgaagccccaagggccagcagaaagaatggaaacaggcatcaattgaggaatgtgcttgccatcccacagtcacatctctgaccaataattgttcctgtctgaaagaattacaggaatgataatggagaggagcctgaggaaaagaaggtccagcaacaggctcaaagtgggatccagatcaaggggaggccccaagacctgacactattactgaggctatggagcattcacaaaaagggacctatcgtgactgccctctgaaagacccaacaagcagctgaaagagtgagatgcagatatttccacccaaccaatgtacagaagcagctgacacctgttgttgaattagggaaggctgaaaacagctgagaagaagggcaatcctgcaggaggactggcagtctcaattaatctggactccctagatctctcaaacactggaccaccaaacagacagcatacacaagctgatatgaggcccccaacacacatacagtagaggacctccatgtctgctttcactcagagatgatgcacctaacccccaagagactggaggcccctgggagtttagaggtcatgtggggtgaggggaggtgggggaagccacgtggagacagggtggagtggggaggaggtgtgggatgtggagcagctggagggtagatgggggcagggaataaataaaataaaaataaataaattaaagaaaaatatatgatacccggacaccacgtgcttaagacataagacctggaggaactgagatgaaactgtccggacacctctttgagaactgcctgtaatagtttctgaacaagttgtgtaggctaccaatggagaaaagcaatatacattcctacatagctgtaaagcctatgaaccactaactgatcagcccaacaagacatcccgatgttttttcaataggggcacctatatcttcatgaaaaccaacaaatacccccattgagtttatacctgagaagtaggatgaaattcatgcctggtattttaaaactagctaattacccatggctaacaactcatagaccttagaacgcctactattgccattctcctaaaccagtataatacctaacagcattgtaagtatttactctttgtggtggtttggatatgcttggctcggggagtggtacttttaggagatatggccttgttggtggcattgtgtcactgtggaagtagactcttcctagttgtctgaagacagtctgcctctggcttcctttggatgaagatgtacaactctcaggtcctccaacaccatgactacatggactccaccatggttcctgccatggtgataatgaactgaacctgaaagcaagccccagttaaatgttgtcctttataaaatggccttggtcatggtgtctctctatagaaatggaaaccctaagaaaagaaattggtaccagggactggggtattgctatgatgggcttgaccatgcttttgtttagaagaatgtggatttgggtactttggatttgggaagcagtggaatgcttcaattggggtataatggaccatcctagaaggaatttggaagatggtcatgctgagcgtgatttgaactgtggaggtctgctgattcaagagagtgatttgaactctgtagattgttcttaggatgttttggtgaagaataaggctgctttttgtctttatcttaagagcctgcatgaggctaaggtgaatatattcagattaactgcattgacaaaggaagtctcaaaaaaaaaaacaaaaaacaaaaaacaaaaacaaaaaaaaacaagcccagcatagactttgtcctctggtttactgtggagcaatgggctatgcacagacagcctgtcttgcccgagctagtatctcgccggcaagaattcactcggacaactggatccttctacggcaaagcttttattgcttcaacataaggaagaccccgaaccaggaaaatggtgctgcttatatagccctcagcatgacatttcagcacctgctgtggcatgacagcacctgattagttgctcgcccatcacctcattactatgccctgagatgggcagtgactgggcgtgaattcactcttgcacttgcacataaggcttgtttactagttaggcacagtggaagccagtgccatcttataatggtgattgctcatggcagggctctccacaagcctggtctctagtcaaactgaggtcttgaaccccagtgatatccgatggatggtaatttccacttacatgggatggaaggtgtttgatcatgtctcctggacctctggttcctgttgaagctaccatccccacagcccccacaagagggacatgtggctagcagtcatgtagacaatgtcccaagcttctggctttcttgctagactcctccccacagttacctaacaatagcaagatagcagctcactataagaaggggtgcttggcccctcctcgattacttgggcttttacctctcttaatctctagcctttcttctctctctctcttccccccttctctcctcttggtcatggctgatctctttctctttctctttctaccttctctttttccccttatctccttgtggccatggccggtctctctctctttctaccttccctcctccttgcctttctacaataaagctctaaaaccatagactgtctctgctcatcaaggcccactgtgcttaaacgatgggatagactttctcataacaagctgcatctaatctcccaacggaaggccttcctgtgctccagctacagacctgaataaggactctcccctgtgtgggaatcacccagcacccaactctccctctgccctctttccttatctccggggccaagtgctgccctggggcccctattctgttctcagctcctccattgtatccagcgtgggatgccggaggatgagaacatgttacctgggcctgccccttgtccaccacccgtcatgtggggtcagtggcctaacacagccagatgcccacctggggccatgtggaaagtgtccggcagtcctcctgtgtcagcctgcccagagcaccggaactctggtggaatgaggacactctcctactcccctctttcccacacacccacagccctgaagtttactatcatgaagagcattttgatgaagcatagcaagctttgaagaaaaaaattataaaatccttggttcaaagaattaggaggaaccaaaaagtagaatggagctgaatcctatgttcaaagagacaaactgattaagacagtggtgaacttggggcaagttcccacccagttaaacttattgcttatatgtttgcagttgaacaaagaataattatgttaggtgttattacctggttattttcatttgaatatttaatctgaaatgaatacattccagaaatggtgagcacacttgtaatccagatcttgaagctggaaaacacaggcttttgaagaatagtagacataaaaagctttgtcccaggcatggtgatacacacctttaatcccaggagacaaaggaaaacagatctttgagttcagggccagcctggaacagaacaagttctaggtggagaaagttaaatccagccgtggtaatacacacctttaatcccagcattcaggagacacagccatgtttatctctgagttcaatctacagagaaagttctaggacttaggcagtgaaggtgttgaaaaacagaaagcaggtgataatgtaatataacaaggagcccatgttccaatgacagaaagcagcagaacttggcaaccttagtaacatggctctggcttaagagtcaagaatagaaggtactacttggacaattgatgctgattagttggagctacgaaattagtggtaattaagaagaaaccagcaacacagataattatttataaaataattctcagcacctttttcctaaactgccgaaaagtaggagaatcaatcataaaatttcggattattacttcaataaaaataaaattctctgattttatacacttctactaagctccattctacatgttatccaccactcataattttagaggattcttattttccttgtaatgtgtgtgcattcacagaaggatacttgaacaccatatttagattaagaaaatctatgtatttgggttttgtttttgtttttgtttttgttttgttttgttttgttttgtttttttcagaaaaatatattcctagacttaggtaactgttacctaatttccaaaagaaaatataaactgtattaatgagtgatgttacttttggtatgttcacagtttagaaactagtgcgttaattctctgttcagtgtatgaagtctttatactaatcaacaatatgggttaaaattgttaaatctctcttcataactattggaaacgttgaaggctctcaacaagatacctggcttgccccaattaaatgtgctcaagaaaagattccttttttttcttctccttgaaagactgtagctaattttcctaataaagtccttcattccctcttagcaccagatagtttatgattctcatgcaccttgcaactttggggctgatgcatagatgtgttttatgaccctatccactccccccttttctgagttactttatgagtttaggtaatgtagaagacacacacgtccagtaagcagtgtctaccaattaacaaaactccttcactatttcagtacttgagaactacattgaacaaatattgtgttgattagtgaagtgcaccttgtcttgagtagaacctctgtggcaaaatatgcatcttcaggacatccattaatagaatatcttccaaggaatattgttgacatagaaattaatgaaacatcgaaatggctatcctgctgaaagcaatctacagattcaatgcaattcctatcaaaattccaacacaattcttcactgagatagaaagggcaatttgcaaattcatctggaataataaaaagtctaggatagcaaaaactattctcaacaataaaagaacctctggtgaaatcaccatacctgacctcaagctgtactacagaacaatatgtgattaaaactgcatgatattggtacagcaacaaacaggtagatcaatggaaagacccaaaaatgaatccacacacctatggtcacttgatctttgacaagggagctaaaaccatccagtggaaaaaagacagcattttcaacaaatggtcttggcacaactggcagttatcatgtagaagaatgcaaattgatccattcttatctcattgtacaaagcacaagtctaagtggatcaaagacctccacaaaaaaccatagacactgaaatttatagaagagaaagtgggcaaaagtctcaaagatatgggcacaggggaaaaattcctaaacagaacagcaatggcttgtgctataagatcaagaattgacaaatggaacctcatgaaattgcaaagcttttgtaaggcaaaagaaactgtcaataagactaaaaggccaccaacagaatggaaacagatttttaccaatcctaaatctgataggggactaatatccaatatatataaagaagtcaagaagcaggactccagaaaatcaaatagccctattaaaaatggggtacagagctaaccaaagaattctcgagtgaggaataccaaaggactgaaaaaatactcagcatccttaatcatcagagaaatgcaaatcaaaacaaccttgagattccacctcactccagtcagaatggctaagataaaaaattcaggtgacagcagatgctggcaaggatgtggagaaagaggaacactcctctattgctggtgggattgcaagcttgtacaaccattctggaaatcagtttggcggttcctcagaaaattggacatagtactaccggaggatccagcaatacctctcctgggcatatattcagaagatgtcccaaccggtaagaaggacacatgctccactatgttcctagcagccttatttataatagtcagaagctgaaacgaacccagatgtccctcaacagaggaatggatacagaaaatgtggtacatttacacaatggagtactactcagctattaaaaacaatgaatttatgaaattcttgggcaaattgatgtatctggaggatatcatccttagtgaggtaacccaatcacaaaagaagtcacttgatatgcactcactgataagtggatattagcccagaaacttagaatatccaagatacaatctgcaaaacacaagaaaatcaaaaagaaggaagaccaaagtgtggatacttcattcctccttagaatagggaacaaaatactcatggaaggagttacagaaacaaagtttggagctaagatgaaaggatggaccatccagggacaaccccaccctgggatccatcccataatcagccacctaacacagacactattgcatatgccagtaagattttgctgaaaggaccctgatatagctgtcttgtgtgaggctatgccagtgcctggcaaatacagaagtgaatgcacacagtcatctataggatggaacacagggcccccaatgtaagagctagagaaagtacccaagagctgaagggatctgcaaccctataggtggaacaacaatatgaactaaccagtaaccccagaggtcttgtctctagctgcatatctagcagaagatggcctagtcggccatcacagggaagagaggcccttagtcttgcaaactttatatgccccagtacaggggaatgccagggccaagaattgggagtgggtggataggggagcagggcgggggtggggggtatagggaactttcaggatagcatttgaaatgtaaataaagaaaatatctaataagaaggcaaaaaatatctaaaaaattaattaagtaattaattaatgaaacatacccatgctttgacctggccatctagttttcattttttgtctctagtagcagcttatatttcctatttggttggggattattaccaatggatgattttgttccccttttacaactggccaatatctatcaacaggacaggttttactgatatctgatggagcagaggctcttatatatccagcaattcacagaatagtcatttataatgaataattgtcaagcacaatggttctcagccttcctaacacttttaccctttaatatagatcctcatgttgtagtgatctccaaccataaaattaattttgttgccacttcataactgtaattttgctagtgattaaccatagtggaaatatatgtgttttctagtgatcttaggtcatcagatgatgatgcccaaagaagttgtaacttacaggttgagaaccactggtttaccagaagtgttaataatgtggaagttgagctaacctgcttgtagaggagtcttctttccctcgtgatatacatgtctacttgattataataaaaattcaaagcttaactattcagcttatctttcttcaggtttttaaattttgaccaaaatgagaaataataaaaaagtaaaacacaataaagtggaacacatttgaaaagctataaaccactttatgtagatagtctgaaactattgtttaatcctccttgtgtgtatatctggtctagtttctttcattccaagacctagaccaacagatttcccagccatccttgagagctccctgtgataagttctccttttactgtaatcagcaaaattttgttccttgcaatcaaagaggcctgtgggaagccctattttcaagtgaaagttaatttggagattatgtttgtttattctacaaggtcaaatattactttgtatgctgacttattagaggcatgaacctcatcatctaggagattaaaactccagttgggatgacttggcatacccaaataaaatgaggattagtttatattcaaggcaatgcttgctatttgccagatgaatagttcaaagaacttgtaaatactttgggatttaagacaagaaaaaaaattagcttttgtggttaccagggaagcttttgttggaggttaggtttcacaatggaagtgagaggtattagggagagaattgtggacatgttgataccagataaacctctattcagattgctgctttggaaatcaaatatgtgggaacttatgtgcaagttatttatcaaatgtaatgtaaaataccctagaataacatgtaacagcagattctaaataaacaatttgtcttagtgaacactcaattgctatgaaggacgccatgaccatggcaactcttataaaggaaagcatttaatttgggcttgcttacaatttcatagattttggtcattttcagcatgccaggaagcatggtctcatgcaggtagacatgctgctgaaggaggagtttagagttctacatctggatctgtaggaatcagaaagagagcgagacaccaggcctggttttgagcatttgaaaccccaaagcctacccctagtgagacaccttctccaataaggccaaatcttttataatccctcccaagtagcactacctcctcatgaccaatcattcagctaatgatcctgagggaacattcctatttaaacaaccacatgattgctttggtaactagtataatatgatatgaggaaataagtttgatatgtggggttgatacgtttaaaagtaagtaaaacttcaagaccattttaaagactattttatagttgtcatgatttatgttcctctgtgaaaagttgtagattttatcttccagtaaatgtacaagatatttttaggtatgaatagctaaatgttgctataaaaagagaagttttggtatgtgatttcaagtacgctgaaaatagtgatttcagtatgtgattttaaggctgtggtatggaataggctttgtgggagtggtctagttgattgaccttaacaaacgtattccaaaatgacatcatccacagaaattaatggctgcttttcactctatcccacataatctttttggaaatctaattaagtaggcaaatgaaaaacagaatagagcaataaaattgtaataatagtgtaaaatgtataggcaatgtaatcaactcattcatatcattcaataaataatgctactcatatcttttcactaagtgcatggagttgtcaaaccttttcatctgcactgaatgatctggaggtgcatggtgtaaaccattgctttcaatggaaaagaagttaatttgagcagagtcctcaagagtgttagtgtcaagcacataaaaactcacttagggaacagcagacagtagctctagtagcttcactaagcacattaagcccagtgtgttgctatactctgtagagcaattatatttaaggacaattaaacacaagcagataagcagctacagatggaagtacaggggagggaatacagactgaaacatgtgtattaaactaaacccctagtttccattctttcaatcacaaagtaacatttagccgtacccaaattagtctctctcaaggtctagaatgtactggatgaattgtctgataaaattctaaatgtctactcagttgttcaggaggattggtatccataaactctgtcttcatttcctaagcagtaattgtttgagaataaattgaagaaacagagtcagagtcagagacagagacagaaatagagagacagagatagacacacacacacacacacacacacacacacacacacgagagagggggggagagagggagagggagagaggcgagagggagaaaaaggagagggagagcagaggagaggagaggagagggaaggggaggggaggggaggaggagaggggaggggaggggaggaggagaggggaggggtgaggggaggggaggggaagaggaagaggaagaaagaagagaaagaggagaggagaggagaggagaggagaggagaggagaagagaagagaagagaagagaagagaagagaagagaagagaagagaagagaagagaagagaagagaagagaaaagaagcaaatgggctgtgctgaccatgatagcatgtattttagctctctaaatgttatcattatgtgtggtgctgataggtttatctctaagctggtggtcaagagctggatgaatggctcagaggctggtttattatcatacatgcttagtacttctggcaactcccagtcctgagcatgatactaaaattaaatgaggttcaacacttacatgtcctatagggaattgttggactccaaatgcaatttcattttctctctctcatgggttttggattgaaaggtgtatatacgtgagaattcctaaagccatcataactcagttgggtgattgccatgaaaccacttgattagcctaggaggcacagtttaattactgtggactcaaggaggctagaattcttggtgagtgttctcagctatgtcacctatctgctgcttacagcatgtgtgtcctcctactcatcctgcaaatgaaggatgttggtcataaaaccacataaatgaaatattgtaaacttcattgagatttgtctaaattgactaaaacttgaactgactcttttatagttctaggacaccacatcagacccatatgctaatgcatttaaaacatgtttgatatttgaacatatacatataagatacttaacattatcccttaatataaataaatatgactttagtaattgatatttaattgtgaaattgaactaaatatctctggagatcatgttgagggtatgtctaggagccaacaatgtccctagatttatatcctcctgagactcgagaagcttgtcatttctgcacatgaagcacattccttccattccctgtctgccattatactcaaaaatttactgatgtgaatttgcaaaaaaaaaaaaattaagaacactctccagagacccttggtgtctatgatttggatatgtaagaaaaaataggaataattctatagggaaataaaaattactttttatataaatgagatgtaaattgtctgtaatttacttcacttcaaccatgtttttaaagcatactacatgtatactactccaagtatattatttattttatttgtaaggtcataccataattacatcattcccctttcccttttcttcttccaaacctacccatcaatactcattatttttctcagaattcatgccctctttttatttaattttgttacatacatatatgtgtatatatgcatatatgtatattcctgaatatattccttctcagtctgcataatatcacttgaatgttatgtgggccacacattctgcaatccccatatctcccactattcctcagcaaacaaattcctcatcttagtggaaaccacttttataaatatgtgtatacctatatatatgtgtgtgtgtgtgtgtgtgtacatatatgtgtgtatatatatatatgtatatatataataaaatatataaatatatatcacatctgatgtgattgtattttgaattcagatatttaagcttttattctttatattctaaaaataattaaagatcatattattaaaaatgactggaaagaatacaatatgaagataatataatagacatttaggtctgtgtaaattttccacaaatatgtttgatttttaaattgtttaagttttgtaagagcaatatatgttgtaggctatcaatgaagacttattgaaaaatgcaaactattaattcactaaaatttttctatcttgggtaattaagcaagatggagcttatgccatacaaatctattttctccatatctttctggtatatttttgattatgaacaattagttttgagaatatcaacagaattttgtatttctataaccttaagcatcctgaagcaagacaccactttctcttctagacttgtaaatatgagacatccctttcatatcagcagcaatttcctaaaaagccaattaagaaaggtttagcaataatcttttataacctagcccagtgctagtcctcttgtgtattataaagatctataaaacattttaaattggtaaaagcagttatacagcttaagcaatacataaatacagtaagtattgaactgaaatcaggctatgaataacagggtgaaataaggttgtctctatgacaacagtacaattatctttatgtactccaagcactctagttgatttcttctagttacctctggtttgtttcttctttttctttcttttaattttccagactccatccttgtctcactcattgtttgccctgcctcaactgtagtactgtgtcgttttgttttgttttgtcttgtcctgtttttgacaggatttctctgtgtagccctggctgtcctggtacacactctgcagaccaggctggccttgaactcagaaatccgcctgcctttgcctccagagtgctgggattaaaggcgtgtgccaccacgccccgctagtactgtgttttcttatctacctgtgttctcccccagcatgtatctcacatactaagttaatcatcattagattcactacctttgagtcattgttttattccaagaattaacaatgacactttagcctaccacctcatatccaaatctatctgcagatttcttatgatccttaagaatttcatccttcactatctatgtactttcatgtccattttgtattgtttctgtcatgagcaattggatttctgcatcacccattcagttacttctcatcagaccactcttttgtatgcaaatcattcttgatatctttatcactatgatatggattgtgttgttaagtttcccttaatttcttctttactctctgcattcccattttcttttcattctttaagtttcacatgggcatcaaggtcccttcataaaacttcctcctgattctctcaaccagcattgacccctcttttctccaagtcatgtatgtatatatttcttactatgtaggtgctgcaactacagcctttcattagatttcatcatggtttgttctctttttattttgtgctagattataaattgagatcaaagaagcatattttatttccttgtctgttaacccaaaacatctgacttggtaaacaaaagattctggcttttaaaaatctgtcactaaagaatctatctctcctttcttttatcacagaagattaaggcacagaatgggtatgaagtagactcttagaagccttttgcctcgggaaatctccactgcaattcattaagactatttagtgccagagagtaaatatgagaatgtgatgtttctctgattttactttcaaacaatacacttcttgatatagaaatgcttataaaaatgcatccaaaataaatagtccatttgttgtacatgttgaaaaatacagctgtggagatagcgtaacttaaatgaattaatggtgctctaaaattcctgggaaatggatattgtacccaagtacaaacctgtctaataaatgtttacacaccatcaagtctaaaaacattcaatatcatacatggtagaatattctttaccctataatttgtctcaatttttccattactttctttcattttctcttctagctttactcacagacaagcctcccaagccattgttccccatggaaaatcagccaagtgttatagatgtccagctgggtaagtttccttctgggaataataatagatcctaaacttgttctctgttaacagatggggaaaattgcacgaaccaggaaaggtttattgccactgttattacatgcaaatcaatttgtgttctgctcatttataaccctggcattcagtacaatagcagtttaagggaatgagtttgtattgcatcaaggaatggtaatactaatttgttacactgtgtattaagtgtgctgtacgacagagctctttaactctgtgattgatagattcatagtcgtcttgtattggtgattggtacagaaatattttcatacatgtcagccaaaaaaaaattatttggagaccattaacttctggaggctaagcacttcataaaagacactgcacagtgcagcctttaaaatgatttgataatattatttcaacaacacaatccagtgctatttaaaatccattttaaggacctgaatatttatgaatcatatgatgtcagggtcagtaacaagttgattcatgaatgctactgtctttttataatctcaaataagaacataaaaggctaagggtgtgtgtgtgtgtgtgtgtgtgtgtgtgtgtgtgtgtgtagcctttttccaatccttgtgatttcaaagaatttaggaatgaaactctgtggtagacctctttggttctcttacaaaatgtggcctttaatctaaactatattacttaacatttgtgagctttctcttatcttcagtttaatcttaatattctcaagtttttcaattaaaaaacaaaacaaaacagaactgagtaaattttagaaaatccatgttcttttgcaatttatgaccttgatgggtcctaccaattatacagacaagcaggattaattaatcccaatattcctttcttgggaaattttttactcccattatgattttttccaagcaaacttggatttggaaaggtttattcaatcttcaaaagaggagaaagaaaattatgtccctaagattttgttcactactctaaaatgtagttttcaaatgctgtctaccaacatgggtactcaagttcagtctgttttaaccaaatttgtgctgtgagtggtataataattcctgtggattatttgtaacatgtacaatatatttgcttagtttgaacaagtatttcagcacatactaaccacagctcaccaatattaccaccttacaaaattattacatcaatttggttctgatacaaagtcaaattttaattct

SEQ ID NO: 746 - DNA, 935293 bp, mus musculus; identical to SEQ ID NO: 745

SEQ ID NO: 747 - DNA, 935293 bp, mus musculus; identical to SEQ ID NO: 745

SEQ ID NO: 748 - DNA, 935293 bp, mus musculus; identical to SEQ ID NO: 745

SEQ ID NO: 749 - DNA, 875 bp, mus musculus
ctggctggccaacctcgagtctctcctgtaacgtttccccatcctgtgacccttttaagaggcggatcccgcagtgtccttttcctctccgcttgctcgctcgctcgctggctggctctctctcccagccacctctacccccagccgggtgggcggagcttcgcgcgagcgtcccagagcccgacgaggccgcggcagtcgcgagcgagcatccctagcgcttgcttgtaggagctgcgtctgcagtagcctggccgctgacgctgcgtgccggctggcagggcagcctgcgacctcgctggccccgcgcccgctgctagccgccggctccccacctggttcgcacctagtcccagcccgggtcgcctgccgagtgcgcgccatggggccgccgcccgggatcggggtctactgccgcggcggctgcggagctgcccggctactggcttggtgcttccttctggctctgagtccgcacgcgcccggttcccggggagccgaagccgtgtggaccgcgtacctcaacgtgtcctggcgggttccgcacaccggagtgaaccgcacggtgtgggagctgagcgaggagggcgtgtacggccaggactcgccgctggagcccgtctccggggtcctggtaccgcccgacgggcccggggcgctcaacgcctgtaacccgcacaccaatttcacggtgcccacggtttgggggagcacggtgcaagtatcttggttggccctcatccaacgcggtggaggctgcaccttcgcggacaagatccatctggcttcagagagaggggcttctggagcggtcatctttaacttccctgggacccgcaatgaggtcatccccatgtctcacccgggtgagtgca

SEQ ID NO: 750 - DNA, 60375 bp, mus musculus
tctccctgtccctttgcttggaaagaaaacgggtgcccctttttttgcccccactaagtagagcagggtcctcccgagagtcttcaggtgtaggggttgggtgcaaaagaattcttcagaatttaatttgcctctggtggaaaagggtaagacaaacggggtggggtgcttgggggggggtcgcagaggctggcacagttggggttttcgcttcttttcctggtgtttcacaagggtgctttcctgggattaagggtgtgggagggtgggcattggcttttaaactaggagggagaacattgcctgggaatcgctttgcggtataaaaacggatttttctcttctctctgggtttctcttcacatttcctatgaatcaagtacaagattatgttacagtactcagttaacctcattgtaattttttgtggaaactttagcttaggagttctctgcccagtggtcttggatcccaagtagttcttgttatcagtgcttttgtttgttgcctcctgacaaacctgatttagcttcttgagttccaaggcaggtggttaatgctactgaaaataaaataaaataaaataaaataaaataaaggcccatactttgtaaaaagtcatccaggtacttctgaaatgtgtggacatggtggggtgactatttaactcccttcaactgcccttccagaaacctcctttttgtggtttgtgatcctaggacctgaaggacaaagtgtgtgtgtgtgtgtgtgtgtgtgtgtgtgtgtatgtgtgttggtggtggtggtgtgtgtgtgtgtgttgcaggggaacaggggagagaagggaagagtctaataacaatgtttcctggctgttgagagctgggcctaaagtcagaccttgattcaaatgtctgcgctggggcttcctagtcctgtgaccttggcaacttatctgaactctgagtcttggtactctcatcagtcaaatgagacgggataataagaaaccgattatccacaggtttgcctctagggtaaaaatgaaatcaaaccttctagagtctagggcagtgtaactaaaggttagcagagacagagactcctttaggagtccccgaaggaaggaatttagttatttaactgcatgagaatgtgtgttttgcttgcagtactaccactggcttggcctggagagctctggccctgagtgaggggctgtgtggcacaatggaaagagcactgaaccagaaccccagagattggagttcctgtaagctccctcccttgctttgctcagctttgtgacgaccttgtccaagctacatgtcaaatggcagtgtaagcattgggaggtgggcaccgggttggcagagcatgcacagatacagcagagataagaggacacaatggtcgggatcagctctaaaaggcttcagttcttagatttagtatattgattaagggagcaaacttatctttcctagatgataatgcattgattagaatgcaattacattttaaaggctactcaagttgaataatgaggcttaggaaaatttaaagtctttatttggctatgcgattttacaaggatttgacttagttttctccaaatgagcttcatttgcatgaaggattctcagtggaataatatattttatttagagcgcgccaggttaaatgactggacttgtgtgaaggatatttatctggcagttttaggagacatgattaacttttggtgagctcctactgtgtgctaggctttccatctacacattattattattatttattatcagggactatggtatagtaggaaaaacagacattcatcaaagtcaagattgacagtccagttctggatttaacacacaatagctttgtgaccttggccagcttatttaaccttattgagtcttggctcccctatttgtaaatgaagatgatatttatgttgtgataatgactaagaataacatataagctaggtagcagaggagaaacatccataaatgctagttgcataatagattaatggtaagaagaagtgaaaagcgaatatccaaatatatagttctccagttaccagtttgaagacatggatgtcctgaaaatctaattaggtcttttgcatttccggatctcatataggaaggaagaaagtcacaagtgcgctgagagatatttgggtacttttgaagcattttagtacccgaactgatgacacaaacaatattgctgttatatgaactacccaaaaaaaaaaaaaagctaacagattacttttgaggcataaaatgacaattctctatggaactcctagagaaactacttttcagcatagggagaaacgacttcattcccatttgccattgaggatttggaacgtgttgtgtgctgtttgcttttctctctcctgagaacaaatctggggctcccttttaagcatctgcttgaccatagtgggatggaggtttaagttttaattcattacatattacatggggccaccaaacatgaaaagccattgctgccttctttgtttacgctcacaggggctacacaggaatcatttgaacagaagacctaagctttcacctaccataactggaaaatcttttatacccattgtttcaagtgattgaaatacgtggtttgaaaccatttcttttgttttttgtttacttgttttggaggcaagatcttactgggtagcccagagaggcttccaactcactctgtaatccaataacttcaggctggctgtaggttgattgtactgcctgttgacattacaggccattgccatgcctagcagaacctttattcattcattcattcattcattcattcattcattcattctgttttggagaaattttacaatatcgagcaatcatttaggaagaggaagctgtagtttagtggatgaaaaggtgttctgctctctgaggatggtggtgcatgcctttactccatgccaaacagaggcaggcacatctgttatctctgagttcagggccagccagggctccacaaaaaaaccctgtctcaaaaaataaaaatcacacaaacgcaagaaagtgtagtctactatcaacttgtgcaaattatatctgtatcttattatgattgcaaactattcagaaaacccagcttcacatagataaggcattacaaaggatacatatgaagtaatagcttgctgtggaatacctgaatatatatatatacgtatatatatatatatatatataagatatacatatatatgtggaatatatatatgagatatgtgatatatatatgaaatacatgtgaaaaatatatatgaaatatatgttttatatatatacgtgtgtgtgtgtgtgtgtgtgtgtgtgtgaaatatatatatttcaaccaaagtgatccaggaactgagaagagaattccaaggagaatttgatagcaaagtttaactattcagagtcacttcaaatatgaaaatcagatgagaagcagcaaaaatttagagtaagcactgcagccatctaaaatgtcgattttcacaatgaagtgtggtaagcatgccttctctattgcacaacacaaactgttctttctcagatcaagcagatgggcctaagccatgtctgctgtctaattgagctcagcctacagattgaagtgatctgtgtacttgctggtccaattttccttgcaccaataggggcaggcatgggtttcttgaaggacccatgcagagctacagcgttcctcatctatggcacatttacaagtacttgaaacatgtgcaaaaaggtgataggagaagcagcgtttctgggggctttagttttttaaaagtgaatgaaataaatagtgtatgttaatgattggctgctctttcatcaagcacagtgtggtatataaaagttgcttgtatactttattgaacaatactatatgcattagttaaaagaatggggcctgccactcactatttctaatctctagaacacttgttttacttctctgaattctcttattcaaggtaggcacattttttaaaaaaaaaaaagaaatctcttgaggttgtaggattaaatgagatagtgttgacgaaatgttcttattaatctcagtaagctagctaaatgcattttataaaatgaaaattgagtcctatgtttagagaacaaaatttgaaaatgagcagcctatggtacttcaaagtctgcataactcaaaatcttaatttaaaccctctaggcagagagtagacgggagatatttttttttttaacaaggaaaaactcctttgatcttcctagctttgacattctcttctttaatagcttcttttcagtcaagctaccaatcttttccttttccattcaaaaagaaccttgaaatactattggtttgagctatctcactctgtagtccaggtggcctcaagctcactgagatctgcccacctctgccttcccagtgctggaattaaaggcctgagccaccaagcctggccctgaagtttgcttttagactgacttatccccatcccaatatcccagttccttctcgactccttttttctttgcttcttgaataaattagaataagttgattaaagcattgggtggtaatgatttaccaatatgaaataccactgccaaatccatttccagaatatccttcatagctctttttcattgcacctcacagcccgtcccccccccattataacagctgcagcatccagttgatggtatcactttaaatactgtcacacagtccccttctctcttgtgataattaataccctgctttcagttcctgtgtcttctcttggagagacacagaagcggctagcttcctgattggtctccttgtctccggtcattttcttcctgtacacagttcttccatgttgctaccggaacgcagctctgatcacataaatgcccttgcctatacattttaaaatactttgctcagcataacatacacaactgaattggtcccaaagtcattcaaaaactttatatccctctttactcctatctggcctctcctagtatcagtggtttaaatgtgcatttttaatagttttttaatcgttgtgagtgtgtgctctgcatgccgtagcatacagggaaactcgggagtcgattttctccttcaccttagagtctggggatccacctccagtcatcaggcttgggcagcgagctctttattgagttttctagatggggtttctctgtgtacccttggctctcctggtactcatggctgtcctggaactcactctgtagactaggctggcctaaaacttctgagtgctgggattaacggcatgagccaccattgccgggctgtgcagcaagatctttaacatgctgtttgagttcacttgagttcacttttacccatgtgttctaactctgctggtcagaaacccattcatccttcaaatttcagcgcaaatgcttcctcatccttgaagatacttttttttcctttaaaaattgcttagctttgtttatttacttgagacagggtctcactatgtgcgcctaactggcctgaaagtagatacataggctaggttggcttcggccttccccttgcttgggcctcttaagtcttaagtcttgggaatgcaggcatgggccagtttgtgcatgccagtatcaattttaattattgcacactaattacacatatttatgagcctcaattgtggcatttctatacagcccccctaactcacccctgtagtccacacctgaaacaaaatatcagttcaaacagcatctcatctcttttcatactttctgccttctgctggttgttatttgttgatatatatttttcttcagggtagatggtagtcatttttatgttttaatttttagattcttcataggagtctttgttctgggtgtactttagaaatgccttttaaattgccgtcagctcccaagaagtcaaatgccagagggtcatgagatccactagaaaggtatctcaggcctggcaatgggactgtgttttattgagcattattaactctgtgtgtgtgtgtgctgtctgagtgtacgaaaaagagtaaacgccatattctgtgaagaatttaggatttcgtaggatgaagaatatatgataaaaggatagaaatatttcaaattagaggctccttaatttctgtagggaccaaataattactaaattctacttttttttaaagcaaaatgacttgggtaacaagtgaaataatgacaaatgaattttagactttttacattgtgctttccctgtgctatttttggatgcttaaaaaactatgccagccttcaatttgtatctccaattaaaatgcttccatcgaacatgttcaactttgaattccctagcataaaatgagttcacttttaaggaaagaaatatagctagatcagtacattgatttctttgcacatatagttattttttcctcctctatctctgggaaatacagatgatcacatatctactatcacatttaacctctacactccctatctcctttttgattttgttcccacttctaaaatgataaaaaattgtaagtaaaagcattgagcttcgctatggaatgtagtgtacatagtacaaacatacatttctttgttattttctgattacacagctaagtgtaggtaagatataaaacacatgatcctccttccaaagcacagaaggaaacaccattaataattgttcttgtctgtttttctatgtgtaagtatagcattatattttacatttatcatagtcataattttcataattaatgctatgttaggaatattcagaaaaattaaaggcatacaaatgtgaagaaaaacacatttttcatatttagtgttttttatgttttccaagtatttccaagtatactattattattgttattattatatctatttatttattttttatatctatttttttcttttttcccatcaattcactgtctcaattgtagcctccccttgtcagttccctctcccccacataactcctcccccacctccctccccttcttctctgagaagggggaggtccccccaggtaccagcccaccctggcacatgacatcactgcagaactatatatatcctcactcactgaggccagacagggcagcccagttagggtaacaggatccacaggcaagcagcagcttttagggtagcccccactccagttgttcaggacacacatgaagaccaagctgcacatctgctgtatatatgccaggggctaggtacagccatgtatgctctttggttggtggttccatttcttggagcccccaaggacccaggttagttgattttgttggtcttcttatggaattatttttacattatttatttatttattatttactttgtttgtttgtttgtttgtttgtttgtttttcgagacagggtttctctgtgtagtcctggctgtcctggaactcactctgtagattaggctggcctcgaactcagaaatccacctgccaagtgctgggattaaaagcgtgaaccaccactgaccagcatggaattatttttaaattgtacatatatactgtgtacaccacagccctagatcaaaacccaatgcttttaattacagagtttttggtctctcagctccttctccagcactatgtctgcctatatgccaccatgcttcttatcatgataaaactgtaagccagcctcaattaaatattttcctttatacaaaaagaaaaaaggagttctctcatagttaaaggttatattaatttactagggactggaattgaacctggcttccattagctagcagaaagaaagtgcaatagttggataaggagcagggtgatttgcatcagttaaagcaaaaatatgttctgtataaatggttacataaagatatactcaagagttctaaaatggtctactctactccatatgcattgtctgttgtgggtttgttctcttgaaagatttttttttctgagtcagggtatggtctattccaatctgccctccaacatactatgtagccatgatgaccttgaagtactgatcctcaagcctccaccactggagtgctggggatacgtgtgtgtgtgtgtgtgtgtgtgtgtgtgtgtggtgtgtgtgtgtaataccaagctcagtttctgcggtacagagtgtgtgtgtgtgtgtgtgtggtgtgtttgtaaccaagctcagtttctgccatacagaggatgaaagccaaggcttcttgcattctaggcaagcattctgccaactgagctttgatggatttgatcagcatttgtgctccagttctctttctcttgacattcctataggtgatatcttttcttacagttgagactttctcccatcagttgaaagtagatttgaaaaaaattggattctgtctacccaacagtagaatggtcttggagttttttccaaactttgatagggttccatgtattttcagagaggattggcactgggttagagattcagcactgaaaaacagaatatgataatttatatgtgcatatataatatgtacatacaatatatgcatatataatgtatacatatataatataataatgatatatgcacatgttatatatatatatatatatatatatatatatatatatatatatatatatatacacacacatatatatatagcatacaaactaaaaaggtatataaatcattagcttgaagctcagtaaatttccacaaatgaaagcacttgtgtaaactgtacctaacttgataagtgaaatgatattgaatctcagaagacaagtaaataacccaatatgaaaaaggtttgtaccacagttatcaactgggtccaatcagtcacagaaacagtatggtgattgtcctcccatacatagtgttggatgttattaccaaatacatgggtatttttatgtgtgcttgttcctgggtttgttgttgttattgttgttggaaagaatattaaaatagttcagagctgctctacttttccccacaacacccactttggagctctgcatgagactcttttgtttttatttcatgtcccactcacttcctttggagctgtatatggccttctatgcatcgcggtatgtggtactgcttgcatttgccaatagactaactacaatattgatttcttagctaaacaaagtctggtgattcaagctgagcagtgggaaaccagatgtaattggaggctatttggttcagaatctaattgtgaattacttggttttaacacttgaacaatcagggaccaacctgtgactttgagttaatgctattcattttgaccttttcggaaagatgatggtactgaaatttcttgtgcctttatgatctctctggaagtggcttagacaaatgctgcctgcaattaacgatatcgtggcatttaaaaagaaaataacaccatattataatcattgttggtgaaaattacaggttattttcctcttccttgtttttctgtattctctgatttcttagtatgaatatattttactttcgtaaccagaagaaatgttttttaaaaaaacctcaatatgtcaatagtttgataaagcttaaagaaaaaattaatgctataatataacaaaaacatataattatagaataggttacagactgagaatttaggaattgctgtggccttttagatacagttgtatggttattaggttacatctttctaaaccctaattgattttttatatgtataaatgagactgcaacactaaagaacttgaaggcctacagtcttcctattttgttatgaaatgtttctcttttcttttgtattttaaaatttttttatcttccctttgtgcacattgaaacatagatagctcatctttctttctattttcctttcttttctagaagaggcttgctgaatctcactagcatcctccagcatccattttattgactacttttaagactgagacttactgaatgacttagtataaagagcatatatgttgatcatttgtacccagcaggactagctgctctgatacagtttttgtcactctagaaaggaggatgcatttttactagagtaagaacaagagggaccttagtgctcttgttttatactttattaatgatgaatagaacattttagctcattaaaattgaattacttcttaatttccattaaaactactttttcttatgtgaaactccactagtttgtgattcacacaagaaacccttgaatatataggttgctgtggtgccattttttttttccttttaagaaacttgccccactttctgccctattctctacctttactgatctggttaactgtaccttgggtactcttacactctgcacatacaagcatgttcttattctttatcttccccttccttctatctctcctccttcccctaaattctcccgcccctctttccttagtttctgatctcccttgccttcttcctttttaaaactgctgtctccttgctgctgctgctgcttctgctgctgctgctgctgctgctgctgcttctgctgctgctgctgctgctgcttcttcttcttcttcttcttcttcttcttcttcttcttcttcttcttcttcttcttcttcttcttcttcttcttcttcttcttcttctccttctcctcctcctcctcctcctcctcctcctcctcctcctccttcttctcctcctcctcctccttctcctcctcctcctccttcttcttttggtttttcgagacagggtttctctgtgtagccctggctttcttggagctcactctgtagaccagactgaccttgaactcagaaagccgcctgtgactgcctcccaagtgctgcgattaaaggcatgtgccaccactgccaagctcagctccttgcttcttttgaagtaaaatgaatcactatgtatcagtgctcttgatatataattgaccttgagcatgtagttgcactcactcccatatctgccacgaaaactccaaccaactatgtaatcctcctgattaaatttaccttatcatgttctagtattcaggataaatctgaaatgttcttgcttgttttgctttaaatattatagagatatgatttttggaaaagttttcttaaatttggggttaagtaatattatttttattttcttacattttagtcctcattacattttcaacatgcaacagtctgtgtgctcctttgaacatccaatctctttagcaacattactgcgaggaaaaaaagtgttttctgtagttccagataattagcttacggataaactttagatattacccattagtgttttcatgttgttaacaatgatagtcctgccgctcttcagcttattccgtttcttccaattgtgctgctttggactttattgtattgagtttctttgtcatattgatcatggttctccctcacctttccctgtggttcaccaggaagaagttttgtttttctaattttggatgatctctgaacataatatttattctactaacacttataatattcttaattttgagatattttatttacttatactttaaatgtatgagtgtttgcctccatgtatgtctgtgtaccacatgcctgcagtgcctttataggccaggtgagcacgttggatctcctggaatggagttacagattgttgtaaactaccatttgggtgctaagaacagaaccagagccctctagaagatcaactaatgttcttaactgctgaatcatctctccagcccctattcttaaggttttaatatatatatcttaaatttgactcgtgcttcagttagccagtagcttttcaaatgcatcttttctcttcatagaggatttaaggtcatttggatggagatgaagattttcattcatacataaagaaagccatgagcaaaccatctataacactgttcccaaagtgctcttctaaagagtttttgcatcaaattcttggtttccacccagtctatttcatttttgcaagcaagtaagagatgtgagataacagaactggccaatgtaaagattatctctcacctcctttctgtagtcctctgttgtgtatcttttcctaggaagacaggaacaagtatctgctcatctccaataggacattgaccaaagaaacaattcaacctgagtctagcttagtgaactagtgagtttattgtgattactcacaggagtatggatggcttaaagcagtggcatcacttagaagcccactccaacataggtgatgactcatgaaagttgtgtccttggagtgccctgcaaaacttgcagagagctcggccagcaggagacttctccccaacagtagttactgcttatataaccttagagtgaggtggggacttgtttttagttattttaaaaacttttttattcaaaataattgtactctgatcacagtttctcctcttttgtatcctccaagatcctccccacagtgcaggtttttcgttaattttttttttataatacgctatgctcatgttatattccctcactctagaaaaaagctttcagaaactttttcttgggtaagtagggctttggaatcttattaggatttaggaattttctgagacttgtgagttgtttatttcttgagccttttgagtgttaattgctccctgagtcttaacaagttttccacctgggtggaatatttcaacaacactctcaaaccattgcattttcaccacttcttttttgactggtgtctgttacttaaacttgctaacaaggtaagggaacttacttaaccttaagtaatgtaatgaaaggctgacagataacctttgatagtgaggaaacctacttgattgctttatttctttatttcaatctatggtaccaagggtgaagttgttccttttgaaagttgaagatagcatattacaatgcaaggtgtccttgagcctgatttcttgacatgaattcctgttctacacatgaataaatatgtaatactgggcattttggcaacctgaacctcagttatcttattcatgaaagacacccagtaatacttattctccatgatgctataaagtgttgaacacatagtgaacaattgaagaatgttagttcccttgaacttgttgctaacagttttattagtttgaaaccatagttttcctttggttatagttttttagtttcatacttttaaatatgtaattattttatattcaaaagaagaaaagaacaatgacacccattttgcttccccccgccctgggtagtttctgaaaaatgataggaaaattgcataatgaagaaatgggtctagacatgtggcaaatgcctgtagtcctggtacttaggagtttgaggcaatcctgggctaccctgtcacagataaaacaatgacaacaaccatggatataactcagaggtagaatgcttgcctatcatatggaagtctctgggtttgatctctaataccataagaaaacaaagaaaacaaaaaaaaaatcaaaaaaagaaaaacctaccaaacaaaagtaaatgggctataggaacaactgtcatgtcttccattttaaagtcagaacaagaccttagtattaagacatcaaactccatcaatgaaaatgcttatggccccctttctagcatagaagtaatgagaaagaatttgggaatcagatggattttaatatgattctcacttcatttatctcctgtaatatctttgtatgctttgccaaattaatctctttaaaacttggtttctacccatgtggaatggagagtaataattatgtgtacattatagacttattatgatggataaatatagataaagaattgagtgcacattttaatacattaaaaggaaagcttaatttctctttcacctaatctgtagtccagtcttggagactagcagtgcacatcactgtatcatttcttagagcctctaatatgccaagaaaactcagttcaatttcatttaatgtattgtttctgaacttctttatctatagactttctttgtatctccaaaatacaaatctgaaatatatataattttggaattctgattagcatgcacttcataatttctcccttcttccattatttttttttaattttggcctcttaattttaactatatcaaagtctggtcaacttatagaaatgactaagctagtaaagttacttcaatccattatagcaagaacagaatgcttcaaatgtgacaaaagtgtggatacttcactccctcttagaatggggatcaaaatacccatggaataagttacagagacaaagtttggagctgagatggaaggaaggaccatcccaagactgccccacccgggatccatcccatatacaaccaccaaacccagacactattgcatatgccagaaagattttgctgacaggatcctgatatagctgtctcatatgaggctatgccagtgactggcaaatacaaagtggatgttcacagtcatctattggatggaacacagggcctccaatgaaggagactgccatatccagggatccatcccataatcagcctccaaaagctgataccattgcatacactagcaagattttgctgaaaggaacctgatatagctgtctcttgtgagactatgcgggggcctagcaaacacagaagtggatgctcacagtcagctattggatggatcacagaacccccaatggaggagctagagaaagtacccaaagagctgaaggggtctgcaactctataggtggaacaacaatatgaaccaaccagtacccccagagctcatgtctctagctgcatatgtagcaaaagatggcctagtcggccatcactggaaagagaggcccattggtcatgcaaactttatatgcctcagtacaggggaacgccagggccaagaagtgggagtgggtgggtaggggagtgggggggggggaacggtatggagacttttgggatagcattgaaaatgtaaatgaggaaaatacctaataaaaatattaaaaaagaaaaaaagatatatgtgtgtagataagtccccaataaatcataatctatgtatcctaaagagagagagagagagagagagagagagagagagagagagagagagaaagtacccaaggagctgaaggggtctgcaaccctataggtggaacaacaatatgaactaaccagtacccccagagctgtgtctctagttgcatatgtagcagaggatggcctagttggccatcaatgggaagagaggcccttggttttgtgaagatcatatgccccagtacaggggaatgccagggccaggaagtgggagtgtgtgggttggggagcagggggggtggtatagggagctttggggatagcatttgaaatgtaaatgaagaaaatatctaataaaaaagaataccataaaaaagaaaccaaaaatatttgttaattgaataacctgtattctatagaatcttgcaataatacatatttttctcaacatagtttaaggtcttatagtgacctattctaactgcttcaatggttttcttttatgctttctgaacaagatcctatgttgtaaaaccactgctttcttagtggacacagatgtctatattataacctgaccttagacaccaaattatctgtgtcctggtatttaaaccgaattctgaagctgagatgtacccaaactcccagttggagtgggattattgactcctgtggagtaggcctatcagcatgaccattttagcagagtcagctaaactgtgtcactgtgtcagtgagcatcatactgcacacaaggtctatagagtaggactagtctttagctttttatcaatgtatatctcatatcctttctttaggtgggcatacctaatttaaatatggtatctttgtatgtgagaaagaggcatatattttttattagatattttctttatttacatttcaaatgttatcccctttcgtagtttcccctctgaaaatcccctatcccttccacactctccctgctcaccaacccacccactcccacctcctggccctggcattcccctatactggggcatagagcagaagaggcatatcttagggtgttcatatcttaaaaggatgaatttggttttcagattgaatcaaattttgaagaaccatcaaatatagctgacagtagcacaagatgttccactgatgtttgaaaccataaatattattgaaccataatacacatatatgaacattatatatatatttataaatgtattttcctttacatacatacctatgataaacatttaattcgtgagttaagtagagtcaggattcacaacaataactaatagtaaagtagaataattctaacagtataataaaactaaagtttatgacatttttatttctgtagttttttttatataatcatgttggaatatagataattgaaatgccaaaaaatgtgatagtagatgagagggtacagtataattaaagcttcacttagcaagtgcttatttggcatatgttattgccactttggtagataccatagatacaatgatggaaaacatagtcaccaacatgaaatttatagcttggtgtgaaggatgagtaaggcatacactgcatggatagcttaaatcaggccatctaacctacatgcgtcagggtattctgaaaagatgttaaactgcatgtgaagtggagctttatagaaccttttaccaaaagagcaatccaaagatagtaatgtttcttatagccatgaagaaagcaaatcaaagaactagactggtggcttggactctagtgcggaaattgttactggtgattttgataatatcagcgacaataaaaatgtgttctattgggaaaggaatgggcttctttctgatgtggctaaattttcaaacttctatatgaaatgcattgcatactttaaaaaatgattttcttggcagactttttccatacatggcaaataattgatatttttctagatactgaattaatatttttctaaaccttaatatcaatcaaactataatcaaactccaacataatgcttctcaaagtattacgtgtagaccacataatccaaattaacccataaaactagtcaaaccagcagatttccacatcctaccccagatgtactgactcaaaatgggacttaggaagtctcccagttaagttccatgcatagtaaagttttaggatcattgatctacccaaaacgtcttaaaataatatcagaggactattgttgctccctgtaatttcgcagtggtttaagaagtcaagactacatattgtgtgagtttctttgtgaatgtgttacctcactcaggatgatgccctcctaggatacccaagatataagatataatttgctaaacacatgaaactcaagaagaatgaagactgaagtgtggacactatgcccctccttagatttgggaacaaaacacccatggaaggagttacagagacaaagtttggagctgagatgaaaggatggaccatgtagagactgccatatccagggatccaccccataatcagcatccaaacgctgacaccattgcatacactagcaagattttattgaaaggacccagatgtagctgtctcttgtgagactatgccggggcctagcaaacacagaagtggatgctcacagtcagctaatggatggatcatagggctcccaatggaggagctagagaaagtagccaaggagctaaagggatctgcaaccctataggtggaacaacattatgaactaaccagtaccccggagctcttgactctagctgcatatatatcaaaagatggcctagtcggccatcactggaaagagaggcccattggacttgcaaactttatatgccccagtacaggggaatgccagggccaaaaagggggagtgggtgggtaggggagtgggggtgggtggatatgggggacttttggtatagcattggaaatgtaaatgagctaaatacctaataaaatatggaaaaaaaagaagtcaagactagtttcataataacacttcaacatcattcattctattcatgtttacacaaatgatatagaagcagtgataaaaactgcgagcatcatttttgttgttgttttgctttttgagacagttggctgtcttggaacttcctctgtagaccaggatggactcaaactcacagagatgcatctgcttctgcctcctgagtgctgggattaaaagtgtgtgccacctccccctggcaaggaagcatctaaaaactagcatctaaaaacaaactaagactgaaaacattagatggtattaattgttattgtctatccctgtgtacttataagaaaaggtaaatgccaacttcgcagagaatgtccctcaaataccatggagtgctcagctataaatggggcatctacagtgcatgtctttctgcaaggctcagtgatcattgtgaaagaggaggcaagaagattgtaagccagagtggtggatgattgcatggaaatggtgttttctctacccaatagggcagtcagttgcacatgtgaacttatggtagttatggcagaatgcataagaactgtataagctaaagccagacaaaattgcaacatggaatgggagatgggcatgaagtcccatgcctagctgaagaacacggatgtttgatagcttctgggagagggaaagtaagttctctttaagagcatgacatctacaggacctagtagttccatggcagccgtatactcagtagtaacactagttgaacttgatggttggtttggtttgggtttgttgtttttgttgttgttttactttttcaagacagggtgtctctgcgtagcctttggctatcctggagctcactctgtagaccaggctggcttttgagatctgcctgcctctgcttcctgagtattgggattaaaggcgtgctgcaccagcacccagtaaacttgataggttttcaaaaggagagaacttgaagttgggtggataagaaagtgagtgtggagttggctggagtggatatgaacagtgtgtgccttatgaagtctcagacaaggaataaaaaaaaaaaacattacttcaaaattagaaataaagctgaaggttactttaaaatacccagatgaattagtagaataattagttttattaagtccctcctctatgggacttacacataggtgtgcttctgtgtgatgggtgagtgatgtaggcataaagcagcttgcaacacaatcaagtgttgtgtttgaaggcaaagcacgtgtgggatagagctgtcagctgagctagctattcttttcaaatacctccttttaacttgacaacctactgacaaacaggagctcttcagagctaaatatttggaagaccttttctcaagaatgaaaactgagcctgtcatttcaaggaaaagcaccgacagtatttgctgccagtgatatgattttttaagttttcaggcaaaattggaactgaaaaaaaaatgaagccaccatataaacttgaaaacttcctgatacttgggctttttctgataacatctgtgttgatattaacaaccgatttacccttttatattgtatagtcttgaaatgagttcttatttaaatctgtataatgaaccaatactttatagatgatcaatgcatgatattaaggtggacgagcagaagcagaggatgtagcccagttgactaagtgcttgccttgcaagcattaggatccgagttcaagttcaggaacccatgtggacaaagctaggtacaattctgcatgtttagaatacatgtacctaggaggttgagacccgtggaaccctggggcttgctagctagctagcctagcttcttagtgagatgtacactaagaaaaacctgatctgaaaaaaccagggtaggtggcttctggaaaatgacatctcaggttgacctctgaactccatggacatgtaaacatggacatgtacccacatacctatacaggagctccctacaggaacacacagaacacacaaacacacacacacacgggggggggcacagggtggaggaggtgtggataaatatccattcaatatgcaaggcaaaccagtgaatttccatttaaccaagtagggagggtccattgacatggtttcaaataatatcttttaactaactataagttcagattggatgtaatatcaaagtgcagtatattcaattaatctaaaataactattaaagcaacacttctccagttgcatcgtttctgtgagtaaaaatgtacttcataggcctccactcataaatgacaccactctatttgttacatttggaagaaataatagttgttttaataaaataatgttatgcatttatgatgactttaattgaatgaattaacattttctaaattccttggtattaacttctaatctggtaaatgtcactagaaataacctacataaacaaagattctttgaagtcgtcagtaacttttaaaacatgtaaaaatgtcctgacaccagaaaattggagaactgtgaatcttgctcaacataacaactggtgaaaatcagcctaggcaagacaggactagatgttttcaaaacagttatgagacttgtatacttgtgaatgtgataggtcatgtacaaattattcatctgtgaccttttctacagagttgcatctatttacctactatctttaatatgctgctttctgaagactctatctgttagagattgtttttgtatatcaaaactgatctattcttccatttctctggtgaagctgtgccctccgaacttacagctgaaatgcttgagagtccaaaccaacagaacaactttctgtactgtacacacttacacatttttctgtctgacagaagtacttcttagacttccattctaagagcgttggtattcctgactgaaatcagctatcttccctaactgcccaaagagtttgtgctgtataggaaaacaaaacaaaaacaaaacaaaacaaaaccaagtctttgaaacacactatggaaaaagtgaattttccaaagtccaggtgattggtttcaggttctactgattagagagctgtttattccctgtgcaggaacccctcacacacagacgttgtccgttttagatagcagtgaattcccaattgctgactccgttgcagtgtcaagatgcctgggcagtgttgaatgtgagcttagttttacaacaaccacattggacatcagtggccctgttatttgtaattcactcttagtgaatacttctgctttcctaacattaaattaagaatgctatttttactcctctccttatgttttctgttgaaatgcccaggtcctgtaaaaatgccatcattatgcttaaaatactccatatgttatgaaaatcttattatgacttattttatagcttattagtattagtatcaaaggtgaataaaaaggtccagaaacacagaacttactgtgtctttattctctagaaatactcatttaatgactttgtgtttaaaagtaaataagattaaattagaataatatcattacatttttaaaataaatggaaaaggtcagctatttacatgaacctatatctaatttgtgtgcagttagaatactaaaaaataaaataaatgcctccatagtgcttacactagagaccattgtgatttaatatattagtcgtcgaatgctattcagaagtggtggtaagcattgttacaggggttagagagatggttcagtggttgtgagcactagaccttcaggaggacctaactttggtttccagcatgcatggtgggtggtttgtaaccacctttagctcagcatccccagggaatctgacacacttttggcttctgtaggcacttgccactactgccacatacacaaatagttaataaaagagttgctgtattctgttttgttatcactattcccaagacagggaccgtgttttaggtatttactgtagccccatagcttaacacagtacctgacctgtgtgtagatactgaaaaaaaaaaacagactagggtgaaattgggggtactgtttgtcttctgtgtaactggtccataaggaagtgatttatagttttaactcattggcactgatttgatcacctgagctatccagatcacattctgctggttctaaagtagagaattattacagtgaaactttagatagaaaactagatagcaagctgggccctggtgacttgtgcctttaaacctagcactccagaggcagaagcaggcaaatctctgtgagttcaaggccagactggcctacagagctagttctaggacagccaaggctttacagagaaaccctgtccccaaaaaaaccaaaaccaaaccaaacaaccaaactaacaacaaacaaaagggaagaaaaagaaaactagaaaaactagataactcaccaacgtataaaactattaaattagtgcattgatattgatgttaaacatcattttatagactgtctaatctgtttgcatggactatgttattatatataatgtaagaggacaagctaacactattgaaaaagatgatacagcataagggacacagattcaacaaaacaagttgcttcctggatcattggaattgtcttctgggggcttgaatgcttgtccttagcgaagatccattttatgagctgtctctggatggagagtggccgtgcctcattctccctaataggcaaataaaatgataatctggcctggtgagtcacacagcagttgggaggtgataacaggatggtcagtagtttagggtcagcctcagctacccagtgagtttgaggcacatctagggtacaggagactttaagggcctacaaaatatctcagtgagtgaaggtgcttgctgtgagaagagttcattctgcagaccctatatgttggaaggagagcaatgactcccacacgtgtcctgttcacatgtatgtgaatacgtgcacaaagtttcaaaaagaatgtaaaatcaaaataaaagacaaaagttcttctagcctgcatgcatgtgtcttcgacgttcctttcactttctctcccccaatgactatctactttaggagtaataaattgtaagcttttatcataagcatataaactgcttatcataagtggctaactttcacataatgagtgttttgtgagactttagaaagatcacttaccaaactgaaataatagctcagtgacagaacatttttatgcatgaggccctgggctcagttcttagcacaacaacaaaaaagaaaaaagaaagaaagaaaagaaaagaagtgatcattttaaaagtcactaaagctaatttgaagatccgaaaccgtttggaatcagttgaaaccataatggccatgagcaatactggatggccataggagagctcacaggaaaacaaagcttggctaggtttgctttaggaggacaaattcacacacacccaacagtcataaaaggctttctttagaacctgggggtggggcttactggtaaagtgcttgcctgtcagtcttggtggccttctggagcccttgcgtttcattcctagtcctgaaacaaagagctagtttttgtttgtttgattttgttgttccactaaaacgttactgttctttggaatccagagtcaacatcttagtttgtggtgtttcaatagagtaacaaacagaaaagcaagcaagcaaacaaacaaacaaacaaaaaaacagacttctcttgggattgcatatacactaatttgatcttttacttgtgtgtgtgtgtgtgtgtgtgtgtgtgtgtgtgtgcgcgcgcacgcgcgcgcgagtgcgcaagtatgtgtgtggggtgggtaccccttgatgtccctctttaatttttattttttcaggtcagatcacttcggatgtcagtaaaaagagagaactaatataggagagtggaaagcagaacaccaaagccacggccttgtgttctctttctctccttgctgggaattcaattttaccttgtcattggaataatagcaatgcctaccttatattaactatattaagaccttagattatagatcaattttatctggtaaccttcactctcaggtaaaattgggaaggtaaacaaaaatgcctctgaacaacagttgtagatgctgtgggtacttgcactgaggccttcaagtgccctctggaagcccgttgctctttctgtaggaccaagcttaattgcctcgcatccaacaatactggagaagcataaaattgtagaggaggactgatgctatcagcagcaagctatacaagattcttcctccctcatgaaaaattgttcagtgttagattactgggttttttttaatgaattaggctggttcatgaggtctactccagcttcaataatatatgacttaagcacaaattataagagtctggggacagataatattactgctatattaaataatagcttccaagactaatccaccgtcaataacaaatcataattagtacatctttgttatgaaaatagggcattattacatttttgtacattttagtctgtggaataagaagcaagaacagctaatgatgacgtgcttttaataatatagggatagagcgggttgatttcttttatccatctgcttcacatagtccattagagcaaaaagtctgtgttaaatctatagggaaatgaacctaatattttgttggtagtttttcacttaattatgtttagtgcaatgggcatgcagatgccataacgttgtggattgggtttcacccttctactcttacagaggtcctgggaactgagtcaggttgtcagtctcaagtggcaagggtttttatctcctgagtcatcttgctgcccaactggtataaatttaatcagtatatgacatatatgttttacagaaataaaatgctgctcacagattgtttaaaaatattccaatattgtgctgaaatgtatgttatattcattcatgggaaaaaagctgattgtatggttgcatacactagatacatttttgttataacatattatcacttttccattaattaattaattttatatcccaattgctgttccctcccagttcctccctcacatagtctctacctcttttgagagggtaagacactcccctgttatccccccaccttggcacagcctaaccctgcagtgatacattttattttataagagaaggacttagctaaacatatttgattatgttgaattattatgtctgatactaaaaatgttggaaagatggctcaatgcagaaagcacttggcatgtaaacatcaagacctgagtgcaaatctccagaatctaaggaaagccatgcagagtagtgtatgcatctgtaagcccaattctcatagaggtaaaatagagaaagagacaggaaaatttcaagaagctcaaaggctagctagcatgtaacatacagtggagaaaagtgacaagagaccttgtctcagttaaggtggaaagtaaatactggttaagcctaggttgtcctgatgtccacaagtatgtcatagcatgtgtgtgtacttgtattcacatgttaatgcatgtacatataatacacaaaattaaaaagctacttacataaatatggttaaattttactatttgtgtaaagcaatttttccagtaaaccttacttgaatgaaacatgtaacttcctagatatccccaaaaagaaaaccattgctaatagtgaattacagactttttccactcaaaaaaaagattcttagtttagagagggagttggtatgctgatttaagttgtcagacaaaatgaagagctaggtggaaattaaaattcaaatgataggtgctagggagatagtttagtgggtggtaaaggcattgctactaagcctgataacatgagttctatccccaggaactactttgtagaaggaacaaacagactctcactcatgcaaatgtgtttacacacatgtacacacaaacacacacatgcacgctaaacaatgattaaaaatgaaaccgatggaacatttgctttcattctggaagactatgaactggaccatcagagatacagaggcaaatgggagagggggcagtaatcaagatgtatgctggggacttgaggatgagagtacaaaaaaatagagttatggaaaagcgaatgacaataaatggctgcatgtggttgaatctgagtatgcacgaagtatagtgtaagagagatatacctaactggacaactccattcagactatatcaaatgagattgtataccctaggccaaggagtcaggcttcaatgagtaatatagaataagtaaaaattctgagcaggatataatcacatatgccacacaaaaagcaagaaacaaaaaaatcaaaaaacaaaaattaaaaaaaatgaaaataattctgatgaaattttaagggaatatagttaaagataatcactgaacattgaggatactggatgtaggaaaaccagaaacaagttaggttatagaaatatgccaaggaattataaaagcagcacgaatatgaaaaaaatattttgataatggaagacaccaagaaagatagatttacatgactgataggcacatactaaagggttaaaatggagtttccctgtcttcacctattgtttggctgtgggcctctgcctctgcttccatcagttactggagggaacctcaatgatggtgattgggctaggcactgaatcctgagtataatagaatattattcgaatcatttcattgacttgtttgtcagttgtgtttggttctaccctaggtctctgagcttccagattccgcccatctacatagtgttaggcatgggctgactcttctggtgtggacctcaattcatactagtcattggttggccactcccacaatgctctgggccaccattgccccagtgataaccatggagcctgtaccaggccctctgaatatgatgtgctgtgggtttagggtagagttatgtttaaactcctaacaatggagcatgtgtctctgactcttgcctgctgatgggacccttttcctcctactgggttgccttgtccagccagctttgacacgagggtctgtgcctggtcttattttaaaacctgctctttcctgaagggaaacaggggagaagtgaggggaagtgtgaagaggactggaagggagggagggatggagggagggagggagggaaggaggggagggaggctgtggttgaaaaaacatagtaaatgttttttttttttttaaagatgactttgttgatacttagagcatgtgactcgaagcattgtgatgtcattatctgtgattgggaacagtggataagtagcacttttagaaagctgtaaggcattgaggaagaagagaactacagtaatgtctaggatagagcaaaataaaaaaacaaacaacaataaccaagaaaatgtttacagggctggggagaagtagcaaagtacttgatttgcagtcctagcatcggaaaagcagagaagggagcatccttggggcttgtggccaagcccatccagatcagtgggcaaactcaaggttcagtgggaaaatgtgtttcaaaaaataagatggaaagaaacgaaggaaaacaacttgacattgaaccctggcttgcccatacatgaggacatgcccctaacacacatacaaacacacacacagacacacacacacagacacacacacctcaaaaaaagaaatgcctttcttcaaaatgtctacttatttaaaatttatataaatggggggaatgcactggtatcatacaaaatattcttctaagtggtccttcagcctctgagccatgttgaaatgagacatgcgtcttttatatgactgggagtgtaattcagtgtatttcactgttcaacttcagaaggtatgtatgaatatagattgtgggtattgaaacacaaacgtgttcctgatatatacacagtgtacattcttgacttttaatttttaagtctgcatacagagtggctagtctgagtagccacttctgctgcttcatctgtatcttctaaaggggggggggtaaaaactctagaattctactagtcacttattagagggtcacatccatgatgtataaagaattctttcaaatggcaatattttctaaagttaacttttaaaagtcgctgtactgtcaaatatcatatccattacagtatcacactatgtgactaatgaaaattttccagacagatgtttcccttataggaaaaaaagacagaatgttaggttttagtttcatggctagaaatttaaaaacaacaaagacccttttcctcctaacttacaaattcttttacccataagggaaattttggtcatatgttttagatgaaatttagtcatgtttgttttagataaagatagaggaaatgctgcctgcattttatactctcttcacttcctgtaccttctgcatttttgttccacggaaataggacagtgagccattaacttctatcacaccgagttgtctgtcatgcatcagtcagtaggagccctaagaattttaactgtcacttgcaaagatagtttttttttgggggggggagtaggaggctttaactatctataggaatgagctggagagaaccagaagagccaggtttggttcccagacacatagtagtttctaagtatctgtaagtgcagtttcatgggctctgacagccacctgtcactgtagtgcatgcacattgttcatggtgctcataaagacattcacacaaacactcatatgcatcaactgataaaaggatctttggtgatagcttttgaatatattagggaaggatccaagcctgggtactcaatggtgtttctaggtggcccaatcttttgtcttttgctactcagagctgtaaatttcaaggattgtttatttgggttaaaaaaaatccacaatatataccaccatttaagattttttactcttagtccttgaaaatggaaacactatcttagtattgtcctttgtgtttaaattctagtctaaaggtcttatttgtaggtggttgtttattccaggctggagtttaatcattaaccttgagtaataccttaacctagtatcaatagggggtttctctggttggcaatacattaacattcaaagaacccttcttttgcttaggatcattcatcttgggtcataaaaactaggaggattataaaccttgataagcattggaatgacttaaacaatgacattttcagaacattgagaaagataaggtttgtcttgcttttctaaccaaacatgtttgggagtagaaaggttattacagatatgagatctttagtaacagtagtagtgtaagttcaggtttgtccttaactggcactaaatagaaacgaatacttctatcaccactttgtgttattttctttgctaccctgaacaggcctatatataaaaccttagagctcttgaaacaaaatatctgcctacctgcctgcctgcttgctttctctttcctttcttgtaataaatgttagatggatcaagattaaccttttattttgttattcttttcttctttattatgttttgtaagacatagaacataagaaagaaagaaagaaagaaagaaagaaagaaagaaagaaagagagagagaaagagagagagagagaaagaaaggaaggaaggaaaggaaagagagagagagagggagggggagagagagaaaaagaaagaaagaaagaaagaaagaaagaaagaaagaaagaaagaaagaaagaaagaaagaaagaaagagttgccttctatttcatacatggatagaatgagctttgtctgtattagcctacccattgccttctcttgtctcattgtcttcgcctttcactagtctgcttctccttctcaagtagcttgtgcaaatttgatattatctttaaagatgtagaaaaataccacattgtgatcatgtgatggactgtcaaacatatatgagatgatttgtcaaaaatccctatattgatacataaagctttatatatattaatattgagtaaatatgacaatctgcctacttataaattaaaaaaaaagatacatctaagtattttaataatcccgtggaggtaagttctattgtttgtcagtagtggactatttgtcattaagaaggccttcacacagtttgcatattggggcaatttcttaggcctgtactcctagctactcaggaggatcaggcagaaggacctgagtttcaggcttgcctgggatgcagagtgagacaagcaacctagactccaagtgtaatgcgttgaattatggttaatggcgttgccatgccttcctttaaagcagctgttctcgacacagaggggtcatgcatcagatactctgcctatcagatatttacagtacaactcataacgttagcaaaaatacagttatgaagtagcaacaaaacaatttttatggttgggggtcactacaacatgaggaaactgtattaaaaagaacaaaaccctaggaaggctgagaagcactgttttcaactatgagctcctgagatcaatgaccaaatcttcacatggttagagcccttatggcttttgaatgtaataagtgcttaataatgttaactgaatgataacatagccttttgtgtcagcaggtctcattttaaatgttttaaattatccattcaattggcttttttatattaatgatctcaaagtaaaactgaattcattttcttttacaggtgctggggacattgttgcaatcatgattggcaatctgaaaggaacaaaaattctgcagtctattcaaagaggcatccaagtcacaatggtcatcgaagtagggaaaaaacatggcccttgggtgaatcattattcaattttcttcgtttctgtgtcctttttcataattacggcagcaaccgtgggctatttcatcttttattctgctcgaagattacgaaatgcaagagctcaaagcaggaagcaggtttgtcatgctccctttgcctattcaaatatttctactgttgcacttacagtttggtttcgtggatattattatacttactagacacagatctataaatatgcttttgaaattcagtcattcagaaaggatatcagctctcatcatctcaagttttatattctgtcatttgtcaaagttaatcctgcttgattaagtcttttaacacctctaagggtacacagccaacatttatttctaaatgactgtaaatacatatgttgctttaaatgaactgttttcctaaattataagagcatttcacactcaaagaaattagaaagtacagatgaagaaatattcataaaaccaagataactgttatcactgcctgaaggtaaatgtgcgtgtgctcacgcaagagaattaatgaatgaatggatggatgaatgaacgaatttgtattcaagtctatactctccttccaccttgtgggttccaagaattgaactcatgttaggcttgactgcaagtagctttacccacttagcaatcttgccagcctaaggaaggttttgcattttcaattgttcacgataaaagtgttaaactacaaacatacagtgtattcataattttacaatattttaacactaatgctttaaaaagtacaaagtatggaaagggtagcacaaaacatccaagggcttataaaacagaggagtacctataattctctatccctgatctgatcacatttaaaccatcttcaccccttcctataatatcaattctctaattgattagcttaaattctgtggccattcaaatgttatctcagattgtcactttctttttttttttttttttttttttggtttttcgagacagggtctctctgtgtagccctggctgccctggaactcactctgtagaccaggctggcctcgaactcagaaatccgcctgcctctgcctcccgagtgctgggattaaaggtgtgcaccaccacacctggctagattgtcactttctttgttgtagaattatccatttggtgtccataggggattggtttcaggacctcctgttatgtactcaaaatccatgaagtctcttatgtaaaacattacagtatttgcatataatgtatgcatgtacaaacactttagatcctgtctagattgcttataataactaatacattgtttatagtatgcaaatcagacttatgccatgttctgtagagaatgactgtgggaaaaagtctacacatattcaggagagatgcagattcttattctgaacgctttcaatgcaatgtttgctaaatccatacacgtagaacctatgcacatactcgccggcgaaatcaaccctggctaaaccttacctcgcactctgtgtctacacctagacttgcagaagtaccagaaaaaaaatatttgtagctatactgactttaaatttatgatctgcatcagtacttctgtctgtatgtgcatctagaccctgttcctcctctctggcttctgttttgccagatactatgttttcttccacagccaactttctctggtgtacatgctctttctggcttttgtatactcaaggctgtcattccagcaattttcctccttttagcaatgtcgtctcctttcctctagttctttccagtcaacacaggcacatatcagtattacacacattttctacagagtttctattgtccttaggccagaagctattgagctgctcttccctccctccctccctccttcccttcctccctccctccttccctttgtctctgtctttctctcttatttcccacgtagccttcatgaacaaatgcagtatccctccagagcataattatttacttacttgtattcctcccttcttccccatgccaccatcatgagttactgttcccttcaaggtttgtcagtgtaacaacgcaatgttgtgccacttctccatgacattggtagttaccactttcaggggatagaagcaacagaacgtgtttttatgatctgaaaagttcctcaaaggccgggcaatgccatgtactaattttccacagagcaaagaaacctccagtatatttaggaccagaagcaacaagatttctgtagagtaaggaaattaatggaatttcacaatagatgaaaagtttaaatcatattataaaacctatataaggattaggtactaccatatattaataaatgctgaacatcagaatgtttagacttaattgccttctgtcctctttggtgaagaagcttatcacagtggtgacaggttcagcctgttaccagctaaggtcagaaggatatttagcattccagtgccagactgctcagtaaattcactgtgttaatatttgacatttgtatatcatgtggtttttttctctctgagggtggaaaaaaatggtctcccatatgactgactgactatgcaaaggttagtcacaatgatgaaagtggtttgtgtctgtccacagtaagatccgtgtttctgtattctaagtgctataataaatctataaactcctctacgaagtaataaggtttattcctggatttgaaacaacagaaatatattattcacagttctggaggcaggagtaagaaggtttatgaagaactttgccaggtattgcacaagccacattgcacatttaggcctaatatcatctttcaattaagcaattttcatagattataatacattttatcaaagtttccctcagtagaatttcaagaatagcattaaagcttctcatctattacagaaggctttggcaggatctgcttttactgctttcttgattttatcttcctcttttgaggataaaaaaatccaatatatgggcagtaatcactttcgcttataaagatttgagtgctgtaatgttacttatagatttgattttcataagttcacatttttttttgtaaaaagcttcatgtacaggtttacaactttttttcttttcttttttttttttttttttttttttttttggttttcagagacagggtttctctgtgtagccctggctgtcctggaactcactctgtagaccaggctggccttgaactcagaaatccacctgcctctgcctctcaagtgctgggattaaaggcatgggccaccactgcccggctcaggtttacaactttaactggacatttagccacattttttagttttctattgatagaaatgttgatgaagctgtattatagagactttccccatcattagaatattagggaaggctgggcatggtgatgcacgcctttaatcccacaaaagcaggtgaatctttgtgaattctaggccagccagggttatatagtgagaccctgtcactaaaaagcaaaccaaaagaatattagggaagatattgtttccagagatatcttccttttgaagattatgaggtatagtagcaaatattatataaattgatgatagcagctaagttttgataatgactcagatgagcccccacgaataataccttttatgggtcataaaagatgtataagcatacaccatcctgtttttgctggtgaaaaaaaaaaaaaaaccttgtagacatcatgaaaaataccaatggtttctgaatgaaaatagcataccaaataaggcgaagtggattgctgttcctacttgaaacaaccttaatagaaaagaatgttacaagaaatctcacgacacaattgcatcaaatactagactacttgtggttatgatccctataccactgtagaatacagtacccatcatttggagagaagtatagtatatgtgttttgacattatctaaggcagtactcagtgacaccttacattggattaaatgcttttaaatgaaagaaaagatggtacccagtaaaataggaaatgaaatatatatatagcaagaaaagctggatttacatttactcttgaaaaaaataatttttaagattatagttaatgacatcattttcccttccaaacaacactcccatgtagttccccttgttcttcaaatttttggcccctttaattgttgttactgtatgtgtgtgtgtgttttcctaaatacacaaatacaatttgctcagtctgtaaaatgttacttttatgaaagtttccagggctgaccatgtagtattggataagcagttggtgtgttcttccctgggggagactctttctaggcgttccttagttatttgtgtagggttgaggcctcaagagctttctgctttcaacattagcatgtctattggtatcatgcttgtacatttactcttaaggagcagtgattttaagaaaagtaagatatagtaattaaaatacataggaaggaatcatttgcaagaaaggcagaaaaatggattgatggatttcgaagaagataagggaggcacagggagagagtaatcagcatatgttgtatacatgaatgaaattgttaaagaacaaatttaattgataagcagtggcttagaaataactacttttgagaagaaaaaaaatcatatgaatggaaatgtcacaacaaaacgcattaaattttagaagtcatatgtagtataaaaatgagactaggtatgaggatagaaacaatactaatgatatctatgtactcaataatggaaggagttagctatgccgttcaacagttaatggaaacctttagctacatattaatgtgaattaagatatgtgatgcactttgtcccaactaacatggaacctaaacgtgacataatcattactactagtgacatttctccctaataatatttcatacgtgggaaaggccagtcctagaaatgtagagttctgtgatacggtaactaaagcaaagtatattgtgaccatattttgagttttgaaatgtatattactagaacacttctataacatatgcttatgggctctctctctctctttctctctctctctctctctctctctctctctctctcacacacacacacacacacacacacacacacacacacacactaaaaggcgggggatatgtgtcccttgagaaaagtacttgcttcacggactttaagacctgaattaggtactgagcactcatagaaaagccaagtatgccagggcttgactgtaatcccagtgcttcggaggaggagagaggaggatcaggctttagtggccagacactctagccaaatttgtgaaccgttggccagggggagactttatcttagatattaaggtgaacaacaacagacttgataacatggaagggaaaaatctcagactccaacccctagacaaagagctataggcaactacggaatactgagagcaggaaaaattggcatcctcggaatgagcaccctgactgtttatccagcaccaatggtcagcccccgaagcatatacatataagtaacagtagcttcctgagcagggtagttatgtactcaggcatatatatgggacaataacaaagtcagtggccatgaacttaggggctgtggggtgggcacatggaagaggttggatggaggaatgtgattacttaaaaataaacaaaagtaaggtggagagaaatttaggaaaatacatggtattaaccaatggcatatatacacaaagtaaaataatcatactgtaatatgatataataagagtcagctcctatgtgtaaacagatcatatagtaatcaaatagagtggaagatataagtaaaactcaaggtgccgtgccaatagatagtgactttcctgagaaagaattaaaattacctaatttattactataataaggcactctggacaagcttattacgaagttcaagtagccatagaccaagaggtaaatggataatgaaattggtacagcaataaaagatattagtgaggatcttatagatggttgaattgtttctttaagcctacttctacttgttggcctctccacctattaggtgtgtttattgtccttaaagactgtattgtgtgtctatgtgtacatgtttgtttggatgtgtatgttgtatatatttaaaatatataaatgctgtactatactaatataaatactatactataaatataattgagtctataaatatcaaccaaatgctatttatatgaaattatatgttcatattgcaacatataaaatacgaatataacagcatatacaaatacttagactttactatggtaaatacttaccaatgaagtattcatatataaatactttttttaaaggtaccacacgatgcttttgttgtaaaaagttttgaccaaagacaatgtcaatagactgtaatacaagaggtaacagagtggaacttctaccttgaatatttccaagttaaccatgattggccattagccaactctgggaatgtggtcctcaaagtgtcctttatatcagtggttgatgtattgttagatatgactagagcaatgaaccatgttataccagtttttcaagatggctttgcacaacaattgagctggctaatatacagctggtttcattgtctgggccctgcctttcagacagtatgaccagctgcaagcaaaatgatcctagctaccagctcttcccactcctaccatttgagtctgggagtctgatactcaaattagttccctagatagagacattccacacatctccctatagcttcctgttagaaataataatagagagtgctctcagatgaagaaaggctaagctgtcttaatatcttaaaattaatccttggacctggtatattggcttatgtttataatctcagcatttgggaggatgaagcaagagggttagtgaatgtctgaggccagcctggctacatagtgggttaaagacaagcctgggctacaatgtgagaccctgcctcaaaacagttgcctttgagtataagctattgttaatattatctggaacattcccaattatggtctattagttaaattaactgaaaaagccattagatgcttatatttgtaccattatttgtcttagtttatcatctatctgtctgtctatatatgcttaatgtatatttgtggtcagtgtgtttacatgtatgcacttgcctaaatttgagaattattcctgatcttttacaaagccatgagaatgttggctcttacatggaggaagttaaacaaatacttgtctaaatgagatctatatttataatcttctgactttcacatagattgaaagggaactcaaataatgagtcacagaatttaatatattcatgtactctaattttactggcttttttttttctggagattgggttttactgctgctggtatgtttttgtttggtttggttcaattttgccagtgtaacaaaatacttgagaaaaattaaagtaggtaaagttgatgatggctcatggtgttgagatttcagtccacaatcatttagtccagtccctctaggctggcgaaagcatcatagtagaccacgtagctatgtagtgtaattactaaccctgttgtggttatgaacacaaatgaagaccggaaaggatgggatctcaacatcctcttcaaggatacaccaccaatacgttttagacccacttctgaaaggtttgatgaatctgtagtagtgccccaggctggcaacaacacctttagaaaatgagcttttgaaaacatttacgtctcaaaccataacaattaacctgaggtggtgatgaacttttgatacaagcaatccttccatttcagttttccacactggttggggctacagctgggtataaccatacccagatgatatcactaagtctttacccaactttatgctgcataattggcaaataaacttgtatccaaaatgttcactgtagtggcttgatatgctgtgcattgtgaaatgactgcccgagccaatgtattgagtctctccttcaccacatagagttaaccctgcgtgtgtttaggaacatccattttaagaactgctctcctagcaaatttcaagtaaaagatttttgagtagcagaattccatgattttcttagctttgtaaaaaagttaatctcatagaagcagagagcaagacagcagcttccagggctgtgagaaagggaaatgttagttagggactagagttgatttagaagtgcaaatttacaatcacacaacgatttctaaaggtgctgattatatttgtttgaaaaggccataatcttagtttataacatctccactgaccaattttcctttcttcacaattcttccttacagtatataaagttccttagactgctaatggtggccatctttctgggaatgatttatattcttctttacctctgccttcctccaggccttttagatatatctgaactgctttaatcgctggcatagcctttctgataaggaacatttttaaaaagttgcttcttaatttttttctaatgaaagaaaactctttcatattgtaggaactgttttattcaggaattgtgcatagcttttctttgaaaacgtccttctcagtgcctttgatttcacacactgaaactaccacatagcacacacactgcatttgctcacagataggcatcctagggaaagaatccctttactatatattttcatacacatttacacatcattttttaccaactctgagtcaagcttatgatttttttcttcattcttggacaatgtcctatatttttagcttttaatgaaatgtttgttttttaaaaaggcaatgactcatatgcagaaaaatctagtttctttgcattatccccccccctttttggtttttgtgtactcttgccccattaagtaattagtctaactctattagttgttcatgtatagttcagttacactgactgttaaatgcccggtggtcaaatcccaggcaggtaaattggcaggctgacatatgttctatgtaatgtggtatgactatacaggtgaactaaatagaacagcttatgttcacctcaattttaaaattgaaaattataataaataatgagaattggtctgactttatttccagctccctcctcccagccaccttgaaaaatcttagaatcaaaaacagcaacaataacctaaaaccgtgtagctgatagcttccattactggcatggcactgtcaaagcttttgattggcttgaggagtggcattaagcttctattaagaaaattggtgagagagagagagacagacagacagacagacagacacacatacatagacacacacagacacacacaagagagagacagagacacacagacacacacagacactcatacatagacacacacagacacacacacatacatagacacacagacacacagacacacaagagagagacagagacacacagacacacatacatagacacacacagacacacacacacaagagagagacagagacacacagacacacagagacacacatacatagacacacacacacacacacaggagagagacagagacacacagacacacatacagagacacacacacatacatagacacacagacacacacagattgtctctttcttcaattctcaactcgattgtcaaatattcttaaaccagatatgatttaacattgaggagaggagaggttgttagtataatacatctatttaaaatgtttctcaaatcacaacgtatagccaatttagaaacaattttaagactgagtaatagctgactttgagggttccctccctagtttttttttctcctttatcttctccgtaaggaatgcaaagccttttaaaggtttcttcactagcacacagtggaggcagtgtgcagctgtggagagatcacaggctttaaagtcagatacaagctgggctggaactgaatcagccttgccacctgcctggactttagtcaagcttcagaacgcacttgacttgactataaaacctggatattaaaatacctacttcacatgttagttaatgattatacgtgatgacacaggtaaaaagcttaggcatgagcctgataggtagtcggggcccagtaaatgctctttacaaattactttccgcagatgtactggaaaagaggcttttgataactaaaactgagaaatgccttatttgagaaaccatgaaagtattcatattttaaattaaatattctcagagcagtgagtagccactatgggagtttttaaaaacaattaagacccaggccctaggtactagcagtttagagggagaaaaataaagaaataacacacttgtaggacctagagttctcttttaaacctattcttattaatcctttgggaatttcatacaacctattttaaagatattcaccctacaagcctctccggaattgcatcccaacatcccaacatccctactctctctctctctctctctctctctctctctctctctctctctctctctctttctccctttctctctttctctctcacccactgactccaatttgtgctgcatatatataatattaattatatattacatattatgtatataccatgggtgtaggactagccactagaacgattctcaacctgtgggtcgagatcgcttacaaccattgggggaaaaaaaaaagagatacttacattaagattcataccagtagcaaaaccgtggttttgaagtagcaaagcaaataattgtatgcttaggggtcaccatcacaagagggactctattaaaggatcacagcattaggaaggttgagaggcactgcactagagcatgggtcatctatgaggagccacacccttagtaaaacactgactctccttccccagtacccatcaactataaatagctaactaggcttgggggctttctttcaggccttcctccatgcaggaatgctgactagtttgctcttgcgcaagcagccacagctgctatgcgttcctacgtcagtggttatctcatgcccagaagacattttgtgctggccatccctgacctcagactttgataagcttcttatggtatcttctgagagaggtccctgagctttgataggtgtcacatagttgtcccatttgttgctgagcactctgctgacatttattttttgctcaccactgtccagtacacaaagcaaattctctagtgaggtctgagaactacacaaagtactcatttttttatggaataaattacaaattgccacttgaacccacatgctatctttaaaggttgtaggtctttccagatattctataatcaagtttcatttttattaattattttatgtatttacatttcaactgttgtctccttcccagtccatgagccccaccctcacccctccctttcacatctaagagagtacttccccacccacccacccactcctacctcacccctttaataccatcccaaccttctagcattccccttttctggggcaagtttcttgcaattaggcgcgtgcgcgcgcgcgcgcgcgcgtgtgtgtgtgtgtgtgtgtgtgtgtgtgtgtgtgtgtgtgagagagagagagagagagagagagagagaaagagagagagagagagagaattttaccccatcacctatttttagcttgatattagtaacagctcttttccccccttaggaatagattcatatatggcatatatggcatatttgcctttgagcccaaacctcaaattaatttgtattacattcatatccgcaatgaaggaaaattatgtggcattcattactagtaaacacataaacattgccattggagactcagggattgataatatattgaattgaacatttaggaatgaaaaaaatcagcaaatgcaagcttgagagcttgtttggaggctctgtcaggggagttcagctattcatatagccttgacaaaagaatgttcctcctctttaggggaaggttgtcctcttcaacggagcctgatgctttgggtgaggcacacatggcatggtaaggttgaaaggggacaccgacctagccagccaaattagctgagtcaaccttggtgacgaatagagtgacagatgttgcagccagatcaccctccctcatctcagtgtgcatatatacttattcaaataaacatgctagagaaatagcacttcctaatgagcacagttctccacttggctatagaacttgatgcttaaacctcaatgagaaatgttttaaagacagatcacaaagatatttctctgggtatactatatatatgccttcctgtcattggttctgtctccctttacagtgcattttttacctcagtgtcacagtagctcctgatctatgtgataagaaagtactgaggcttacaaatctgagccacatccaggcatgtggatcttagttgttcacctagtgaaatgaacacagcttaacggcctataggctcaggaaactagagaccaatctgaaaacagttgaattctacatggttttattgaactaggctccaggaatataaagatcgagctctcttcttatcctagcctttacttgtgctttcatttgcagcagcgttagttatttcttttccttttcttttttcttttttggtttttgagacagggattctctgtgtagccctggctgtcctggaactcactctgtagtccacgcttgcctcgaactcagaaatctgcctgcctctgcctccagagtgctgggattaaaggcgtgtgccaccacgcccagctgtgtgttagttgtttctacccatctgtatttactggtcaaggggcaatccgagccaggtttttgctcttcctgtgatagaagaaaaggagtttggttagtaattttgttagctttcagtcaaatatctttcaaaaatgatatatggggcacatctttaggcactggggacattctttacatacccctactatggattactttctttcaaaatatcattgtctggaacagtcacaggtatgttacctgtttccagttgtactcatttacaaactctagtttatatttccatttactaaatgttttattgagtatctatgatatgtcaggcactatgttaggtattttatttgcattatatataatttccatgaaatatgtgtgagctggaaacctttctggggaacaaaccctgcatagaggtgggggatgggggcaggaaagctctttctttctcataatgaacgctggttctcaataccaattttttgatgaagttctgctatgtttattcatttttgtaactaaaactaagattgtaactcagaatatgatcatgtatcatctgtcttgctgaaatgcccttgagttcacatcacatcgactttgacgtgtaagctaccgcaagttcagttgacacatgcagtatattcacctgagacatgcttaaataaaatatagatgtctttctgaaaaacagaaaagatttatttgctgcattataccaaattaagaccaaatatcttgttttattcctgtagccaattccagctgcagaaaagcaagacagtctcccaatgattctattctttgcaatcttttcttaacttacagggtcatttgcttcgtaatatgacttgtgactcaattatgcagactatttcagtctttggtccactccctataagagctttgctttgatgttgactatccagactcatcttagacacatgctcagtgaaacaatttggaatccatcctccttcctagacaaaattggttgtaagcagcaggtttttctaacattaaacatataggggttattttcttcattttatagaaaagtaagtgtaatactttggtggcttgtcagtgttattctttagtcaatgacaaaatcagatttttaatctaggtccatttgaattcaaatcctgtgcacttttgttcgacaagacccatttcagaaaagaaattggagaaagtatactttaaggtcctttgagcttgaaaataggaaaattgcttcaaaaattcatagcgtctgaatccatttggaagggaggcatactgttttttgccattatggtcccagggatgctgtttttaaaagtagggaaacacagtaagtttcagtaatttggggatttaaggtccattttacatgagaaagtaatgtctggtactataaatctggccaagaacccagggggtggagctattactagtattttgctaaattgacatagtatcaaactgtcttctaaattcataagtctatacccattgatcagtgctatttttggtcctcatcaaaggagtgtctttgtgccgtggacaggagttaccaatgaaacaactggtcaaagtacagagaacaaagtgtctctggtatactcagacataaatgggacatctatatcacagggcttaaccccaaggcacagggaatatcttagaagagggaggaaaaaaattgtaagggctagatgttgcagaggcctggggcaaaacagtatcttctgtacataattggaccactgcactgaagttcccagcaactgattacctgcaaaagagtcagcatgcctgcacgaagaagaaagaagatgggctggaaaactccacctctagtggaaccattaacagttgataggtatttgtaatgaaatgtcagttttctttaaggatttatccctggtagatacactgtattccagtgcagtggttctcaacctgtggttagcaaccccagggggttgcatatcagatatttatttttattaggattcataaatgtggcaaaattgcagctatgaagtagcaatgaaataatgttactgttgggggggtcagcacaacatgagcaactattattagagggttgtagcattagggaggttgaaaaacactgatctagtggatggccccacacagctgtgaatgtataggcagcataaaattgactcagtggactatgagaaaatgtttcccatacatatgtagctgatgtgcagctcagacttcatgtgggtcctgaacaactatccctaaacctgtatgtagaatccattcctcagtgggagtagtgcctaccccattagagacttgatgtgccagggtaggggccatgcatcctctcagaggagaaggggagggtggggactgtgggatgggagggagaatgttagagggggcagtcatcaggataaagtgactacatctttttttaagatttatttattatatgtaagtacactgtagctgtcttcagacactccagaagagggggtcagatcttgttacagatggttgtcagccaccatgtggttgctgggatttgaactccggaccttcagaagagcagtcgggtgctcttacccactgagccatctcaccagccccgtgactacatttttaaaaaaataaaatgtttcagtaatttggaagatcattcttgatatctgataaagggaatatgtattatggttagtttgtgtgtgtgtgtgtgtgtgtgtgtgtgtgtgccaagaagctatttcttgttgatgcctactgagaaagagaaattcggtttcctccaatagagtgggtatatcaaccactcataagggcaggccttatatccaggagtacatagctaaaacaaaacagactccatgttttttggtttggttttgtgtacgttttgttttgatatattttttctttactaacattattttattgttgtgacttttgtgtttttgttttcttttgatgggggaggggggaggggagagagaacatgaagttgggttagggaggtggggaggatatgagaggaattggaggaaaggaaagaatatgatcaaaatatattgtatacaagctttccaattaaaaacctttgtgcactcacacacacacacacacacacatgttatgtctgcatgcaactgtacattcatatggaagtcaatggtgtcaaagacatgtgtcttcctcaatagttctctaccttactctctgatacagtctttcactgaacctggaactcactgaatcaactaggctaccaaggtgcaggaatcatcctgtctctgcctcttcaatgctggattagagtcacacagtatgacgccttgcttttactgagtgctgggcatcaaacttagacccttaaagcttccataataaacacctcaccaactgagccatctctccagccacagattctaatctctaaagtttcatttagacagtaacttttaatgatggatatttgagtcattactttaaatcatacttcttttaaaaatatgtcttgtaataatctgttttttattacagaggcagttaaaggcagatgctaaaaaagctattggaaagcttcagctgcgcaccttgaaacaaggagacaaggtacttttcttacttttaaagcaatactaccaaaccattgttcaaactaaatgccaattgtccaaatgccttttcattgccatttatatacctcattcagtattaaaattctattcaatactgcaattagactgtacaatgacccccaactgtaccttacatactaatcaccggcacctgtgaatattattatctggcagaacaaaattgcagcaatggaaagtttgagaatgagatcatccaggactactaagacaagtcctaaatataatcagaatccatgtaagctaggggaaggaggaggtttgaccaccatacatagcagcattgctgggaaataaagaaaggctgagtggttcaaagaaaaagccatgaaaccgggagtaccaggattctttcaaagctaggaaaagtaattacaggcatgttccctgaagctcacagtaagagctgctaacacctcggttacttcttgacctccacaaaaggtaataaggcattctattactgtgtagcttgtaagggatcataatttgtgatggcaatgatagaaaactaatatagtgcttcaggacgacttcgtttgaaagtttattttggacattgatgagaaaagacatcagcaaaaaaaaaatcggcatgacttagtggagtaaagatttaacatttctaacaccacaggaagcattaggtgcttggctctaaatattcaaaatatatacaagattgacatgttaaaatttgcacagcaccaagtgctggggctcttgctttgcatccttgagactttgagttcaattgtaaatatagagaaaaaaaagtttaaaaaaaaaaacctcagccaaccaaagagcacacatggaggaactcatggctccagctgcataggtagcagaggatggcctagtcggacatcaatgggaggagaaggcctttggttctgtgaagacttgatgccccattgtggaggaatgctagggtggtgaggtgggagtgggatggttgggtgggagagcaccctcatagaagcaaggggataggatgggagtttgcagaggggaaactgggaagggggataacatttaaaatataaacaaataaaatgattaataaaaatctttagaaaaaggaaaagaaaaatctaaagaaatggaggcatgtattgtgttgggatcaaaaagttcattgttaaggtgtcagttcatcttaaactaaccaatggcttagatacactttcaccaaaaattttcacgagaaaatattggagatgctcaagtatcagcataatcaaaataattttgaataagagctgtagatgttggatgtcctatatcacttctctagaaatggtggcttggaaaacggagtctggtaaacaagtttgagtttcttcagagaaccagaaaaatctatattctgaggattaagaatggctacatgagcaaagttctcatgattttaagcggtagacaattacaaggacaagccacacatggcaaacaaagtttccatagaagcatatgaacatttaattaaataagaacagcaaggaatactgaagactctaaagcaaacttagtcctatctgctacacctgggaggagcatgaagccacattccaagaacaattccatgttttgaagaaactaagggcacaagactcttgttttcttggaatgtgctcacaagcactaatatttctcacatgactgcatttctagactgtgtgggacagtgctggtacacgccttcaattctagtacctagcaagctgatgtagaaggattgcaagttcaagttcagcctgggctatatagaaagaccttgtctaaatatagggttgggggattaaaagaggaacaacttcaaatagtaattcacaccttccaatttttagaaatattttaagactatatctgtgagagtgtagaagtgtgagaccaatagatgaatgatcacagtagaatccagaaatggaccaacagatgcctggccagtttattttgtttttatgaataataaaaccagagtgcagtgaactgattaaaacactatgaccagaagcattttgtagaggaaagggtccatgtcactttatagttctatatctcagtccatcactaagggaaggcaaggcagaaacctggaggcagaaactcatggaggagcttactgactacttgcttagtctgctttcttataagaccaaggactaccagcccagggtgacaccatccacagtgagctatgcccgccctatataaaccatcaatcaggaaagtgcactactggccaagctggtgggaacattttctcaattgagatgccttcttccaaaatgatgcttatgtcaagttgatagaaaactagacatcacagtgtcaattataaaaatactcccattctccatacagtgtaaaaaattaaataaaaaaagattataggcctaaatatacagctgataaagtctttggagaaaaaatacttcattttataggatacactaatattttatattagtaggttttatgtatgaccccaaaaacaaatcctcagagaaaatgtggaatttgactgtcaaagtttaaaggggctggtaagatggatcaaaggcaccagatactctttcagagaaccccatgttcaattcctaatacgtatgggtggctcacaaccatctataattccagttccaggagatctgatgcactctcctggcttctgcaggaccagacatgcacacggtgcacagacatacaagaagttaaaacttacatacatataaagtataataaaataataagaaaggtaatttcaattcttggtggacatagtggagcacaccctttaaccccagaactcgggagtcataggtgtctctaaatgtgaggccaacctgctctacatagcaaattcccagacagccagggctacggagtgagaccctgtatcaactaaacaaacaagccaaaccaataataataataataataataataataataataataatatatcctctgttatttgaaagacagtttttaaagaaagaaaacgcaaggtacagtcttggagaaaatattttcaaaccacatatttgttaaacgactatggttagaatataaagaacttttgaccccataacaacaggaatcactaaataaaaatatagatgcaaacatgtggtatgaaagcagaaaggttatgggggagtatagcggtacaagagaggtcagggagatggtagagcatatgggaggacatatcaataacaaaacaaatgtaaaattccacagtgaggaggtagagagatggctcagtggttaagagcactggctgctcttccagaggtcctgagttcaattcccagcaaccacatggtggctcacaaccatctgtaactccagtcccagaggatctatcgccctcttctggcccctttgggcactgtatgcatatgacatacccacataccttcaggcactcaaacacataaaataaaaataacagagactaaaaataacataatgaaacctaatattatgtgtgcttattactttgaataaccatgggctgaggagatggtgcagagtttaaaggcacttactgcttttacagaagtcctggcttcaattcccagctcacagcaataacaatatttctttaaaattaagcaatgtaataagtatgctaaatagacatttcatcaaaggaacatatggctgagaagaataaaaaaggatactcgatgtcattggtcattagagaaatacaaagttagaaccacacgtgagaccagtacacattcattagcctggctaaaagtgaaaataactggaaaagtcaagacctggtgaatatatacagcctctgtctggaattcttatgtatcttctggtaataagactaaatggtcatgactgccctgcaaaaatacacttatcatactagatattcaccataaaggtatgaaacacctatattcccattaaattcttagatgtagttattagaaattgttcaaactggaaggaatcaaaatccatagataaacttagaatattcatatcatagaataaaatatagtaataaaagggtaagaaagtcctactgctacatacaataacatacatgaatatcaaggaccttgtgaaggatctgaacctcaaaagctagatttagtacatgattctatgtatatggcattattataaaagtctaagctgtagaaattgaacatatatcagttatgagcagaggttgagaatgagaggaagcccgagttcctacggggctatggattggtttcttggtataattctgtaccttattgtggtgggaatattatcactgcttatgttcctcataacatgtagtagcactgtaaacgaaacgactgacttgtactaaatgtaaattataccatttttagagaacatcataaaacttaccaacggctttttttcccatttttattaggtattttcttcatttacatttcaaatgctatcctgaaagccccctttcccctccccccgccctgctccccaatagttaagctgaagttagtactgcatgatttacttttgttctttctccattttgtcgactttattattttacctcatcaaagtgtcaagtttaaatcgcctttgaaactttttattgtttgagtcacacctcactctttatccataggaaattggccctgatggagatagctgtgctgtgtgcattgagctctataagccaaatgatttggtgcgcatcctaacctgcaagtaagtttcatcttctttcatatcagtaaaaataatatctcccgcaaattaacatgataaaggaaaactattttgaactattaaggataaaggtactctttgaatgcttcaaaattgatgtatcaccaaaatccggtacagtttgttctcgacaatttgttttctctgcaggaaactgaggaacctagtcagcagtgtgtgtgtgtgtgtgtgtgtgtgtgtgtgtgtgtgtgtgtgtgtgtgtttagtacttgattatttcaaatttattctaatatttctattgagaaaaactagaatcatcttggtgccctattttaaagtcttcgctctttagatttttttttaaagttcctcctctggaaggttattcttaacacgtttcctcttaagtaataatgggattcttggagcatatttcattgcctaagcattgatactatactatatacattgattgatcaatactatagcattctgttacggagaatgctgattgcattttagagtagggaactgatacttttaatattgtaacattggaactaccaacagacttaaatctggtagcattagccattttcaagttatgaatattaaagatagctttttgaggctagagtaatggaggtatatttaagagctctgcaatatgaaatctccaaaatctattctcgtggctcctttattaatggcatgtttaaaggcagaaaaagatatccatgcaaaggctaagtgtaatctgagtgtgtgtgtgtgtgtaagtgttgatgctgtttcacaccttataactaaattctctcttttctccttcattagtcatattttccataagacatgtgtggacccgtggcttttagaacacaggacttgccccatgtgcaagtgtgacattctcaaagctctgggaattgaggtaaacgttgctatatcctttctgtgaaggaacttcaccagtgtggtattttatatgcctgggcattcatgaaaataacttctctctctgggtaggtaatgtgcaaatcacagtttatccctaaaactagacatatttctttcatagacacggggaaattcctccatcttggacgtatatattttccttcttcttcttcttctcaaacgtagttattatctagatcataatttggaccataatttaaatttggatcataatataaactaccaaggtgttatctacttttctattttaaccttgtcattattacaattatccaatttgttattaatcaccatgttagtttgagaaagcataataaaattataattttgtatttggtaaatgaaagaccttatcttcaagatacaataaatatcaactcaataaaatctttttaacttaacagaaatgtgcagatgaaagcaattctcggttctcttttgtgacagagtagcatatattaatgtatactaagtgcctactttgtaccagtgaagagtgaaggaatcagcaaaatgaagatatatatatatataccttccattggtaaagccaattcctaccccagctactctactgtgactgaggccagcaagagatttttgtgatcatgaaaatggattagaggtttattaggctaaaaaatatttctgtaagttatcacaaatgaaaacatcataatcatatgtcaatgtaatgcatgtactccaaacatcttcttttgttcaaatgcttcccaaaggtggatgttgaagatggatcagtgtctttacaagttcctgtttctaatgaagcatctaatactgcctctccccatgaagaggacagtcgcagtgagactgcatcatctggatatgcttcagtacaaggagcagatgagccacctctggaggaacatgcgcagtcagcaagtaagcacagtactgaagggcagtgggctcatcacaagtaatcagtccactgtggaccacacatctggctatgcatcttgctttttagtagttgtttcatttattccttatgccattttaaggttttttttctatttaaaatggcacaataaaagatgcactcctgccataaagtatatgcatattcaaagaggacatacatattcaagtattcctaaaatagatgacatgcagaaggaattgggattattcccaaaaggagagttttgttggaaaatgccctgggccatttaaatgtttctccttactgaggcaaaagagcaactttaaactttagaagccattgtttattactgataaatcagaatgtagaataaatgactccagaaataataaaagaatttgacttacaaaagctagatttctgcctatcttctcagaaatccattttgcagataggaaactaggttgaacaatggtatatgctgccacctgttgacttgtccaggacatgaatcaattgttagacactcaggttgaatatattatttggaattcgtgtgaaattattattacggtttagtgattttacatgaatggggatagttggaggttgtttattacttctaaaaacatcaaatctccatataattctttctttctctaacttcactctctcagtgtttttcttttttcttttccattgctaagtatttattttgccaagataagtgaaaacatatgcccgtacaaaacatagtacatgagtgttgccaacagtgttgtttttaatagtgccaaagtggagaggacttgtctgttaactgacaagtgaataaacaaaatgtggtgtatatgtctaacagaaggtgccgggcatggtgatacatagctttaatcccggcactcaggcagaagcaaaccggtctctgtgagttcaaggccagcctgctatacattgtaagtttcaggacagccagggctacacagtgaaatttcccatctcaaaacataaagagaaacagcaacaacaaaagaggaatgatgtggaaaatatggcaactcatgcttgtaatcagagcacttgggaggcagaggtagaggaatgacacaagtataaggctagcttggattatataggaaaacttgtgtcaacaaacaagggaaaagccagcaagatgcctcaaggggtaagatgcttgtccccaactctgacaacctaaatttaatcccaggatctgatttgtagaaggagagaactgactcttcagttcttctttgacctacacacacacatgttcccacgcatgcatgcacacacatgcatgtgcaaatacataccatcaataaacatgtttattgatagatactacactaagcttctagacacaaagggtcacatgttgtgtgctgtaggattccattgttgcttgtttccttttattttttgagacagggtctcatagaaaccagattggccttgaacttggtatgtagctgaggatacccttcacctccaaagtgctaagattacaaaccaacaccactgtgccttgcttaccattttatttatataaaaaatccaggctaggtacaccattataggcaggtagcagactcatggttgctacaatccgaggataaggatgggaaatggcagccagtaagtaagggatttcttttgggagagacagaaatgtctggcagctctgtgtttttctaaaattagatggagaccattgagatggctcagtggtgaagagcactccttgctcttgcactaattttgagcctgttgtttagcacccacacgatggttcataagcatctgtaactccagtcccagggcatcacatggtttagcttcttctaaccgcggaaccatgatgcatatacatacagataggcaaaacactcatatacaggaactaaataattctaattaaaaaaaataggtaggggtggtaagttgcaaaattttgtggttataacaaaaccctttgaactctgaattttcttttcttttttttttttgcattgttggccacagaaaccagagcttcttacatgccccaacttgactacacccctaagctgatttatacagttaaaaattacatttttatgggatgtgcactacatttcgatttaagccattaccaaaaatctgcctaccttcagcaattccagggagctgagaatcaacttctttgaatgtgtgtgcatttttgactttttgagacagggtctcatgtagcccacactggccttgaattcctgatcctcttgcctggcagctctgtgtttttctttgcttgaaggttttcccttggtccttactttgtagtaacccaatgttagtgtaaaagtggagggaacaaagtactacaatagcttttgaacatttcagcttcccatgacataaacctttgcgctctatggctttatcagtaccatagatatcatttctgaagatgtcacgaggctcataactatgtcaaagctaaccttgcattccttgcagctgcacacacataggaatcttaattatctgtagattgttctacctgtaatactgagtcatcgtttctttgtcttgatggtcttgtgttcccataatcgtatggtaatagaatttggtgaagataaaagataatttaatttgtgctaggttttttatataaaaaattccatcctacttgattgtgttcagtttttaggagggtggggaagcagaagagactctacagatcatttaaatagcaaatgaaataatgatccatgctccgcctgcatccttacctggatgtgtggcagtggtacccactttgaggcttaaggagtctccttccctagattcttcactccttttttttcccattggttcagtatattttctcagtgccatcccactaatttctaatcttccatatatagctgcactgtgagctgcctgcatatctttgtgccattccactctaactttcttagtctgacacccactctgcattcgagaagcctttatttcacttgaatatccataaccacagatgtctattaatgcatttaggaaacttaaattgtttcagacagctttgagttcctctagagcatcttatattaacctgttttctattcagcacaccctgctgcctgagaaatgtaaacttgtcatgaaaaaaaaatgaccatttagattataattcagtctggtttgtgtatattgctggtttggcgattgtctctgatacatctctgataattacaatgaaagtggctatttataattttgcaaatgcatatttacttcatctatgtaacacattgggatcaattctgttagtatactagtcttcaaagttaactacatgcctaatttcctggaggatttgttgactcagtgggttttgagtgaagcctgaaattttgtatctctaaccagttttctggtgcggaagcacactgaaagcacatccaatacgagccctggttgtcaagctggctgtatgtcagaatcacatggagagattttaaaaatatatatcatggcatacaggctggggaggggtgcccaagggggccacaaccccctcagaggagaaggagaggacggagggtggggagattgtgggaagaatgaccggaagtggggcagtgagtagtaaagtaaaagataaattcaattaaaaattttaaaagcatggcatataaaagcactttagaacaattaactcagaattcatgatggactgtgcctaattaattacaggtagtttttattttaattttgaagcagcttcaggttgactaagaaaatttaaatgtcaataatcatacagagactacccatctaccttgcctagcttctgtaaatgtgaacatcttatctacccatatccttatatggagcctagggaatgacttgatgaaggattgactagagaccttgttcagcttgagcagatggcccgtgcatgtcccttttctgtctcaagatgccatgtttaatttcctcttatgtctcctcgacctccagtctatggcaattccttaatatttgcctttcatgaggttggtacttttgaatattacttttctgttattttataaaaaaatgttcctttacttcgccttgtctgctgcttcatggtaattaaatccctgtccgtttctggttagaatgccagcgaagcggatgctgtgtcccagtcagcagcgcatattatgaggcacacaatgttctcattacagatgactttaactttgttcacttggttaaggttttgtctgccaaattcttccctttaaagttactgttttccatttgtaattattgaatatctttttgataggtgcttagaaactatgcacgtatcttgtttctcgtggttcttttcttggccagctttcacaataattgatacttcctgttataattattcaccaaatagtgatttgctaattctgtcattcttcccacacatactaattttcagatgtaaggaggggccatccctttttccgttttattgggttatttatagtagagtgagatcacagaacttctttcattctttgttagtttcatgatttgtccattgctcataaaggccccaattctgtcttcagaatcttagttaggttgggttttttattcttttgacttcctaactctctgttactacagcatgctttcagtcttaggttgcctttttttcccctttaagggacagtaaatatttagggatcgaaggccacatatgtttatgttgccatatatgtattctttttgtgtatctctttaggggaggtgttggttggttttggaaactcttttaaaatgtgaaaagcagtctttttaattattttatttaattacatcccaaatgttgtcccctctcagtccccccttgcagagtttttcaccccacccccatccccttctcatttgagagggtgccccctccagggtgtgtccccaccttgacatatcaagtctttacaggattaagagcatcctctcccactgaagccagataaatcagtcctctgctggatatgtgcctgagccgtggaacatccagtgtgtgtatactcactcggtgaaaagcactcttaattgtgtctttggctctgcaagatgtagtttgctaacacttaggctagaatctaggttaatcttatatactctccgtcccagaatctgccatttcgtcaagagttctttgcttagagattgttatatcaaaagcaagatataggcactaggcatagttacttattgcctcagggtggttattacagtcagttctttcaaagaacaaggctagaagatgcatgtctactcacaaagctcctcttcccttcctttctttgcccctctccctcttatctggaagacactgagtttctactgctggatgtatgtcattacagctgcacaccactggactcatttgaaactgtcctcccggccttacttgtaattccttttagtgacaatgaagggagaaaggctttccttattcaaaatatatttccttgacctttcaattctagcagaaacgtaaaatactttagcaactaccttacaatccattttcctttagctatatggcttgaagttactttggtgttgttttgttcatcccccacctttcttcttctaggatggttatgtattctatttactatacagttaggttcaaatagcccaagtgatagtaatgtgcatccaggcttaagacctgatatttttagaaaagaaaaaaacgcaaaagatgtaacttttgcccttagtacgtttataatttaggtaaaagtaaccacacaaacataaataaaaaaacaggaatcataaatcaataatgccaaaagtgccttaagggaaacaatataaattaagatttcctttttttttttcaagataggatctcatgctgtagcctaggccaacctgaagtgtactgtgtaactaaggctagcctggaaggtagaagaattcttgtgtcttacctgctgaatgctatgaatacaggaggtcatcctacacttggattaaaaaaaagtcacatagtaatcatcagaatatgatggcattgaataaggaagccttcttggaaatgagtgcagacttcttgccttgaaaggaaagaaaggtactatcattctaacatcttcacttctgtgtccagatgaaaa

SEQ ID NO: 751 - DNA, 136 bp, mus musculus
tggataatagcagtgactatttttctgttggagcacattcaattctcagtacccacatggcagctcatagctgtctatgatttcagtcacaggacaccttctggcttctgtaggcaccagacatgcacatggtgca

SEQ ID NO: 752 - DNA, 510 bp, mus musculus; identical to SEQ ID NO: 104

SEQ ID NO: 753 - DNA, 309 bp, mus musculus
tgtgcctgccacatgtgtgcagatgctttcccaagccagaagagggcctcgatgccttggaacaggagtcataggcattgtgagctgcccaacacaggtacaaggagctaacctcttgtctgcaagagcagcaggctctcttcactgctaaggcatctgccggcctcactatttcagcacctttagcatgcacttcttgtgtgttttatttagttctgcacactggtagcatgtgttgctgctttttgggatcactgtaggcaagtaagtcatagagcagttctgtcccactaggggcacttatgttac

SEQ ID NO: 754 - DNA, 1526 bp, mus musculus
aggtgacgtcatagcatagctagggagcggttgctgagcagaggggctctacagtaggcaggcagctgtggccgcaaactgtctggggtcttacgctgggggctgtagctttttctcctctgggagtaagtgcattgggtgaaagaagagccgtggggggagcgagccgggcccggggctgcggctgcggccgctgggctgcagctccccagcccaactgccagcgtgctccgaggtactggaaaggtcttggcagggtggctggacccttggcaggtaaatcccgcgacttctgtactgtaccgagctagctcgggggaggggagaatgccgggcagatgttctttcttgtgtccccctcctgctcttgctgtgtcccagctttgactcttctacgtggctccattgcccaagccctgggacctagcgcacagtgcttcatggggtttgctcaggcagatgagtgggtgtgtccgggctggtcctgaaggacctgggcttcttcccttagccaagcccagggttagcttactggggtttgggccgcctggggcaaaatccgccctgaaagctatgtcagactgtaagtctcctaccatcttcccctgaacccccccaccccgcctcagccatactgttgacagcagccctccagagaaggggaggggggtgtggccgcagtctggccaagtctgcatcagaacaacctgagtgaaacagaaaagtgccaaatttcttaaaagggagctttcctttctttaaaaaaaaatccccctccccttttctctttggggggatggtaatgacaagaggaccttttttcccccttttctttttcttcttctgcggggactgaatggattcaatatggcccttagaaaagcctggcatcttccccccccccccttggcccctgtctttatctggagagtgggggtcattgggtttgctgcttcctcccttcccattcctgtagctcccagaagacgctgccctcagtttgtgacctgctacgatgactgacatacttctgagtgaacagaacattttagattcaggctctagcaggctttgcttccctaggtggtggctgagggtagagtgtgggtgttgggggatatagatggttcttctaaggagataaccagaggctccattgggttgttttttgcctgtctgcttgtttgtttgttcccaccttccagagtccatttctagattcttggggtttctgggctgtgtgggctgtaaaagcagagggaagggtgcgtgccttggctttggaaagcctgatgggggtggttgcggtgctatttaaaaaaaaaaaaaagtggcttccaccggggaagcccttagccatgttagttttgctcccttccccaatggttttgcagactcaaatccaggccaactgtatggctgtctgaggtgttggaacagaaggaggtccattcctgttggtgacagcactgtggccctgttctaggatgagccaggtataaaaggtcagtgtggttttcactggg

SEQ ID NO: 755 - DNA, 269329 bp, mus musculus
agtccttgggctcctctcagcatcctgattccttcgccagtactcaaccaccacccactcggcagcctccaggcccgggactgtcccaggtggctgccgcttgcgcggcgcggaagaggagtccagtaaggttgccgcaccacgcgccggggtgctcggactccagacaacacaaatctgaaaaaaaaaacacacttggcctggggtaagttgacaaatggcaccggtgctgtcctatttgttgttacggagctgcagggaaatggggcttgaactaaggtgctgagattctgtgggttggaaagaggctggctggctgggggctggggtggtgggacacaaatggaggccagcaacagattgtttaggaacacctggaagagccggtgccgtggatggatggagccttaggagatttaggacaggatactgttggcacctaccacaaccaccgttttcatgagcagtgttctgaatcagagcctggatagtgaattagtatgattttctggggtaaatattatgtccccagcccagccctgagaaagcctgctcctaggcagcttcaaaatgggtctgagattagtgtgagaatggagatacccagtcttcaaggacagtccttcaactgcagagagccaagaacctgatacatgagggctcctggagcagagcttccatttaccttgctgggtttctaaccttcaaacttaagagctggccagtttagtttacctggattcctttaaggagcccagaaatacacaattggggccatcagtcagatatatgctctaaagtggccacttccctgcaccgtatgtaatgactggagcaaacagtctccatcaggttccacttagtcaggttctgagctgaattcacaggtcctggcctttctgcttggtctgggagaaagactgggaggaggtctgtttccctgttggcaaggtgggatatttggactgcagctacgcacctggtgatagccaagtgtttagcagtgtaatcactcccttatgaaaatcctggagccgggaaaccagcctggaagacagaatccctgaactttacccgagttgattgtatgagtaggagaggagaggcaaagactaatcaatagtgctctatcagagatgctgtgtgttttccctggcttcaaatgagtaataaatactatattcatatggcacccagacccacttgtcttttgcaatatagttgtcttcttggtatttagctggaattacatgttgatatgtcatcccattatgcatgcccaattgcctagtgcttgtttcttggatttgagggtgttctacagatgatctgtatcatttctcattccccatcaagtcttacaagttgagatttaaaggatgtcaaatggtgcctttcactggtcttgaaaaatctactaaattaaaaggcatggtagtacatttacatagtaccaagttactttcaaagcaaatgtttaggctgagaaaaggagaagagtaaaagtcggtgagttggaacaaagaactgaatgaatggcacctgaagctcgtggtttagtcccatggccatggagttttcataaactgtacatctatattcataaactaaatgtatggggttctacattagtgtctagatacagtgatttggttctgttgtgtgtgtacatacttgtttaaagagttcagtagaccccatacagtctggggcctgtgtttgtgtagaagagggagggggctgaacgtgtgctttcaaaagcatccgggctcattaattaaactttctatttattagatgctactgagatataatgaattacatccttggcaaacacgggaaagagattctgcatgcaatggaactatttatgttgtatcaggcaatttggtctaatgcatagtgccgagagacacagactgagaatcactccggtacaatctgaaaaggtccccgtgctgttacttttctgttctgacagtttcttagggaaaacacaatcaaatctcttcttggagagatgaaaattgcaaggacaagattacagattagtcgaaaagaaccaacagtttcatgcttaggggaggactcagtagggatgaacataaggtgttagatatttactctgttcttggttacgtgagtatccagctgctgaaattctcctgacctgtgattacacaagggacaaagagataggaaactgcaaggatttcaaaccaatatagacacagcttcgttgacacagattcacctggctttagaataagcttcaagagcagacacagatcatataatagctgccatcctttccagatataaaatctgtaattttgattctattcattatagaactaacaactaaatggcacacagaaccacggaacgcagggacaagaaatcagagatttgcaataggaaaaggaggaaaggaataggagagccaaagatgtttggaaacacatggaaagaaaagcatccaggtgtttgctttggcttgaaatggagttagttcagaaaatcacctcagacgtgaagtgctgtaaaactgccggcaatttgccttgtaaacactgagtaaacagtaagagaattccttagaaccaggaaattggggacattggagtacgagttaagtgttgtcatcccctttcactctttagcatgctcagttccaatctgctagccatccaggtgtataattatcaaatgaatatttcaaatgtgtcacaatacttctagcctgcctagttccaaatattctaatttgtctttcgcctgtctccattgctgagaaaaagaaacaaaccatttctgactgatctacttctgcaaagacttctgttcttagctgacaacaccactctgttcagatgtctctttctagctgatgggaaatagggggtgggggctcatcctacctcaagaagtgccctgtgtcccaagatgccactaacttaattctgctcagtcattttccatgtttttagggacaggtgtgacaaactttgcagtcctgtttcagaaatgatgccagtctaggcagaagccctcactttttcgagcttaggagttgatgatcctttgtaccaccccatctaaaactcgctttcctctgtcaatgggctcctcaagcacttgtccaatgacacttgcaaacccatcctgccagcaagaaatgattcctagatgactcagctgtggtctcatgagcaaacatgcattttacatcatccgcaactgagtgagaacagattatttaaaataaataaatacaagctcatagagctgagcaaaattgcagttcactgggtcaagggagtttgggaaatgcctctgacttggtccttcacttattacacagttgtcccttggattctgacagctagtgagattatcctagccattttccttagcaaaagcgagataaaaatgatggtgtgaaagagacaggtgtcatatcctcatttcccttatagagaaatcaggacctagagaatagaaatagcttgcttagatcataaaactagctagtggcagagctaaaacaagaacgcagaactatcttctcagactgaagaacttcaataaagatctctggaggctctcccaagaaattgattggactctaaaatgtaaatttacactcattattctacttccttcccatagccacagttatatgttttatttatgtattatacctagtttgttttgattgagacaatgtcttactatgtagcctagtgtgaccttgaactctcaatcctccctcttcaaccttgttagtacagagattccaggcatcctttccgcaacagccagctgttattgccttacctctgcaacttatcacttatcacctctggaaacacacacagagcctgttgagatgttttagctgctgaagccccttgccaacaaacctaacaactcaagctcaattccggggacacatggtagaaagaactgactcctcccacagttcttctctgacctgcacacacatacatgagtatatgcacctccaaatacacaaaataaatacatttaaatcacacacacacacatatatacacacacacaaccacacacaagttttatcttgacagtgcaaaaaaaatattacaaatacccacaactattattcaggaaggcgtcaaagctgaaatagcattaagaggtttgtagccaaataatctgcagaatgagagaattacaactgttcatgaaataagcaggagatggtttgcataaaataaatgacataagtaaaataaatataaatatatttttgatctgagccctcatgagaatctcccatccaggcaaaagatatcatatataaatttctatctaggcttcaatgatgatttcttcaaagtgcaagcatctgacataagatgaaaaatacattgttctatcaacatattttacaaaggtgagcaacagtaaaaattaatgcttacatggtatgtatttatttgccattttccattcagtatctcacttcaacttttctcaaaaacatcatgaaattagtttattataatttctgctttgtagatgagacagtaagtagctgaagctcaaaagaatgatgcaatatgcccattttataaacgttaatgacttaggtatgatctatacccatgactacttcatcctcacccacaggaatacctacttgctcattttactcacttgtaaaatacaatatgtataatataagtaaattctaataaaatcactatgcattcacctttgtaaagacttgattgccatgtgtaatttggatcgcttaattgtcaagacagaggcagaccacagtatcagagcgctggccttttgatgtgtaaggcattcagcttctgttggaattgaggtagcccaacacattttcacttttcgaacagatgagattactgtggcattagtaatcttacaccattcagatagctaacttttaatatttctatgaccatagtaataaatacacattttagtaaattgtttaatgtctggatattagttttctatttctactacaacaaattaccatgcccttattaatctagtactagttattaatttaagagtttagatttattcttgttctcatcatttaataattcagtatatcaggaatcttctatgaagctcactgggctaaaattaagggatcagcaggagtgcattctcttgtgggcattcttgtgggggaaaatcagttcccttgtttctacaggttgtcttggcacagttcacttccttgagtgtaggactgagacccagagtgctttgataacatcaagggaagtctgttctcactagtagaggccattcacgttcctcagtctccttcaaagtcagtgagagcaagctgaataccatcacattcggaatcctctcctcttgatttgtgtctctgactcttctctctcctactttatttaaaagctgatttacaaatgatatttatatgaaaataggagtaagatgggatgtttttacttttgtgtacattgggaattgagcaaccgaaggtgattagtacacacagccccttgaacttctttcatatttgtatggtaagtataatctaagtcagcttttctaatgattttaagatgtataatgcatcactgtttcttaaacccaccttgagttgatgaaggggtgttacattgattctttgcagaaaattcagaataatctcaatagttgaaagtcaactagttagtaattgaatcatatgtgaaaaggcttcttggcatgtaacataacacaattacaggctccgagtataaaagtattggtgtgtttgggagactacatcctgtctagcacaatcttttatgtactgagtagtataatacatgatattaaatgaaatgttaaataatttattaaataatattaagtgaccataatgtatttgggaagcattatttccattcaactgatgaaggagaaacagtaagttacattttatgtatattacatggatattaaattggacatattataaatacatctctcttcctttacgtcttacattttcctgtttggcctacattatactgtctctttattatccaaaagtactttgatcatttgcaattcttttttctgttgttacttggggttatactttaatcatggttttcctttccatagttttagttaccagtcatcaacttcagtctgaaaatattagctgtaaaattccaaaaataaataattcataaaattttaataatatacccttcttagtagtgtaatggaatttattctgtcctgatccattctggccaggatctgcctcatccttctctgagtgtattaacactacatacactattacaccactagtcatttagtgtccaccataataccaaatatagcacagtgctcgtgtataagtaacatttgtatcttagccaacattaccgcacaattcctatggcaatcaccatatttcatattaccacatagaaattttatcatcttatattgtcacaggaataaacatgaatatactacaacaaaatattttgagagacagaaacaatatacacataatttacatcgtaggacattatagatgttatagttattctattttattattcactgttgatgccagtctcttactctgcctatattataaatttttaagaaggcaaaaattatttatgtacttccttcaatttttaaagatttattattttatgtacaagaatctctgtatgtgcaccacatgtgtgtctagtgtcagagtaagtcagaagagagcatcagatttccacgtactagggttacagatggttgtgacctaccatgtgggttttgaggagggacttgaacttgggttctctacaagagcatcaagtgctcttaaacactgaaccaactctccaacaatctctaacttataatcttaactttatcataaatgaatatgtatgagaaaaaagagaatagtataaatacagtttagttctgtctacagtttcagacatccaccgaaggtcttagaatatatcaccccatggataaaggggttatgaattttatgcatcactgtgagttagctacctaacaggaagcagcttaatggaaaagaggtttatttgggttcatgatttgagatgctttcttgtgaggaatgcactgtggctatgtagaaacaggagcatgtagcagctgttattgcaaagagaaagacatggatgctagaaaaacactaggctttctcctttttcttttcttattcatttggggtcctcaatctatggaatattgcacctgtattttggactgtttttttcccctcctcagttaaatctctggaggtgccttccaaatcatgcctagaagtatgtattgtaggtaattctaaatccagtcaagtttgcaatgaaagcaaccagcacaggtaaagggggcacgactatattttgtttgttttctgtccattctgttcctctgtgttactgatgaatcctggggttttgtgtatgctaggcaaaagctctacatggaaccacatctctagccttttatcttccttattaaaattttaaataggtaatttatgcctgtggctcaaaaatcaaaatctataaaagagtattcaatgaaaactttattcccactgtatttgccatctgcgggactgcaatcatccctgtcctttttatttgttttcatctaagacttctgaatggaaatataagcaactatgaatagaaagattttatgccatagcaaactaaagcttcagtccatttcatcttttttgttgtatcaccacaaggcaactttagaagaactgtcatccatgttaagggacaaagaattacatcaatcagtgatttcactaagtctctaaaattcattatagccccttacattcatgatgatcactggagtagcctgaatattctataatcctaatgattgcattttgttttcagtcaattttatgtaggttattacagagttccgtaatttcaaaaatcacaagttggggtggaggaaaagaagataggagaagaaaaataaggatgaaaaggaagacaagaagaaggggaggggaacaggaagaagagaggatgagcatgtggtctagaatacatagtagagggtgaactctggagagttcattacataaagttttgttactacatgaagtaatagggtgatcatattacaaccaagtccaataccttattggtaaattgtctctgaaaacatgacacatctctctcttaccttgtagaaaaatatacaacttttacataattgtcagcattgaaagagcctaacacatagctgggtagcgtcttatataaagatgggtatcaaagacaaaaccaactagtttgtctttcagtacatctgataacaaaaatcaatgtgccaacgctaattccattttcatttgtaccatgaacctttacctgtaaatccagagcctcttcctcctgatgttactacatgatgtaaatgtatcttctactaacacaaagcagcattctattatctattctattattctattatcttctatttgtttctgtacttcaaagtgatttttttcaagctattgacaatgatttgttagtgttttgtgcagtagccaacaaggagtattttaaatgaaatagaacaaaggataaaaatgtgaacaccaaatgataagagtaatcattattttgtgaaaacttttctttttcagtaacatacatgtatgaaaggaatgtgtgtgtacttgtatgtgtgtgtactggcatactcatatttgttaatatgctgggcacaatgtaaaacatttttcttactatttggttactggcagaaaacctgatcaacattaaaatgcttgaagccattagtcagatgttataaatattctaaatcttcataaataaatgaatccttttccttcatcttgaaacttgaccattctgaacatatgcttccaaatagaagaggattccatactgtctgtctcttgatatagtagttcctattctcgccataaaaaaaaaaatgctcagaaagcagcaaatatccaaagaaaaagtaagaaactcaatagaaatttgtattgtttctttcggtgatgcatgaacatcttgggatttgatacatatcagaatttgaacctgaagttcccagttgtcgctttcattggcatctcatggatacagtgctcaggggaccctagctagtactgaatatgggctgaaagtctgaggcttccataaaacatttaaactcaagagctcttgactctgctgtcagcttcagtggttgtctccaaaaacttttccagaattagaaacttttaggctgctgttagacaccaagtgatgaaaaaagattgacaatggaagataaaaataatcttgtgagataagggctaaggaactggtagttagtaaataaaattctcctgagatcttgttgtgtgaaaagagaggtttgcctatagtcactgtagtacaatctggccaggaaattttttttaaaaaattaagactttgaagaaagaggacagtatataaaatcaattaaaatttctgtcttccagatggaacacagggaccctaatgaaggagctagagaaagtacccaaggagctaaaggggtctgcaaccctataggaggaacaatgatatgaactaaccactatcccccagagctgtatctctagttgcacatgtagcagaggatggcctagctggccatcaatgggaggagaatgaatttatgaaattcctagacaaatggatggacctggagggcatcatcctgaatgaggtaacccaatcacaaaagaactcatacaatatgtactcactgataagtggatattagcccagaaacttagaatacccaagatataagatacaatttgcgaaacacatgaaactcaagaagaacgacgaccaaagtgtggacactttgccccttcttagaattgggaacaaaacacccatggaaggagttacagagacaaagtttggagctgagatgaaaggatggaccatctagagactgccatatctggggatccatcccataatcagcttccaaacgctgacaccattgcatacactagcaagattttgctgaaaggacccagatatagctgtctcttgtgagactgtgccagggcctagcaaacacagaagtggatgctcaccgttagctattggatggatcacagggcccccaatggaggagctagagaaagtacccaaggagctaaagggatctgcaaccctataggtggaacaacaatatgaactaaccagtaccccccagagctcatgtctctagctgcatatgtatcagaagatggcctagttggccatcagtggaaagagaggcccattggtcatgcaaactttatatgcctcagtataggggaatgccagggccaagaagtaggagtgggtgggtgggggagtgggtggggcagcgtgtgagggacttttggtatagcattggaaatgtaaataaaataaatatctaattttttaaaaagggaaatacaagataatatagagattggagatgaagtaatgaatattctgaattagtattccagaaatattagggggataaaaactaaccataccaacttagaaagaattatagaattctcaggacaaaagggagcgttatagttaagtggcaaatcaaggtacaaacccatctgactgattctgcctctgttgccttattatctatgaaaagataatagtaaaagtatctaccttacaagaatgctatacgttgtagtgagtttacatatacaaggtgttcagcccactacctataaattatatttattaaaattgatattattgatattgtattaaaatgaagatataatattattatattaaaattgatattattgtaggatgtagtggtaaacctagaaagggaggcatatgaaagatactataaacagtagatatattataataaatgattgtattatatgataaacttagtcaaatattactgtaatttttagtttctgttacttttactcgtgtctgtgataaattactctgaccaaagcaactgaagaaatagtttatttttggctcacagttcaagagggcagtccagcatagcaagggagttctggtatcaagaagtggaggctgcttgtcatataaattcagtcaggaagcagagaggcattaatgcttatgtttagctagcttcttcctgttattcagtttggactccagtccatgtaatgtttcgacccacaatcagcatgggttttctgacttcgattaatctaatctagataatccctcacacgcatgtttagagagagacttgttccctagatgattttagatgctgtcaaggtgatagtgttaagcatcataaatccttgtcaacttgacctccaaacatgcatatcattttaagccatgatattacacaccttgtttccatatgctcctagctgtgtcataatgcaaaatctcttcaattcaatttcaaatgaccccttaacagtccaaacactgttcaaaaggccaatgtctcttctgggactgaaggtaatttcttaaatatatatctgcaaaacaaaaatgttatataattccaataaacaattgcacagagtaaatattcccattataaaacagaggaatggggtatgtatggaaaggatatataaaaccaaggcaagactaaaacacagtggggccaacaccaaatcctgcagctttatgtttcatctgggtcttacaatagacttttctgggctccagagccattgggtagcctcaccctctggctctatcatctgtagcacatacaacttctctcttgtgtttattccagttcatgtctgcagctttatttcaatcttttcttcttttttctttctttttcctttctttctctcttccttccttccttcccttctttctttcttctttcctttcttttttgaaaaatgccccatggttatggcatctccaatgtcctgggttatctgctccaatatacacttcatcttcacatcatcacaaggtttcagcatcccagcctcaccttcacagcaccacaataatctctcagagcttccttgtggtgaccctgatccaactacatattgccttggtttggtggctatctaaaatcttttactaagattccctgatcctctcaatattgcattttttacccctgaaaaactagtatcatgtggactgcactaccaaggtctgttgtaggctgtgccttgaaccagagtagcagtggcttctatttgccgagacaggtgttttggagcaagatataaattcataggcattctgtattcaggttttcctccctttaaatatttgttttcacaaattggagtctttaatgaatggagttttaccttcaagacctttcctattgccccagtgaagaaagtgcagtttctctttaagaactgcagatattttgctttggcctcattattctgcttgtctccaatttgagtcttgctcacaaatttgtcaacaatcctcacatctttcacatttttttgttctcttccactgcagttctgaataagagctgtaaagtagtagtatccatcttaaaaattcctccatgaacaacattatgaactaaccagtacccctgagctcttgactctagctgcatatgtatcaaaagatggcctagtcggccatcactggaaagagaggcccattggacacgcagactttgtgtgccccggtacaggggaacgccagggccaaagggggggagtgggtgggtaggggagtgggggtgggtgggtaagggggacttttggtatagcattggaaatgtaaatgagctaaatacctaataaaaaatggaaaaaaaaaagaaattaatttaaaaaaaaaattcctccatgaaaatttatattcataacatttgaactcagcctcatggatgaccttcagcccagtacctgatagagtttattgcctctgaaacttcctaagatgggtttccacttccagtatttctttcaccattctagtataccaaacttccccctaaactcttccactatgctctgatttatatggcaggaacttttctagcccaaagttccaaatttgtctactttcttcctgcaaatcagttccagaagcctgaaaagcatgtgatcaccttaatcagagcaacagcaggaaatgtgaaggtgtgacaaaacaacaaaagaatgagccaaactctcggttgaatactgagtttggcatgtgagccatcctactgaaagtggccacagacactcttgaactatagcattggaattcaaggaaaagattaaagaattgagaagaaattatgggaggtcatatacatcactatgtaaaattttaatctctgaaaaaaataggctaaaagtatccaaaggaaaaagtcagcagaatgagagccacaaataaaaattgaacttcaatcaaccatgtttactggagaagggggagccagggaaaaagtggctgaaagctaagcgaggcttatgcaaggcacttcagaggatgctcagagaagagcatttgatgcactctatgatgcagcctgcacatttgtgacagatgcattttaaagtatgaaatgtgaaataatgacattcaattgcaaaatgtaagtctgcagtgttaatggggcgttggagacatggctcagcagctaagaacacttgcagctcttgcagagacctcagtttgaatcccagcaccaacatggtggcttatacccacctatatctccagttccagagactctggaaacctcttttcgcctcctttggcatgcatgcatatatacatcaaatgataacacacataaaaaaagaaaagaaaaaatacattttttaaaagttatattcttttattgactagagaaacctgaaaggtttcaggcatgttttacaacttgaaagaaggatgacatttggagatgtattaggagtactattcagataaaaataattgtgtaatcaaatgtggagtcagaaataggtacataaaatttaaggaaagagaagactgaaataaatgaagaaagagaaaaggacgagcaagagaaaggagagagagagatccaaaccaattgcaatgcaaatcttcagctccagcaaattttaaatgtccagtgtcatcttgtatttagagctgaatttttcatgaaaatatcttttcacataaaactagatgccaggcttctacattaagtgttaacaatagtgatgaatgatggctaaagcaaaagaacaggttaagtaaggcaaggatatatgagagtgagagaaaggtggtcagttggatttgggacacgttgaaggtcagatgccaatagtacatacagatattaaataagcagttagacagatagccctaaaagagcgggaatcggagctagaaatatacattaggctgagattatctaataataatagaatgataactattaattaagtatatactatattaaatgtacatgtgtaagagttttaaaaatagttttattatacaagacgtattcaaacatcacaataaccccatgattacattgcttttttttatcccgatttaacaaaaagactgaaactgagactcagagaggctatgtacccaagatcacacacataaagtcaggatttagatccaggtacgcataactcaaaaaaccaggctcctggtcaagacatcaatgtcaggtgttagtcatgcaagtagaatcactatagcagagaagaatatggctatgagacagtatctcctaataatatcaggaagctacacccataaagtctcaccaacatgactgcctgaacaggagctgaacaaaacaatagacatgccaaagagggtggggagaggggaaagccttcaaccctacacacacacacacacacacacacacacacaaaaaaaaaaaaaaactacgagaaactaaggaatactgagaatgagtgaaatagttgtccccagggaaaaggatactacttggtgagccaatagcaaatggtcagtcctgaaaacatatatacaagaaacatacagacagagcaggctatatttaggaatatatatatatatatatatatatatatatatatccttatgcacaaaataaaattcaattaaaaagagaacataaatttgaaagagagcaagagttgtatatgggaaggtttggagtaaggagaatagaaaaattatataattatattatcatctcaaaagaaaagaaaaaatttaaagaactaggccaactgttgatccttgataggtgggaataatgaaccactcagaatagatagaacaagcatacaggtaaaaggaaaactaggagtacatgatagcattaacaccaggagcagaaagaatgtcctgaagaaggaactgtatcatgggtatcaagagctttatccatttgctattgcagggcccttgaataatgtagtagttggagcagatgcaaggaaaccacaaccaatgagtggagccgactctattacctatttttgtacagcttgcaaattcaacatgctctttatattttcaaatgcatgaaaaaaaatttaaaatgtatttcattatatgaaaatcatgtgaaatttaaaatgcagtgtccataaataaagttttattggaacagaatcactctcatttatttatgtattgactgtggctttttttctactacagtggcagagctgagcaaccgggtgcatatggcatgctaagcccaaaaatttcctcatctagcttcttgtactacgtgttttccagtccctggcttacagtatggattttaagacaaggctaccttagtcaaagtcctaattcagctattcatatatgtatgagaccttgagtaagtcactaaaaagctctagtgaccatcacctatatcgtggagattaaaatggggcttaattgccaaaggatcattgtaaatatcaaataagtgcctagcatagtaccttgtacatagtaataacttaatacatcttacacgcgttctcgaccggccaggaagaacgcagcaaaccggaattttctgcggcaaaagctttattgcttacatcttcaggagccagagagcaagagcgcaagagcgcaagagctctattgcttacatctttaggagccaaagcgcaagagagcaagagcgagggcaagagcgcaagagcgcaagagctttattgcttacatcttcaggagcaagaagcaagagccagagcaagagtgcaagagagcaagagcaagagctctattgcttacatctttaggagccagagcgcaagagggcaagagtgcaagagagagaatggcgaaaccccgtcccttttaaggagaattattctccgcctaggacgtattactccctgattggctgcagcccatcggcccagttgtcgtcacggggaaggcagagcacatggggtggagaactacccttggcacatgcgcagattatttgtttaccacttagaacacaggatgtcagcgccatcttgcaacggcgaatgtgagggcggcttcctacaaatacatcataactgccattaatagtctgttgttggaaagatgagtgaagggcaaatttctatgactggcaaagcgaattagagatgaatactaccaaaatgtaactatcctaagggtttttttttttcagtagagttgaggagggcaaaagaagcaaagaaaaggagaaatcttatttttaataatgagacacaaacacattgaagggctgagagagtggggtaaatgagtagggacagaacacttgaaaggatagaaaatggaacagtaggctaggggtggggtgggatgaagaagagtctgagcagggtagcaggtttagctaacagaaggaccaggaataactgttgcttggaaaagacagagttacattcaactagaaggtttgatgagctggaaatagcttagatacaaaagcatttcttctgtgagttcagaggttaactgttctattgtgaagtaggagtcaagggatttgatggtgtacaggttatggggcatggtacttgcacatggaaggtgatctggaagatttaaaaagaaaaatgctgcgtaggaggtcctggtaggcttgcagagcttggaaactaagaagctgatacatcaatctgttaagccacaagactttctctacagatactaggaaacctcaaggggaaaggatccatgaaatggagaattaagtaaaatgaggacttggtagttgtattgaaaaacataggaaaagccttgccactgctggcaaccataagatcccttatcaacctgtcctgggagcactagctctgggactgtagtcatgtcagcaggcactgtgactagctaatctttaccctgcctcatgtaatatctgatttgcacaatgacactacctacccagacatttctgggtttcttgaccccccccccatctctctgcagcctaacagagacagacaatgtagtcaaaagctccaaggtaaaacataaagtgacttttatggaaaaagaataatacttccgaagaatagagagccatattagagatcgttcaagtaccttttgggatgccatgagccaaacaataaaaactctttataatttgtgagatgcaggaccagaattttatgatgttcggcacagatctaaataaaatgcaacaacagcaggtatattaggttttctcctttgagacttcagggggaaaatgagagggctagcggtccaattcttgtttgagcattcaaaagtcagaatagagaaaaaaaagaagcagatgctttcagggatgcccatacaatcagagaatatgctttgactaaaggataagatgacaaagaaaaaaaatggattcctccaaaggtgcctactgagactcttggagtctagactttcaacccagtagatactttggcactatttttaacagaattactaattttaaaagatatggtgtgtacaaactagtgaatagaaccccatagaagagtgactgaatactccacaagacacttatccagagtctttgagcctcctgctggcaagatgagtctcctgcaggtatttcccccatgtttccctgatgttccagcctatagaccccacaagcagtaattccatccagtggtttccaggtacaagtgaaggtctggtaaaatgatgaataaggttggtttgtactcacataatacacatcaaagtctgttaccacatactttaagtatgctagtccaacatcatgagcactatattgttggactagcatgcaagggttctaaatttaatccctagatctgctccttactaggagtataactttaataaagatatttaattactctaaacctcagcacctatcatttgttaaatgaagataaccgtactagtgctcttgtatagttgttggaaggattaagtaatactgcttagcactcaacatcattcatgataaatattcattaactgccatcatcctccccatttaatgtacaaagaccttaaagcaagacttccactaaattcagcttgaagcctaggtctgccacatactcactgcttgcaaagggaaggccttacaagagatgtataatctgatttcttagttgaaatcagaattacctgtttaaaaagatatggtgtgcgaaaagtaaggaacaatgttcaatgcttgtgctcattttccttttagaaagctgtgcctctttttaaaggtatagaagcagaggccaatggcccgttaagcaaatatcaaccctggaatgagaaccaagcccctttactcctctcctaaggctccacccacttagattatttaagaaacgcttggtcctctggagagaaggctcatcagttaagaatatttggtgttctcatagagaatccaaatttggtctgcagctccccagtccctataaactaggatctggaggatctaatgtcctcttctggcctgctctggcatcctcacatatacacgtatatacccacataaagacacataaacataggttgaaaaaattggtcctctactcttttgatccccagagcagagactttacagaagtctgaacttccttggtgtttaagaatggcaacgtcactgactgcaggctgacatcagaagatagtcttgtaccattcattgtcttgactccagcacaagtaaaagtagagtataccagccacattcatactttaaaaaaaaatgctctcatctccctccttccaccaggcattgatgtctgactcctcatctttctggctttgttccgtgaagcctcagcctctattcaaaaggtgaacccccttcagcatacaatgacacccattaccagggagccactcaacaacacaatagtatggatgagctttgtcacagtttttgctctttggaaggggagaaaggagaaatatcaagtacagaatgctgttctggcttcctgtatgctagaagacactggagacagcaggaagacattataaaaaaaaagcaaaggcataaaggaaaaggctgctgcagtctctatcttttctagggatagagatcagtgaaggacagatgaatgaaccatctctagaactgtgaaaggaaccagagctagacatggaaaggtcacagtccaatattataagcagattcttaccttattttacctaccttattttcttcacctgtaaaatgaaataaccatgctatttatctcattgagatgtattaaaagccatacaaacatatttataaatccctgtccctgcctgaaagatcattaaagctccatttaacttctcagaacaggatccaggatgcactgaccttgactgcaagatggccgggtgagatgcagctggcattcctcctggcccctcaactggtaaatggaacagttcttgcacccgccatgtttcatctcgagttcctctctcttcctgtctctggaaaaagctaaccactttgaattaagtttctgtatatcctcccatatcttatcctttatcttatcaaacaagttttatgagccagagattttacagatggtgaagcatatagtctttatcacaaccctctgaaataatgatcataataaacattttacagatgaagtgaacaacttacaggaatattgggtgagttacccaaaatcattgagctagcttctgagattactagaagatacagtctcacggcaaactccctgatactctggcttttacaatctctccacctccttttcctaagtattccctaagccttaggtgtggaacttggtttatggatttattcactgggatggggctctacaactctgcattttgactgactgtggttttctgtaatggtctctgcctgttaaaaagggatgttctctcaatgaggggtgagtactacacttagcgtctggtatagggacaaatgtttagagtgtggttagggattatgtggttttattaaagaggcaattgtaggttctccttcaagagtcaggacttcactagccctgggtaattgcctacatttccaataccaggcatgatttccctcacctataaaggtgatgagttgatgtgtcttgcctgagcgtgagctgaacaataacaataataatagatatgccaaagtcaacaggagagagaccacatgctttcaaccatacataaagaactacaggcaaccaagaaatgctgagattgggagaaatagtcttctctagaaaaaaagcacaccaattggttctctaataccaaatgcttagccatgaaagcatacatacaagcaacattatgtatgagaaggatatataggactatatatgtggaacaacagttaatggaaaaaaagaggccatgaatttgcaaaagagaaagaagggctgtataggagagtttgaggggaggaaagggaaggggaacatgatgtaattatattatcatgtcaaaaagaatagctgcaaaaactacctgcaaattgtgaaactacgattcaaattgagtctagttgagtccacagaagagactctggtctttaccatttatgttcacacaatagtgattgtgttctattgcaatgttatatttggtgacatcctatactgatctaagcattgatagtagacttcaagggatcaaagaccagattgtgacagttcattctccattcccagagcctaatttaaaggctgaattactaagtgattccattagtaaaattcagattcacttagtgaaaatcaactcagtgctaaatacgtgatttatttaggatgaaataaggatgcataagatcagagtccaaactctaagcttgctttatttgtgagacaaataattgcaatgccatgagaataggaatattttcagaatatgcaccgaactataaatgcttatggggcaatgatgggaacatggaagcagaagggttgcttgtttttctacttcggaaagtcaggaagaactgtagagaaagaatgtaaaacttagtcaaaatatcactttttgcagatgatatgatagtatatataagtgaccctaaaaattccaacagagaactcctaaacctgataaacagcttcggtgaagtagctggatataaaattaactcaaacaagtcaatggcctttctctacacaacgaataaacaggctgagaaagaaattagggaaacaacacccttctcaatagccacaaataatataaaatatctcggcgtgactctaacgaaggaagtgaaagatctgtatgataaaaacttcaagtccctgaagaaagaaattaaagaagatctcagaagatggaaagatctcccatgctcaggcaggaccaacattgtaaaaatggctatcttgccaaaagcaatctacagattcaatgcaatccccattaaaattccaactcaattcttcaacgaattagaaggagcaatttgcaaattcatctggaataacaaaaaaccgaggatagcaaaaactcttctcaaggataaaagaacctctggtggaatcaccatgcctgacctaaagctttactacagagcaattgtgataaaaactgcatggtactggtatagagacagacaagtggaccaatggaatagaattgaagacccagaaatgaacccacacacctatggtcacttgatcttcgacaagggagccaaaaccatccagtggaagaaagacagcattttcaacaattggtgctggcacaactggttgttatcatgtagaagaatgcgaatcgatccatacttatctccttgtactaaggtcaaatctaagtggatcaaggaacttcacataaaaccagagacactgaaacttatagaggagaaagtggggaaaagccttgaagatatgggcacaggggaaaaattcctgaacagaacagcaatggcttgtgctgtaagatcgagaattgacaaatgggacctaatgaaactccaaagtttctgcaaggcaaaagacactgtctataagacaaaaagaccaccaacagactgggaaaggatctttacctatcctaaatcagataggggactaatatccaacatatataaagaactcaagaaggtggacctcagaaaatcaaataacccccttaaaaaatggggctcagaactgaacaaagaattctcacctgaggaataccgaatggcagagaagcacctgaaaaaatgttcaacatccttaatcatcagggaaatgcaaatcaaaacaaccctgagattccacctcacaccagtgagaatggctaagatcaaaaattcaggtgacagcagatgctggcgaggatgtggagaaagaggaacactcctccattgttggtgggattgcaggcttgtacaaccactctggaaatcagtctggcggttcctcagaaaattggacatagtactaccggaggatccagcaatacctctcctgggcatatatccagaagaagccccaactggtaagaaggacacatgctccactatgttcatagcagccttatttataatagccagaaactggaaagaacccagatgcccctcaacagaggaatggatacagaaaatgtggtacatctacacaatggagtactactcagctattaaaaagaatgaatttatgaaattcctagccaaatggatggacctggagagcatcatcctgagtgaggtaacacaatcacaaaggaactcacacaatatgtactcactgataagtggatactagcccaaaacctaggatacccacgatataagatacaatttcctaaacacatgaaactcaagaaaaatgaagactgaagtgtggacactaggcccctccttagaagtgggaacaaaacacccatggaaggagttacagaaacaaagtatggagctgagatgaaaggatggaccatgtagagactgccatatccagggatccaccccataatcagcttccaaatgctgacaccattgcatacactagcaagattttactgaaaggacccagatgtagctgtctcttgtgagactatgccggggcctagcaaacacagaagtggatgctcacagtcagctaatggatggatcacagggctcccaatggaggagctagagaaagtacccaaggagctaaagggatcttcaaccctataggtggaacaacattatgaactaaccagtacccctgagctcttgactctagctgcatatgtatcaaaagatggcctagtcggccatcactggaaagagaggcccattggacacgcagactttgtgtgccccggtacaggggaacgccagggccaaagggggggagtgggtgggtaggggagtgggggtgggtgggtaaggggaacttttggtatagcattggaaatgtaaatgagctaaatacctaataaaaaatggaaaaaaaaaaaaaaaaaaaaaaaaaaaaaaaagaatgtaaaacttggcctagggctttaagaagtagaaaatagagaccaagcatcaagcagaaacatccctggtgaagagaaaggcacgaagaaagtgagatcagtggtgggaataggtaatttagggtggctgaagtccaggatacatgcttaagagtgcagagatttgacaagctaggttggcacttgctgatcaagttaaactctgtcttacacccagaataggatatctacacccttccagatagataaagagatcatgagaattgccttgtcaatgttgtagtgaagacagaggaaaacatgaaaatgtggaactacagtacaggaagctgctattgttccataaagtgacaataagttattaaactcagccaatagggttagatatgagaaatgtcttaaagactaccttgataactcttggcagtaggatagaatagaaagataacagaaaaggaagattcaaaaatgacctcatggtttctggctctataaacgggctagattgtcttgccccaaatagttatgaaatatatgaggtaagttacaatgggagtggtgagttttagattgaatttgttttgtccaaagtatgtgtacaagtgatatgcaacagtagtggtgttcagaagtcagtttgacagctctctggctcacaaaagacaaaaggaaattagatttgatttcattgctatacaaatcattcactgaaatcatgtatgtgagtaatattggttttttattaataatcacacagaccctgatttgattcatctctgttgaaaggcaactcttcaagtcttcaagtaaaaagggataaattgcttttttatgacttattctccaaacattttcttagggagattactcctgatgcactttcaaagaaaatcatcctgttttttactctctaagcaatgagaattgtttatttaaatcaataccaaaaaaaaaatcacaaaatcatcagttatctaggcttgaggctttcaggtacattaagaaacatagcagcagcaaacattgatccctgtagtgtctttagttctcataggccaaaaagcatgcatgaaaaatacggaagaaaatcagacagagacagtgcacagggcagtaatgaggaatgtagggcaatatgttattaagcttctgaatagattgcctagaaggtacgactgaggagactaacagatacacaagaacttaaatcacatgaaatagatcagaagacaggacacagatagccttactatagccctgagttcaaaaaagactataatctatagatccagcccccatgtctcaagactcagtgatacacagtggcctcaaacagccaacaaagttctctgaggcaaacaactctttcacaaacaactctaagacttagcttaattttagacatggccccatgaggatcctgaatactgaattataggcattagtcaccacatccagtttatacagtactgggtattgaacttagaattcattctttcttttcttatttttgtttcagcgtttatgtttacttttctgtgcacgtgtgagtacctgtaagtatgtatatggaccaccttcatgcttgattttcagagagagcagaaaatgttgtggaatcctcaggagatggtagtactgctctactatgtgggtactgggaactgaacccaggtcctttgaaagaggagcaacaactgagccatctctttagccctcaggcctagcttctcaaactgtgagttgtgaccccatgtggggttatgtaattgaatgtgttattcataaaaaaaatttttaaatgataaaagactttctgaatatgtggcaacccaaaattaattaaaatgaaacatgtaaagaattaaggcatttcggagatcactgaacctatgttgtatggcacaatttctctgtatccttgggtctgaacacatggctgatgcactctatactacacacatgtcatcacaaaaacacaatgctatcactgccaagaaaacacagtccaaattcaagaatatttaatggtatgagttgtgtgtttgtttatgccatatttatggatttatctcttgtgaaaacataatggtttaagtacaggaaatgaagacttttcatattttcctaccatgagtccacttacatataaattagtatatctttgcactgggttgtgtttgaatgtttgactttaaaaaaatgtgagagattggcctgagcttcataaaaattaccacattgagagctagtgagataattctattagcaaagtgttttctttgcaagcatgaggacctgaattcaatccacaggtgccatgttaaaattaaaatactggtcatgggcaattataatctgattagtggggagactatgtggagagtttgagactaataagaggcactgttttaaaaagaattagcaatgcctgaaaatgacacccaatgttatcttgtatcctacatatgcatacacatgcacacacacacacacacacacacacacacacacacacaagaatagatagatagataaatagatacatacatacgtacatacatacatacatagatagatatagagatccattcataaaatcactaagtgacttttgcttgagataagggcagatctgttaacaatttatgagatggctctaaacattcttctgccatttcaggctatgcctttatgtgaagtggcattctcaatattgaatattataaactctgaattttttggagattctttacatgctacaacatcaaatattcagccaagatttaactctttgtgtgaaaataaacaagcatactcatctcattagtgtgaaaaatgtctcccatcttcaataaatgataaacatgtatgcatagaaaaagttattttaagaaaaatgttttaaaacttattaccagtgagttattggattatatcttgtgcatccaggatcatatttcaagcaaagataagtcatgagttcaaaaatgtaagcactggctactcttccagaggttcaattcacagcacccacatggcagctcacatctgtctgtaactccaggtcctgaggacccaatgcctatttctggcctttgtggatactgcatacagatggtgcacagacttatatacaggcaaaacatatatgcataaaacaaaacagataagagaaaaagaaaccttggtcaaacatcattgaacaacatccaagcagataaagaaccagctctagagcggctgccaccattcctcagcctcatgcagtacatatttgagtgaccttagctgcttcctctctcttaccaatatacacagtcatgtcactatgacttgttaatttctcttctgtggttggttatctcccatttcactgtatcactccactcatgctaccctaagtactcccctcatgcacaagcgagaataactcccattaatctcttcctaccaccagattgtctcttgattttaccctttgccaaaaatcctttcaatgttccctcataacctaaaggatgaagctcacacgtcttgacctcagtccataggtcttatgttgtctggcgcaaaccacacttccggtataatcaccatgttaattggcattctgtcaaatagtggctcctaattctaaaacacttttcatggtctagaccactatcatgatgttcactgctttgggcttccagcacagcttcatgcccaaagaacaccatgaggcagagcaaaccaggggacaaataagaacagtccttgtttaaagacaagattccaggcacctaagaactttcctgcctatgaaaatccgtggtagctgccagcagtaccaccctgaggattaagcctttaactaatagagagtgagtggggataccaccctcagctctagaagactactatttgtgatgtatcccagcatcaactatgccttccccacatttgcttatataatatatgctatcaagagtatagggatttggggattggttagttggtcggttcccttggttttttttttttttactctctctctctctctctctctctctctctctctgtatgtgtgtgagggggtgtgttcagtgtgtatgtggttgctgttgttgttgttgtttgtttttgagacagaatatagttatacagcactgactgaccttcaattaactacgaagttaagactgacctcaaacttgtgatccttctgcctcagcatcctgtgtccaccaccacgtcagcatagaacattggttttgctctaaaatgacttcttaagtattgtctgtcttttaaagctttctaaagtcacacccaacaaatatatagactatatctaatatctgaagttattactagctttcatacgtttttatgattgctttctcctctgagttcattatacagtggctaaagattgcaactggctctttttaataattttcttgtaactttatcagtcactgtgttgtgtccaaaccacgtttcttcaaggtagactttaggattcataggagactgtgtttctttatctccactccttactccagaccctgcaaataacatattgccttgcataatagtagaaaagcaataaatatttttcaattatttttataacagcatatttctaatcagaaattctatttccttgggagactgtgactagctggcagtttctaaagcatctacaagaagcaggacaaacgtgaaataagtccctgtctcagtacaatgcaattcaattccagatcgagaaggaaaccacactggtgctaattaaatggaatagcctggagtaataatgaattctcaaaatgagtaggagagagagaaatatgacaataactcatgagggaaaataaaatcattctattgttggaatgattggttcctggttttagacagaactaattcaaacctctcaaagacttccagtttgcaaactcatttttgtgcattaagatgaagaaagaatggcagttgcaatactagaagaacctgttttctggattttttgtttttgtctttattctctttcactttccttctggatgttccataatccactagaactccttgtctttctcatattagggtgtgtgtgtgtgtgtgtgtgtgtgtgtgtgtgtgtgtgtgtaatcacaagttttttagctgccttggtagagattgcttttccaattataatttgaacataaaatgttccctcaggctcatgttttcgagcttgtccccagctggtgacactatgtaagaagaatatggaacctttaagagctaaagtttgtccagtatttacaatgatttacttatcaccagagggcaagtctttgaaggtcacttgcctgagctctagttctggttgtcctctggtacctagtccattgtggtgttaggactgatcaccacgtgttcctgccaccataaagttcagcacattttggtcactctgtaatggactgaaatctctctgaaaccaaggtccaaagtaaatctttccccaattaagtagcttctgtcaggtatttggtcacaggaacacaaaattaactaacacactcagattcgtggagagttcacattgctatgtaaacacagtcataagcccaagtctgatgctggtggctttcaatagcctgtgtgtatatcagcttgtgtttgcatgcacttcttcccttattgcactcccctctatgaattgtcttcatctcagttccaaagactaataaatacagttaccagtttccctcccaacattcgtctttatatatagtgtcacattctcttttagtttcaagttttgctttgcctcacactgcagcaagcctgttctcatacctaggaccattccaacataaatcccctcggttctagtcatcaaacaaattctgacaggcccgagtgctggtgttcagaaggtgatgaataccctctgttgagtcatttctctttgcacaacccgcccttgtagttttccttgtgggttgtgtcaaaattgaacttggccatggagtacaaatggtttggtgcagttcaagaaatcctgtaggtgtttaattaataaacagttgtcgaccggctttaacagcctacagactgactgaatcagacacaaatcataacacaggcaacccagggagtgttttcctcaatattaaaagaaagtttccaaagatgaaatatagcattaaggtttaagaatgcccagttgtagtagggtccagaggaaagctaagattacctcagcaggcattttcaccaaggagtccagaaaataagaaaactaagaaagacacctttgattttcttcaacatacagggcatctgtagaggcatgcatttaaagagaaagaaaattgcagcttaaaaaccagccttttcatgaaatttctttcacaatagtctctgttggtgattctcaatcaattggggccattcatagaagtagcccatggttgtcaattgcatatcttgatacagaatcatttattatgggaatttctgctgagaagtgccagtatgtttatgtgttctctaaacgaagaaacactgccctaaactaggatgacagttcatttaggaacaggaaacaagaaggaccaaagattgtgcacaggaccttaataaggttttttatttcaaatacgttaatataaatatataatttataacagttaataatattgcatttgatcatgtggataagaactcttacatgtgtctgcaatgtaaaaacattgcttgttaattttttattggacattttgctattttttttgtcaaccttagtttaagttgtaagggcaatatcttttgctctttcctctcctccttccagttctgagtagctgcatgtgatccaaatgactacccctgcttacactgttacaaaatttcatcactctgatctagttcagcaaatgtaaatgtattcaggcatataacataaatataaaaaaattgtgtaaagacgattggatgtagtagtaacagcagtgactaagagaagacacgcccagtggataatttacataaatttattgggggttttttggtttacttgttaaatttgtcattgataatttcacacatgtatgagatattactcctatctatactctttcccccccccccaatgaaatttaaattcgggaactgtaaaaaatcatatacttatcaaatgcatattttggaatttgaaaatcaacttttgattacctgattttttttaaacactagataggactagaaggaagacgaactcatttggtggggtgtcttccagctcaaaggcttggttattttcttttccaccttgtacattaatcagaatcctttagggatcacattacaaataaaattctgtaaaatctccttccttctcccttaccactgctgtccttctttcctcccctatatacttttgccatagttccatagatgttctccatgagagaaaaactctagcattttctagaatatggagctgatgtcctataccttaatttttttcaaagatgaataaagatgaaattgagacagaaacactaggttaaatggatgacactgggaggaagtccacaggaagttttagaagcatctcttctataccttacaaactttccatcccttccactgcagcataagacaatcagaagctccagaaaatgactttatccactgagtgtctactctgaactaagctccttgaatggattctctgccaataatctgaatttgggggttagaaatggaaccacatcatttggcagaaactgtaaaacctgaaaactaatagacaaacgtgaagctgctgagctactttaaagcttcatgaaggaggaggcagagatgatgccatgtattatataattagaaattaacacagactagccttctgagaaaagcagagtagacttgatgacacatgcaatgatacaagatgcgcttggtgagttctcattctcctgtcaccaggcttgagcattctcaaacggcaacaaagctagtgaagattcaggatcgttgagtcagagccctgtgtggattttaactcagaagttgacaggattgtcatcatttggtaaaagttaccttgataatcacactccttgtattggagagtgaacaaacacatggtgttgtttaggtgatagattcaacatagcagcccacgatgaaaagctagtcactctgtgtttcaatcctagatccatgattatctgtgaagtcttggcaatttgtgtaacttttctgtatctacttcatttatctataagatgagcataatactattttaccctacagggttattatagaggttaaatatgaagtatagatatcagtgcctagtatgtaattaacactcaacatgttcctattattaacatagtttcctaacatcttttaaaggtagaaattaaaaccagtgttcactattttaagatttaaatggaccttaagtaaatcatatcttttcccagggtcttagttacttcctttttaaaaaatgaaatggtagcattgtatcaaaaattttgctggtacctttattttggtagcccacacttacattggtgatctggcaatgttacatcttgcctaaaccttgccaaaagagaatgaatcatgcatatccccaaggtcctgttactccccaagacagagggtgggcctttctactctgccctttcttggttctttaattctgtgacacaagaaatacagaatcaaagggtgccggcagctcatctgcttacaccagctgttagcaaacagtacagctcatcgtttagcaatgaaagctgcaacatggatctaagaacaatgtgttatttatctcttgtctacctttattccacatcaaacctgacattggtcactgaaatcacacagaccagctggtaggcaaaaggacaacagctaatacgatggcttgcttgcttgtcatcttgggctgttatgttgaatgtcaggcttagattgctctaaagagtccagcctattagaccagctccaagatgggagaggaaattctaatattgttctttcttccctgggagggggctgtgcagatgtcatttggcttttttaatgctggttttaaaacaatagaatttttaataactctccttagttttttcacaaagatactgcacaaagagcccaggctcacagaaatggcaagcagagactagcataagtgttatctctcttcatctccatccttcaaatgtggagttaccaaaaaggagagcaccaaccatcagaaatgaaatcttctggagagcttactaagatactaggtatctaatcctcactgaatttaactctgcagtagtagagggcaggactttagtttcctgctcttacgggttttttgtttgtttgtttgtttgtttttgtttttttgctttttttttttttgtctactataagttttgatctaatagtcaccaccttcttgaatctatgttgaaagttgatctgttttagggtaatttcagctatggatgagttaattatgggaaagatatggatgtcaaatgtagatggggacaattgaattaagaggaacatattctgtcagaacaataaaccagtagaagtcatagaaaatctaagtacatacttccatctttagagtgattaggcttgataattcaggaaaactgcacattttgaagctccaactaccagaaggagactcatattttttgtctgcaagaataataataaaaatataagtggaaatgttcccttaattgtacactataaatttttttacctcaatgaagtaggaaataaaacatattttacagcctaggaaatagtcttagaaaaggagatccattttccaaggtcacatagctagttggttagttataaatcatagcagttattgatgaaaagatgaggcagatttgttttatttgcttctctcccctatttccctcatgcctctaaattttaagatgaaaacattactacccattacattttatttatttacaaactctaagttgtactcagttggctcttttgttccaatgtggggattgaacactggtcatcagacatgacagcatccatagtccctcactatattccttctgttatatctgtattgatggagatttaaggcttgatggctgaagcaaaacctcttctacacctttgttcaaatcctgaaagatctaatactgcttgcagtgaaagtgagatggaaaagatttaaaaaccctgttcacaaagcttcaggttctctcatcaagccttcgaattactggtgctaaactttaagtgttacagctctctagagtgacagccagaaaaatcaaacttcgaaaatctcttacaagatatacaagtaacaatcctattaacttaatcatatagaaacaactgaaggtgctcgctataaatgctacatgtgcttgctgctcctggttaaagatgcttgtgggcactaacatagggaagagaacacattcaatggtaaaagtgacccctctccagaagcagttagagtaaaaatataccttctgcctcctcaggaaaaatgagtgagagcccatcaataactttctcatacatggctaagaagcaaaatccatacagtgtatagctgtaaaaagtacttgggtatcatatagttcaatttctttcacctgattgtcaaggtaatggaggctcagagagagagagagagagagagagagagagagagagagagagagagagagagagagagacaagacagagacagagacagagacagaaacaaacagagagatttctgtcccccagctacatactgcactataaatattcccaaatcaagcgcatgggtagaatggtgaatctcgttgagtggaatccactccctattagaatactgcacagtagctcccggttgcctactgagttaaatctaagcaccctggtctcaatcacctcatcccaacatgctaagcacagcatagtccctcgttttgttatcctttaacaggtgacattctctcccataagagttctgtctctgttcctataccaacctacatcatacctcaaggcctacctcagaagacattggcccaggattctctctactctcctctgcctcatcaggtttagtttgtgatccaacataataccaaactatcataacctctatataccaaaccccatctgtgttagatcacttaaaaacttgagtgaatgaaaaaataataataccagaagaatatagcatttgtgggctttggaagtgcatacttactaagtattaaataccaatctggacaggtctccttttttactaagatttacattctcctcaattaccctcttaatgccaatgatttttttactggaatgtagatcatcaacagcagcagcaacaacaacaacacacacacacacatgacacaacacacacacaccatggtccttctcctttctttttttttttttcaaatcatacctatgtaacctgcctaaaactacttcgttgtgctttcaagctgacaccaccagcaaagtttggtgtctcaggcctgacatgccaatatgtacacaggccaaataaaacttcaaggtcctcttagctacagagcaagttaaacattaccttgggcaagttagtgaaagcttgtctgacaatttaaaaggggaggtaaggaaaaaggatgtcactctgtgggagagtgatcgtctatcatgcctgcagtcctagattcaatcctagtactatttaaaaggaaccaccaatgttatcacccacaagagcaagaactgggatgttaaatatttctctcttttatatcatcccacagaggctatgttctttgggataataacagaaggcaccatttcccaccatgtgttcttcaagaatgttaggagaaaatgtcagttcagcatggagaatgctgggacaagcagtgaaaaagatagacccatttaggcaatgtagatattctttaaacattaaatattaaacaccctaatatccattgctcatctctgagaggatactaaagtctattgtgggattttatttgccagagttatttgactgtgaggccctcctacagccctgcttatgacacctcaagggtttttgtgttgttttgttttgttttgttttgaacaaactaaattgctgaaccatgttctacattcagaaagcttttctgtacatttttatttcagctggaaatattctatatttatatattaaaatgcatttgatcccatcaaaatgctgcacatctcactttctgaactgaccctctgtcctgtcattgactaagatttcagaagaatctgagggagggagttatagaaaagacatcatttcacacccaaagttgagacaaggcaattcagaatgcctttaagacaaggcagcctcatgatagttaacagtatttaagcagaatgagaggcatctgtaattgtgacaatttctaagagctttcataggcattgtctcatttcttaatcattatgatcagtgtgaccatctccactttatagataaaacccagcaagatcaaatatttctgaaaaaaaaaaaaggtgttcatcatcagaggcaagactttaaacagcatctacacattccaattccagtatgctcgtgtgtactaaaggttgaagaagaaagattatctctgctctgtgataacccaaacccactgagacctagtactgagcattccactgccagaccaggaggcgcagagcctccttacagggatagggttattctaaagagaaggtgagaacaggatttttgaagatctcctttgatttcttttctagtcaccaaagttaatcacgctgctcattacagaaaagccagaaggagcaaataaatgaaataaaaagaattaaagtaccaataaacacccataactatctatccagaaacaattgtctgtgacagttttgcatataatgtaacagagccttttctattcaccttacattcttttttttttccattttttattaggtatttcgctcatttacatttgcaatgctataccaaaagtcccccatagccacccaccccctctcccctacccacccactccccttttatggccctggcgttcccctgtactggggcatataaagtttgcgtgtccaatgggcctctctttcgagtgatggccgactaggccatcttttgatgcatatgcagctagagtcaagagctccggggtactggttagttcataatgttgttccacctatagggttgcagatccctttagcttctttggtactttctctagctccttcattgggggccatgtgatccatccaatagccgactgtgagcatccacttctatgtttgctaggcccaggcatactctgacaagagatagctatatcagggtcctttcagcatcccagcactgggaagataaaggtgaagacgggaggagtctttcaaagttgagccgtacctgggacacgtggtgagtttcaggccagcctgggtgacatagccaaactccatttccaaaactacagtgattgaacatttattttgacgttgatatttcctctccagcagaagagctagtatcattccgctatgattaaatcaggtttaccagcaataaccatagtgaaaagttaagacggggtttgcccaagtgtggccctctggaaacttgagagtacgtgcttctcatctggaaaagtgttagaaatgcattctctgctacatatgcagctagagacacgagctctgggaggtactggttagctcatattgttgttcctcctatagggttgcagactcctttacctccttgggtactttctctagctccatcattaggggccctgtgtgccatacaataaatgactgtgagcatccacttctgtatatgccatagcatagcctcacaagaaatagctatatgagggtcctgtcagcaaaatcttgctggcatatgcaatagtgtctgggtttggtggttgtatatgggatggatccccaggtggggcagtctctggatggtccttccttccatgggtattttcttccccattctaagaaggaatgaagtatccacaatttggtctagttggccatcaatgggaggagaggaccttggtcttgcgaagattatatgccccggtacaggggaatgccagggccaggaatagggagtgggtaggttggggaacagggcgggggggtgtataggggacttttggagaggaaactaggaaaggggatagcatttgaaatgtaaatgaagaaaatatctaataaaaaagtaacataaaaataaatcttcttgaaaaaaaacacacatatacacactgggttttaaaggttttttttttttggtttttttttgggggggtaggaacttggacaaataaaatttggacaaaaagaaagaaagaaatgtattctcaggctccaaaacagacaagctgaattgggaactctgaaggtagggctctgaaaaatctgtatttttatgaaacccttcacatgattctgatagctttaaaaaactttcaaggagacaagcaatggctggttgtggatagatgtagggtatctgatttacaacgtcaccaaaaatacaaaccagagaacatgggtctcccttgaagagcaacaaagccttaagggtttatttatccatccatgccataactgtttttaaataccctacatacaaagcactgcactagatacttacaattcaattaataataataattataatgattgtagtaataataataataatagattacaaaaactgtctagtagaaagcttagttgtgagactgggtttaagcatacacatttgtaattcttaaagagcaaaaataatggacaactccagaacagaaacagattccagatagaaaagatgtgatggttgtgaatgattctcatggaccctgttaatactctaaattgtatctgtcttttcccttttcaagacagcacagttctggcttctgtggattcttgaagtatgcctcagggatttgtagttctatgttaatgtaatacataaaatagagtcaccttgactttgcatttatttggcttatgtaagctctaaccttttgctgcagtgcaacataaatgccagacccatttttttctaggcatgcaaacaaacactcattctaaataatatgtcagaggacctggtgactagaggagtgtgacaacctacagggagtcgagaatctgctgatctaaaccttggtgtagagggcaccaccatgatatgcctccattcgctttccaagaaaagttgtcattgaagttaaagtttttgaaataccagaacatttccttatgggggacaatcagcaataataataataataataataataataataataataataataacaataattttaaaatatccagagaaaatatctgatgagtttgcagtcccaccaagtcccccagtctgtacaaaccaccttttctgaagcagaagaaactacacaaaagtgatggatagtttatctgcctatggtttcctgcctacctagtgcagggtttctcaagggtttctcaagctcactcataacattataggtttggtaaatattgctgtgaagttttcctatgtgttattaggatatttaggaacatccatggacttctacctactacatgccagcaaatgtcacagtatatgtaggcatcaacaacatcccctgggcaaaaaagtgatcaagtcagcgttaaaaaaaacattgacctagatggaaagaagaatgtttatacattctggatattaatctctggggagtcatgtacataatgctttcaaatttgatggatcaaagcattctaaaagaagatgtaggctcaacttctagggcatttgccttgcatgaccaggacactgaatatgttccttaccattaataataataataatagtaataataataatagacaatatgaataatttgagtatttaactctctcccatctacaataagtccttaactgcttcatttggtagaacaatgttgttaaaataatattttttctctcttaaaataaattcctcaaagccagtaattacagatcacagaagcaagtaatggtgatgtctttgtagatgtacagggcatgtgtcttcctctttccctgcagtttattatttatgaattatttgtatgccccaggagtctttcatcttctatcagttatattagtttgggtgggtgttcaaagttactggcttaaaacaatggaaactcatctcacagttttgggggtaagaaacttgaaattagtaccacctggatagaatcaaagtgtaagcaaggccacagtgccatcataggctctgaggtggattctgtcccttgtgttttccagcctctggtaactatagactcattcctttgccttgtgaccacatttgctctcccctctgcctccacagtcacatcccctattgtggttgtcactggatctctttctgcctttcctttaaagggatgctcattataccattgtaacatactggataatcgaggatggtcttcccatctcaaaattcttcgtttgaccacaccactgaaataaatgccaccactttcattttgccatatcctgtaacagttacaggttccagtgacatggatgtgttaggagtgtgatgatcagcccctcctacttgcccatttggattgcataaagcacagatgacatccactttataaagaaacaatggctcaaccaagtaaactggcactaaaaattctcctcatcaactacctatccgtgctaccctacttgttggtcactgtttggcaaactcaccttggggctttcccaattgaggttctgtacatcattgatgcagcatacatttaccattgtgccaaagactgaggacaaaacagtagattagaagcatggtctgctgtttagcacattttcactcaatgttagtctgaaatatcctttttgagattataatataattccatcattttccatgtctcttcccttcctctaacctcccccatatattcctccttgttctctttacaatccatagcatctttttatttgatggttgctacatacttgtgtgtgtgtgtgtgtgtgtgtgtgtgtgtgtgtgtgtgtatgctcctgaatacataattacattcctgctcagtctgtatagtgttacttataagtttgtgggactgaatggttggaattaaataaccaattggtactctcttccctgggctagactatttatttttttctgttctcagcatccgttagctgcctactcattcttttaatactaaagtctacacctgtccctgaaattcacacacacacacacacacacacacacacacacacacacacacacacaccttttctataataatcatgtctgtataaataaatcaagaatccagagatttagattccctctttttaattaatcatggcccaggaagatataggactattcccattcttccaaagacatatgacactgtgaaattagtgtaaccatgaggaatgacaagatggactttttaagcttgggatggttctagaaagtgtactatcatactgagaggattaaagatgagaaaccatacgtagttgcacaaggtattggaatagcaccagggaaatgaaaggagacttaatatagcacaagaagaaagcaagctatcacttttaatattcatcgagtccatgacagcatgctgcttcacacactcatcagcatttcacattggcagtacagagtaggcatatgccacgtataatttttacaaatctctttcacaaaatagtctctagattggtttcttatgacatctctgtatgaagggtggctattatcatcattctatttcacaggttaaaatacaacacaaaaacaacaaaggtttcaagaattaattttctctaggcagaataaattgcaagatttctttgtaatcactgtctcctccaaatactgtatctcatttaaccatggcataaaaagacagctgggcgtggtggcgcacgcctttaatcccagcactcaggaggcagaggcaggcggatttctgagttcgaggccagcctggtccacaaagtgcgttccaggacaaccctgtctcaaaaacaaaaacaaaaacaaaaaacaaaaaacaaaaaacaaaacaaaacaagacaaaaaaaacaaaacaaaaagataaaaagatgtctcataacattataagccatggctactgagttgttagtatatctaacaaataccctattattcagttacatagttcaacccttggaacgtgagtatccaacactcacttttcatgtaattcaggtacatgaccaaaaggtggcagtaacttcctgggtcagaagcttgaatgctcagtcttaaattgctatgctcacattaggttataacaaaaaagtatagatttccaggactttattgttttcaaaatttttactttgttactttattgtattttaaataatattttcagctacatttaaaggttctcaatataaaaactatatcaagaaaacaaaaatacatgatgtggtatacttaaaaataagttaaaaatactccctttttaactacaatttcaacaaggtttggtcttatcccaagactataaattgcaatattcgtttctacttcactctaagtgtttcccttcctgtgacatgactgtaagatttctgtttaacttaacaaaagagccaagggctctattcacaagtgggtttccttccttccttcctccctccctccctccctccctccctccctccctccctccctccctcctttctttctttctcttgttttttccttctttttctttcccgtttctctaaaagctttcaagggaagtacttcaaaaagagtacatcagagtatctctcatctgcagctccctgcttctagtgtttcttcctctcctcaacagagacactatcaaatggcaatgtgttatcactgaaagagcagcccggtttttttttttcttttgttgctattaataatgaagtaaattttttctcagtactaaaaagataacaccatccctcttcctttaagggatctgcatatgtagctgcctactcagtgcattgcaaactctccgtcatatgattttccagcaaattcttaacaacctgcaatgttcagagtgcattctctcacagataagtttgttttgtccaaactaatggctataaacctaagctcacaacacagcatcaaatcaaaaaagcctacccatacatatatattatgcatatgttcatgtgtgtacttttttaaaattaactatttatttatttacattctagacattgccccctcttagtccccactcctacagttcttcatcccattccccctttggctttgagagagtgtttcccctgggcatcctcattccctgtggcctcaagtctctataagattaggtgtatccttgccaactgaggccaggtgtgtgtacttttatagagagatgtataactgctgcataagagatcaactggtacattatagtaaacatagcccatattctcagtgagaaaaaaagttgtaaatttctaggcttggcactgtggtagtgactatgataactagaggaagtgtaagccacagctcctgcctcaagagatttgcaatgcaattgaagagatgatattcctaaatgaaacatttctatatcagtgtaatatgtacatcagcacatattcaaaagaatgagtagaaataatatgaggtccagagaagtgtagtacaaagaatcgtttcgtgggagagatcttgaaggttgaggacataatgtgtaaccataagccaaagataagaatcagctcacaaaaataaagaggtaagaacaaacctggtaggattgtaggccaattgcagacttgactagaacaaaacagaaatgagggtagataaatccattcaagttattgtataggttatgtaagagatggagagttaagaaatgatgatcaacttctaaacattaccatctgcttctttatgctgactgagttctaaaagttaagaagaaaagcattttctagaggaagtctgtagctatgactagtgatagaagacaaactagatgtagtggaataaagatggcctatccctgagatgagaaatagagaaaacccttggtcttgggacagtagtccacaaagcaagaacacaaatcatcagtactactagaagtctaatatattcgaaaagggtgaagatatgtatttgaagtgttgaaaattgaagagaggtggtatatatgttgttaagggaagctaaaaatgtattccaagatagaaaaagagagtttagagaaaagtgcattctttgcttttagattaagtgagcctgggccatcagtagcatcagggtccttctgtgtgtaatgtggctcctatttttttctctcacatattcagcattaattcatcttcccttccaagcaatcctatatttaatgactgtcatatggctcaagaaacttgaccgcaacactgtcacttcatggatacaagtaagaagacttatactaaagtccttgcagaagatagttttcagataagatctgcacttgtcatatctgcagagagcatctgtcagcgtcctcataggctacacatagagaattggcttctaatccttaacactctgactttgtcctgctgcttctctcctgatggggctgagacatgcaaattaaatctagtttatttgattcgagtttgagttatcactgccctgtgctccataaaggaagtgaaaacatttctttttcaaactgaccagaatacttagaacaagacagtcaagactataaaacccctttcagtaaaataaaatgaatcccgtatataaaatatgttggtgtctttccagctatggagcaatgggatatctaatccaccagaacaaaatgcatcagagaattctgttgttttaaaggcactggttcagaaattagcaaacaaaacctcagtaagatatcttaaatcctctttgccagataagatagtcagttgtacataagaaaaatgtaaagagggggtattcaaagttaccaaggaagttatgtctgcttcttccccagtgattgttagcagactaccatagtatccttttatccgaggtttccctttctgggatttcagtggtgatccaaaactcttcagtgaaaattttaaaaataaagtagtcacaatttttaaagtgttcaacatcctaagtagcatgataaaatgttgtaccaactcatgttgtgccaactgagacatgacatatctactcagactctatgtgctgcccatttatcttatagtcactctgttatcagatttattcttgtaatatcatagcattagtggttcagtaacctttgtttcacttaatagcggcctcaaagtgtaaaaatagtaacactatttacatataccaagggtagccatgaactgcctctcataaatggaaggtagaaacacaaggtattttgagagacacaatattcacttttattttagaatatattgttattgttgttttattttagtgttatcgttaagcccttgttagatatattttaaaattcaacttgaccataaatattcatgtttgagagaagagtatacatatagagtttactaagtactacccttaataaggggtcaatataaagtcttgcaacatatttcctgcaaatgatgaaaggctagaatacagtgattggatgaaagtatattggagagtctggctatcaggactcgaatctcagacctgtcatctagaattgggtgaccttaagcaagttatttcagctttctctgtggtctctgtatgctggagataatagcattatattagctgacaaaaagattgcatgaataaatgtatttaagacacataatatggtacccaacacacggtaagtattcaaaagataatacaaacatggtttgaatttccttcaagccacatggctctctgacaacagccttataggcattattagcaagcaagaaaaaaaaactatcacactatcttagggttttctttgctgtgaagagataccatgaccaaggcaactcttagagggacaacatttaattgggggtggcttacaggttcagaggttcagtccattatcatcaagttgggaagcatggcagcatctaggcaggtattgtgcaggaagagctgagagttctacaacttcatctgaaggctgctgggaaaagactggcttctacttagttaggaggaggttctcattacctacctcaacagtgacacacttcttctaacaaggccatacctactaatagtgccactccctgggccaagcatattcaaaccaccacacacactaatacctagaattgttggtaatttttattaaaaaatattttcacttatatgattatgtataatatagcatagatatattatacatatgtgatatgtataatatatcttcacccttaccaattccatgtatgacaccttaaacttctactgtcaacaccatcatttcttttgctgacttcttctggatgccagagcctactttttcaatccctatatggtacaatgaataaatgaagagattgcgtttctaatcaaagactactaagagtcaatctgtccataataagttgcacatgtattatattgcctcttagaatgtcatctaaagccttaaagccgagtcattctctgcagtagctaggtcagttacaccatcattaagaccttcattttatattatgtttcactacccgattctgacaccagtattttcttcaactcacagagaaactacttaatcatttctttaagtaattgtctccgggtcaatttctcagggaaccacacaaacctatgagaaaaccgaaagcaaatgtgatacttttgccacaacaaaactgaattgtagatcaattgaaaaataagggacatagacttagaactcccatctcttgatcttctgtatccgttgttgtttatgactatatgtcataccctttcccaggcatacaccaactaacaatgtcaggaaatacccttatcttcctcattttatattagttaatttccttaaagtctttttctggatcccgcagagaagggtcacatttgagctgacatatattattagacttatccatgtattacatgcatatttatgagtttgtactttaaatatcggttcctaactaggcatctaaataatgaacactgagttatctgtcagagtccataaatggattgttgaggttcatcaagactctaacatagaaattctgaattagtagcaactgatctgtcaaagtaatgcttatggaacttattgcattagtcatactataaggtccctttgataatttttcaggaaattggagacccaaaggacctcagagtcatgtgtgtaccatcagttctcattacatggcaagagctacataacaaatggatgatgataattccctgattaataagaacatatttttaaaatatgagacatcatcatttcatggcttcatgttctatatcttccacccaaaagggaggtacactatagtcttgggaaccataactgaaagactagttagcctgagcatctgctaaatgtagattacaagaatgttgtatccattggggtctctcactttaagagaatccttaattagtggccatctggcctcctaggaaagactgtaattaaagtagccatgaaggagcagtgaacatgtaacacatgaagagtgaaaaccttgcctggctgtgccttccctccgggatactcagtactcaggtgaatgccaagggcacattgggatatttttatttttcataaaaatgatttgagtcccaagaatgggaataaataaatcaccagctgagttgtatggcagacacaaaccttactaacatctgactctccgcagtaaatctgtttcagtgcatatctttagttctcaatgtccctgtttgttccagttgattttctgttcttcatttcagtaataggagggtcttgccactttggcctaaatgaagaagctgaacaagacccatggcttttgtcaaatgtatgcatccatgtatttttttcctgaaaaacagaagagtaagttattatcaacagttgtttcttaaaagaggaatcaactgaatgttcccaaatagtatctgctgagtttgaaatgatctctgctgcaatattcaaatgtgaagttgtgaacaaacaacgtatttgttctaagattgttaaaaaaataacaaaaacaagaaaggctgtgtgtacactacttcttgatatccgcaaaacctattggtaaacaccttcggcagtccctctccttagatagagaatgagatcagaaatggattgctgaaagagggtacaacccactgatgcatttaaaccattgagttcagctgtaaccatatttctctgaaagaggtcaaattatgagaatcacttaagaagaatggagggcaacactccaggcttcaaaagaacctttcacccaacccctagtttgcaaaagcaacagtattaaagacttgcaacaaggctaaggatccagagctaaacacttacctgaacaccaatctgtgcactttaggggatttcttcaaatttcttcaaagtgaggccctattgaacttgtctcagagtcttcacattttgcacataattctaatcagattttcatgtttggtttaaaggtcctgcaatcaattattgaataaggatgatacaaataggcagactaaagtgaacagggaacagcacacaagacctcaactgtacacaaagaattacaggctatcaaggaatgctgggtgctggaaaaatagtcttttccagggaaaactcaccgattggttgtctaataccaaatggctagccctggaaacatacagacaagaaacattatacagactgagcaggctatatttaggaatatatgtgtgtatgtaacaacaattaatgaaaaaagaagccatgaatttgaaagagcaaggaggggtgtgtgggagggtgctaaaggggggaaatgaagggagaaatgatatgtcatcatctcaaaatttttaatgtttagaaaaatgttgtgttttaatgctagagagtgaatgtttttcaaaacagatttttaaaaaatacatagcaaatggagagaataaaggctgacaaaataactgcaatttggaaatgtttagtggtggaacaaacattcttataagctataatggggcctgagggcatcactggatacagctcactaggaagctgaagatcatatcctgggcactgagtcatcaagagtagatgcaattccatgccatatattctgcctaaagaggctaggaagtatgtagcacgtgctagaaaatgttctaacctgagtgcttacattaaaaactgttgaatactaggaagcaaatttaaactccagaaaattctgctacccagaaatgttctcttttcagagctccatctgttgctgaggttttactctcttcattttgacctcatcctctacagtcttggtcacctctcagttaaaaaagatgaatttccatctgacgctcctttttacagtggaaaatacaagctccaagtttttctactcttgaaagaaaggagtacttaaaaaaatgttgtgctccatgtgaatcaaatagtattcttattcttatacttattcttatattagctatgaatttccaataaaaactctagtgtaaatcattatagcctggaagtgaaggataattacctataatataactttgcaaaagagaaaaatcctggtcgaattagattatgaggcagttcatatcatttctcagttgtatattcaacatttggtttccatgttaccagcagcaactaacatgtctgtaacctacatcttctgaacatgtcaaagaaatacaaaacagattttgtttgtatggagcagttcagatattctgagacccggtaagcatagtgggcccagagtagaggaaaatggaatcaagatgaagcaaacaatgcatgcccttgttgcaggctactatatggctaaaaatagagagaagggggagagggtggaagtggggagggaaaagaagagggagagagggagggagggagagagggagagagagacagagacagagacagagacagagagacagagagactgggcctgccatgaggtttaaaagcacatcccccagtaacacacttcctccaacaaggtcataccacctaattcttctcaaatagtgccactccctcatgacaacacatttaaatatatgaacccatgggagccattcttattcaaaccaccacagctagatagctcagttaaccaatattgcccaaaatgtatgacattatgaactcatgtacaagtttaggaccaagttctcaaaatataagacagtgcaattcatttctgtgcaaaagtacaaagatagcaactgaaaaaatattaaatttcacactgcaaccagctttatgaaaacatgttgagttttatagtgtaccaaaaagaatgtctagttttttgaaaataggtatgaaatgatactttgctttgaaactacatgtagaaaactacttttcctcatatgcttcacatagagctataaatggtatcagattgtatgaagaagcagacatggaatccatctacctttaggtgattgatatataccttaaagagatttacaaaatttttagagaggacaaggctgcccatactttttcctttgtatgtgttttagaaatagaggattattttgaatttttaaattaacatttaacacctttgttattcttattggtaaattaattaatacaactgccttttaatttttttaaaaaaatgtattgctaaaggatgggcatactacaagaaaggttgagggtggggtgattaagacaagctgacaaaaaaagtcacaattctcccactaactaaactagattccagaagtggcgagcatggagagagagagagagagagagagagagagagagagagagagagagagagagagagagagagatctgataaactctaatttggtagcatttgtggataagggatcagagaccaaatctttaactgcatctcaacctttctgcatctcaacctttggagttaagagtgaaaactcagaaaggtagatgaactgtgcaaagtgctaagtatagatagaaggttcaccaggaaaacctaggctaggctactaggaggattacctgggatggtggttgaacaaagaatggttacaggtaattgaagagggggagaaaggcagaggtataaggcaaaagagcccaaggaaacaagagatgcttcagcaaaagctactgtgtgtatacatttggacaaaagcttataactgggtcactagacttagaaaaatttattttttatttaccatctcattgcattgatcactagaaaaatctttctaccactgcataacactcaaacacccataaacatcatgtaaaccttgaatttcaaaaatgagcaagaagatgaccaggtttccttttttaaggctttctgtagagagaagcattgtagcctttcagaataagccctgcagtcagtggccctgataaaacttaagtgtaaagactggcattggtagaatggcagaacagagggtaccaagctcccattccttcacagacatacacattagaaaataagctgaaactgtcagaatgaactctgttagaaatctggaaaatggcagagtcatagatccccagcaattgatgaatcaagaaaaatacaccttgcacatagttgaaaggctttggtagtacatattcctgccctcacctcatcttagcagtggactttgaaggtggcaacctatgtttcctgtgttccctgggggtcctgattgcagagaaatcaaagcagacctcatcaaaaaaattactatgtaggtctgttataaactgtcttagggcattctggggggcgaatgcataatactcccccctccatttcacctaactcagaaatctatctgcatataacagtggcagacattgttcaaaaacactgtaagataaccaacaaacttataactaccttgggcaaaatattattatggttggagaaaataatattcaacctaaagacaaaggttcactagatgcactagggaaataatttctttaggaaagaaaaatcaaaatcactcatgtatgctgtacagtgcagaaagtcatgagtatgcttcaggcaggatgtatgttcagaaaagacctatggagaccttaagctcttactgatgccttttctcttcacttcatataagcaacaattgaaggttaaagcaaaattataaaattatagcctaactgataacagagggtgccggaagtgagccaacaaatatgtaggtaagagattaggaaatctctgacaaaatactggctgattacactctaaaggaacagagacttcagtaaccagtttcagaggcttagtctattatcatcatggtgaggagcatggcgagagccatggtagaatggtgcatgaaaaatagctgagtgggagagagagagagagagagagaaagagagagagagagagagagagagagagagagagagagagagagagagagagagagagatcctgggcctggcataggctgttaaaacttcaaagcccacttccattgacatgcttcctccaacaaggctacacctaccccaacagggtcatccttctgatcctttcaaacagtttcactacctgatgactaagtattcaaatatatgaattcatgagggctaccacactactctagcaagatatcatatgatactctctatcaatgcagcagtaagccacacaatcacaagggaaacagcctactgaggtgtactatgttaagatatgttgtttaatacattagatatatttagtgcattttcatctaattttcattcaataatgaaacaaagcatattacaattatatccaaacattataatctgataagggtttccccaatctcctcacagatcctaccacctccctactcatccaactctatgccttttttctctctttctttcaaaaacaaacaggtagaaaaaatacaaagaaaaagcacaagaacttgatgttttgggttaacatgcatgaaataatttatgaatttccttatcaactttagcaaaatattggcatagttaagttgacatagatgtgctgtcttgataagcttattttattgtttacatctttgaagttactttatacctaagctgtttcttaaaaatttacaaatagatcaaatactttatctaacataaaaatatttttgttatacattttaaagcaaaatattactttatagtaaaaaatatttttcagtgttttatatatttattttgatatatctcatcataaatttgggaacatctatacagcagaatagaataaggaatacatgctgtaacttggataaagctgaaagtattaacattgttttaggtgaataaaaacacaagagatcatatgttatatgtttctattcatatgaaacatgcagaatagattaattaaaacacagaggaagaatatacttcagcaattgttaggagttggagctaactgaagtgagaagggatgaagagaagagcttaatgagttaagagctttactttgtaatgatgggaatgaagaactagatagcgctgatgcttttgtctcattcttcctacactagtgctgcagaattggccatcttgaagtggttgcatttgtgttgcgtgcatttcccctacataaattacttcacaagtctgtaagtgcttaatatctgtttgaaatgttaatattttcatgcactcctataagcatagtaaataaaatacaaccttctgcaaactgaaaaaaattatctagccaattagtaaacatggaaattaggaaataaggttagaaggaatagtcaattaaaataacaatagaaacagtgtttgaccataatggccaagaagccattccacatatgtcacctctgtctaaaagcagaagggcagaagaggtttactcagacattgtatccaaggtaggacaggcagaaaagggaaatgaactaattctttagttgcatgtgtcaatgagctatgcatttcacctatttgcattctagcgaacaggctgattgattgtttggttttgttttgctttgtgtcttttttataacagttttattactttttgaaattataatataatcatatcatttccccattctctttcctcccttcataccttcctacatacatccacttgctttctcaaatttatgacaatgttttcattgaaaatagattattctattatacaatatatcccaaccagtttccccttcctccgctcctcccatctcccctgccccctctcctctaccacaaaaccacactccctctattacctcttcataaaaaaagcaggcctccaagagacaacagccaaacagcccaaaacaagctacattaagacaacagaaaatttcaatgttggacaagataacccaataggaggaaaaagtcccaagagtggtcaaagagtcagagatacattcactcctcctcttaggaattccacaaaacatgaggataacaatcataacacacaggcacactcacaaagacacaccaacaaacacagagagagagagagagagagagagagagagagagagagagagagagagagagagagagagagagaggagctgttcagacccatgcaaaccacatgattgcccttcagtctctgagtccatatgagccctgtgtaacttaatcagtgagccatattttcctgatatttttccacctgttctgattcctacactttcttctccctcttttatgtggtacctcatgctttgaggggagagatctgatagagacctccaatttagactgtctttcttcataatgtctgtgtgtgtgtgtgtgtgtgtgtgtgtgtgtgtctgaacccacttccatctcctgctggaggaagcctctctggtgaagacagggcacagtaccagtctatgaatatagcagaatatcactggggatcatgtcattgattatcttttcttagctgggaacatttggttctaccctaagtctctaggctatccaatctcaggcttcttaccatctaggcagtgttgggcatgaatttcatctcatggcctgggcctcaaaagttagtccagtcattagttggccactccttcaagttctgaatgtctattgtcccaacacatcttgcaggcagaagaagttgtaggttaagggttttgtggctgggttgatgtctaggctcctctttctgtaacctgcagagtactttttcatgccaaagtgattagaatgtagaaacaacatccacacagctcattgaatatagagaagtttagctggtgtctgtatggagcctattattctttaattgttgaacaattaaagaacaattaaacaattaattgttgaacaacagttaaagaacacactcatatgtgtgtatgtgttttatgtattcccaaatatataaacataacctatatagtccatatgaagttacatgtatatataatttcagagctgaccacttgatattggttatccaaatggtatgctcatccctgcagaagactttttctcctgctctcaacactctttagttccctgtattaaggtgcttgtgttagttttttcagtactgatgctaaagtcccttttctaaaagccaataggcaagagatgctcaaagggctaaagttttagttctagtctgaggcaacactccaagaacaaagcaattccacaactgaagtccttagttggaaatagtcctcttagtgcaggttcagcctctgctttattcaggcattcgatgggttagattagtcccacccacattattaaagataaagtgcttcttttactcagtctacccattcaaatgttaatcacatcctcaaatgggcacattcataataatgaccaactatcttggtattctacctaatagccctgtcaagttgacatataaaattattaatcacagcagtagtaaagacaagtcttacctctttctctgggaagattggacttttgaggtcatttgtaccctctttctactcaagcacatatcagcatcactaagaaggtagggtttatttttatgatgatttaaatgatatgaatcttataaagacagattcctaaagaagtacattttagagactgagaaaggataggatattatggattaaaactaccttaacaaattttcatttatttggattgataaagtctcattttccaatccctgacacacatatacctttgaggcttcagtcatgttaggaataacaagcatgcaagggaacaatgaacttcagcaaaatatgaaactacaagtgcagataaagcagaccatacaaccagaatataggaacacattcaaaagatagtacaaatataggaagttctggaaactggatacaataacatatttttaaatggaattagatacaataatagatccaaacttagcaggtaaatacagaaagtctagaatgtacaaggtgaagaagctcaaagaaagaggctcacatgagactatggaaaccagaagactcgtaaatcaggcaatttctccatctcaggcagggggccttttagaccttttcatagtattctgaggtctgctctccaagatctgggcagttcaggaccaacattacttccagttcctcaatccgtatctttatcagaaaattctgccaaggactatgagaaactcccaagaggctggaggctgagaacagatttcagtagcaggtggtagaattacaaagagaaaggccaaggagaaaggagaccagaaagaattctaaagtgtctcaatcctgtttgaatgaaaaaacaaaatagagctcactcaatggccaataacttctttttcccccttttttattataatttttattagatatttcctttatttacatttcaaatgttatcccctttcctagtttcccctcctgtttcactcttctggaatcagactatataaatgctaaacaataccaatgtagaaaatggtatgtcttatcagtaaaacacatagctgttactcttaccctttaaaatgctacttacagtaaatcccattgtaattagcatgtttcttctttccttgaacttgaaccaagctggaaagtcttacccatcacattttcttttcttttctttttccttttctttttctttttctttttctttttctttttctttttctttctttcttcttctttttttggtgtgtgtgtgtggttataatttcagaaatgctgtaaactgctcctgttctagctgtgttagttttgatttcatactcccacttcatgaaaattacagcacaattcaccatttgtaatgctaatagaaagtacttattcattcaacatgtggatttagctcctactatgtaccaagcattgttctagataccgaatatatagcagtgggaaagcaatacaaattcccctattgcctgtagtttatgttcttgtgaactttcagatgtgccacctggaggatctgataaccaggcatttgacctgccctggcatacgtggaaaatagcagtcttccacttccaacagaaatttcattcctctctgtagccgtctcatcatgttccttctgtagcatctgctgacagttagaatatgctatggtgaatgtgaaatgactcccacacttatgtatccgattgcctgcttcccattctccataaaaaataaagggcaaaagacttgggcaaaaagaagtttaaatatgacttagagcatccagttcttacagtataaatattgtctcttcacccacccatctcttggactgaagtgtatatctgtacatgaccatcaagctcctgagtctcttgaagctagacttcttagaaagtcttattcaaacgctttggatatttgctaactacccactaagtgccatgcagttggcactcagtgataatctctaatatagtccatctattttttatgttaagtctgtaggtgtaaagagaacagctctttctctttggtagaggaattttaattcagcagcatggctactttggcaagggatcacatctaaaaatatgatccagctggaatacagacacgccctggtttacagtataatctggctgagatatggccacatccttagtatacacctttaatccataacaatgaaggtaaggttagtttgtagaagaagcagccatgtttgaatgtgacatctagttgagggtcagacaaagtgatgactcaaagaaagatataacagatgagtcagagataggatatgtccaactcacacaagaatagcagaggaagagtggatacataagagcagcaagagaggaaaaaaagggtggtgtggtgtggtaggtgtatatctgtacatgaccatcatgtggcaatgtggcaatgacttatccaagatcaaaaaacttgcaagaaatctcttggaatgtgcaaactgttctattgacctcataaatcctgccctgtagtgtcagttgggggtacttcattctttatttgtccattcaagcatgtatattatgcattccaagtattacatgtacaatatccttggtcttacagtagccatattcaatcatctttcctgttattattctcttttcatttgcatcctaagagagaaggagaggaaactgtgttggtagtaaaatgttcattcaatagagtaagacaatctaaatttctatgcccattttggcagtgggaatctcaagaagttttgtaatatgcataaatataaagacagtgccaaaattctagacatttgaatgaataattgaattaatattttatggcacaactgggtagcaaagaaaatgctttcgtttggacttgactacaggaattgagtagaaagaagtgtctttcctgaccatctggaagctttttaatattctgtttctgtttgttttgttttcttcttattgtttattcctttcttattcattttatttcgggggataatacaatatattcatcttatattgcaaattaagagaagagcctgcatcaccaagtcagttctaagttatatttaaggatggagtacaaaaacttaacaaaaaaattgggaagtggcaggtgattctttgtgacttagtagaataaattgtcactaacccagctcccatcagacctttcttcaaagtttctaacaataagagagtaaactgattttaggccaattacctctattctcctgtgaccctgtggtgtagctggtaataagaaggatagagatctcaaaggccagcagtaaatggaagttctcaagcagcccgaagcatccgacaagtagataaacatcccccagaagagttgaaaattgattgctgtcatgagtgggaaaagtcagcttcagtcaggttattgattatttgattgttgaaaaattatccttggtgcctggacccataggaccatgaacaatgaaaaagtaaacatttcaaaaaaaaaaaaagctaagctgatataacagggattcaaatgaggtatctgtctaactcaagagataaagaacactggaggcagctgtgcctttaaattgaatggttgacaaagtcaaatgtgattgttgccagtcaggccccagagattccatttttgctttttctgcctctgcaaaataatacttgctcatctcatcacattgataatgtactgtcagcactagggaaacaaagtgtgtgcttttagaattcaggtctaaccacatcaatcaggtgatacactattgggacctcagggtgttctattgccttctgtgttcctcattgctgaagccctagaggaaacgtgttaaaacaaagggtatttccacacaaagcacccctgtcccacctagacttctaattccattttcaaaagaccaagactctaaacttttgctctcaatcaatcctactactacttggtccatgaggagagagatagggtacatctttgcccaagtttctcctttcataagcaattgttacacagaaacaccagacatctaaaacatgagaaaataagcacaagtactgatttaaatatcagtacattaaaatgtgttagatatgagtagaagataaattcaatgtcatatataaacaattgttattagtctaaatctctaagaattggagttttgaggctaaaatttatttcagagtgcaggtaaggaataaaatagatgaaaaagtttgtttgacaggagattttaatctcaccatatttctagcatccattctactggctattctgtggtagttactttctcaacaccaaatgtgtagcaaaagcaactcatgatgggttttttttttttggtattttcctcatttacatttccaatgctatcccaaaagtcccccataccctcccccccccacccccctacccactcactcccacttcttggccctggcgttcccctgtactggggcatataaagtttgcaagtccaatgggcctctctttccagtgatggccaactaggccatcttttgatacatatgcagctagagtgacacaggctaaagtcacctggaaagaaagtctcaaaaaggaattgtctctattggcttggcctgtgggcatgtctgtggggagatcttggttttgttaactaatgtaggaacacccagtccattgtgggtagcaccatttcctgggtttgagaatggataaagtgagctgagtagtgaggatgtgtgtgtttattctctctctgctcttgactgtggacatgactagctacttcacgttcctgcttcattgactgccccacaatggtggacagtaatatgtaattctatgccaaacaagcccttctttctttaaagttgcttttgttggggtgtttgccacagaaacagtaaacaaaactaaaatggtttcagagtatatacggcatgaaagatatggcagacggagtggattgttctgcagtggcaaaatcttgcccaggcatcttctcatatgggaccagagagcttagagcttggggaagaagcagagcagggcttgcctcctccatttcacatgaaccactttctcccagctaggactcacattctgaaggtatacctcccaaaacaaccatctgggagtcaaacattcaaacatatgaacatgtgtgagacttttcacattcaaatcataatgtgttctgtcaacagattagacaaaaagaacataaatatatggctgcagttaccacaaccagaaggctttttgctctctagacctcaatttcctctttggaaatggggattcaatttcctctttggaaattgggatacacacacacacacacacacacacacacacacacacacacacacacacacacatatatatatatatatatatatatatatatatatatatatatatatattatccttaacatgccttggttcacagttccagactctacagtttctggggatggtttgtcttctgaactggctcaaggttcctatgcataatttcatttcactgaaaagatgactaatttctataagcagcaaaattcaaaatgggaccctgatttcccacatttattggtacatcccttccccctaggtatttaattcaacaccaatgtagatccagttgtaaaggtattatagatgtaattaaaggcccagataaactgaccataaaatagcgatagtgttttggttagacccatctaattgtataaatatttttcaagatgggtattttctgtggctgataagaaaaaagttagagaggcatgcactagctggcttgaaagaaaccagtggtacatgtgaaagctacccttgggggccacaagacaagaaacaattcaacttctctaatggctgggtgacccctagacccctagacctctaatgagagaaagaaaaccatctctgccaataacctgaatgagatcagaagaagctctgattcctgacaagatgtgcagtcctagccagacaccttgagttcagcttagtgagatcatgaccagaaaatccaagcatactatgtgtagactcctcacctagtgaaactataaaagctatccaaatttatattagttgaagccattaagtctgtagacattttttatgaagccataaaaaaactaatataggttcatttagtcaccaaatcctgtgtcctgttggcctctcctctttttttaatcattattttaatttattaggattttcctcttttgttgctttcaatttcctttagcttgaggattatttcctcttgttcacatcacttctctgaacagaaacaaaaagaatttacaggtaataaatttttaagttttacagcattatatcacttaatcacagctacaacttcctgtcattaaaaacacttactattaagcctgatgacctgggtttgagccctagaacttacatggtatgagagaatacaagttgacctctaagcacaacacgggagtcctagagtgtgcatatgcacttttgaacatgcaaacacacacacaaaactgaataaatgtaattttttaaaaattaaattaaataatatgaattaaattccaagttatatagaatccaaaatgatttcatgtattatttagccaattcttggattcagtacaagtccatatgcaagatcaattccttcatttggctatagccagtgaagcatcagtgcatgtcagaaaaccgggctatcatagtgaataagacataaacaatagctacccttgtggaattcacactgtaataaaacatgctctaggcaattgtaatgaaaaatcaaactttttgttttcaacttcctatgatgtgtgctccaaaaggtaatataaactatatcatttaaaggggagagtcctcatacagaattcttaatggtctttccatgttttgtttgtaataagtcttcaactgtgtcctctgatttacaggtatcgtgcacctcattttgaactagccacatttcaagtcttaataaccatgtacagtttatggccatggtactagctagcaccagtccagttgaaatcgcaatgcactgtgatactctgttatgctaggagaagtgctgagggccatgggaacatgagggcactcaagtagggaatggagaaaacaagaaacgtttagtaagttttaatcaggtcaacagtggaggaaagactgtacagaataaagaaatcacacaagctgtaaattgaccgaccatacaagacacaaagttttgtatgagcaaagtccagaggaaggaaagcagaggggcagagcatgtgcaggattgcagacaccatcaagagtgtgggtgggaagaacaggtttggtacctcctgtggaactggcctcactgcctgccaatccaaggtgtgagtgctgcctcttgcttacgtaggctctctcataagcaaatgctccttggattagaaatggttctctctcaacttctctttctgcaaggatcttatacctcaaaccctgtgacttagcaaatttaaatcctccgcaatattactaccaattgtccaaggaaaattctccttggaatccaaaatagaagtttttcacagccctgtacacttaatattattctcacactgggctcctcaaccttctccagtagtctctttctccatacaagtaatgataatagtagcatgcttaataacttacaagatcccatgctaggtgattttcatgaattactcctttatatattttacttttaaagttatataattaccttttccctcctctttattccctctaatccctctcatgtacccttcatgttctctttctctcaaattcataccctttttattagttgttatataaatacacatattatatagtcttatatatttctaaatgtataaatataatatgcttagtctacacaatgttacctgaatatatatttttttcatgattgaccacttggaattgaataacaaactaggtttttttgtttttctgaaggacatcatttctcctactttcagaatttaataggtgaccataattttttgtcttaagctgaggccctgaaagctttcctatttccatgtaagtatgtccattggtgacttcattgttgtttaggcagccatgttgatgagacttcataagtgtgacctctctgacatttctttctttctttctttttttttttttacttttttaaaaattagatattttctttatttacattttaaatgttatcccctttcctggtttcctctccaaaaatcccatatcccctcccccctcctcctgctcccaacccacccactcctgcttcctggccctggcattcccctacactagggcatcgagccctcacaggacgaagggcctctcctcccattgatgaccgactagaccatcctctgctacatatgcagctaaagccatgagtcccaccatgtgttttctttggttggtggtttagttccagggagctctgggggtactggttggttcatattgttgttcctcctatggggctgcaaaccccttcagctccttgggtcctttctctagctccttcattggggaccctgtactctgtccaatggatgattgtgagcatccaccgttgtatttgtcaggtactggcagagcctctcaagagacagttatatcaggatcctgtcagcaagaacttcttggcatctgccatagcgtctgggtttggtggttgtttatgggatggatccccaggtggggcagtccagatggtcattccttcagtatctgctccacactttgtctctctaactccttccatggatgtttttgttccccattctaggaaggatcgaagcacccacacttcggtcttccttcttcttgagttttatgtggtttgtgaattgtatcttgggtattctgagcttctgggctaatatccaccctctgacatttctaagagacatgatctcacagcaaactttttgtttctctggcccttcttacatttagtttatcccatttttagtaataatccctgagccttaggtccagaaattatgttggaaatatatcagttgtgactctaatcattgtgattctaaatagccttaagttcttctcaacaagaggaaaacaatgtctggcactggaaaattacttcctagggctagtgaagtcatgggcactggaaaagagcttacaaccaccattttattaagccttaattcctaaggatggtctgaatatttacctttatacatacccacagataagtgcagttctccaccccccttcaaagaaacttctctttgagacaaagagtgaccagtacagaaaatcataactgacccaaatgggagaagaagagataatctgatgctcagtcccagttatcatttttagctataattatagtctgtgttgtatcccttttgttagcctttgtatgcagacaaaactcgaggtttcaagaggtgtcatgattcattcaaggtgaatgaagtgtggcaaaccagaggtaccaatgcaatgtaaacccaatcagtctaagtttggatcgctaacatttggttactgttctacatgcccctcccttcacacatattacacaagcacacacagagcaaactcatacccatgagaaacagatgaataattccaaccaagctctcaaaaatgttgagatggtgctcactccaggaaagaagagtctgagtagatggtaatgaagtaccagactgtgaagcatgagacagaaagagtgtcactgagctgccacgtatgggttctgagtatcctcatataggtcaacgtttttctactgtggactacccaaagaaacatgaatgcatgcaagaaagactggatagataacaaaatatgtataactaggcatgtttctcctgcatacatatacttgtacacacacatattggcctgtctccctgcaagacagtgcttctctgcaagatgtacaacaatatcccagaattgcatgcctcatttatcacctctgttcttacctgtgattctctagagaggggaggttgggtagcattctgcaggagctgcattgacactcttcctgagcaaatataatgactaaccatttccttcccagttttaacatctctgttctggttgtccccaatgtctttctctgtgtagaataattaagattttaaggactgggaagcattttctcaagctaactgtgagatttgaaaacaattcaaaacattcttctgcctgatctgctgctctccattacgtcttgctttaatttgttttgttctgttttcttggagcctgtgatctctaatttgccctgtgctttaacaataagctcgttgctcttcaaatggtagatgacagttctaagcattgcacatggagatgaaaatgaaatcacccaaaccctacaggcaccagatcaagataaacaacataattagttaactctttcttgtcctatcttctgcttcatattacatagggaaacatttgcttggctaccttcatctgctctctttatctttacttgtctttgaaaatggacacctggaaattttgacaaagtgctacccatcgtatctcctgaatgtatttacaaatcctacattgcttacagtacttcaaaacgctcatgagaattgggcttacaaagtgacccatcacaagcttttgaaaggaatgctagatgaaaagaacagtgtttcttcattccaaacattgagtttccaagtgcaggaccttaaagccagcatttgtactacctgagaactcactagaaatccagaaagaactcagtactccttagttagaaatcctggggctggggaaagctatgtgattcaggtgactctgatttgagccaacatttcaatgccattcccttatagaatgcttcctagctctgaattagaaggaccctggctaaatgacaatagccagaatattaacaaacaataaaacaatttattaagaaacaataaaaatgtctttggttttataagtggtcttcaatgatagatgcacagaaaaattttaggaagggggatgtgttgggggagcatcctctcaggtgacatggaggcgagatggggtgaagaattctgggaggagaactgggaaggagaattatttggggtgtaaataaataaaataactcattttaaaagaatttcaagagagttctaaaaataactacaccaaggcttcacatagacactgactctgttggtctgactctattggtctgttgggaataggcctattcctttaaaaatccctagatgtttctaatatgcaacctagactaagaactactattttgggaactacagagtagaatgtcatcagaagagagaaccggacagcttctgggacgggcggaagcacagagccgctgaggcagcagcctgggcgggccgcagacaaccggccaccatccggaccagaggacaggtgtccgcctggcttgggaggcggcctcagcctcagcatcagcggtcgccatcttggttccgggactcagcagaacttaggaaattagtctgaacaggttagagggtgcgccagagaaccggacagcttctgggacgggcagaagcacagagccgctgaggcagcagcctgggcgggccgcagacaaccggccaccatccggaccagaggacaggtgtccgcctggctcgggagacggcctcagcctcaggagcagcggtcaccatcttggttccaggactccctggaacttaggattttagtctgcacaggtgagagtctgcaccacagaagctgacagcttctgggaactgccaaagcaacacagcttctgagagaggccctgttttgggccttcttcttcgaccaggaggacgtccaaaaacaagatatctgcgcaccttccctgtaagagagcttgccagcagagagtgctctgagcactgaaactcagaggagagaatctgtctcccaggtctgctgagagacggtaacagaatcaccagaagaacaatctctaaacagagtcaactataactactaactccagagattaccagatggcgaaaggtaaacgtaggaatcctactaacaggaaccaagaccactcaccatcatcagaacccagcactcccacttcgcccagtccagggcaccccaacacacccgaaaacctagacctagatttaaaagcatatctcatgatgatggtagaggacatcaagaaggactttaataaatcacttaaagaaatacaggagaacactgctaaagagttacaagtccttaaagaaaaacaggaaaacacaatcaaacaggtagaagtccttacagaaaaagaggaaaaaacatacaaacaggtgatggaaatgaacaaaaccatactagacctaaaaagggaagtagaaacaataaagaaaactcaaagtgaggcaacactggagatagaaaccctaggaaagaaatctggaaccatagatttgagcatcagcaacagaatacaagagatggaagagagaatctcaggtgcagaagattccatagagaacatcggcacaacaatcaaagaaaatggaaaatgcaaaaagatcctaactcaaaatatccaggaaatccaggacacaatgagaagaccaaacctacggataataggagtggatgagaatgaagattttcaactcaaaggaccagcaaacatcttcaacaaaattattgaagaaaacttcccaaatataaagaaagagatacctatgaacatacaagaagcctacagaactccaaatagactggaccagaaaagaaattcctcccgacacataataatcagaacaacaaatgcactaaataaagatagaatactaaaagcagtaagggaaaaaggtcaagtaacgtataaaggcaagcctatcagaattataacagatttttcaccagagactatgaaagccagaagagcctggacagatgttatacagacactaagagaacacaaatgccagcccaggctactatacccagccaaactctcaattaccatagacggagaaaccaaagtattccatgacaaaaccaaattcacccattatctctccatgaatccagcccttcaaaggataataacagaaaaaaaccaatacaaggacaggaaccacaccttagaaaaaacaagaaggcaatccctcaacaaacctaaaagaagacagccacaagaacagaatgccaactttaacaacaaaaataacaggaagcaacaattacttttccttaatatctcttaatatcaatggactcaactccccaataaaaagacatagactaacaaactggctacacaaacaagacccaacattttgctgcttacaggaaactcatctcagagaaaaagatagacactacctcagaatgaaaggctggaaaacaattttccaagcaaatggtatgaagaaacaagctggagtagccattctaatatctaacaaaatcgacttccaacccaaaataatcaaaaaagacaaggaggagcacttcatactcatcaagttaaaatcctccaagaggaactctcaattctgaatatatatgctccaaatacaagggcagccacattcactaaagaaactttagtaaagctcaaaacacacattgcacctcacataataatagtgggagacttcaacacaccactttcaccaatggacagattatggaaacagaaactaaacagggacacagtgaaactaacagaagtgatgaagcaaatggactcaacagatatctacagaatattttatcctgaaacaaaaggatataccttcttctcagcacctcatggtaccttctccaaaattgaccacataataggtcacaaaacaggcctcaacagattcaaaaatattgaaattgtcccatgtatcctatcagatcaccatgcactaaggctgatcttcaataacaaaaaaaataacagaaagccaacactcacgtggaaactgaacaacactcttctcaatgataccttggtcaaggaaggaataaagaaagaaattaaagactttttagagtttaatgaaaatgaagccacaacgtacccaaacctttgggacacaatgaaagcatttctaagagggaaactcatagctctgagtgcctccatgaagaaacgggagagagcacatactagcagcttgacaacacatctaaaagctctagaaaaaaaggaagcaaattcacccaagaggagtagacggcaggaaataatcaaactcaggggtgaaatcaaccaagtggaaacaagaagaactattcaaagaattaaccaaacgtagagttggttctttgagaaaatcaacaagatagataaacccttagctagactcactagagggcacagagacaaaatcctaattaacaaaatcagaactgaaaagggagacataacaacagatcctgaagaaatccaaaacaccatcagatccttctacaaaaggctatactcaacaaaactggaaaacctggacgaaatggacaaatttctggacagataccaggtaccaaagttgaatcaggatcaagttgaccttctaaacagtcccatatcccctaaagaaatagaagcagttataaatagtctcccagccaaaaaaagcccaggaccagacgggtttagtgcagagttctatcagaccttcaaagaagatctaattccagttctgcacaaactttttcacaagatagaagtagaaagtactctacccaactcattttatgaagccactattactctgatacctaaaccacagaaagatccaacaaagatagagaacttcagaccaatttctcttatgaatatcgatgcaaaaatcctcaataaaattctcgctaaccgaatccaagaacacattaaagcaatcatccatcctgaccaagtaggttttattccaggaatgcagggatggtttaatatacgaaaatccatcaatgtaatccactatataaacaaactcaaagacaaaaaccacatgatcatctcgttggatgcagaaaaagcatttgacaagatccaacacccattcatgataaaagttttggaaagatcaggaattcaaggcccatacctaaacatgataaaagcaatctacagcaaaccagtagccaacatcaaagtaaatggagagaagctggaagcaatcccactaaaatcagggactagacaaggctgcccactttctccctaccttttcaacatagtacttgaagtattagccagagcaattctacaacaaaaggagatcaaggggatacaaattggaaaggaggaagtcaaaatatcactttttgcagatgatatgatagtatatataagtgaccctaaaaattccaccagagaactcctaaacctgataaacagcttcggtgaagtagctggatataaaattaactcaaacaagtcaatggcctttctctacacaaagaataaacaagctgagaaagaaattagggaaacaacacccttctcaatagtcacaaataatataaaatatctcggcgtgactctaactaaggaagtgaaagatctgtatgataaaaacttcaagtctctgaagaaagaaattaaagaagatctcagaagatggaaagatctcccatgctcaaggattggcaggatcaatattgtaaaaatggctatcttgccaaaagcaatctacagattcaatgcaatccccatcaaaattccaactcaattcttcaacgaattagaaggagcaatttgcaaattcatctggaataacaaaaaacctaggatagcaaaaagtcttctcaaggataaaagaacctctggtggaatcaccatgcctgacctaaagctttactacagagcaattgtgataaaaactgcatggtactggtatactgacagacaagtagaccaatggaatagaattgaagacccagaaatgaaccaacacatcctatggtcacttgatcttcgacaagggagctaaaaccatccagtggaagaaagacagcattttcaacaaatggtgctggcacaactggttgttatcatgtagaagaatgggaatcgatccatacttatctccttgtactaaggtcaaatctaaatgaatcaaagaacttcacataaaaccagagacactgaaacttatagaggagaaagtggggaaaagccttgaagatatgggcacaggggaaaaattcctgaacagaacagcaatggcttgtgctgtaagatcgagaattgacaaatgggacctaatgaaactccgaagtttctgcaaggcaaaagacaccgtcaataagacaaagagaccaccaacagattgggaaaggatctttacctatcctaaatcagataggggactaatatccaacatatataaagaactcaagaaggtggacttcagaaaatcaaacaactccattaaaaaatggggctcagaactgaacaaagaattctctcctgaggaataccgaatggcagagaagcacctgaaaaaatgttcaacatccttaatcatcagggaaatgcaaatcaaaacaaccctgagattccacctcacaccagtcagaatgtctaagatcaaaaattcaggtgacagcagatgctggcgaggatgtggagaaagaggaacactcctccattgttggtgggattgcaggcttgtacaaccactctggaaatctgtctggcggttcctcagaaaattggacatagtactaccggaggatccagcaatacctctcctgggcatatatccagaagatgccccaactggtaagaaggacacatgctccactatgttcatagcagccttatttataatagccagaagctggaaagaacccagatgcccctcaacagaggaatggatacagaaaatgtggtacatctacacaatggagtactactcagctattaaaaagaatgaatttatgaaattcctagccaaatggatggacctggagggcatcatcctgagtgaggtaacacattcacaaaggaactcacacaatatgtactcactgataagtggatattagcccaaaacctaggatacccaagatataagatacaatttcctaaacacatgaaactcaagaaaaatgaagactgaagtgtggacactatgcccctccttagaagtgggaacaaaacacccttggaaggagttacagagaaagtttggagctgagatgaaaggatggaccatgtagagactgccttatccagggatccaccccataatcagcatccaaacgctgacaccattgcatacactagcaagattttatcgaaaggacccagatgtagctgtcttttgtgagactatgccggggcctagcaaacacagaagtggatgcccacagtcagctaatggatggattacagggctcccaatggaggagctagagaaagtacccaaggagctaaagggatctgcaaccctataggtggatcaacattatgaactaaccagtaccccggagctcttgactctagctgcatatgtatcaaaagatggcctagtcggccatcactggaaagagaggcccattggacacacaaactttatatgccccagaacaggggaacgccagggccaaaaagggggagtgggtgggtaggggagtgggggtgggtgggtatgggggacttttggtatagcattggaaatgtaaatgagctaaatacctaataaaaaatggaaaaaaaaaacgaatgtcatcagaagacctttacctttttattagcaactaatacatgtccttatttagatctaatgattgcctgagtgggtcatgggtaatttgggaggtattaccaacaagatacggtaggttgaaagcactgaatacttggtatatgccaagctctatgccctcatgtccatgagtgaatagattcactgggatgagttgctgtgcaccctatggaaagaactgagataagatggttagttcacaggagcatacacagagaaggtgctcaccacaatccctgaaggaacatatgatggaaaaagggaagtgagccaatcatacaaccagaatggattacatcccagagagcttaaataaataatctcacattcttcccaaatttcttctaaaacatgaaaaagtgcaatgacatatgaatggattggaagctatttctacacttaaaatgatggacaaaaccgaaatactatctcaggaaaccattctctctaaacgttttgagaaagcttgggtaactttagggaagatggagtgtgtgtactaagttcagtgatatgctatgtctcacaaaatatatgatagagtgcaatcaaagaaggagtccagtgtgagactttaaactacacacagatggtggggagagagggagagagaaagagacagacagagagaagaggagggataaaaatattaaccaattttaatacccaatggttttttgggggattttttgtttttgttttttgagtttttttgtttttgttttttgggttttttgtttttgttttttgtttttttgaattctaagatgctttgtttctaagtctgtcctgcaatactgagaaattttcacagtctcagacagtctttataaatatagggataaatacataaaacaaactaatggtacttcagaatatattctatatacatgaacaatttctagaaggcagaaaatcgttctaactaccgtactgctactactggaggtagtttaatcattaatgtgtagttagccaaccatctgaaaccacctgattaaacactgtagtgacccatttaataattagagctttctgctgtctacacggtgcactggagtctctcttcacaggaggaagcagtttggaggacctgggaaagattatatacaaatgactggagccagctgtttatgcttatcaggactacaggcgtggatggacccttccacaactcttcaatattagaagctgaaagatatttttaagaaaatgttcaccctcttgccttcttgctcttgctctgtcctctttctcctgctccccatctctccccattgccctccccccctccacgtgctcatggcaggcctctactcctctctctccttctctctctttctctcccctctctctctctgcctttctctgtctcgaaaaaaaaaaaagaaaaagaaaaaaaaaagaaaacagtcaccaaaaacctctctaaatacctgtcatgtgaagaaatgtaaatagtgaagagagctaggacaatggaaggcagctagagccgctttcaaattactgttgcaaatagcttcaggaacttcagcataccatttagcatctctgagttgcttaaaccatctttgaagaggagatatcacccatcttacaaagttttgatgattagctagaaaaatggactatagaatagaccttgtgtgtgcatggctccacacacgcgcgcacacacacacatcttaagtgctccatcagtgataatggtactacttttctaaattgcctttgcatgtgaaagccaaagatacttaagtggtaataaggtttgcacagggtgccatcgagggcattgctaagaagccataggtgcgaatacagagttgcactatttggctattttaatgataagcagtccaatgttacttaattcaacctaagatgtgagtcagaattacatctcaattgctgcccctcctcctgattctcccctcacagggttctacccccatgcccctttccttatcctctgagagggtggggccccctaggtatgcccccatccacgtagatcaagtctctgtagggttaggcaaatcctcttccgctgatgtcagacaaggcagccctgtcagggaacagattccacagacaggcaacagctcccactccagttattcgggggactatgtggagactgagctgcacatctgctatttgtgtgctagggggcctcgatctagcccatgtattccctttggttggtggctcagtctctgagagctcctaagggtccaggtttgctgactctgttggtcttcttgtggagtttctttctcctttgaggccctcaatcatttcccccaactcttccataagagttcccaatttccatccaatgtttagctgtgggtaactggagctatttcagtcagctgatgggtagagcttctcagaggacagccatgctatactcctgtctgccagcataacagagtatcattaatagtgtcaggaattggtgcttgtacatgagttgtgtttcatgctgggcccgttattggttcaccattccttcagtctctgtgccatctttgtctctgtatttcttttagacaggaaaatttggggatcaagttttgtgggtgggttggtgtcccaatccctccactggggctcctgcctggagacaggaggtgggtggcctccaggttccttttccccactgttatgcatctcagctaaggtcacccgcattggctcctgggagcctccccaatcctaggtctctgggacttcatagagattttccaccaccacccccagcagctgcagatttccactcatttaccctggcctctggctctcttgtatctcctcgtacctgatcctgaacacccattccttctccagctcctcttctacccagttccctccctccctctatattctatgactattttattcccccttctaagtaaggttcaagtatcctcacttgggctttctttcttgttaaacttctttgggtctgtggcgtgtatcatgggtattctgatctttatggctaatatctacttatcagtgagtccataccatatatgtccttttgggttgaggttacctcgctcaagaggatattttctaattccatccattcccctgcaaaacttaagatgtccttgttttgaataactattgtgtaaatgaaccacagtttctgtatccattcttcatgtgagagacatctgggttgtttcccatttctggttattatgaagctgctatgaacactgtagagcacatgcccctgtggtatggtggaacatcttttggatatatgcccaggagggtatagctggagcttcaggtagaactatttccaattttctgagaaaccaccagattgatttacagaatggttgtagatgtttgcaatctcaccagcaattgagaagtgctgcccttgttctacttctgcaccagcaagtttttatattagccattctgattggtgtaaggtggaatctcagggtcattttgatttgcatttccctgatgatgaaggatgttgaacatttcattgagtgcttctccaccattcaagagttctctgttgagaattttttgtttaaccctttgccccagtttttaatttgatttatttggtttgttgggctctaatttctttttttaagatattttctttatttacatttcaaatgttgtcccctttcctaattttccctctgaaaatcccctatccccttccccctgctccccagcccacccactcttgattcctggtcctggcattcccctatattggggtgtagaaccttcacaggaccaagggcctctcctcccactgatgaccgactaggtcattttctgctacatatgcagctagagccatgtgtctgggctctaatttcttgagttttctctctctctctctctctctctctctctatatatatatatatatatatagagagagagagagagagagatcctttcccaattggttggctgctgtttatccatttgacaatgtcctttgccttatagaagctttttggtttcatgcggtcccattgatcaattgttgaccttggagctccacttcttctaaagcctggacctattgagaagtgattggtgcccaggaaaacaataccaattcctgaacatttaattgagtggctaaacagaatatactgcaaaatatacagtatagggtgctatttgatggtattagaagcaaacaattcatccttcttttctctctctctctctctctctctctctctctctctctctctgtgtgtgtgtgtgtgtgtgtgtgtgtgtgtgtgttagtgtgcacacgtgcacatgtagtgtatgtactgatttttcaaaatcctttcattttggcccccactccctgtcttcctcacagcctcgggaatattagagcaatggaatactgcagacctcgaatgctgcaggtgctactggagaaccccagtgttcagacagaaatgctcagcacagccagggtgaattgagataggtaacagactttgatcctcaagactgtgtgagcctccctccaatgggaacagttcaatagagtcagtctctgcaaaaaggcagcagacaactctacgtttcagtcattatgagatctgcaacctttccatcatgaaaaaaataatctatgcacattttggacagccctgttttcctccccattctttgggtaagtgctgggttttacaccaaccagattagattcattctaaattacttgagcactgggataatagatccctctatcctggaaacaacaaaataaaccatagaaacgaaaggctttccaaacctaaggagtggaggagatgctttcccggggaaaggtttctcaaaaacagcccaatcccaactgatgagaattctaccatgcacacagaatctagcaaaacttgtgtttctccacagccttctcacatctaacctggtctttccccttgtcacactgggaagaactgaatgctcttcccatagagaagaaagaccatgacaattccagcctgctctcccttgatgcaagctggtaactctctagttggtcctttcatgggcatggatctatagttgtgcatttatttaacatttatgtaatagttactactatggtttgattgtggtttggcactcaaaagctaatgtgttagaatcttgtgaccataggagaagtgatggaaccttgattaagcatagtgcaaagtaattaggttcttggagccctgctctggaaaagaatccatgcggttctcatggggtcctgttacttctcatatgaggattgttatgaaagatcaaggctaatctcttattccactttcctgtcttatgtcatgacttccctttacttgtgcttccaatactgtaacacactggggactcatcaaaggtcacatacatgaagcagcccagattcagaccttcacttccaaaatgaggaactaaataaaccttttgtctttataagtacctaactctagtatttcatttcagcaacagaaaatgaacttacgcacttaccatatgccaagcactattctagattattattttcatgacaactttgagatgagtgtacaattattaagcccctttcacagatgaagaaactaatacagaaaggatgaaatattgtgcctatagtcaaagaactagttaataggacaactggggtttaacctagcagtatgactccagagcctattctccaaataactaaaatacctttgccttttccagtagtgtagtccattttcaccagggcttgtgttgagaggcattaaaggctcctgctgaaacatggcttaaaagggcgactcggagtagcagatgttgctctgtatgttgatgactccacatgatcatttcccaggataaaaaagccccaaattgaaatgtcacccacactcttctctccactgaggacaaagcttgcttactggaaagttccacagaaaaatggtatgatgctgtcgctgatagcctgaagtggtatttaatagacaacaaaaactatgacccaaaaatacagactccaactgtgaaatctctcacccttgtattgctgagtcaataatttcatacttaattcccttttctgaaggagctgaggtccttctgaattggaagtaaaatctggcaagagtaatctaattagcattggtcataaattcatattatcatagccatggccctgcagagtaccaaatgattagaacttgggcccctgaggaggcatgttgtaaagaagagaagcaaaatttaggaaatacctgtagctggcagagttgcctggactgcaaaggcttcaggatgatcatcctgagcatccccaagtagccatcaattccatgaaggtattagatatctacaaggcaagctctcataagaagtgagactacactgaagacacgtgtgactccatctttctctggcatcaaaagtaatgacataagcactaacacaaacatgaaaggtgacagtaaagtcatgttttcagcgagaaagtctcccagactgacaaacaagacgcctggggatgcacatggtcttgcttaaacacagaggcactttcatcttggctatagcaaaagagctactactcgctgaagcctaactccaatacactgatcctaaggccacatagaacaaggtcataggcaaagagtttaggccctttcatagactaagaaagccaaagatatatactacagaagtgatagagttcccagaaaagcttgaagcccagatttccagctgaagatgtccacatagcacacacacactaaccaactgattttgacttctctcattattcttgagattatgattactaaccaatttataagccaattgataggtcaggcactattatagtgttcaatgggcattaactcatttaaatccaggcatgttaccacacacctgtaatagacaacctgggctacatttctagtttcagcatagcttggactaattggtgaaatcctgtctcaaaaacacacaaaacaaaaaccaagcaagtattaggtcatttgataacaatttattgagtaattattatcatgtatagcaaaaagattttgaaaagtaaatggtcaaaggttgcacagttaataattggtaaagtgaaggttttctatctacaatatgactctctcttctaaaatacaaaatgcacagtcaggataatggcttagtggtaaaagcactgccacaaaacctaacaaactgattttgatctccagaactcacatgatgcaaaaagagatcttactcctctgatctccacatctactggcacaaataaaatcaatacaatgtttaaaagtatttaatggaaaatatattctgttctgtggtggggaataccaaagaccaagtacccttggaatcttagaagatgtagaccagtgtcacatcacccaagatacctgcattcattaattttccattgctttgattagatactatgaccgaaagcatcttatagagagtttgtcttgatgtgtggttctagaggagcccataacactgaggaaggcaaaacagcaactggccaaaggaggacaccaagagatctcaaccacacataggacacagagagttattgcagggaatagagcaaagctaaaccctcaaaacctgtccccaatgtcaaacttcctccagtaaggctgccatccctgaagtataccaactaggaaccagatgttaaaaaacatgagcctctaggggacatttctcatctaaaaccacagtagtatccatcccccacttatgaacaatcgtaggccccctcatcgggagactaaattacagttatgttttgaaaagcttcaccatgggtggagtagagggtcgggtttttttgttttttgttttgttttgttttgttttgtttttttctgaagttcccatttggagtagaaaaggattcttcttaaatatgacaaatattggatttagagagactattttatgaaagtcttcattctttaaatctctttactgtgcagatggttgggctatggttggtagatatggtgtattctagtccttacataagaagttgcaataataatgtttgtcaacagatctgccagtatgtattgaatctgcccaattcctgtgacttcaaatcgtcctttcctcatagtgacctaaatagaaagcaaagcaaagacaccttagagtacctttgttacttaatggatagatgagggagaaagggatcagagaattgctggggttaccatggaagaggtaaagcaagaccgttcatctgctaagtcaccctactctcctgaaacggaaataatccgcaatagccacacatattcctagacctgcaagtaggaagaagttcatgctgtgctctctaaatgaagcccatgttggaattcactttctagtccaaagggagcatgcccacctagggaacaatctttaaggaaatccttctccttgaacagatgaaataaagcatagctttatgcccaagcaagagattagatcactttctgggtattctccggtgtgaactaaccatatttgcagtcacctgaataccacatatgcaggaggaaccaggtaaatgtttccaaaagcaaactgtgctactcaaaccagttcctctcctagtctttctattgggttatgcatgcctgatctcagagacatcacaaagcttgggaagtagaagagacagggacattcacaacttcctgttggttctcgtttcacattctcttcatagcatctcctcactgccccataaccagaactcattcaccagactcctgctttcccatactctatgccttttccattagctttctgtctctaggactagctgcatgagcgttttctctgaataacctcctggaggggggggcagcactcacatttggcttattagtatccctttcaaagtctcaaagacaagaccctagtttttcattttgcacttggtcctgtaagttgggaagccactagtgcctggctctccccatttgggcccgtcttgtcagtacttctttttctaatactgaaaatgatatcttcacgtgtctaatgtctgttcagtacctccagaatagaactacaacccctcagtcagaccttcaaggccctctgttacctggcctttatgtaatcatctatgtctctcacataagttctaccattttacacttgtggatcgtttttgtcaataactaataacagcaaagctgttaatagctcacactctggaggtaaacagataccttttaaatgcttttatgcctcctggctatatagcttttgaaagaaatctttaacctttctgacgctacttcttcccaaaaggaatagcaatagtatccacctcctaatggcaaatgagacgatcagcacacatacatctctgaggaaaatgtctggcccctgataaatgctcagaggatgttcaatgctaatattatagcttatgacaattgtcgttacagaactgactctttccagaagtcactcatctgtgttccaatctaattagccacattgctggctggaatcacataccacatagtggcctgtcgtatctttgcacttccctctcctgtacctgacagataacctctggttgtagaaaatcataatttgtaggcttttcggcagtgttcacatgtctcttgtctccccctgctagtatgggagaaacataatgggccagcagaagctgcagaagcagccatgaagaggaggcagcacgtttgccaagtaagacttctggggaaagaagctctaggaagttgctttcaggagttgagctcctcacctcccttgcaaggctatccattctcctgctggtaggctttggggagctacacaggttttagatgagcatggcttagactctgggatgccccacctctattgcatcaaaaatcaactctaatctcacagcaaagttttatcttgatctgttgatgtcattcacagagtagtcaagaaggaagcgattcacaatatatgaaggagaacttgccccagtgttttttgtttgtttggttggttggtttgggttgggttggtttggtttggtttggtttggtttggtttggtttagtttggtttggttttgccttaataatatttttgttagatattttctttatttatatttcaaatgttattccttttcctggtttcccctccaaaaacccccatccccatccccctccccctgctcaccaacccacccactcctgcttcctggtcctggcattcccctacactggggcatcaagccttctcaggaccaagggcctctcctcccgttgatgactgacaaggccatcctctgctacatatgtggctggagccgtgggtctctccatgtgtattctttgattggtgatttagtccctgggagctctgggggtacaggttagttcatattgttgttcctcctatggggttgcaaacctcttcagatccttgggtcctttctctagcttctccattggggaccctgtgctcagtccaatggatggctaaaagcattcacctctgtatttgtcaggcactggcagagtctctcaggagatgagtatatcaggctcctgtcagcaagcactgttggcattcacaatagtgtctgggtttggtgactatatgtgggatagatccttatctccctaagctcaagtccaagtggatcaaggactttcacataaaaccagatacactgaaactaatagaaaagaaagtaggtaagagcctcgagcacataggcacaggggaaattttcctgaacagaacaccaatagcttatgctctaagatcaagaactgacaaatgggacctcataaaattgcaacgcttcagtaaggcaaaggacactgtcgataggacaaaacggcaaccaacagattgggaaaatatctttaccaaccaaccctacatccgatagagggataatacccaatacacacaaagaactcaagaagttagactccagagaaacaaataaccctattaaaaatggggtacagagctacacaaaaaattctcaactgaggaataccgaatggctgagaagcacctaaataaatgttcagtcatcagggaaaggcaaatctaaacaacccagtggtttttgtatgagtcaatttgcaacacaccaatggctgtgagaagaacagcagccagcagtgtcaatctttgtggtactaagaggatttgttctcatccccaactcaggcaggagcttaattaccaaagtcataacaaatccctaagtgctgctgctcttgagaggacagaaacttatctgaccaggtgtttagaagtggagcctttcagaagagaggattagataagtgcatcagggtggaagactctgtgattgactactagtggttttataaaagaggactagagaccagaacacatatgtactccctgtctcacaccatgaggatgccctggaccatcgcaggagtctgcaaacaagaagttcaataccatatggagtctctagacattatacccttagaaatatgaacctaaatcaagttctttcttagaaagtagtctgcatcccataaaagggactgatggattctcgtctccttccacatgcttacaaaggtatattatccttccttagaaaggaaagtctctaccaagcttgctatgcagagccatctgtggaaatattaaacgaatcattgctggggtgccctcaaaactgattaaggctgactatatgtgtttaggaaaggatccccagaattggtaatatcaagtccccaaacatttctctttttattttttatacatttttattgaaaacagagttacatttccccccccccttttccccgctctagcccttcctatgtctccccacttcaacctgccccatgtaccccactctcaaattgatagcctctttttcattgattattgttgtttcatacgtgaatacatgtgaattcatatgcacagataacaaatataacctgcagagttcgtttttgcggctagtgtgtagatggtttcaggatgggaaagaaccaataggtaagatgagaataataacttctaagccaatatccgggtctccatgttatcaatcttccttaaatacctctatgtaaactattactgaatgaaggttaaataaaataaataaataaataaaactgaagttcataagcccccagtaccactctggtcattttcatgtctcctttatccctgctccatactctgacctctagggatccttagcagctcacaaaggcgccctctaccttcatctcatagaaagctctcctactgtttcctccacctagaatggctcctccccctctctgctaacaacaggggttctcaactgtgagcaggcaggcagcagaatcccctagagagcttgttaaatttggcaagctggctgtgctcagttccaccacagaatttcctagtagagttaaggtggacctgagatttgagttgctaacaaatccctaagtgctgctgttcttgctgttggtcaaaacagcacaggtggaaaagaagttgcctgggagactcttacaaagcctggcctgtccagcctccccctttcaggacaaggtcttccttaactccccacctcctttccctggtgagaatgagcattccttaccctgcatccctgtggagttctgtgttacacttgctgtatttttctctccccctggactacaaagcctttgaagccattcttgttatagttagttttgcattctctacaactctcggaatgaaaaagtctcctataaatgaagtcatttctctaactctaacacctagagaaagtacagacttggaatttgtgttccgtagaagagcacctttcatcttcttcttattgattgacagtcacttactaccagcccttattatgtatataatagggggtatatatgtataaaaggttagggggtgatgatcacactatattaatatcacttattacattcattttgtagaaaaatattgaaatgttaaggaatttttcaagaagcgtacaaatgcgtacccccacaacctttacgcacagaacactttcatttttcagtggtgatctcagcggtgctcctcactgcagtagttcaagggctagggatgtaactcaatagaagagtcacttcatgtgcacaagaccctgggtgcaattgccaggatggcatgcaaaaccaaagaaagagagagtggaaagaagaaagagggaaagtccaattccagaccacgaagtctgtttattggtcacacttttacaatcttccatatgatcacttgtattgagtgattatattaactgtggccttcgggaagattccaggccagtcagtgaggagaaactcttcctttggtttatttgatcatcccatgtcacgagattcaaggtacacactgaatgaatagaataagcaagtcaaaagacttggcttcagcattgccttatcattctgtggaatcagaagtgaagtagggccctttccctctttgtgtttccaaaaagcctctttgcaattgacagtgacctggtttttggacatgtttgctcaggcagtaccagcgattgaatatagggacggactctcacgacaagtagattctttaccactgagccctagcttgctttataaattttcaaaatataaaaggtttcattgtgacatcgtcatatatgtcttcttattcttattttatttttgttttagccttgtcttattttgtgagataggctttctctatgtaggccaagctggcctcaaactcatgaccttcctgcctcagcttgctaagaactagtgttacaggcatttacaccatacttcctagggaaaacttgcattctttcatccctcttcatggttttcttattcctaccctcctattctcaaggactcagaattttaaagttcttttttatttgtttgtttgtttgggatgatggcatttgtcatagtgtgcatgtggaagccataggacaacttgtaagagttagttctttcctttcattttgttgctcttcagaattaaactcagtttaactcatcaggtttaggacaagtgattttaatcactgggctatcctgccatttctaaggtgtgtaggtgtgtgtacctttctgtatctaagtgtctgtgtgtgtgtgtgtgtgtgtgtgtgtgtgtgtgtgtgtgcgcgcgtgcgcgcattatttcctctgtgtgtatgtgtatgtgcatgactgtatgtgtgtgaattagagagagagaaggagagagagggaaggaggaagagaggagagagagtgagagaattcttccttgttctcataaaacagggactcctactgaaactggaacttggctgatgcagcaaaccttgagcatactgctgtctctgcccaccctccctccatgttggggttacaggtgctcatgttgccatgtttggatctttttatgtgagtgcttgtatctgagctggggcataatgctttcacagcaagtcctctttcttactgagccatgtctgcagctccccgctcaggattttcatactgattgtgttggctgttcaaagtgttccataacaaatgttctatactccagccagccaggcttttctgctctcctcgcatgtcctccaaactctttattaaggtggtataacaattataagcagtccataattattaagagcatggattctagggtcaagtaagtctggcagatacactatcaagctggtccatgacagtaggaacacactaagctctaaggctacattcatccacttatctatcatatggtgatattttatataccataagctatgaggatgctctaaaaagtaactgatataaagtacataacacccaactggctcacacaaagtactgaataagtagttaccatcacaaagatgttaaaactttactattcgtatttgctgagtgagagcttgtccaattacctctgcatgcctgttccctcctgtggaactggcattttgtgttactattttgttgggacagcactgtgtagctcaggctggcttagaactcacagctcttctgccacttctttagggctgagatgacaggtctgagtcaccacctgccatcaggaatggtctctgaggaagctttattttgtttcactgtagccagaataatcttttcagaatctagaaagatttttattccttttcctttctctgaaattatttctgactgaatcctctggcttctaagacaaagcaataaattctttggtctctgtcgctttgcattcaacaactattagttctgagtacttggaaatttaggaacattttcgttgtcataaataccaaaggggcatttagtgtataaaggccttcaaccgtgcctgtgcaaaatagcaccctctagccacaaatagaattgtcatactccaaagccagtgctgtcccattgagaaacacccttgtcaaactacaaccaaatctcccatcattcctttatcctctgcactccagctgctctggccttgtttctacgactccgcagaaccatggatctgctattgtttcttagactacaattcttaatgataattcctttaagtcttaatgggtccaataaatctcaaagcttggcttaagcagtatttctttgtggaggccttcattaatcccctagctgtgatggtaaatcttgattaaccatcaattagccatctatttcggaggatttagacttaccatgaaaacgtgtccctgggagtatctgtgaggggttatctaaattaggttaatcaataattgacttgggatgacccacctgaaatgtgagtggtgccattgtatcggctgaggttctggtctgaataaaatagagaatataagctaaatacaagcaatcatcactatctggctcctatcaattcaatgtgatcagctacggcaggttcctaccacaatgacttactaccatgatgcttctactaccaatatacttctgctaagtactttataaaagtaataaaggaactagtatactatattgcatatgtgttcttcaaactgggtgcctttctttcaatgtattcatctcaattcataattctgtgttcatttgtgcaatcctttaattagtgccagtttcacccatgagatcacagcatccaagaaagcaggaacaacgtctgtttttttctcaccactctatatggagcaccttcctccacactggtctgccagtaggccctttagcctttgtagaaatgagggccaatgtgtgcagtaagtactgagtcttacaaagttccaaaggagagtgggcaactatcaacttgatttgttttggaagctcttattgaactcactgaggtaaaatgggggattagatagggtagaaggattcttccatttaattattttgtttgcactcaagcatattagaattcaaaggttggtcacaatgcaagtttccaatttctccctgattccaaaatgctacacagagacaccctgattgattgcctactcacaatttgaactatagtaaaacaaataaattgtttaaagcacattgtcccttctttattttaatgtttcttgtcatgcaagaagtccaacttttggaaattttgaaaaatacactgtcaagagtcttaaagtcttggaacatgatactgcatgtggtggacctaattaaatctcagctctcatgtgttctgcatcaaaattcaggccaattggttgcttgagatctaagtgatttggagttgggttgccttttgcaatgccacagtctaggtggtctgaaagattgagaaaggaaaataaaaggagatgtggacaatgagagaggagctgccaagacacacagaagctcacttcattggagacaaaagtgccagtgaggagagaatatgctgccacagagcactgaagatcccaccttgatgaacaagatggttcctatggtgggagactgcatttgtgtggtggcatcactactgagatgtctatttgtcttggttagagttttactgttgtgaacagacatcatgaccaaggtaaatctcacaaaggacatgtaattggggctggcttacaggttcagaggttcagtcaattattatcaaggtggagcatggcagcatccaggcaggcatgctgtgggaggagctgagagttctatatctttatctgaaggctactagaagactggctcccaggcaactaggacagagctcttaaagcccatgcccacagtgacacacctactccaacaaggccgtatgtcctaatagtgtcacagcctgggccaaccatatgcaaatcatcacactatttgaggtatagagttctagctgaatttaggaacagataagactggcttgctttcttctctctcctcctagatatcacttatgggtactaccttgctccttctcccaatgtttcttgttaagatttgggctggaaactagcatattagagcatctgccttacccattttactttagcactgttcctggactggagttctagagaacacgtgcttcatggagacaaagaacattgtcccccaaataaacctcattgtgactcatgtggttatatgaatttaacacaaaatggaaaactttagccttcatgctttttatctcccttccctttcagaatatagattcttatctctgagcaaatacctatgaggtacattttatttggagctataagttcacaaaattaaataatccaaagctccaacaatgttaccaataacttttagtttctgttacttaagttgtgtgtgtgtgtgtgtgtgtgtgtgtgtgtgtgtgtgtgcatgcatgtgtgcatgtgtgcatgtgtttatgtatgacagtatcaaggaaaaaagaggccatgaatttgaaagggagtaaaatggggtaacaaaggagttgaatggaggatcagttaaaaataatataattataatttaattaaaaataattccccctacaaaatctttagtatcttagattttgcagccaaaatgattaaaagaaaataaaacctcattttcccactcttgcataatcaagatgaaatatgccaaccttagaatggcattatgttagagtaaatatttgttagagtaagaagatagtcagaagagacagtatgggtttgtttctttgttccttttttgttggtttttgctttttgggttttgtttgttttttttttgtttgtttatgctaacatgctagcatatacattattatcactgagctacatccaaagcccttctggggtgctttgattgttttctcttcaactaacatttaggttatcatactaagtaatagattttcctatagtaattttttattttgatccttctatctcattttggtttatttttattttcacattttcctcggcccccatcccaccagcagccactgtctatttcttttccacttatcagctttcatatcacatgcacattcttttttttttctttccattttttattaggtatttagctcatttacatttccaatgctataccaaaagtcccccatacccacccacccccactcccctacccgcccactccccctttttggccctggcgttcccctgttctggggcatataaagtttgtgtgtccaatgggcctctctttccagtgatggccgactaggccatcttttgatacatatgcagctagagtcaagagctccggggtactggttagttcataatgttgatccacctatagggttgcagatccctttagctccttgggtactttctctagctcttccattgggagccctgtaatccctccattagctgactgtgggcatccacttctgtgtttgctaggccccggcatagtctcacaagagacagctacatctgggtcctttcgataaaatcttgctagtgtatgcaatggtgtcagcgtttggatgctgattatggggtggatccctggataaggcagtctctacatggtccatcctttcatctcagctccaaactttgtctctgtaactccttccaagggtgttttgttcccacttctaaggaggggcatagtgtccacacttcagtcttcatttttcttgagtttcatgtgtttaggaaattgtatcttatatcttgggtatcctaggttttgggctaatatccacttatcagtgagtacatattgtgtgagttcctttgtgaatgtgttacctcactcaggataatgccctccaggtccatccatttggctaggaatttcataaattcattctttttaatagctgagtagtactccattgtgtagatgtaccacattttctgtatccattcctctgttgagggacatctgggttctttccagcttctggctattataaataaggctgctatgaacatagtggagcatgtgtccttcttaccagttggggcatcttctggatatatgcccaggagaggtattgctggatcctccggtagtactatgtccaattttctgaggaaccgccagacggatttccagagtggttgtacaagcctgcaatcccaccaacaatggaggagtgttcctctttctccacatcctcgccagcatctgctgtcacctgaatttttgatcttagacattctgactggtgtgaggtggaatctcagggttgttttgatttgcatttccctgatgattaaggatgttgaacattttttcaggtgcttctctgccattcggtattcctcaggtgagaattctttgttcagttctgagccccattttttaatggagttgtttgattttctgaagtccaccttcttgagttctttatatatgttggatattagtcccctatctgatttaggataggtaaagatcctttcccaatctgttggtggtctctttgtcttattgacggtgtcttttgccttgcagaaactttggagtttcattaggtcccatttgtcaattctcgatcttacagcacaagccattgctgttctgttcaggaatttttcccctgtgcccatatcttcaaggcttttccccagtttctcctctataagtttcagtgtctctggttttatgtgaagttctttgattcatttagatttgaccttagtacaaggagataagtatggatcgattcgcattcttctacatgataacaaccagttgtgccagcaccatttgttgaaaatgctgtctttcttccactggatggttttagctcccttgtcgaagatcaagtgaccataggtgtgtgggttcatttctgggtcttcaattctattccattggtctacttgtctgtctctataccagtaccatgcagtttttaccacaattgctctgtagtaaagctttaggtcaggcatggtgattccaccagaggttcttttatccttgagaagactttttgctatcctaggttttttgttattccagatgaatttgcaaattgctccttctaattcgttgaagaattgagttggaattttgatggggattgcattgaatctgtagattgcttttggcaagatagtcatttatacaatattgatcctgccaatccatgagcatgggagatctttccatcttctgagatcatctttaatttctttcttcagagacttgaagtttttatcatacagatctttcacttccttagttagagtcacgctgagatattttatattatttgtgactattgtgaagggtgttgtttccctaatttctttctcagcctgtttattctttgtgtagagaaaggccattgacttgtttgagttaattttatatccagctacttcaccgaagctgtttatcaggtttaggagttctctggtggaatttttagggtcacttatatatactatcatatcatctgcaaaaagtgatattttgacttcctcctttccaatttgtatccccttgatctccttttgttgtcgaattgctctggctaatacttcaagtactatgttgaaaaggtagggagaaagtgggcagccttgtctcgtccctgattttagtgggattgcttccagcttctctccatttactttgatgttggctactggtttgctgtagattgcttttatcatgtttaggtatgggccttgaattcctgatctttccagaacttttatcatgaatgggtgttggatcttgtcaaatgctttttctgcatccaacgagatgatcatgtggtttttgtctttgagtttgtttatatagtggattacattgatggattttcgtatattaaaccatccctgcattcctggaataaaacctacttggtcaggatggatgattgctttaatgtgttcttggattcggttagcgagaattttattgaggatttttgcatcgatattcataagagaaattggtctgaagttctctatctttgttggatctttctgtgatttaggtatcagagtaatagtggcttcataaaatgagttgggtagagtactttctacttctatcttgtgaaaaagtttgtgcagaactggaattagatcttctttgaaggtctgatagaactctgcactaaacccgtctggtcctgggctttttttggctgggagactatttataactgcttctatttctttaggggatatgggactgtttagaaggtcaacttgatcctgattcaactttggtacctggtatctgtccagaaatttgtccatttagtccaggttttccagttttgttgagtatagccttttgtagaaggatctgatggtgttttggatttcttcaggatctgttgttatgtctcccttttcagttctgattttgttaattaggattttgtctctgtgccctctagtgagtctagctaagggtttatctatcttgttgattttctcaaagaaccaactcttcgtttggttaattctttgaatagttcttcttgtttccacttggttgatttcacccctgagtttgattatttcctgccgtctactcctcttgggtgaatttgcttcctttttttctagagcttttagatgtgttgtcaagctgctagtatgtgctctctcccgtttcttcatggaggcactcagagctatgagtttccctcttagaaatgctttcattgtgtcccaaaggtttgggtacgttgtggcttcattttcattaaactctaaaaagtctttaatttctttctttattccttcctttaccaaggtatcattgagaagagtgttgttcagtttccacgtgagtgttggctttctgttattttttttgttattgaagatcagccttagtgcatggtgatctgataggatacatgggacaatttcaatatttttgaatctgttgaggcctgttttgtgacctattatgtggtcaattttggagaaggtaccatgaggtgctgagaagaaggtatatccttttgttttaggataaaatgttctgtagatatctgtcagatccatttgtttcatcacttctgttagtttcagtgtgtccctgtttagtttctgtttccatgatctgtccattggtgaaagtggtgtgttgaagtctcccactattattgtgtgaggtgcaatgtgtgctttgagctttactaaagtttctttaatgaatgtggctgcccttgtatttggcgcatagatattcagaattgagagttcctcttggaggattttacctttgatgagaacaaagtgcccctccttgtcttttttgatgactttgggttggaagtcaatcttatcagatattaggatggctactccagcttgtttcttcataccatttgcttggaaaattgttttccagccttttattctgaggtagtgtctatctttttctctgagatgtgtctcctgtaaacagcaaaatgttgggtcttgtttgtgtagccagtttgttagtctatgtctttttattggggagttgagaccattgatgttaagagatattaaggaaaagtaatagttgcttcctgttatttttgttgttaaagttggcattctgttcttgtggctgtcttcttttaggtttgttgagggattaccttcttgttttttctagggcattgttcccgttcttgtattggtttttttctgttattaacctttgaagggctggattcgtggagagataatgtgagaatttggttttgtcgtggaatactttggattctccatctatggtaattgggagtttggctgggtatagtagcctgggctggaatttgtgttctcttagtgtctgtataacatctgtccaggctcttctggctttcatagtctctggtgaaaaatctggtgtaattctgataggcttgcctttgtatgttacttgacctttttcccttaccgcttttagtattctatctttatttagtgcatttgttgttctgattattatgtgtcaggaggaatttcttttctggtccagtctatttggagttctgtaggcttcttgtatgttcataggtatctctttctttatatttgggaagttttcttcaataattttgttgaagatgtttgctggtcctttgagttgaaaatcttcattctcatccactcctattatccgtaggtttggtcttctcattgtgtcctggatttcctggatattttgagttaggatctttttgcattttccattttctttgattgttgtgccgatgttctctatggaatcttctgcacctgagattctctcttccatctcttgtattctgttgctgatgctcaaatctatggttccagatttctttcctagggtttctatctccagtgttgcctcactttgagttttctttattgtttctacttccctttttaggtctagtatggttttgttcatttccatcacctgtttgtatgttttttcctctttttctgtaaggacttctacctgtttgattgtgttttcctgtttttctttaaggacttgtaactctttagcagtgttctcctgtatttctttaagtgatttattaaagtccttcttgatgtcctctaccatcatcatgagatatgcttttaaatctaggtctaggttttcgggtgtgttggggtgccctggactgggcgaagtgggagtgctgggttctgatgatggtgagtggtcttggttcctgttagtaggattcctacgtttacctttcgccatctggtaatctctggagttagtagttatagttgactctgtttagagattgttcttctggtgattctgttactgtctctcagcagacctgggagacagattctctcctctgagtttcagtgctcagagcactctctgctggcaagctctcttacagggaaggtgcgcagatatcttgtttttggacgtcctcctggtcgaagaagaaggcccaaaacagggcctctctcagaagctgtgttgctttggcagttcccagaagctgtcagcttctgtggtgcagactctcacctgtgcagactaaaatcctaagttccagggagtcctggaaccaagatggtgaccgctgctcctgaggctgaggccgtctcccgagccaggcggacacctgtcctctggtccggatggtggccggttgtctgcggcccgcccaggctgctgcctcagcggctctgtgcttccgcccgtcccagaagctgtccggttctctggcgcaccctctaacctgttcagactaatttcctaagttctccacatgcacattcttgttttatgcttctctcataagatctctttcttctttttcattatcctgcttttaatttttaaaaattattttatcttatatattatgggtgttttgcctgaatgcctatctgcatgagccacaagcatgctttgtacctttggagttgagaacggggcatcatatccttgtgggacaccataggggtgctgggaatcaaacctagatcttttggaacagtcagtacttttaaccactgaaccatctcctagtcctcaccttttaaaaaaaaagtattttaatataggaaaagctatatagttttgtacctaaaatgcaggatatcctggccagacctttcagttttcttcccataaatacactgaaaatatgaaattgttcactcctgatcctgtagtttatttactgtgctcagtgtatacactgagttacatctccagctatagtttatttcattctataacacattataaaaagtggttatataaatatcaaatcttcatattcatatattatgtctacataactttatatcatgaatccccttgtagattcatcacacgcacacaagtacacataaatacactaatataaattacaattctaaacctaggttctgtatatgagagaaaatacacagtatttgtttttctgagtttggcttattttacttaataatttcaagttccatccatttgcatgtatataccatgattcaatttttcttgaagctgtataaaattccgttgtgtatattaacacaatatcttcatatgttgctgatcatctaggttgtttctacttcctgtctattgtaataatatatcaataaacatgaatgtatatgtttcttggtggtatattgacatatagagtcttgtagaattgtattcaagagtggacatgtaatagtccttcctcctcctcctccatcttcttatttatttatttatttatttatttatttatttatttatttttggtggtgtggtggtggttatggtggggtttttgtagtaacttccaaagttatttccaaagttcagctcttaaatttttttcattgtattttttaatttacatttcaaatattatcccctttcccagtcccccccccaacggaaaccccctatcccattctccttccccctgctcctatgagggtgcttcagccctgagtttgattatttcctgctgtctactcctcttcggtgaatttatttctttttcttctagagctttcaggtgtgctgtaaagctgctagtgtaagctctctccaatttctcttcagaggcactcaaagctatgagttttcctcttagctttcattgtgtcccataggtttaggtatgatgtgtcttcattttcattaaattctaaaatgtctttagtttctttctttatttcttccttgaccaagttatcaatgagtatagctttgttcagcttccatgtatatgtgtgtcttctgttgttttgttggaatttaataacagtcttaatctgtggtgatctggtagggtgcatgggattatttcaatcttcttgtatctgttgaggcctgttttgttactgattatatggtcaattttggcgaaggcaccgtgaggttctgagaaaaaggtatatttctttgctttaggatgaaaggttatgtaaatatctgttagatccatttggttcataacttctgttagtttcactctgtctgtttagtttctgtttgcatgatctgtccattgctgagagtagagtgttgaagctccccactaatattgtgtggggtgcaatgtgtgctttgagctttagtaaagtttcttttatgaatgtgggtgcccttgcatttggagcatagatgttcagaattgagagctcatcttggtagatttttcctttgagcagtatgaagtgtccttccttatcctttctgataacttttggtggaaagtcgattttatttgatattagaatggttactactggccagagtagatgagggagccatcttgggtcccagatccctcagagactagtctgcacaggtgagtgtgtggactacagaagctacacaccttctgggacaggcagaagcaacacagcttctgggacagaccccatttcgggctccagccatctgggtaccttccccgcaagaggagaggtgtcccccgggaggcctttgccaggtcccggatccctcagagactagtctgcgcaggtaagagttcggactacagaagcaacacagcttctgggacagacccagacatctgggcatcttccctgccagaggaggggtgtccaccagggaaggctctttcggagcaggtgagggagccatcttaggtcccgagttcctcagagaccaatctgcgcaggtcaactcatggactgcaaagggtgagcaagcggactgcagaagcaacaccacttctgggacaggcagaagcaacacagcttctgcgaaagatcttgtttcggcctccaaacatctgggcaccttccccatcagaggagaggtgtccacctgggagggctctttcagagcaggtgatggagccatcttgggtcccggaaccctcagagtctagtctgcccaggtgagagtgtggtctacagaagcaacacagcttctgggataggcagaagctacacagctactgggacagaccccatttcaggctccagatatccgggcaccttccccgtcagaggagaggtgtctgcccagaagggctctgacctgcagagcaggtaagagagccatcttgtgtcccctgtccctcagaaaccagtctgtgcaggtgagcgtgcagactgcagaggcaacacatctcctgggaaaagccctgtttcgggccttcatcttcagccaggagacaggtctgaacgccagatatctgtgcaccttccctgcaagagaagagcttgcctgcagagagtactctgataactgagactcaggagcgagcaagactcctatgtctgctgacagaggctaacagaatcacaggaggaacaagctccaaccagagacaactataacaactaactccagagattaccagatggcaaaaggcaaatgtaagaatcttactaacagaaaccaagatcactcaccatcatcagacccagcactcccacctcagccaatcctagatacccaacacacctgaaaagcaagactcagatttaaaatcatatctcttgatgctggtagaggacatcatggagggctttaataactcacttaaagaaatacaggagaacactgctaaagagttacacgtccttaaagaaaaaaacaggaaaacacaaccaaacaggtgatggaattaaagaaaaccatccaagatctaaaaagggaagtaaaaacaataaagaaaacccaaagtgagacaacactggagatagaaacactaggaaagaaatctagaaccatagatgtgagcatcagcaacagaatacaagatatggaagagagaatatcaggtgcagaagattccatagagaacatgggcacaacaatcaaaaaaatgcaaaatgcaaaaaattcctaactcaaaacatccaggaaatccaggacacaatgagaagaccaaacctacggatattaggagtagatgagaatgacgattttcaacttaaagggccagaaaatatcttcaacaaaattatagaagaaaacttcccaaacctaaagaaagagatgcccatgaacatacaagaagtctacaaacctccaaatagactgacccagaaaagaaaatcctcctgacacttaataatcagaacaacaactgcactaaataaagatagaatattgaaatcagtaagggaaaaaggtcaagtaacatataaaagcagtctgattagaattacaccagacttctcaccagagactatgaaagccagaagatcctgaacagatgttaagcagaccctaaaagaaaacaaatgccaacccaggctactataaccagcaaaactctcaattaacatagatggagaaaccaaagtattccacgataaaaccaaattcacacaatatctttgcatgaatccagcccttcataggataataaagggaaaacaccaacacaaggacagaaaatacaccctagaaaaaacaagaaagtaatccttcaacaaacccaaaagaagacagccacaagaacagaatgccaactttaacaacaaaaataatggaaagcaacaattacttttctttaatttctcttaacatcaatgaactcaattccccaataaaaagacatagactaatagactcactacacaaacaggacccaacattttgttgcttacaggaaacccacctcagggaaaaggacatacactacctcagagtaaaaggctggaaaacaattttccaagcaaatagtccaaagaaacaagctggagtagcaattctaatatcgaataaaattgacttccaacccaaagttatcaaaaaagacaggaaggggcacttcatactcatcaaatgtaaaatctaccaaaatgaactctcaattctgaatatctatgctccaaatacaaggacagccacattcattaaagaaattttactagagctcaaagtacacattacacctcacacaataatagtgggagatttcaacacaccactctcaccaatggacagatcctggaaacagaaaataaacagagacacatggacaataacagaagttatgaaacaaatggatttaacatatttctacagaaaattttatcctaaaacaaaaggatataccttcttctcagggacacatggtaactcctccaaaattgatcatataaatcagtcataaaacaggcctccacagatacaaaaatattgaaattatcccatgcaacctatctgatgaccacagactaaggctgatcttcaataacaaaattaaaaatagaaagccaacattcatgtggaaactgaacaacacactactcaacgattccttggtcaaggatgaaataaagaaagaaattaaagactttttagagtttaatgaaaataaagccacaacatacccaaacttatgggacacaatgaaagaattaataagaggaaaactcatagacctgagtgcctccaaaaagaaactagagagagcatacactagcagcctaacagcacacctagaagctctagaacaaaaggaagcaaattcacccaagaggagtggataggaggaaataatcaaactcagggttaaaatcaaccaactgaaaacaaaaagaaatattcaaagaatcatctaaaccaggaactgtttctttgagaaaatcaacaagatagataaacccttagccagactaactagagggcacagggacagtattctaattaacaaaatcagaaatgaaaaaggagacataaaaacagaacctgaggaaatccaaaacatcagcagatcctacaaaaggctatactcaacaaaactggaaaacctggatgaaatggacaagtttctagacagataacagttaccaaagttaaatcaggatcagattaatgatctaaacagtcccatttcccctgttgcaaccagtaagaaggacacatgctccactatgttcatagcagccttatttataatagtcagaagctggaaagaacccagatgcccctcaacagaggaatggatacacaaaatgtggtacatttacactactcagctattaaaaagaatgaatttatgaaattcctaggcaaatggatggacctggagggcatcatcctcagtgaggtaacccaatcacaaaggaactcacacaatatgtactcaatgataagtggatattagcccagaaacttaggatacccaagatataagatacaatttgctaaaggcatgaaactcaaaaagaactatgaccaaagtatggacactttgccccttcttagaattgggaacaaaacacccatgaaaggagttacagagacaaagtttggagctgtgacgaaaggatggaccatctagagactgccatatccagggatccatcccataatcagcttccaaacactgacaccattgcatacactagcaagattttgctgaaaggacccagatatagctctctcttgtgagactatgccggggcctagcaaacacaaaagtagatgttcacggtcagctattggatggatcacagggcccccaatggaggagctagagaaagtacccaaggaactaaagggatctgcaaccctataggtggaacaacattatgaactaaccagtaccccggagctcttgactctagctgcatatgtatcaaaagatggcctagtcggccatcactggaaagagagtcccattggacttgcaaactttatatgccccagtacaggggaatgccagggccaaaaagttggagtgggtgggtagggaagtggggtggggtatgggggaattttgggatagcattggaaatgtaaatgaggaaaatacctaataaaaaatattaagaaagaaagaaagaaaggaaggaaggaaggaaggaaggaaggaaggaaggaagaaaagaaagaaagaaagaaagaaagaaagaaagaaagaaagaaagaaagaaagacagacagacagacagacagaaagaaagaaagaaagaaagaaagaaagaaagaaagaaagaaagaaagaaagagaagcagtcataaatagtctcccaaccaaaacaaggccatggccaaatgggtttagcccagacttctatcagaccttcaaagaagacctaattccaactcttctcaaactattccacaaaatagaaacagaaggtactctacccaattcattctatgaagccacaattactctgacacctaaaccacacaaagatcccacaaagaaagagaacttcagaccaatttctcttatgaatatcgatgcaaaaatactcaataaaatcctcgcaaaccaaatccaagaacacccagtttgttttttgggaccgtttgcttggaatattgttttccagccttttagtctgatgaggaagcatctgtctttatcactgaagtatgtttcctgtatatagcaaaatattgggtcctgttcatgtatccagtctgttagtttatgtcttttattggtatattgagtccattgatgttaagagatattaaggaaaagtgattgttacttcctgttatttttgttgttagaggttgaattatgtttgtgtagctatcttcttttaggtttgttgaaaaattactttcttgctttttctaggatgtagtttccctccttgtgttggtattctttctattatactttgtagggctggatttgtggaaatacattgtgtaaatttgattttgtcatggaatatcttgtttcctctgcctacagtaattgagagttttgcatggtctggcatttgtgttcacttagggtctgtatgatatctgctaaggattttctagctttcatagtctctggtgagaagtctggtgtaattctgaaaggtctgcctttatatgttacttgacctttttcccttactgcttttaaaattctttctttgtttagtgaatttggtgttttaattattatgtgacaggaggaatttcttttctggtccagtctatttggagttttgtaggcttcttgtatgttcatgggcatctctttctttaggttagggaagttttcttctataattttgttgaagatatttactgactctaagttgggaatctttgctctcttctatacctattatccttaggtttggccttctaattgtgtcctggatttcctggatgtgttaggttaggagatttttgcattttgcattttctctgactgttgtgtcaatgtttcctacagtatcttctgcccctgagattctatcttctatttattttattctgctggtgatgcttgcatctatgactactgatctatttcctagattttctaactccagggttgtcttcctttatgatttctttattctttctatttacatttttagattttgggtgggtttgttcatttcctttgcctgtttgtgttttgctataattctttaagggatttttgttttttctctttaagggcttctacctgtttacctgtgttctcctgtatttctttaaggaagtaatttatattcttcttaaagtcctctatcaccatcatgtgaaattattttagatctgagtcttgcttttccagtgtgatggtgaatccaggacttgttatggtgcgagaattgggttctgatgataccaagtaaccttggtttctattgcttattttcttatgcttgcctcctgccgtctgaatatcgctagtgctatctgccatcactatctgactagagcctgtccttcctgttatcctggttgtcagaaatcttcatagtccagctgtctctgtgatcctgtgattctgtgatcctgagattctgggtgtcagagctcctgggagtcaagctgcctctgggagcctgagatcctggtgtgtctaatttcctgggatcctgggatcctgggatcctggctgtgttagagcacctggtatttgagcctcctctgggtgctgtgggactggctgcagagtttttgcccaagataaaccagcacagaccggaaggaacccaaaccactgctcttagatttttgagacagagttttactctgtaaattaagtagcctttgatcttcagagactactacctcaatctcccaagtactagaagaattataggtatgcaaccgcatgatcaactagaaatactaaaaatacacattgattctgagccagtgtgatgagactggtgagcaagtaagtagaaacaaatgaaaacatgagatctggaagatagctaagagtagatatttaaaaaaatttcccattcctgtaagtaaactagacagccttgaaagtcctttgaacagataaacagtatcatataacttgtgtcctttttttcaccatttacatagtacttttattagtgagtagagattcaataagagattacagcttcaattatatggctaattaacagtttgtttttcttttttttgtatttaactcattttattagttaaaggaatgactgtgaaacacaaatacttacagttatttttcaaatgtagttttgatttcctctaagatttaaaatattcgtaagagtaaaatttaaagatatttgtattttagtttatgggaataataattctatatgaataaagtatgtagtattctttcatttatggaattactgaagacatgttgattttgtagtaataagtatgtttttaagtagatattttctttttttttcttaaagcagtttgttcttaaaaaaaatttccaaacttttttcttttccttttatatttattattatgttttctttatttacatattgaatgttatcccctttccttgtttcacctcagaaacccccctatcccaatccccctacccctgctagccaacctacccactccctcttccatatcctggcattcccctacactggggtatgtcgggcatcaatggaaggagagggcctgtaatttgtatcttttaaagatcactttgagtgttatctgaagaatagatgcatgttgcaagggataaaaaacatgtgcatccaggaaatctaggaatctctcttgatatctccaaagaagggagatagatactctaaagcagatgatagcagaaggacagtaaaaactggttagattctaggtatgtttttgaaatatgctgtatgtcatttatataccaggcagtaatgggtgtgtgtttggatatagcacagaacatagccaaaatcagtctcttcacagattaggggtttctagtacatagtaacccctaacagttcttgagcactccctgtgctctaaacactgctttcttaacccacttaatgctaatcacaacccaaccatgtaactaaattctaatatgatgaaattgggtctgaagaaatggttcagtggttaagaacactggctaatcttccataggacatggaagggttcaattccttgcacccaaattgtggcgtacaactgcaactccagttctggagaatccaatgccctcttctggtctctgtgaacaccagacatgcaaatattacatatacatacatgcatgcaaaaacctcatacacataaaatcaaatcaatatttttatagatggtgaaattaagataggacagaagataatttgtttcttgatggcatacaacatgataaacaaaaacccaagaaactcaacttgattgttagagaacaagccatcccacccagcacttgcctttttgccacacagtaatttccaccgcagaatacctcttggggtcccctttcatctttgttctacatatggtggaagatttcatagaagattgccagggttattttactgtccaaagcttccagagttggctgttggtgtgtcaagttttcattaagcctcttccttgacaagcatttcatttcaccatctttgttgatacaaagctgatttgaccatggtataataatacacacaaaaaatggaggacagtctagaaagtacttacagggtcaaatctacatccagaccaccaattcatgttcagaatcaagtacttttcaactgcttgtatggctgttccttggtatctgaggaagatttcttccaggacccacaaaccaaatatcaaggatactcgtcttttctataacattatacaatatttgtatgaagcacatgtgtatcttcctaaagtccttcaataatttgtagattacttataatcccccaataaaatgcatgtaccatattaacagttgttacactgcatgatttaaagcagtggttctcaatctgtcaggtgcaacctcttgggggttttaacgattctttcacaggaatggcatatcagatatactgcatatcagatatttacattataattcacaatagtagaaaattacaattatgaagtatcaatgaaataattttgtggctgggagtcaccacagcatgaggaattggattaaatggtcacagcattaggaaggttgagaaccattgatggagagaataacaagaggaaattctgcataagttgaatctagatccattttttccctcaaatatattgctctaagagaagaaatgttcatagctccaattctttctaacttgcaatcatctgatttaagaaacacatagaaaagagcctttattgcccattatttcagagcataaacttgtactatccaccctcaacataaactctcctctcccgatgatccttaagtgttcagccatgttacacatgatatgttcagtgctacagtattatcacttatttctttgtgtgtgtgtttgtttattatgctttaaatagcttcttttgattctgtatacttaaattctaggtccaagtgaaataatgcctgccatttctctcgggctttatttgtactcagtatagatccaagtatactccatgtgctatctcatttagttccaaatgtttgaattaggttatctcattactattcttatctttagatgttacttaaggggttttggtgtttgtttgtttgttagttttaaggaaccccaaaaggcactcagctaggaaataacaggaccacatgtctttccaatgccccaaccagttttcttaaccacagacagtgtgtcctcgaaggaaaaaacacacacacaattaaaaaaaataattttatctttaaattctctcagaaacagctatataaaagtataattgacatataatcaactctgcatatttgaagtatgtgactcggtaagttgtgacatatgtatgcacctatgctgtcaccatcacaatcaagataaagatgggtgaaaatattgatcacttgcaaaagttcctgagtcaaagctggatactttttgtttacattactttgggcttttaaagacaaagacttctctgctgtatagtcctcactggcttgtaattcactatgtaggcaagactgtcataatatacaacatagaccacactggcaaacttgtggaagtcgtatggactaagtactagaattccaggtggacacttctatgcccaacacaaagtattttcttagagtacaaagcagtaatatacaagagtcacaactgaccataccaacactacccttagtacactcattctcttgattaatatcacaaattgccgatatataagttgagattttcaatgctgaacttcccaagctaagaacagcaaacagaatgatgataaattctgagttaggaaatcagcccagggagtcactaggctgattgatctcttcttattttcagaaataaagtatgtggattatttatcagataaaatgaaattttagtgttccttttgggctcttatatatgagaaaaatgggcttggtatttataagctttttaaaaaaatctttatggtgcctagaaaagaaaatttctgtctatgactaaggtggcagctaaactcatttaaaagaaaaaggcaaagggatgaagagggagtgggagagaaaggaaaaaaagcctatacacctgtttatttgatggatgtacctagtagtgatagattgccaccaggttcttagaaaattatgcacaggggccctgaagggtttttctttatcaaattgatttatcaatcacctttgctcaagtgcagactgcaccgcccacattgctataacgttttcactctaaatggagaggagaactgaggttgaagaaggattacatgaacatctggaccatgacaaaccactgccctgggccactttacccacccgtttgatttacagtcttcttcatgaaatctgatggtaggaaaagaagattaatatcatttaaagcagtataacattaggatgaaaagagctagttgtgtatactatgataatgaagccttcttaaagaggtgctagatacagggtcatagaaaaagggagagtgtttcaaatgctgtatagccaccagggatagagatacaaatgagtatagcaaataaaatgagtattgatgggaaaagccattttcagtatgagaagtctctaatggcattgcattgctgaccaaaaagagatagatacccttcccaccaaaaaaaaaaaaaaaaagaaagagacagacaactagtgagagtgagaccataggtgccaattagatcttctgtttttccatcacatccaatgacggtcagatgtctaagtcttttaatttgagacaaatccttgtctacccatctgatataaagtaattgtgcttaggacagattttatgagcaacaggggttagcacaaaagaataattaagcagggagaaagaaattctgcagagaaaacattcctgttttcttttcctgtgaaaacagaaatatcccataatgggaatgactgggacaatgtccctgtggtaaactatctggttaccaagtacttccaatcctcaatttctccactaaaggcaggctataacccatgcagtagtctagaacacaacaaaaaaacatttaagagagcaatatgtacttattttccattgattatataagaattgagtcctgaaatttccaatgcaaatacatagaaaagtactgtgaagcatggtacaaagagtctctaaattctaatgtgtctttgatggtaggaaagacctgtccactctcagtgggaatgacctctctctccttgtttaaaattaaacttacatgtcctaaaaaaaaaaaacaatatgttatggcctccctcccctgtggccaactgttatagggaaggacagttctgaatctcttcagaaactacacacaaaaactctcatgcatctcaactagtaactagtcagggaagatgtgtgacaatgtacattaaaggtatagaataaaatggaagactggagaaaatcatttatgtccatttgctatgagagattctgcatttaatgttgtaccttgtggagtttgaaaagtttctaaaagtgtgcttggttgatgaggtaaaaaaagaaccacaagacccctagtgaataaattagaagtcttagacataccttacttcaatgtagaggaaaagattcaaaggggtagtgaggatagaatttttaagtctagaaaacatgattctccgtggctgtgtaagttggtgtcactgacaaatcctagaattgattttctctgtaggacagaccttagactaggagctatagtcccagacttgtaaaatgtaaataaggtgaacataattgggttccagggacaagtatgacactaatttaccaccaaagcatgagtgtggttaatataaaggacaacagaaccaaagcagcaatccagatggtgagatgtctgcaaacctgtgacattagctagctgattaaagaacccctgaaaagttaaagacacaggaagcctaatcaaatgcttaaatgcagaactgaaaaggtcccatgttaaatgagcaataatgtccaaccagaatcataaaatcaaagtcaatgaactccttgactgccatcatttgacagacccagaacacctcaaatgaagaagagggtagatcccttgatataaagatctcagtctactagaaaattctattctattaatcttccttgaaaccttcccaaaaggatccatagctttctttcagtagaattttgtactatgccataggaaccccaacagtggttctaaagtgacactgtggcccactcttcagagtatcattttatttagatcaagtatcaatagtactttagctctggattttttcacagtagacataatttgacagcatcacctactgttcagactagtaacttctggagatcaggtatcaatagtcctttaactctggactgtttcacagtagacataatattttactcaatcccttctggtggctttttctaagactgagactacacaattgaaatacatacactttgcagttggaagaatcaccacattcctttgctgacctgtacattgagatatgaaagttcaaacagatgccactagaaccatttgttcctctataaacagtaaggcaaaagccacatcctattcctcaaagaactgcagagattaatgtcatcctcaaagacttgaaagatacaggagtagtgattcctaccatatcagcattcacatcatcctcttggcctatgtaggtggtagttggatcatggaaaataatggtagaatgttgtaaattaaactccaattccagctgctgtattagatgttgtttcattacacaaacaaattaacatgcttccccctgcttactttctctgatgcagtgataaatactttgacaaacacaacttgagtggtaaaaggttgattctgtctccctgttcaagggcatagtccatcagagtgaggaagtcaaaaaggcagggtcttgaaacatctggtcacattacatccacaaccaggaagcagagaataattaatgcatatttctgcttagctccctttctccatttatagtccaaaatccaagcctggaatctaccacccatgataagcaactctggccacatcaaatgtaatcaagatcattttctggtaggcatacatagatgcccttctcccagaaaattccagattctgtcaagtagaaacaaaccatcacaccgttgccactgggatgtaactgattagcaagtggatattctccacctatgtgaattaaacatcactagaacccttttcatcctgttggttctgtttttctggacaaatattgggtggtatacacctctattacacatttgttaacacactttgtaaataacaaatatataagactatttattgtgaattttatgtatagctttgaaggtttcacttaagctaataagtttaatttaatttaaataatgtttaatttacagcttatagcgcacattccatctcatccccttctgccttaaatcgaaattgtatgccttccatatgtatataaatataatacatatatttaatataatataacaaaattaataaaaatataatgcccacatttttcatattccaagctttggaatattaatgacaaaggtttaacatttatatatctcaagtttttgctaaaatatcctattacatttgaagagacttaaataggaaaactacttttctttctatatagtttatctgttactcttcctgttgctgtggaaaaactagtctaacaaaaacaatttgggagaaatggtttattgtggctcatgtttcaaggatacagcccagccatggcaaggaatcatggcagcaggagcttctttcaacttatttcattgcatccagccaagagccagagtgatgactgctagtactcagctttcattcttctttttattcagtccaggacctcagctcatatttctggtgtgtcatcccaagtcagtcactagcctaacatagataattgttcacaaacatgcccagagccttgtctctgcaatgcttgtggatcctgcccagttgacagctgatatcaaccatctaatataccaatgtagtttccactttctgttctcaaaatacccttttacacatccatatttttacattctttttcttttgctataagacttccattatgctatgggcctgttgcttatgacatcatttggatttttcagcctaactttttttaatcttcatttctgaagtatattttaagtatagaattctaggttatatgattatagttaggttattgttgtcctgatgttcagtgtttgtgtttggttttggccttttctaggtttgtttctttgtagttgtttggatattctatgtaatgaccctctatcagatttacaattggtaaagagttttacccagtttgataatgactttttgtttgaattatagtatttgttagttttgtccattgtgactggaataaaatgaaatttgaaagcaaaaaaaaaaaagaattctaggttatacaattgtcttccattactgtgaaaatgttccctcatttccttcttgttttataacttctgagatgtacttctcagttatccctgcaactgagtcctgaagattgctgttcatctgagtgcttcaattctgtttatcactaatgctgaataatttaattttgatatttctcgatatagttcccttcaggttcttaaacttaaggttcattttatatatatacatgtgtgtgtgtgtgtgtgtgtgtgtgtgtgtgtgtgtgtctgtgtgtgtgtttctgtgtgtttatttcataaaatttatatgtatttcaactactatatttcaaagactttccttggcagcactattgtcttttctgctatggcgatttcagtcacaattatgtctcttactaagatgttcgttgatttactggtgcacgtttgttatttgtttctgtgtattattttaaatagttactgaaatgtattcattttatttctttgttgtataattgacattgagcttctgaagtgaaatcactttattacttgtgcttttcatctcataaatgtttaaattgcatcttttataccttcaatttgcttgcttaacagtgtcttaaactgtatactgctatatgatttatacatagcacatgcacaaatttccctattaaagaatgcatttagtgacttttagtatatttatagatctgtgaaacgattagaattcaagaaagtacaaatggataaaaacataggaaagtggtatgcatctttagccattagaacaaatgcagattgaaactactttgagaatccatggcactccagtcaaaatggctaccatcaaaaaagtaaatgctaataaggatgtgtagaaagaaagattctctagacactactgtaaggaatacaaattagtgtgaccactgtggaaatcagtacagatgttttaaaaaactgaaactacaatctaatatgattttggctgtactagtctaggaatcaaaagtgagcatacattcaagatcctatatgccatttttattataaaatcaccttaactccccagcaagagatggatgcataaagaaaatttggcatcaatacacagtagagtattatttaaacacaaagatgaatgaaatcatgttgcttgcaggaaaatgtttgaaactagaaatcatattagcaaaataagccagctgcataaaaacaaatatcacaagttgtcccttacattcagaatagagattactaaagaaatgtgaaagtagaagaaggattatttgtggacagataagggactaggaggagggaagaaaagggaccagagacgacgatgggtggtatatacaaacagtgagtgaaagtgccacaatgtcactaattattttgtatgattattatatatctgtgcagaaatactatggcagattttagaccaatttcttcagctcagcaaccagttacttatcctttagctattactttctcaaccttcctaattctgtgaccctttaaaacagtaggctgatttccaaggtggttaatccattttatagtaccaaaaaggtactgtatgaggattctaatatattcatatcttcaacgacacctgttactttcttttttttaaatatagccaccatagggcatgtaaagtagcttttcactattgctaaaatttgcattctcccagaagtaatgaagtaatgatattggccattcatctatcttctgagaagaaacaaaaacaagaagtcctctcccagaaggactatctcaggtgtcccagtcggccatcattgggaagcgaggccccttggtcttgcaaactttatatacctcagtacgggggaacgcctgggccaagaagtgggagtgggtggggaggggagtgggtggagggtctgcgggacttttggaatagcattggaaatgtaaatgaagaaaatacctaataaaaaaataaaataaaataaaataagtccaataaagccttaccttctagagcagaagactgactgtcaacgcaaaaaaaagaaggctctctctctctctctctctctctctctctctctctctctctctgcttttctacaataaagctctaagaccatgaaaaaaaataagaagtctaagtccttatcccctttaaaaattatttcctattctttgcatgtatatagtgaatttttggttcttttcactccattttaccctgtctcactcctccttcttttccttttaaattatttcttcttctcaacatgttccctttcctgcattcatttttttctgtacatgtatataacctgccaagattaattggggttgcctgaatgagcacagatgggagattatttactgaagaaggggcaatttagtagtgactacacaactaaataaggaaatacatcttcttccattcaccattagctattaagagtctctcaatgatcctgtcttcctccaacgatgaaataattagcatacccatcctgtaggtcttgtgcaagtaactacagcagtggttcattagctttaccttcattttacattggaatattcattttcttttcttcctttaagacacttattttaaaaaaaaagaagaagaagaagaagaagaagaagaatcacttatttaatgtttataactacactgtagctgtcttcagccacaccagaaagagggcatcatatcccattacagatagttgtcagctaccatgtgattgctaggaattgaactctagaagagcagtcagtgctcttaactgttgtgccatctcttcagcccctgcaatattcattttcttaatgttaaactttgtgagttctctgtatctttttctttaaacatttttcatacaatatattttgatcttttataagtagtttctacctgcgtaaattatcttgtttcttgacattttctttaacatagcataagattacaatgtcaatgaaatatagtttatcaatacatcttttcatgggtcaagacttcagtgatatatctataaaattaccagtatacacatgttcaccaatattttcttttacctttagatgatatattttttttcattttggtccatgatccatcctgaactaatatttaaaaatggaacgagatctctgtctagataaatttttgaaagtggatctctagttgttccaggactatttgatagaaagataacctctggtctactatattacctttgttcctttgtaaaagacaaatggtgtttacaaagctctacttcttggctttcttatctattgttgtctgttctattgatcttcttgtctattcttttgccaaccacatactggcttgatcattgtagctttaagcatatttttacaggttcaagagtgtccatcccatccaaaagaatttattcttcaccttcaactctgagttagttatacttggtattttgcttctttgtataaatactacaatcagcttgtcaacatcaaaaaagacatgcttttgtgtttgcaaatggtgttgaatttataactctaattcagaactaacttctcaacaacattttgtcttcctattaccatagatacttttcttccactattttaaggttatttgttagcagaatattacagttttctccttgtacatatttttttagatttatacatttatttttcatttattgatagagatgttacaattgtggttttttcaatactgtgtgtttattattggtatggggtacatgataacagtgtttcctttctccccctgattctcgcagattttctacatagataggtgtgttttttgagaaaaaaaatacttttatatcttcctttctaatttgcatatacttcatttccttttcttatcttgctccatcaattaggaatcctaatatgacagtcaaaagtagtaaacagacttcaataccttatgctaaaagagaaagtttcaaatgtcacaccagaaaacattatgttggttataggatttctgtaagagttcttaataatgttgagatatttgtatccaaccagtggacagaagcagctgacccctgttgttgaattagtgaaggcagaaagaagctgaggagaatggcaaccctgtaggaagaccagcagtctctattaatctggatccctaagatctctcaaacactggatcaccaaacagacagcatacaccacctgatatgaggcccccaatacacatagagtataggactgctgggtctgtgttcattcagagatgatgcacctaaccctcaagagactggaggccccagggagtttagaggtcaggtggagtgaggggtagggacattcacatggagacagggggtgtggaggagttatgggatatggaacagttgaagggtggatgtggagtggggataaaatatggagtgtaaaaaaattaattaatttttaaaaagagaaattctaccactatttcaaatttgttaaaagtccgttttaaaaaagtctcaaatggaaattgggcattgtcatatgctttctgtctattaataacagtcatacaaattttttaaaaatttatttatttatttattttatgtattcactattgctctcctcagacataccagaaaggggcatcagaacccattacagatggttatgagccaccatgtggttgctgggaattgaactcagaacctctagaagagtagtcagtgctcttaaccactgagcaacctctccagaatttttgtctttagcctattggtgtaatgagttatattaattcattttcttattttcattaaccactttgttgaggcattattgatatacaaagagcaataaatatttaatgtttataacttaataactttgaatataaaacatacctgtgaaattaatacaatttataacataaacatatccaggtgctaaagagatgaatccacagttaaaagcacttcctgctcttgcagatgactgaagtttgatccccagtacgcctatcaagcagtgcccaatcacctgtaacttcaactacaaaggacccaaagccctcttctggtctcctcaataactaatgcaggtgttcataaacccagagatacacatataaataaaaataaaaggcatctttaaagaagaacctattgatcatctttaaaatttttctcctactttatcattttttatgagaatgttcaatgtttcgaagcatatatttaagcaagcaatgtaaagctgtcaactctagacctggtgctggatactactaggtcctgtgactcactcatcttttgtaagtcagactttgtacccttttattaatatctgcctatccctatcctagttcttggcaatcagctcttcattttgtttcagtcattttgactattttagactccttgtatttatattattatggattttcaattctacaaattactaacaccgtttaacacaaaatcctctaggtttatctaacttgcaaatgaagacttttctttaggtttaaagctgaataatataaattgtatatgttgaattttctttattcatttgctgtcaattaacacctaggttgtcttcactggggtattacaaatactgcccaggtaagaatagtaacatatctatccacaatcctgtttcaactcctgttagatcatactatcctcttccatagatacatccagcaatttttatagctatgtattttaagcaattaaatgtagtatctaagtaaatcatattatacacattttccagggtttgttgctagttccatgatgccagtatttgttgtcttctgttcacctaacttaaacagagatgtctttaaatatcctgaactaatagtccccctacctttgtttgacattctctaactgtgtgctgaagcaagtatcaatgttctggaagacagataacgtttgtgtgttcgcctctactttttgctgagtggagactcaacatcattcttccattatcttgggccagtaagacttcgcatgccatttctgagcaaacatggcaggacaaggatctttagaataagatgttgaaacctttggacatatgccaaggactggtatggctgggtcgtatggtaaatttatttttagcagtttgagaattctgcaaatttctgagcaaacagatgagagaataagcagtgtttgtgtctgggttattccctcaatataatattttctggttctatccatttacctgtgaatctcatttttcttcatagatgaatagtgtgcacatttttgttgtccattcatcactggttagacattgatgcagcttacattccctagctattgaaaaacagagcagaaaggaacatggccaaagaagtatctttagcattttgaaaattctgcacacaagtttccaaagtagctacacaattccatcaataggaataggggtttcttttctcccacaccctctccagtacttgttatcagctgctttcttaacctttgccattctgactggtgtgagatgaaatcttaaagttgttttaatttgcattttcctaattgctatgaactatgactttttgagagatttcttcgctatattttatttcttcttttaagaactctctgctcagatctgtagcctatttttaagtggggcctttgttttcctgagactttgttttatgagttctttgtatattctggatattaatcctcttttaggtgtctagctggcaaagagtctctcccatctgtggattttctcttcatttagttgattttttttttactttgctgtacagaattcttttaatttcatgaggtcccatttatcaattgttggtactaattcctgagcaagtgggatcctattcacaaagccctgtcctgcacttatacctgtagggtaggatactacctgtgatttcttttagattttcagcatttcagttttcccactgaggccttggtccatttccagttgatttttgtgtggagtgaaatatatgagcccaatttcattcttctacatgtggatagccagtttccccagcctcattcaatgaagatgttgtctttcttccagggcatttattcttttgtttgtgggtttgtgtttttcagattttatgaaactatagttacctggtttctttgtatggcagaaaataccaatctaaaggaaaagtgcatattttattattaaatatgaatgcatgctgagctaactgtacatacatattcactctgcccatattaaaaacaatttgggctgggactggtggcacaggcttaattaggaggctcaaaaacaagttcaagtcctccctgagctacagaaggacttcaaggacagcccacaggcaaactagtgagactgtgtctaaatataaaatggaacaagggataaggatataagttaatggtaaagcaattgcctagcatgtatgagaccctgaattgagtctctagtaacacaaaggtttggcttttttgttgtttgttttgttttattatgggtaactttatattatgaaaatggattatttataaccatatacatataattttattttaatcttttaaatataattataactcttcctcccttctctttctcccttcacatctcccagttactgcctactcccacatactactcaagttgatagcctctttatctttgattatatttgttacatacatatacatgtgtgtgagaacacacaaacatatataaagagaacatactgagcttgtttttgttgtttgtgtatatatggtttcaatgctggccactctacattgggcaagcaataatggggctcatccccaggagaggttaattctcctttaggcaatcagcagctgtctatcattaattgcctaggggtgggacaccatgaaaatttccctcttccacataaacattgatattgctattgttcaggtcttatttacacaggcatcactaggaaaggctgtttcacatcagacttcccattactctgatttttataatcttaccaccatttctttcaagatgtgccctgagccatagttgcaggagctgtgatacataaatgtctgtctgagctgaactcctcagtctattgatctctgcattgtgtccagttgtggttttctgtgatggtctccatttgctgtaaagagaaacttctttgatgcaaagtagcagctacacttccctgtgggtttaaggataagatttagagtgcattaaggaattatactattctagcaaagtggaggtagtagattcctttctaaggtccacaactttactaggctcagaaatcgtgcagggtttccagtactaggaattatttcatttctgttgagtgagccttaagttcaattaggcagctgttgtctaccacagacatgtgagtaccacttcttgaactttcacgcatatcttgtcatgctgagattgttaaagttcataggcattgcatctgggttaggactgttgaattccttccctcccttggcaatttgcatggtgtttcctagaacccttgaagttagtcctcaggaaagaagctttcagatctgatcaaactcattacctgcataatgtgtcatcagaatgtgttatcttcagcaatatgggcccaccctcaacccctcagaaagcaactataggttgcattgatcatccatattggaatcacttggagaaccctgatcgtccctatgaaagaatgcttcttgtatctggtgctagactttttgttagtctatggttcttatagagtcagcgtgggtgacttaacttcctataagatacacatacatattacataaatacatacatacatacatacacacacacacacacaaatgtgtatgttagactatacatcttttgataaaaaatctgcatcaaaatttcacatttgcctcatttttttatgccatagtcacaatgtgatatgtaatagaaacagcattttcttaaatgccgccaattttagtagacaatttagaaataagaatttcctaattcatggcgttggaaagatggctccattgttaagagcacttgctactcttgcagaggatctgtaacccccagagctcgtgtctctagctgcatatgtatcagaagatggcctagttggccatcattggaaagagaggccaattggccttgcaaactttatatgccctcagtacaggggaacgccagggccaagaagtgggagtgggtgggtaggggagtgggagggagggtgtactggctagttttgtgtcaacttgacacagctggagttaccagagaaaggagcttcagttgaggaaatgcctccatgagatccagctgtaaggcattttcccaattagtgatcaagggggaaagtccccttgtgggtgggaccatctctgggctggtagtcttggttctataagagagcaggctgatcaggccaggagaggcaagccagtaaagaacatccctccatggcctctgtatcagctcctgctccctgacctgtttgagttccagtcctgacttcctttggtgatgaacagcagtatggaagtgtaagccaaataaacctttttcacctcagcttgcttcttgttcatgatgtttgtgcaggaatagaaaccctgactaagacagagggtatgggggactttggggatagcattggaagtgtaaatgaagaaaatacctaattaaaaaaataaaataaatgttaagaaagtttcctaattaacaaaaaactctagagtaatattaacatgaatgtaagtcagggaaatggggttttcctaaagatttttcaggaaagacaaataaaactgtttaggctgggtctttgtagaggtggaaacccattctgttctctagttactatgaagattcagaatattttgattattgtatttctcagactgcaacatatcaaagctaccatgactctgcagagtgggttacaggattagtgggggtgaaattgtcatagtttttcctatttttaccaagattgggatttttttctttaaaaaaaatgctttttggattgttataaggctttgcttaatttccaaagttctgaaaataatttttgacattttttgataaattttcccagaattttcatagattttatgggggggggaatcagattcatgtagattcatgtgacttcttaaatagcgattgtgccagaaattagtctcctgggctgagtattttcacattcctaaaagtactctttaatctttacagagtaaagacatttggaaaaaaaagttttgaccttgtaagtaagaattttcagatgagactagtgactgatttattttggagtctactgaggtatttcttaccatctcaattcccattattgatagaaatttcctgtctggacagtgacagtagcagctatactgtttgctctgtgggagtactgggtagtagtacttttaatctttaagctgtattttatctagttgtgggttgtcttgatatatacacattgttctccttaatgccaatgtgtaatcctatatagatatctggagctttttttcctgcaattctcatcccactgatcagtcctgtaatctgtggttgccttcgttttcacttcatctctgtttgctcatcacaaagaagatagcaatctctgattcaattcccttttcatgacctggaaactcaaggtgacacgcttgtacaattatacaattctcctcatttttttccccatctctcagtgaccactttcattggctgatatgttctatcctatttacttttgtttggttcaaatagaagatgagattcaactcctgttatttcatctggaccagaggcataaatctgtcctatgccagtcctttaagcttaaatctgcattgttagcactctctcacggctttcttctttaaaaaatcaataaaataataaatctatatctgacaagaagcatttgccaagtcatgagatataaaagaattccaaatatcttttcccatgaattttaaggtattaaaaatacataatgtttccactacagagatatgatttttttaaaaaaattaacttcaaaagtataaataacagtaaaatatagcagaaaagaaataggatctgatatttaagttaccactttgtttttatgtagttaagtgtaagttgatatactttcatttcaatagtaatcatattgaaaaatcaccatcacagatttaaaattcaactacttaaccatctgcattatacaactgcttctatgcctggtaattagaatcatcatgaaagtcagtgcatgtctggaagcaaagaagaattcatttacccttgttccctgctcaccagggtgttgggctatcccagcaaatacacatagagccgtttgaccaccacgaaaacaaaatccatactaaagtttttgatattaaaagttcattaagatagatcttgacatcatttttaattctaagaattacctttcaagatgataaagtattttctcagagcagcaatacaataagcctgtcacctaacacctttatagatactaagccgctaaataagaagaacaaagcctgatatcattggcctacacgatgtatacttggaaggtataatagaaacagatagagaagaaaaattagaaagaaaaggtagaaatgttcaaattaaaatatatttcttgtgctttatttaagaacataaagtcagttctgaaatagtcacatatcagaatatattgaagaaggcaaggcaataactgtgtcctcttgccttggcccagctacttgctagtaaggaagattgcacaagctcctagctatctgtcttacctgacttcttgataacataccaattttagggaaagatttgaagggagagaaagataataaggctatcacaaaccttatagatttaaggtacctttaggatcatagcaaagcaaaaaaatattgaaaagtgatggatgtacagtagttcatagaaaaacaagaagctcatagtgaaaagtcacagacagtgtagatgactgattcagtaaggaaatttgggattgttttagagaaagaaattaaaagaacgatcccattcaaattcccttttaaaaaaaaaacagtagagtaaacctaccaaggaaacacccaaacactccttaaaacactgaaggataaaactgaagaagacactagtacataaaaggacctctctcatgctcctggattgaaagaattagtattatgaaagttgctatattctatcataagcaatctacaaatcagtgacattttctttaaacttccaatgacattcttcacagaaatagaaaatgcagtcttaaaatttacatggaagagactgtgtgatggctcagtgagtaaaaccacttgccaccaaatctgctgacctgagtccaatctctggagctctcatggtagaaggtacaactgattcacacaatgtgttttcttactatacacgtatatgctactctagcaagcatgtgctcatcaacaagcacagtatatcaacccgtcggccatcaatgggagcagtggcccttggtcctgtgaaggttctatgccccagtataggggaatgccagggccaggaagcaagagtgggtgggttgaggagcagcggaagagggaggggataggggattttcggagtagaaactaggaaaggggataacatttgaaatgtaaataaagaaaatattaaaaaatagttattaacatgtggaaaacttggaaattgagaagagagtatacacaaaatttttgccacaaaaatggtagtagttgagatatttcattggcttggtttaattgttcagcaatgtgtgcatatattaaaacatcattccatatttttaaaaaaaaagatgaaataaaaaaaatttaaagctcatggaagtataagaggccgttaatatccaaagcaattctgactgaaaaacgatgctgggtgtatcagcccatgtgagtcaaaactatcctacagagacatagtactgagacagctggaacaggcacgaagatctacagaatagaacggaaggtccagataccattttgtgcaactttcatctatgtattagggcacaatgcccatgttaagaagaaggaaattagatcttttctttacaaaagaaaaccagctcctttacaaaaaccaactccaagtgggttaaaatccttaatataagacttgaaacactgaacttactagaagaaaaactaggagaaacatttgaagatataggtataggcaattacttcctgaatatgcttcctgtcactctggaaacaataccaacaatggaaaagtgggatttcacaaaattagaaaatgtccatgtgacaaacagttaatggagtgagcatgcaacctatagaatggaagaaacttttgctacctatgtttgctttaaatcttccagtaactgagagaagcctgaaatgtagactctggaaatgtgggttatgactgattcagccacttattagtactggagtcttggggtcattccttcctgtggtgctaaaaatactcaaagcagatgatgattctgtgacgtgggcaaggatatgtggaagaattaatgagacaatgtgtacaaaagatattggtaactataaagctctgaaaaaaaatcaaaaaaaggagagagagaattaaaagcctgataaccctagagacacttcagctagaagtgactggccaaggagaacttttctaatgagagccacaaaatcccaagattctatactattcaagaaactccagaaataaataaaattcccatagtgcacagtacattaggaaacttactgaatttaatttgctcaactgcttcctataaaaagtaggagcacaatgtgactaactaaatgccactttagaaagattcaggtcaaatgacattagtcaaataacagctccatgaatcactgatgaggttcagattacgccaaactgtctgccaggaaaaaaaaatgaggaagtcattaatttatgtacacaaactgagaacaatgtagctcagggataatattttgtctatttcaggattttagttataaacttcatttagcccttcagtgactactagcacacattcgtagtgtccgtggcagcttgctttgttttaatcgtggtctcatacttgtgcttgtattttaaagtgctagtaaaaatttcctatagtcagatcagagcatagtatatagtatcccagtctcacctccaaaagccacacccccacaaggaaagtgctaggataaaggacaggagaagcaagacaaggggactgtaacctgagatcatctatgagagagaaaaaaaaaactgaaaagaagccaaagcttgcagccaaaaagaacagtttacatcagcatttcatgaagagaacagggtacagagtggatatgtaactagaaatcgatcatgagaagaagaggaggagccgggacataaaacacttgacaagcagactattatacatgttactgtcttctatttatataaggttgagtacatgttgaagaagtaggtgaagaggttaaaaatggagtaagcctactgcagtaattatatggggtctagagagaacatcctgattaacaagtgatctgccatccacatgtgagaaatactgaagttctttgtgggtgacagtgacataggttacattagtaataggaataataggcattatcttcattcttgaaaggaacaatggaggaaaatatcccttctaacaaagcattccttagactccagtaaaagaaagaccatgtctggttccccttatgatgcaaatcaaagattacaatgatccattaagatggctttgagtaaaatgcctgctatttctggaagtcagtcctgaggaggctgcagtgacaaactacaaaaatcagagcaaccccctttgaggctagttccattctacctttgcagatgactcataatattggactgaactaggtgcaggagaatgggggttctgtctggataatctattctatctaatcaataaaaaaaatgcatacacggatagtttgggcttcaaacttcattgcttttggcctgaattatcctgtttgccattctgtatcaggtatataaatgactgacagttgtgccctcactatgtgctgtatataactcagaagcttctaatgctataaatgccgctaatgctttgaaaacatttattatattagtaagtagttgattttaggcaagtgttttccttatcttcctcaaatgatagtagagataatggacacataagtcctacctgagttcatcctgtgagagaagagctgacactagaaccctttctagaatgtattcttcatttgcactatttgacacatagcagtatacacatagatacttcccatctatgtcatcatgacacgatgttctcttttgttttgaagctatactattgtgacatcccaaatttaaatgttgcatgttgggccaggcaagaaaggaacgaattaaacaattttgtgggaaacataaccttgtataaaagtgcagttcttaaaaagcagacccaggctggccctagcactctcaactcagatacaacacgacttctgctttgaacaaggtagaagcccacacagacccagaaagataaacacgattgttagctgaactaagttccttgaggttggcggagaaagataattttctttccagtcatcaaacagtgaggtgtggccttcaactggaagaactgaagccagacaattagagggaagattcaaagaaggtgctttcaggatttaagtcaccatgtctcagtcttcagaagaatgtgcagctgacgaaggccagacctgtgaagagacccagaaactacaggttgcagcagcctccgtcgatgttgaggagccatgttcctcatctcatcttatggctactagtctgaaggaccagaccagtgaggagacccaagtctccaaggatgtggaggaaccatgttcctcttctcaacttcttatggctagcaaccaggatgatcctgaagatgagacagccagtacttccaggggtcttcagcatccctatgactcttcaagcgagtctgctgagggtcttgataaccaagaagtgcagggtagcccagtcattccaccagatcagtcagatagcacagatttacctgtgatgactgtagatgggaaagttgatttcttggtgaattacatgctgtacaagtatcaggtgaaagagatgatgagtatgaatgatataatgacactcattgtcagagaagatgaagatcgttttcatgaaatcctcatgagagcttctgagcgtgtggagatggtctttgggctggatgtgaaggaagtagatcctatcaaccattgctatgctctctttatcaaattaggtctcaaaaaaaataaaaaataaataaataaaaattaggtctcacctatgatgggatgcacaatgatgagtacagctttcctaaaactgatctcctgatactcatcctgggtgtagtctttatgaagggcaaccgtgccactgaagaggagatttgggaagtgttgaatccaatgggaatctatgctgggatgactcatttcatgtttggtgaccctagagagctgataactgatgagtttgtgagggagcaatacctggaataccagccaatagccaatagtgatcccatacagtatgaatatgtgtgggggctacaggataaagctgaaactagtaagatgagagtgttagagtttgtggccaaggttcatgggtcagaccctactgcgttcctttctcagtatgaagaggcactgattgaagaagaagagagaacccttaccatgctattagaacacgctggctcaagttctgcttctggtgaaagttctagtgacacaagcagcaatttctctcatgtccagtacagtcagagatcaattgcttctgtataatttacagagaatttttagacttgagggggaagatgtacgacctaggttgatatagagagaaaggagtgtcttagctgcgtagttctaatttgtataagcaccatgccatgtttttcattgtttgccctttatatttgaatgtacttacacttgaaagcattgttgtttagtttcaaaatctcaatgccattcacaaatttaataagagtgttgtcataacatgaaactaattgggaaatgatcccatctatctgtttggttatctggagtagtaaaacatgcgttttctaagcttctaccttttaaacagctttcttctaattacttcctttgtacctttccatttctcagtaaaattacatgctctatgtggagttgttcattttatagttgccaagggtaataaaattcaagaaactttgaaaaaaaactacaattctttcagtaagaacaagagtgacctggttttagtgaacccaatatgcaaaacaagaacattacaaaacagacatgcagaaggtgattacatttataagggactgctcagcaaaactgcctgcgtgcatttaaacgtttaagatcattacttggcagaaccctctgggacacagaaactaaagttcaatgtaaagatccactgccaaatgaagaccaaaaggacgaaataagcatctttgaagtaataatggaagtcaggaagaaatagaatctcttcaacagaacctccatttaccttgacaatattggggatctagtaattagcctagtgcatggcctttctgtttctcaggaatgcagccccccaagttttaagcacagacttgggtattatcctgtgctgccccttgtgtatcatgtcgtccagtctgttatcaagtcatttgaaggaactctaaaattctcttctgtttttcttcatttgtagcataatttccgttctgtcctgattaatttctccatcggcatggccattggaatcacctaatacacctttctgatcatttttttctgtaagaactttaaagggattcccaatgcctagcttctcaactagatttttaaccaccctcaataacttaacttaatcttaacctttaggattatatttagtgccagctatgttcaaagcattgacctcttttttgttttgtttagacaaattggatggcatatacagacgtgaatgctcagtcattgggagcaacatcaggagttcaggccatgcttggctatatagtaagcttaaggtcagcttggactacctgagaccctgtattaaaacaacaacaaaagaaatggtatcttaaaaatcctgttaaaatctggaacccattttgtaatgtctgactcagaaacagagatgattctctgtgactatgaggaataacaggccattagctgaagggcttcaaatgttttaccttcaacaaatcaaagtgacataaatgttgaaaactcttaaatgtattccattcatgtccaagtgtccatttgttaaaaagacatggactcttagaacatctgagaacgaaagaacttcaaacgatcattcacactgaacgtgaaaacaaaaacagcaaaacaaggtcaagttctgtttcctgggatttcttgtgttttctttccagctcgtgtctctagctgcatatgtagcagaagatggcctagttggccatcattgggaaaagaggccccttggtcttgcaaactttatatgcctcagtacagggaaatgccagggccaagaagtgggagtgggtaggggagcagggcagggggagggtatagggaacttttgagatagcatttgaaatgtaaattttaaaaaatctaataaaaaaagaagctaccattcattggtaaatgaaaccaattttagaaaatgtatgaaatgagagctttaaaaaaaatgccccttgtgatttgacttcagagaagctatactgggagactaattgtgaatgtatacaaagatcttttatataaatatatgtatatatcaaatgttaatttataacaacggacataaataggtgtaaccttaagtgattccaaactggagaatagtcaaatacattaagactaattagcatgagatgttagtatatgacagtaaaaaacacattctctcagtcttacctgcaggccactctcctatatacaaaggaaaaatgatactgagaaggatagagatatagaaagtgttaatgtagaagatgatgtatgaaaagtttctttaaaaatcaagtaaaaacactgggtaggaaaacctgggttaagaaagaacacactagtggtctggtagctcagacttctctggaggcagaagctggcgagtttctatgagttcaaggcgaacctggtcttacatagtgactgccaggccagtcagtactacttagtgaactgaaagccaatctaaaaacaaaacaagaacaaaccaaccaaaaggaaaaagaaagcctagaaagagcatgaattttggaggatataataacataatataaaagaatgaccatattaacactgcacataggggaaagtgacaggttattttaaatcatcttatttgactttttgtgagaaagtgttcataatttgctcatatacatacatttttctaatttttattttcaaaatcattcctgagacatataaaagttttttaaaaaaaatctaaagaactcccatatatcttttgttcatattgtctgattgttataattttttaagaaggccctgtgccccatttaaagagtctttgctaataaactctggtataaacattgtcacatcagatttcaaagttaaggggtaagtgaaagaagacagacactgactcgtcatgacctacacaatcaaggataaaagcaactctcagactaataacaagatgcaagacttctagccaattacactgccttctacttgctacaatcagtgtcatttcatcctgtctttctcttaactgcttcaaagaacatcatccagacatggtgataatgagttttgagcaacagatttaaaatcccctgtgcagctgagtaacttggtggattttatatatatatatatatatatatatatatatatatatatataaaatttgctcatgttttcactctagtgaatgtgaaatgtattgatttaatccagctgctaatggtctgacaaaacatcccaggacatcagcaaatagaagaaatttcttacatgaataagagcactgcatacacatccaaagccagaaaaatgcagtatacaactcaaaggatcatatatactgtgcatttctccaagaattggaagagtcttctttactgtagacatttcagaggtgaaagaggcattaaggccaacaaacaaacaaacaaaagttttatataccatcagtatccagtatagtatcctgagctatatgtgactattaaagtgtctaaaatgtgaatatgtactcactgataagtggatattagcccaaaacctaggatacccaagatataagatacaatttcctaaacacatgaaactcaagaaaaataagactgaagtgtggacactatgcccctccttagaagtgggaacaaaacacccttggaaggagttacagagacaaagtttggagctgagatgaaaggatggaccatgtagagactgccatatccagggatccaccccataatcagcatccaaacgctgacaccattgcatacactagcaagattttattgaaaggacccagatgtagctgtctcttgtgagactatgccggggcctagcaaacacagaagtggatgctcacagtcagctaatggatggatcacagggctcccaatggaggagctagagaaagtacccaaggagctaaagggatctgcaaccctataggtggatcaacattatgaactaaccagtaccccggagctcttgactctagctgcatatatatcaaaagatggcctagtcggccatcactggaaagagaggcccattggacacgcaaactttatatgccccagaacaggggaacgccagggccaaaaagggggagtgggcgggtaggggagtgggggtgggtgggtatgggggacttttggtatagcattggaaatgtaaatgagctaaatacctaataaaaaatggaaagaaaaataaataaataaataaagtgtctaaaatgtgatcggtataactgagtgagtgaattatttcatttaaatttaaatattcatattcatatggctactatacttgacagcagatatctaagcctttctatagaaaatttctcaaaaaaagaaaaagaaaagaaaatttctctccagttctaatcactttcagttttctatgacaactacaaccactaccagcagcactgggtactgtctataatgatggtggtcaattccagatgcatattatattcacttgaggatcttttattttaatatttttattattacgtattttcctcaattacatttagaatgctatcccaacagtcccccatactctccccccaccacttccctacccacccattcccattttttggccctggcattcccctgtactggggcatataaagtttgcctgtccaatggtcctctctttccagtgatggccgactaggccatcttttgatacatatgcagctagaggcaagatctccggggtactggttagttcataatgttgttgcacctacagggttgcagatctctttagctccttggatactttctctagctcctccattgggggctctgtgatccatccaatagctgactgtgagcatccacttctgtgtttgctaggccccggcatagtctcacaagagacagttatatcagggtcctttcagccaacgcttgctagtgcatgcaatggtgtcatcctttggagactaattatgggatggatccctggatatggcagtctctagatggtccatccttttgtctcagctccaaactttgtctctgtaactccttccatgggtgattgtttccaattctaagaaggggcaaagtgtccacactttggtcttcattcttctttagtttcatgtgttttgcaaattgtatcttatatctcgggtatactaagtttctggactaatatccacttatcagtgagtacatttcatttgagtacatttgtgattgtgttacctcactcaggatgatgccctcaaggtccatccatttgcctaggaatttcataaattcattctttttaatagctgagtagtactccattgtgtaaatataccacattttttgtattcattcctctgttgagggacatctgggttctttccagcttctggctattatgaataaggctgctatgaacatagtggagcatgtgtccttcttaccggttgggacatcttctggatatatgcccagaagaggtattgctggatcctccggtagtactatgtccaattttctgaggaaccgccagattgatttccagagtggttgtacaagcttgcaatcccaccaaaagtggagaagtgttcctctttctccacatccacgccagcatctgctgtcacctgaatttttgatcttagccattctgactggtgtgagatagaatctcagggttgttttgatttacatttctctcatgattaaggatgctaagcatcttttcaggtgcttctcagccattcggtattgctcaggtgagaattctttgtttagctctgagccccattttaatggggtaatttgattttctggagtccaccttcttgagttgtttatatatattggatattagtcccatatctgatttaggataggtaaagatcctttcccaatctgttggtggcctttttgtcttattgacggtgtcttttgccttacagaagcttacagtttcatgaggtcccatttgtcatttctcaatcttacagcgcaagccactgctgttctattcaggaatttttgccctgttcccataacttcaaggcttttccccactttctcctctataagtttcagtgtctctggttttatgtgaagttccttgatccacttagatttgaccttagtacaaggagataggaatggatcaattctcattcttctacatgttaacaaccagttgtgccagcaccatttgttgaaaatgctgtctttcttccactagatggttttagctcccttgtcaaatatcaagtgaccataggtgtgtgggttcatttctgggtcttcaattctattccattggtctacttgtctgtcactataccagtaccatgcagtttttatcacaattgctctgtagtaaagctttagttcaggcatgttgattccaccagaggtacttttatccttgagaagagtttttgctatcctaggttttttgttattccagatgaatttgcagattgctctttctaattcgttgaagaattgagttggaattttgatggggattgcattcaatctgtagattgcttttggcaagatagacattcttgcaatgttgatcctgccaatccatgagcatgggagatctttccatcttctgagatcttctttaatttctttcttcagagacttgaagttcttatcatacagatcttttacttccttagttagaataacgccaaggtattttatattatttgtgactattgagaagggtgttgtttccctaatttctttctcagcctgtttatcctttgtgtagagaaaggccattgacttgtttcagttaattttatatccagctacttcactgaagctgtttatcaggtttaggagttctctggtggaatttttagggatacttatatatattgtcatatcatctgcaaagagtgatattttgacttcatcttttccaatttgtatccacttgatctccttttgttgtcgaattgctctggctaatacttcaagtactatgttgaagaggtagggagaaagtgggcagccttgtctagtccctgattttagtgggattgcttcaagcttctcaccatttactttgatgttggctactggtttgctgtagattgcttttatcatgtttaagtatgggccttgaattcctgatctttccaagactttgatcatgaatgggtgttggatcttgtcaaatactttctcagcatctaatgagatgatcatgtggtttttgtctttgtgtttgtttatataatggattacgttgatcgatttccgtatattaaaccatccctgcatccctggaataaaacctacttggtctggatggatgattgctttaatgtgttcttggattcggttagcgagaattttattgaggatttttgcatcgatattcataagggaaattgctctgaagttctctatcattgttggatctttcggtggtttaggtatcagagtaattgtggcttcatagaatgagttgggtagagttccttctacttctattttgtggaactggaattagatcttctttgaaggtctgatagaactctgcactaaacccatctggtcctgggctttttttggctgggagactattaatgactgcttctatttctttaggggatatgagactctttagatcattaacttgatcctgatttaactttggtacctggtatctgtctagaaatttgtccatttcgtccaggttttccagttttgttgagtatagccctttgtagaaggatctgatggtgttttggatttcttcaggatctgttgctatgtctccctttttatttctgattttgttaattaggatgctgtccctgtgccctctagtgagtctagctaagggtttatctatcttgttgattttctcaaagaaccaactcctcgtttggttaattctttgaatagttcttcttgtttccacttggttgatttcacccctgagtttgattatttcctgcagtctactcctcttgggtgaatttgcttcctttttttcaagagcatttagatgttttgtcaagctgctagtgtgtgctctctctagtttctttatggaggcactcagacctatgagtttccctcttagaaatgctttcattgtgtcccataagtttgggtatgttgtggcttcattttctttaaactctaaaaagtctttaatttctttctttattccttccttgacctaggtatcattgagaagagtgttgtttagttttcacatgaacgttggctttccattatttatgttgttattgaagatcagccttagtccatggtggtctgataggatgcatgggacaatttcaatatttttgtatctgttgaggcctgttttgtgaccaattatatggtcaattttggagaaggtcccgtgaggtgctgagaagaaggtatattcttttgttttaggataaaatgttctgtagatatctgttagatccatttgttttataacttctgttagtttcactgtgtccctgtttagtttctgtttccattatctgtccattgatgaaagtggtgtgttgaagtctcccactattattgtgtgaggtgcaatatgtactttgagctttactaaagtgtccttaatgaatgtggctgcccttgcatttggagcatagatattcagaattgacagttcctcttaaaggattttacctgtgatgagtatgaagtgtccctccttgtcttttttgataactttgggttggaagttgattttattcaatattagaatggctactccagcttgtttcttcagaccatttgcttggaaagttgttttccagccttttactctgaggtagtgtctgtcttttttcctgagatgggtttcctgtaagcagcagaatgttgggtcctgtttgtgtagccagtctgttagtctatgtctttttattggggaattgagtccattgatattaagagatattaaggaaaagtaattgttgcttccttttatttttgttgttaaagttggcattctgttcttgtggctgtcttctttttggtttgttgagggattactttcttgctttttctagggcgtgatttccatccttgtattggtttttttctgttattatcctttgaaaggctggattcgtggaaagataatgtgtgaatttggttttgtcatggaatactttggtttctccatctatggtaattgagagtttggccaggtatagtagcctgggcttgcatttgtgttctcttagtgtctgtatgatatctgtccaggctcttctggctttcatagtctctggtgaaaagtctggtgtaattctgataggcctgccttcatatgttacttgacctttctccattactgcttttaatattctatctttatttagtgcagttgttgttctgattattatgtgtcaggaggaatttcttttctggtccagtctatttggagttctgtaggcttcttgtatgatcatgggcatctctttctttaggtttgggaagttttcttctataattttgttgaagatattaactggccctttaagttgaaaatcttcattctcatcaactcctattatccgtaggtttggtcttctcattgtgtcctatatttcctggatgttttgagttaggatccttttgcgttttgtattttctttgattgttgtgccgatgttctctatggaatcttctgcacctgagattctctcttccatctcttgtattctgttgctgatgctcgcatctatggttccagatttctttcctagggcttctatctccagtgttgcctccttttgggttttctttattgtgtctacttccctttttaggtctactatgttttttttttatttccatcacctgtttggatgtgttttcttgtttttctttaaggacttctacctgtttggttgtgttttcctgttttttttttaaggacttgtaactttctagcagtgttctcctgtatttctttaagtgagttattaaagtccttcttgatgtcctatactgtcatcatgagatatgcttttaaatctgggtctagcttttcggttgtgttggggtgcccaggactaggtggggtgggagtgctgcgttctgatgatggtgagtggtcttgatttctgttagtaggattcttacgtttgccttctccatctggtattctctggagctagttgttatagttgtctctggttagtgcttgttcctcaggtgattatgttagcctctatcaacagacctgggagactatctctatccttagtttcagtggtcagagtattctctgcaggcaagctctcctcttgcagggatggtgcccagatatctggtgttcgaacctgcctcctggcagaagttgtgttccactcaccagaggtcttaagattccatggagggtcctgtgaggaccttgggggtgtccagaaattccgcacacaaggaactctgctgctggagtgaaccggaagggacttgtgcccctgatcaggccgggttatctgcttccttaattaatgcagtctaaggtcccatgcgattggattggaccagacattgtgttccactcaccagaggtcttaggatcccgtggggaatcctgtgtggttcctttcgggtgtccagagactcccagggcaaggcactccggtgctggagtggaccagaaggcaaggatctttttgaaaatgttactgtaagggaaatggtgacccaggcatgagtactttttaatgctctttaagtgactctaatgtataacaaaagatgagaccctttgaaaaacatactgctgtctctgtagttcttgctgcttcactccatattctgactgcatggctcctcctaacattccaagacttatctttcatttcccttgctcaaatccttcaagctgtaattgctgaatctctacaacccaaaatacttattctttattttacatattctttgttccccaattcatcatgacctgcttttctcatttccttttctgggtattgtttagtaattctctctctctctctctctctctctctctctctctctctctctctttctctctctgtggtgtatgtgtgtgtgtgtgtgtgtttctatctctgtgtgtgtgtctgtccttgtctctgtctctgtctccatctccatctctctatttgtctctctcttgtttttctttcttatttgtttatatatttatttatttagagtcagggactctctttgtagctcttactgtcttagaacttgctatgtagaccacgctggcctcaaagcacagagatgtgcctgcctctgccacccatgttctgccactatgcctgggtttagttattttcttaagtgatttccttataagttacagttagtagctttgagtgcttcttggatgtatagaacatattgattcattttagtcatcaaatattggtaggtcagtctttcagctactgtgttgattttttactggaaggaaagggtgtgattccaattcagcagaaaccaaggtaatatgcaaatgtaacttcttactaggtctgcctggtcattgagctattgtacttcctgagctaggcctaggaaatgtgagaagtgtgaacgcaggaagaaatccaagttggtcaccaaactgggctggctgcacaatcaactcaaactgggcctactgggaatgtgggtgtggcacaggggggtgggaatccagggcactcatggctgaactactgcacaaactgcaaggccagagctaaacataagagtctggaaatggtgctaacaagcaaggatctaaggaatttattaggctaggccaatgtatatgctaggtagatggagctaggtctgggaatgtaagagtggaaagttgatagttataatttcttttaggatgactggtgcttagtggagtaacagaattacttactgtgacatttttgatggtatctcttctttactttgctcaaagtttgtatataattttttataaatatatccatccattttgtcttagtcaaggtttctattcctgaacaaacatcaggaccaagacaaaagttggggaggaaaggatttattcaacttatactcccacattgctgttcatcactgaaggaagtcaggactggaactcaagcaggtcaggaagcaggagctgatgcaaaggccatggagggatgttacttactggcttgcttcccctgccttgctcagcttgctttctttctttctttctttctttctttctttctttctttctttctttctttttttttttttttttttgcaattgacttaactttactcatatatgccatttctagccttttgatctcttacataattgttatttttttaggtattttcttcatttacgtttccaatgctatcccaaaagccccccataccctcccccacccactcccctacctacccactcccacttcttggccctggcattcccctataccgaggcatataaagtttgcatgaccaatgtgcctctctttccactgatggccgactaggcaatcttctgatacatatacagctagagacacaagctccggggggtactggttagttcatattgttgttccacctatagggttgcagatccctttagctccttgggtactttctctatctcctccattgggggccctgtgatccatccaatagctaactgtgagcatccacttctgtgtttgctaggccccggcatagtctcacaagagacaactatatcagggtcctttcagcttgctttcttattagaacccaagactaccagcccagggatggcaccatccacaaggggacctcccaccttgaccactaattgagaaaatgccttacagctgaatctcatggaagcatttcctcaactgaagctcctttctctgtgataactccagcttgtgacaagttgacatacaaaaccagccagtacaattgaacctttgacaatttgacacacaaacacatcactattaggccttgacccttactttcttattcatcccaaagatctaaataactttaaaagtcccacattctttgcaaatatttacatgttaaaatttcaatccttttaaaatatccagtctcttttaaagtccaaagtctttttttacaattaaaattctcttaactttcttccttcaagagggaaagatatcaggacacagtcacaatcaaaagcaaaatcaaactccaaccgtccaatgtctgagatccactcacaatcttctatgctcctccaggggtcacttctccagccctgtcctttgtagcacactgcttgtcttctaggctccagcggactgtactccactgctactgctgttcttggtggtcatctcatagtactggcatctccaaaacactgcaactaggcttcaccaataacgtctcataggctatcttcacagtgccaaacctcaattcctttgcatgaccccttcttatcctgagccatcaattgcacctgaggctgcaccttcatcaatggccttccatggccactcacagtgcagagcatcagctgctctccatgaccccttcatgccttcaaaaccagtaaacctgggtgactcttacatattaccaagtcctgctgcagcatgaggtacaaccttggctatctttgtaacacagcttctttgtgatctcagaaaacacttcccagaagatttcacctcaatgaggctagtctcttcttaatcaccactaatttcttagtttcagctaaccagcatcaattgtcacagtaatgcaaagatttcgctttagtaattctggtatcttgttgatcacagctgattcttcagccccagctaaccaaaaccacagaatcttcacaatcaaaatagcaacagccctgattatgagtctttaatcttccctctgaaatttcacaagccaagcctccatcttctccactgttctcaacattatcttccaagctcctacagaacatacctcagaactctgaacatcccaacggctcttctagctcaaagttccaaagtacttccacagttggtaccaatttgtcttagtcagggtttctattcctgcacaaacatcatgaccaagaagcaagttgaggaggaaaggattattcatcttacatttccacattgctggtcatcaccagggtaagtcaggactggaactcaagcaggtcaggaagccggagctgatgcagaggccatggagggatgtcacttactggcttgcctcccctaccttgctcagcttgctttcttatagaacccaagactaccagcctagggatggcaccacccaccatagaccctccccacttgatcactaattgagaaaatgccttacagctggatcacatggaggcatttcctcaactgaagctcctttctctgtgataacttcagcctatgtcaagttgacacacaaaaccagccagtatacatttaaacatcatatttgcctagttttgtataaaacatagatattgataccttttaaaatgtatatgctaatatgggaaactgtattttgtagataaaatctgcctattcattaaaatgttgtcctattctcttagaccttgttttatacttgccaataactttgttacatgagtagtagtcctttttttttgttaaatttattactaagaatctttacatgatgttcctatgaactagatgttttcatgtaaatttctaaatgacggtgattaagttcttgtattttgtcacctcatcaaaatttcttgtatttataacatatttttgtaagttttataagtatattgtgtgtatataaatataatttttgcttctgtccagatgttcataatagttttatgtgcttctcaatatattattcagaatttaaaagttgaacaccagtacttatagtaccatctttacatttttcttggattttaatgtctatcaatataatgtttcataaattattagatttattattaattagggataataaattttgtatggaattattttttattagatttttctttatttagtttacaaatgttatcccctttcctggtttcccctccgaaaaccctctaccctctccctcctacccctgcacacccacccacccacccactctcacttcctggccatggcatttcccttcactgaggcatagagctttcataagaccaagagcctctcctctgtatggaattattttacttcctttataattttacttagatcttttaagtaaataaatgctaaatgttaatatttccttgagaattcatgacggttttttttccattttttattaggtatttagctcatttacatttccaatgctataccaaaagtcccccatacccacccacccccactcccttacccacccactccccctttttgaccctggcgttcccctgtactggggcatataaagtttgcgtgtccaatggtcctctctttccagtgatagccaactaggccatcttttgatacatatgcagctagagtcaagagctccggggtactggttagttcataatgttgttccacctatagggttgcagatccctttagctccttgggttctttctctagctcctccattgggagccctgtgatccatccattagctgactgtgagcatccacttctgtgtttgctaggccctggcatagtctcacaagagacagctacatctgggtcctttcgataaaatcttgctagtgtatgcaatggtgtcagagtttagaggctgattatggggtggatccctggatatggcagtctctacatggtccatcctttcacctcagctccaaactttgtctctgtaactccttccaagggtgttttgttcccacttctaaggaggggcatagtgtccacacttcactcttcatttttcttgagtttcatgtgtttagcaaattgtatcttatatcttgggtatcctaggtttggggctaatatccacttatcagtgagtacatattgtgtgagttcctttgtgaatgtgttacttcactcaggatgctgccctccaggtccatccatttggctagggatttcataaattcattctttttaatagctgagtagtactccattgtgtagatgtaccacattttctgtatccattcctctgttgaggggcatctgggttctttccagcttctggctattataaataaggctgctacgaacatagtggagcatgtgtccttcttaccagttggggcatcttctggatatatgcccaggagaggtattgctggatcctccggtagtactatgtccaattttctgaggaaccgccagactgatttccagagtggttgtacaagcctgcaatcccaccaacaatggaggagtgttcctctttctccacatcctcgccagcatctgctgtcatgacggttcttatgattaaagttaatatatagtttttatttagattaattaggtttaattagatctagattatttatattaggtttgtataataaggtattctagctctagagaattagtttgaaagagctcatcctttttgtaatctgaatattctttttttaaatattcttaatattaagaaagctaggtgtatttttaagttctatatacagctataaaatcatttgcgctgagtggcttttaataggtagatatttcagactattttaatataactattgttcaaattttctatctctcagaggtttaattttggtagtttatatgtgaggaaatgctatcatttgaatttttttcagttcttttaacaaaattggataaaagtggattagcaaaagggagctattatcttgaatgccttaaagtacagaagttgagagagaatcatgagagctagttcaatgacccaaagtcatcataaatgccctaattatgccatctttaccaaatacgctgcatcacttattggctttcttcacataatggccactaaagtctttggtatcacatgcaaatgacaacacaagaaaataagcccttcagcacatcgaattggccagaattacgtcaatttcccaaatacagctttgtccctctcgaaagaaacaaataattaagactctgtctatggtgaggatttacttctttcataagagtatggctttatagtgggggtatttatataaacaaaaacaagattctaccaacaaagcatttccccatctctatccctaccactgttatgtaatatttccatgcatatttactgaggacttactatgtatcagcttctgagaataggaatgtaaacaggatatataaagttattgttcatattgcatttgtatttggaaagaaagagctaagtgcttaactagtaaataaacaatatatggtcaatacaagaagtttctccaatgaggagaccaagagatgctttgatctattgctatgaatatgtcagtaggagtgatttattgctatgttcctttagcagaataatagtgctaggttttccattagggcccatgacctatgtagcctcaagtccttattcactctaactgtgtttgagatgggtttcatccatggagtagacttcaaatctaatgaaaagtgatttgttactgcaatagcattaagaaacagactgttaattccaaataaggaaacaattgaacagagaaaaacatgctgactaacatcaaatatttccaggcaatctgtggaagaaagaaatggctttttggacattgctctagagggagcaagtgctggggactgaaagttatagacatgtgatttcagctgaacataggaaatcatgtgcacaaattggcaccatacaggtgacaaaaagagagaaaacgtagtttcctatcactacaggtgctcataaccagagtcatcaaaaaggatattgtcacaggaaccttttcatttggctgggacatattatagattgcctgtagaatatttttgcagaagagttgtcatatgaacttgacagataaagactattgttactactttagtatttaggaagttcaaactgagaatggtgactcatgtctataattccagcattctagaggctaaggcagaaccatgagttaaaggccaacctgggctgcataggaagttcctgtctcaaaaatccaaggataaattaaaccaaataaagctggaaattgagcaaaatggtagttggaaaagtgccaaaatactctgacaatcaacacacaccacaaccttcctctgactacttcacaaaaaagctttgttccatgaaatttgcactatgtacacatcatgtggtatttgacatatagtaaaattcattaattgtcaggtattcatactttaaatgtcaaaatttttatcaggttaaatgtcttcgcatcagaatgtcaatgaaggcttgtactattggacacttagcatggataatagtaagaggtcactgagttccaatagtaatgtacaagtccatctggcacatagcctaagcaatgtgtggaaaccagattcctctgatgaggctaatattttagttaggtgggaagccagactattgtgtacacacacacacacacacacacacacacacacacacacacacaaagccctgtgctaggcagagatctgagctgggatttggcaagtcaactttagactctggccttctgcccagtccatcgatttagctccttaagtcacatgatttaatcccacaaatgtcacagataaccattagacaaactcctctggacagcatcaaaggaaagagggaacatgataagccctctgagacagcttgttagagaatacttaatcttttgtgttgggggactcctctcgtaatggggcttactggcaaaatggcatgaaacacaggctggctttgttttctttactgaagaacagatctcagcatttgccttaaattaatgaagtgcaatctggcaagtgtaaaggtaaagagcaacgggaaggaatctttctgataacagatcctcaagagatcccagtcactccctctatcagatccttattccctgaataatagggaagcaagactagtagcaagcatatgaaaaggagactgggtctttaccattactgaggtaaaggctgtgagggttaaggggctccaactgtaggctctaaaagagttcaaagaatgtcacaagtcattaaacatctacaaaagtctgcaaaccaacagatagcacaggaaagagaactttgtctcattctcagcacagtgtaggcatggttctacatacaagaggctcccatggctggacacaaggcctcttctttttccctttattgcatcttcgctgtccttctaatcaaacaaattctttatttacaagataataacactcttaatgatggacttcatgtaaagctattactagattttagccatttgattcactattcattccaatggctgttttggagatctagtggcaaaagaacagctctgtaatatcacaatctcaagcaaaactctggaggaaagtttttcaacataaggattctatgaggactctcctaacacagcatactaaataaaacacagaagattggtttgaatgtaaaagacaagatgcaaaggtagactatggtttgcctatatatccaccaattatgtgtgcttcaagcctgttattatcatgaatgtagtgtcatctcctttcatgattttaactcatgtatctagtatctggcacatagtgaaaatgtaatgaatgacgctgcttgctgcatctactactattagaagcagtcagagtaatggtgcggccccagctcctggcacggtgcccagaaaacattaactattatgaactagaacaattatttttatatctttattgtcccatctcctagcataatatctggcacataataggtaactacatgtgtctgcttccttcctttccacgtttcccagagatacatgtcaattctgtttcccctatgatggtacttaggtaagatggtcatagatgtcccttacaatgctaagcccaacacagtaaggggagactaccagtcttttcttctattgtggcctctgaagaggcaagtggaaaatgtttaagatcattacacagttggaaagactaaccacacctctaattcttcgattgtaatgtagctaaaaggaacagccttccctgtgtccctccctcaccaatctttcagccaagtcatgatcaatgtcgccacttaggttctatgtcccattatagaagaatgccagggtcaggaagtaagagtgagtgggttggtgaacgggggagagggaaggggacaggagattttcagaggggaaaccaggaaaggagataacgtttgaaatgtaaagagagaaaatatctaataaaaaaagaaaagaggaaaaaagaaagaaatatatatatatcaaaagataatatatcatatatatgatatatatgaatgccatatatgaatttaaatgacaaagtacttgaaaagttttaaatgcccaagctatcctcagaagtcttcattatcacactaacatgagaaactggatattctgtgcatcctactaaaactgatatatcacagaaataaatctgaagtcttttttgcatatatttttattagatattttctttatttacatttcaaatgctttcccgaaatttccttataccctctgcccgtcctgctcccctacctacccactcccgcttcttggccctggtgttcccctgtactggggcacataaagtttgcaagaccaaggggtctctcttacctatgatggccgactagcccatcttctgcgacatatgcagctagagacacgagctctgggggtactggttagttcatattgtggttccacctatagggttgcagaccccttcagcttcttgagtaatttctctagctcctccattggggtccctgtgttccatcctatagatgacttgtgagcatccacttctgtatttgccaggcactggcatagaatcaaacaagagagctctatcagggtcctttcagcaaaatcttgctggcatatgcaatagtgtctgggtttggtgctgattatgggatggatcctcaggtgggatagtctctggaaggtccatcctttcatctcagctacaaactttttctctgtaactccttccatagttattttgttcccgattctaagaaggaatgatgtatccacacattggtcttccttcttgattttcttgtgtttagcaaattgtatcttgggtattctaagtttctgggataatatccacttatcagtgagtgcatatctagtgacttcttttgtgattgggttgcctcattaaggatgatatcctccagatatatccatttgtccaagaatttcataaattcattgtttttaatagctgagtagtactcccttgtgtaaaatgtaccacattttctgtatccattcctctgttgagggacatctaggttctttccagcttctggctattataaataaggctgctatgaacatagtggagcatgtgtccttattaccagttggaacatcttctgggtatatgcccaggagagttattgctggatcttcctatagtactatgtccaattttctgaggaacctccagactgacttccattgtggttgtacaagcttgcaatcccaccaacaatggaggagtgttcctctttctccacatcctcgccagcatctgctgtcacctgaatttttgatcttagccattctgactggggtgaggtggaatctcaaggttgttttgatttgcatttccctgatgattaaggatgttgaacattttttcaggtgcttctcagccattcggtattcctcaggtgagaattctttgtttagctctgtaccccatttttaatggggttatttgaatttctggagtccaggttcttgagctctttgtatatattggatattcgtcccctatctgatttaggattggtaaaaatgctttcccaatctgttggtggcctttttgtcttattgacagtgtcttttgccttacagaagctttgcaattttatgaggtcccatttgtcaattcttgatattacagcacaagccattgctattctgctcaggaatttttcccctgtgcccataccttcgaggctttcccccaatttcccctctataaatttcagtgtctctggttttatgtggagttttttttttttttttttgatccacttagactgcaagtttgtacaaggagataagaatggatcaattcacattcttctacataataaccgccagtcgtgccagcaccatttgttgaaaatgctgtcttttttccactggatagttttagctcccttgtcaaagatcaagtgaccataggtgtgtggattcatttctgggtcttcaattctattccattgatctacctgtctgtcactgtactagtaccatgcagtttttaatcacaattgctctgtaatacagcttgagatcaggcatggtgaatccactagaggttcttttattgttgagaatagattttgctatcctatgtttttttttgttattctagatgtatttgcaaattgccctttctaactcagtgaagaattgagttgggattttgatggggattgcattgaatcagtagattgctttgggcagtatagccattgtgactatattaattctgccaatccatgagcatgggagacctttccatcttctgagatcttcttcaatttctttcttcagagacttgaagttcttatcatacagatatttcacttccttagttagagtcacaccaaggtattttatattatttgtgactattgtgaatgttgttgtttccctaatttctttttcagcccatttatcctttgtgtagagaaaggccattgatttgtgtgagttaattttatatccagctactgcactgaagctgtttatcaggtttaggagttctctgttggaatttttagggtcacttatatatactatcatatcatctgcaaatagtgatagtttgagttcttcctttccaatttgtttccccttgatctcctttagttgtagaattgctctggctagaacttcaagtactatattgaataggtagggagaaagtgggcagccttgtctagtccctgattttagtgggactgtttcaagtttctctccatttagtttaatgttggctactggtttgctatagattgcttttattatgtttaggtatgggccttgaattcctgatctttccaagacttttatcatgaaggcatgttgaattttgtcaaaagctttctcagcatctaatgagatgatcatgtggtttttgtcattgagtttgtttatatagtgaattacgttgatggatttttgtatattaaaccatccttgcatccctgggatgaagcctacttggtcaggatggatgatcattttgatgcgttcttggattgggtttgtgaggattttattgaatatttttgcatcaatattcataagagaaattggtcagaagttctctttctttgtaggatctttgtgtggttcagttatcagagaaattgtggcttaatagaatgaattgggtagagtaccttctgtttctattttgtggaatagtttgaggagagttggaatttggtcttctttgaaggtctgatcgaactctgcactaaaaccatctggtcctgggctttttttttttttttttttttttggttgggagactattgatgacttcttctatttctttagggaaaatgggactgtttagattattaacctgatcctgatttaactttggtacctggtatctgtctaggaagttgttcatttcatccaagttttccagttttgttgagtatagccttttgtagtaggatctgctgatattttggatttcctcaggttctattgttacgtctcctttttaatttctgattttgttaattagaataccatccctgaactgcaaccctataggtggaacaacaatatgaactaaccagtacctggagctcttgtctctagctgcatatgtatcaaaagatggcctagtcagccatcactggagagagaggcccattggacttgcaaactttatatgccccagtacaggggaacgccagggccaaaagtggggagtgggtgggtaggggagtggggggggtgggtatgggggacttttgggatagcattggaaatgtaaatgaggaaaatacctaataaaaaaaaaaggataccgtccctgtgccctctagttagtctggctaagggtttatctatcttgttgatttcctcaaagaaccagctcctgatttggttgattctttgaatagttctttttgtttccacttggatgattttaaccctgagtttgattatttcctgctgtctgctcctcttgagtgaatttgcttcctttatttctagaggttctaagtgtgctgttagtccgctaatgtatgctctctctttttggaggcactcagggctgagttttcctcttaggcctgccttcatggtgtcccataagtttgggtatgttgtggcttcattttcattaaactctaaaatgtctttaatttctttctttatttcatccttgaccaaggaatcgttgagtagagtgttgttcagtttccacgtgaatgttggctttctatcatttatgttcttattgaagatcagccttagtccaaggtgatcagataggatgcatgggaaattttcaatatttttgtatctgtggaggcctgttttgtgactgattatatggtcaattttggagtaggtatcatgtggtgctgagaagaaggtatatacttttgttttaggataaattggtctgtagatatctattaaatccatttgtttcataacttctgttagtgtccatgtgtctctgtttattttctgtttccaggatctgtccattggtgagagtggggtgttgaagtctcccactattattgtgtgaggtgcaatgtgtgctttgagctttactaaagtgtctttaatgagtgtggctgcccttgcatttggagcatagatattcagaattgagagttcatcttggtagattttacctttcatgagtatgaagtgcccctctttgtctttttttataactttgggttggaagtcaattttattcgatattagaatggctactcctgcttgtttcttcagactatttgcttggaaaattgttttccagcttttcactctgaggtagcgtctgtccttttccctgaggtgggtttcttgtaagcaacaaaatgttgggtcctgtttgtgtagccagtttattaatctatgtctttttattggggaattgagtccgttgatgttaagagaaattaaagaaattaattaattgttgcttcctgttatttttgttgttaaagttggcattctgttcttgcagatgtcttcttttaggtttgttgaaggattactttcttgctttttctagggtgtagtttctgtccttgtgttggtgttttccctttattattgtttgaaggcctggattattggaaagatattgtgtgaatttggttttatcatggaatactttggtttctccatctatggtaattgagagttttgctggatatagtagcctgggctggcatatgttttctcttagggtctgtataatatctgttcaggatcttctggctttcatagtctctggtgagaagtctggtgtaattctaataggtttatctttatatgttacttgacctttttctcttactgcttttaatattctatctttatttagtgcatttgttgttctgattattatgtgtcgggaggaatttcttttctggtccattctatttggagttctgtaggcttcttgtatgttcatgggcatctctttctttaggtttgggaagttttcttctatgattttgttgaagatatttattggccctttaagttgaaaaccttcattctcatctactcctattatccgtaggtttggtcttcttattgtgtcctggatttcctggatgttttgaattaggatctttttgcattttctttgattgttgtgccgatattctctatggaatcttctgcacctgagattccctcttccatctcttgtattctgttgctgatgctcgcatctatggttcctgatttctttcctaggatttctatctccagagttgtctcgctttgggttttctttattctttctacttccctttttaggttttggatggttttgttcaattccatcacctgtttggttgtgttttcctgtaattctttaaggggttttgtgtttcctctttaaggacttctacctgtttagcagtgttttcctgtatttttcaagtgagttattagtgcccttcttaaagtcctctaccagcatcatgagatatgattttaaatccaaatcttgcttttcaggtgtgttggggtatccaggactgggcgaggtgggagtgccgctttcggatgatactgagtggtcttggtttctgttagattcttacctttgcctttcgccatctggtaatctctggagttagttgttatagttgtctctggctggagctttttcctcctgtgattctgttagcttctgagagcagtccggggagtacagctctctcctgagtctcagtggtcagaatactctctgcaggcaagctctcctcttgcagagaaggtgcacagagttctggagttcagacctgcctcctggctgaagatgaaggcctgaaacatggcctgtcccaaaagatgagttatctctgcagtttgcacagtcacttgaatagactggtctctgagggatctgggacaaaagatggctctctcacctgcttaggtggtcagagccctctcaggtggccacttctcctctggcagggaaggtgcccagatgtctggagcccaacacagggcctgtcccagaagctgtgtagcttctgcagtctgcactctcacctgtgtagactggtctttgagggccccagtacaccagatggctccctcacctgctccagcagacagagccctcccaaatctgaagtcttatgttaaaaaaagtcttccctcagaggcccctaggtcttgcaaactttatatgccccagtacaggggaaccccagggccaagaagtgggagtgggtgggtaggggatcagggggggtatagggaacatttaggatagcatttgaaatgtaaataaagaaaatatctaataaaaaaagtttaaaacttaaaaaagtcttccctctaaagggcagaatggccctcacatttgtatatttaactggccctctgaagattacctcaatagttgctccctgaaaccttttctgaggcctccagtccttgttgagtcctttctgagatcacaaagtatcaaattagtgccacccacttaatatttgattctgctatcacccaattgattttgcttcttaaacgttcagaactactacctgccatgttctagacctgtgtgagttctgggaatacagagatctatgttctgctaccctagtcatatgaagacaaaaaaaatattcagtcagtgttacttactaaagaaatgtgatctaagtaccatcagagaacaggaagactggctgaactccggagggcatttggtaaatatttgcaccaaacagaacttgtggtttaggagatattgaaaaatgagaagttgtttaagcagagaggatagggtgatatccagatacaaagaacttgtcagaaaaggacaagtcggaacatagctcaatgtggctagaactcgagatgggatgaaaagaggtaagggaatactggggatggttgtctcctttactcattgaatatggatctagtgtccaagttgtgtcagtcaatgaacagtgctgggcaccagaaaacaggacctgggacaattcctgtaattgagctttaaggctatttggaaggaacaattagccaataagacaaataagtattaagtagaaattttggtaagcatcaaagaggaagaagacaggaccataaagagaagaatatgaagggactaatttgggcaactctgaggatgatatttatgtaagaactaaaaaaaatggaaagagatgggtaaaggtcaaaggtcttggagtcagaaaatcttggcaacacagaagaattgaaggaaatatcagggagttaaagatttgtggctaggatgagtttaagctaaggtcaggaaagtgaacaggagccaagagcttgcaagcctcctaaagattccattaaaagaatagcaggaggggctggagagatagctcagcaagtaagtgcttgccagacaagcatgtgtttagatcccctggtaccctgatttaaaaaaaaaaaaaaggctgagcatgagagtccacatgtataacctgagcactggggaagcaaagacaagaggatccctagaatttgctggagggaaactctagtcaaaagataaaggagaatagccacagagcaagatatctgccattaatcttgggctatgatacatacacaacacacacacacacacacacacacacacacacacacaccaatcatggaatataagcagaatggaatcaggaagtggtgctttatagaatgacatagatgcacactagaagtcagggggaaagaatggagtcaggtttattagtaagtccaacatgtggcagtagtggaggccatcttctccccctcccctgcccccacaccatcactacagcggctaccagaatgctggatgcactggaattgctcagtgcatttccgataagtaagttattatagcaaaagcccaagagctcttgagtctctcttcaggggctcacactcttcttccctcccacttcctgttgacaacatcgaggcagagaggcagcctaaagctagtattatcaaggtcatatgctgttcagtggcaagtgcttcctctaagtgccgacttcctttagactctgtcaagttcgttcaaagtggctgctctagtgtgcttcctgttgctgtgataaacactgtgactaacaagaacttggggaagaagaggttgatttgttttacactccctcaccgctgtctatcagacagggcaggaactcgagcagatgcagaagccagacgatggaagaaggtgcttattggcttgctccccagagtatgctcagctacctttttgtttttgttcttgtttttgttttgttctgttttgttgtttttcaagacaggatttctctgtgtagccctggctacagcgacctcactcagaactctgaactcactctgtagaccagactggcctcaaactcagagatctgcctgcctctgcttcacgagtgctgggattaaaggcgtgccctgatgtagctactttatacttatgtagcctggcccaactccctagagacagcatcattcgcagtgaactgtgctttcctccatcaactagtaatcaagccaatctgatgggatgcgattccttgcttaaggtgctctccttctccaggtgacttgagtatgtatccaattaacaaaaagtaaccagcacagtaatgaaacgcatcagagtttctctagggagtcaaatatcaccctgttctcctgattgctggacaaagaaagaaatgcattatttgggcaaaaggcagccaacagttatcttcaaatgctaactgccccaaagagcacaaggatatgaattgcaaatgctacttgctataatatatgcttcttgccctgccaaagtagagatgtaattacctgaaaaactgaggtaaatgtggacgttccatacctttgcttacatccaagagatgagacacagagctctttatcacacttccattccctgctagtagtaaaatgaaaagtattaaaatgaggccatcgtaactctagagaggcccagagaactcagggacaggagagaacagctgatcactctgctagtagatctaagtctcattttctcccgtgaagaggatcatcacccccatctcacagggacagtacaaggcgtcagtgaggaatgtgagtgaatttgatctgtaaattgtagaggaagtgctctaccctgtgatggcttctgtatggttatagacaagtgtaattttattttcttggtcatccccgagaaaatttaaacacactgcaggtgttcagtaaaaaacaaacaaacaaacaaacaaacaaacaaacaaactatgtcattttcgctttacagtcagttctgttaagtgtgatgtgaccttcggtttggcaccaacaaaacaggccatttgttcctcagaattaaatcaaactgattctccaatctcttagcttcagagtttggagtcgtggcagaaagaaaccaggggtaagtttaggaagggagtctagccttatcatttgcagatagctttggcctgttaagtcagtacttcttcaatgagcatcatcaaagaacagagctggacttaacactaaaccacatatatttttattttttttccctttttgtctttttttttaaaaaacatggtctcataaatcctaggccagctgtgaacccgctttgtgaccaagggtgaccttgaacttctggttttccttcctctgccttctgagagccgagattatggctgtatgctaccagctctattgcatgtggagctagggaatcaaacatgggctctggggtgagcggagaagcattctcctcacggagctgtattctcagctcctaaaacagtactttggtctggaatgtgtatctggaacagagagaaatgaaatcttgaaaattagattacaaaaagatgcacagacccagcgatcaaaagaaactggccctatgtcaggatgaaggtagtgccactgaccaaaagtagtaccacaaatattttcagcagtgaaaggaaaaggacaatctaatgtgtactatatcttaggggtggtgatcctgtgtaactcctttaactatcagagtagcttttcagggtaggaattattctctagcacaagacttggtaagcagtgtctagacaataactgctaatgatattaatatggataaccttaggaactaatgcagtagaggcttagactaacttgtccaagatcacagagatggtaagtgttagtttgagcccaagtctatctgatcaaagttgggattttgctactctcttccttggcaacagggtcacattgatgtcatttaaacacttttgggattttgaaatgccactaaaaagggattaataagtggtcatttgaaagcttcatgtaactaaaacttctctctctctctctctctctcactcgctctccccccccccacttagttttctaaattgttatgaaccatggcccagctgtactacaagaaggtcaattactcaccatacagagatcgcatccccctccaaatcgtgagggctgagactgagctgtctgctgaggagaaagccttccttagtgctgtggagaagggggactatgccacagtgaagcaggcactgcaggaggccgagatctactacaatgtcaacatcaactgcatggatcctttgggcaggagcgccctgctcattgccattgagaatgagaacttggagatcatggagctactgctgaaccacagtgtgtatgtgggcgatgcattactctacgccatccgcaaggaggtggtaggagctgtggaacttctgcttagctacaggaagcccagtggagagaagcaggtaagagaactccctagtgctggaaatagctagaaatcagagtgtcagagtccaaaggacaaaggtttggcagtctgaaacggagaagccctatcttagaaactgtaatcagttgtctcctgagctatcccaggagctgccctgtgtggcccctgctgttttatttctttgctttgtctttttgtccttagttactcatacatattcaatacttagcagtgcaaagtcacattcatgtctagaatatgtaaactctttccactttctttaccaccccctctacatcttcattttctttctttactcagacattacattctagaaaagagaccaagcacagacctgtgctttctcttgagaggcttttcttccacagacaagaagactttaaatttgagtgccacggtagagacacaaataaaagccttgcatatttttctagtacaaggtatatgactgaatcttactcataagcatttgggagtttatgtctttaagtctcatatcctcaagtcaccgaaatttgatatctttttagtcatctttgatgtcagagtcaaatcttgttccccatgttcaatccctaggccccgtggtttccccattcctcgttctttcccttctaacccaattcccactcctactgcctgctctgtcatcacactcataagtaaggggttctcaaagtgtggcagcgagactggtggcagcagcatttcctgagaacttatgcaaaatgcaaagccttagaaccccacactacaagcagactgagtcatgagctctgagatgttccccaacaaactgtgccttaacaggtcctcgaggggattctaacgcaggctctattttgagagtcactgtcctccacgaccaggaacattttctcattagtctccctgcaccaattctttttgtgcctctgaagccttcctgagaaggcaggttagcttcttctttctacattaggataatgatctaattactcctgtccctgcttttaatgtctcaatgttgactttaccactggtgttatgagaaaatgcttgaagtgatgtactttataaagcaaagaaccttgtcttgctcatcatttctagaggctggatgtccaagataatgtggcttatctgataaacctttgatgagggcctcctagcttctgttatagccacggtgaagaaaacagaatgggaactggtcaaatatggaaggagattaattagcaacaatgcaaacattcaaccccaagtcttatgagacaaagccaaagctggagttcaggaagacccatccttcttcatactggttcatataagacataagcaatgaaaatgagctgacagcttgaaaagtcctggaattgacagaatggagagcagagtcggctagaactatcacatcaacaaaacttggaataacagaccaagttcccttccccatcagcattttccttacctccaaaaaattaaagatcccatcactcttgctccttgctatacaaaactacctggacaccatatttgataaatacttatttaatggatgagtaatatgtaaccattactgagctaagcatcttaacatgacttacttcatttaatcattcaggcattaatctgctagacattattatttagtagtagtagtaataatagtagtagtagtgtattccctgtttgccagtaagaaaaaaggagtattaaatcaattgtaaggatcacaataaatatcagagctggaattcaagctcctaagcttctttttagccactaggtcctgatcacacaattgaatgaggctattacaaagaatttggcaaccgaagctgcagagatggcatattaggaacatgtattgatcttgcaatgtggacctgagttcaattttcagcacccaaagttaggtgtgttataaccacctctaactcagttctaggatagtctgtgcctttttttttaatctccacaggtacctgcattcatatgaacatatacatagatgcataaacatacaaacacatataattaattaatacaactaatctttttaaaattagcaacagtaaaagacatttgaatgtacaacaatcaaaaaattgatttaaagtcaaacgtgcaaagaacctcaggtgtttgtggcagtgcttgctcatgatgtatctatcatgcaacttcattgcagccttggttctgaacaaatagtatggtccctttacattgcacatgctatgactctacacaatgtcagtgacacttctcagctcagatttgagactaatgactgatagattaatgacattgactttattttacataccaataattatgggattatagaagcataatggtgcaactatggaaaacaaagactcttaatatttttgctataattcctcagcatgttaaattagcatacctttggattggattgcattagaatgtttgatttttaaaagctgttcactgagttgttttctattaaaaaataaattggtgagttttagcttgagcttagcacagaatgtccaacaatttcttaaatagccctaaacatacttctgctatttcatagtatatggttttatatatagcagcattctcagcactgatgattctaaaactaaaatcttgttcactctgaaaaatgatcctgcagtatcgcatatcaaaaaaaaatcaaaagaagtatcaaatatgtagccaagatttaattctttgtataatataaacaagtacattcatatcattagtatgtaactttgatttcatctttaatgaggtagatctagcaattgttttaggctaaatttaatcatgatttagtgttagcaaatgtttaatatttgtaaacctctcttatatacttatatacctgggttagattaaaatttctttggtgaaagggggttctgagtggaaaacattttaaaagccatacactaggtcacactgcttccctggaaatcatagaatcctaacacaggaatggtgagatggatcaaatgaatagaaaatagatgcgctacctagtgacaggcctaagagatgtagcatagaatgtgagtttgtttcctactcagtccatcttagcaaacacatcaaaagtcatttgttctgtgtcacattctcagcattaagcaccatcctctaagttcctataccacactggatcagtcttcttccctttatttgaaactaatctcatggcaccttgcactagtggatggcctcacttgtaggagttcctagtccctttactatatggtataagcctaatgcccagttctttccatgctcatcctctgtgtactgaatcagtgtccacaagataagggatgatatataaatatttgccaaagatatgaaggagtgaaatatattttcaaaaaaaatcacaagacatttttccctggacaagacttttggggactgtgtaatcaatcacatttaccctcataactatttggaggaagaagagaacacaacacagtttcctagctgggtagtcagtattgagcaagtccatgtttgatggatcccatcttactcatctttctctgtactctagcagatgctggggatctgttcgtcaggaaggaagacaccatgttacacttacactaaagagcaggttaatgtgacctcaccttggcagaagtagaacttagctcatagaaacaaactattcttggtacaaaatcaggcaaatgcaaccttgataaggatacttataccagcctggattttgctaagacctattgtcagacactatcattataatccctttattgtcagtactccactatcatacaacaatgtatgttaaatagcacagagtcatcagctccatctctatccttttggtagctttagactctcttccccaagcacaactatgaacttccactaaatagtatcttccattgctgtgacagtcactatgataaatcatatgtcagtaactataacaccagactgtcccaatgaaagagtcctgtatttctttgaaatcaaaaccagatttgtttgctcaggaacaatcgggaatgtgaacaaacacaagccccctaaaggaccttgagttcagctgagcagacaaatttcaggaaggcacaccttctgcacacaatctgaagagcaaatctttttcacagagctaccaccacctggtcttcatcactctagaaaatgaggcacagctgacctcatttgggaagataaatcagggtcatcttcagcatttgtagaccagaacttaaggtccaggctgacagctgtgcctcatttaccccattctcatcatgttcctcctactactcatccatattaaaactactttacaataatgatcaagacccaggataaatggccattattggcttcaagagtcagcattcacatagacacctgaattttcaacaggaaccaaattttagaataagaatagtaatatattatcaagtagactattccatacccaaaaggcagaggaggagaaggaggaggaagagagagagagagagagagagagagagagagagagagagagagagagagagagagagagagagatccttttattgctccagattctgtttctttgaccaactttttacccactgcagactatttttttaggagtaaaattgggcaacttgaaggctttgtaatattgattgattgattgattacagataaacactcttagaatttatcaaggaattcaaaacttgggaacaagagaagacctgatgccagactacttcttgcctgttctacttactaccttctggccattggctttaggtatctgtaaatgagcctcgttcagtagggaaggcacattcagctataattcagagactcacatttaggtgaatgtgctaaaccaactctgaaccatttgtggtacatatagggaatgtgtcctgaggctcaatgcatgactataagatcaaaatcttggggctaaagccttaaccaacactttaacaacctcatctccaccagtttctaggtaagaggtccttatgcctctgtatttgttttctgtgttcctctttacaaattaccataaactgaatggcttaaggaaaaataaataaaatgtattatttcacagagtaagaggcaataagaaatgaaagtaatagtaagactgattccttttggagaggtgtctgataagatttgtaagttagctacaatccctcatgcttcttacatttatatcacttcggtctctacctctatagatgcaaagtgttctttctttggctttctttcctctgtttctgtccaaattgcttgcttccttaaatggataatcccatttttctgtaattgcatctacaaagactcttttcccaaataaagatcatactcaaggttagtacaacttgaacatatcatttggggtacacaattcatgctgtgtgagacatactgttccaagtcagtggcttccaaatgtttctagcaatagagccattcataagaacccactgagaatcaacctaaagagggcttccgtagtctatctgcaggttggacccagaacatatagattctctctcactcttgcttttccttgacctttgaggagttagcacaacttgaatgccacaggtgtagaggacagaaggtagagtgtaactccctgttcacagcactagccagttcagttccatcatctctaaaataccactaacagtgcctaacttctgcctaacccagaggtctgttttaaggtaaacttaagattaaaatatgtgaatgactttgggagatcactcaacgttagactgatgtcagtcctgatcattttctgatttgttccttcagttttcttgagatcgtcatagtgtgtgaagagaccagatggtcccgtggccctggtcacaaggcaccccaggtacagtatgtgggagggttggagagtgagctggcccaattcacagatcacctccctcctggctggatggcctagatgtcaacagtctgccttttgctactgaagaagctccataacctcaaaggcattcttcctttgtcagaagggtttaaagacttgaacaccgtgtaagtagagcttctggtcattgtatcaacagcctacccaagttagttggtcacttgcgtcactgcaggcatccagaaagtggctaagccaaccttttccctgtggcccacccctctgggctctgccataattattcatttgtctgtggcagatggctgcaaattaaaattgttctcacagatgagctacagagattaaatctcaccaacactgataagtgtttgtgttgaggttatagaaaatcagcaataggacactgtttggtttgggtttgttttttcttttttcttttttcttttttcttttttctttttctatctggctcttagtctcagggtgagattgtacagtatggaagagagacactgcataaaggttactgaaacacacagacaggaattaaagggactagtttatttattcaactcagtgagagtgatgagaacaaagagcttgtaaaaattaccctgctatttacaagtactctatactttggagtcagccacttattagttgtgtttacttagacaagccacttaatctctctagacctcagtgttttcatctgtgtctagagacaatgagggaatctagtttatagacttatagtaagagtggaaagaactatagatacattgatgtggaatggtccctggcctgtactaagcactcactaaaccaatagaactgttcttcctctgatgtcatctgctggttaatggcatctgttttctcaaatgaagctgggagagaactcaattagtaaagtatctcctgtgcaagcataaggacctgagttcagatctccaatactcatgggaaagctgcacttagggacatacatctggaaacccagcactgggtggaggcaaagagacaggtgaatccccaaagtttactgtgcagccttcctcatcaaaccctcatcaaatcaatgaactgctggtccaatgagatgcactgtctcaaaaattaggggaatacccaccaagtaacatacctaaagtcaacctcctgatttctatacatatgtacctatgtgaacaagttgtatacactactcacacatggagaaggggcacacatgcttgcacattaaatactcattgtacctaatggttaaaaattcaatttgagccccaatacaggggaacaccaggagtgagtgggtaggggaacaaggcggggggagggtataggggacttttgggatagcatttgaaatgtaaatgaagaaaatatctaatttaaaaattaaaaaaataaaaccgatagtaaaacaccaacataaaaaagaattcaatttgaggagctggtaagattgttcagcagttgagagcacttatagctcttacaggggacctgaatttggtccaacaatccacatcaggtaactcatagctgcctatcactccagcttctgtggccactctcttctggtctctataggtagtctacacatgtgcacaaccccccaacacacacacaaattgctcacactcacatgtacacttaaataaaaataaaatcttttggcctagtctgccatcattgggaagaaaggccccttggtcttgcaaacttaatatgtcccagtacaggggaatgccagggccaagaagtgggagtgggtgggtatgggagcagggcagggtgggggggggggtatagggaactttttgggataacatttgaaatgtaataaagaaaatatctaattaaaaaagaaaaaaaagaagagaaaatctttaaagaataagaatccaaattggtggctgattatgggatggatccccaggtggggtagttgctggatagtccatccttttgtcttacctccaaacttagtctctgtaactcctttcatgggtattttgttccctattctaaggaggaatgaagtatccacccattggtcttccctcttcttgattttcttgtgttttgcaaattgtatcttgggtgctctatgtttctgggctaatatccacttatcagtgagtgcatatctaatgacttcttttgtgattgggttacctcactaaggatgatatcctccagatggagaagctagggaaagcacccagggagctgaaggggtctgcaaccctataggtggaacaacaatatgaactaaccagtactgccagagctcgtatctctagctgcatatgtagcagaagatgacttagtcggccatcattgggaagagaggcctcttggtattgcaaactttatatgccccagtacaggggaatgccagggccaagaatcgggagtgggtgggtaggggagcaggatggagggagggtatagggaattttcgggatagcatttgaaatgtatataaagaaaatatctaataaaaaaatccaaattgggtgactttgggaaggtcatttacctcatttaagcatcaattcccttatctgtaacttgaggctaattaatagtcttacctatattgtaagttgtcttaaaatgtgagaatacctttggactgaggaagcagcctggtggtagaggagttatctaagtgatcattacattaagcctctgaagtaatttgaagaatgtaaaatttagttatgacagaatataatctttagtgtatgacagccttattatttgcatcaatacaaaatagttttatttgctaatttcctcataggtataataaattacctgaaagaaaaagcagctgaaggctgaaagactttattttgacttgctgtttggcacagtccctgaggacttgtaaatcagggagcatgtacacgtcacagctgctcacattgcatctgcactcaagaagcagagagggagagatgctgctgcttagcaggttttctctttgttttcagtccagaatttctggcaacggagtgatgctgtccacatttcgggtgggttttcccatgtcaattcatccagtctagaaactccttcatagacatgactaaagatttgcctcctctcatgattttagagcctgtcaactatagtcaatattaagcatctaataatattactatcccaattaatttcataacctgaatttcccagtgtcagagtataccatctatctgttgtgctttctaccaggagctggggtatatttgggttggagatttacttcaacattagaataacgaattttttgtctttttaattaatttaaataactgcccatttcattattgctttcattcccatgttattccttcaaccctctctatcatctctgacccaacagttcggtgtctagataccatattttagcacatttagaagcataactgagacaaaattaatgtataaaccctttatatatttgatgggtatagttttatggatctggacatatgcataatacgcaaatctatcacttctgaacagttcctattgcctcccctattttgtccatgtactgtttttatctcctgacttcctgacatgatgcctacccaactttacttcttttttgaccactgcctccagcatttttttttcttctacagaatcattatattttttccatgcattctggttccaactgataaaccaaaacaagattaagtaagtccaattcacaaaatgttctctgtgctgaggagtaggtcagctctgtgaagttctcagcaaaatgaggaaaacatgattagagggagcttcaatgcaggagggcttcctgtctcactttgatctcaagggattgttgtcacccatttattagtgaaaggggggctgtgagcttacggggagaaccttactttgtggagtcagttctttctttgggcagttctggaagctgaactcatgtccttcggcttgtaatttggggcaacaagcaccaaataatgagaatgaaaaagagaaaacagcactgagtggccttacacgtgagatggaggagacagtatcaaaagtcaaaggatagtcttcactacaaatgattttggaaacagcctgggctccacaagaccctgtctcaccccagcatggatgcagggatgtaggcacaatattccacccataggtgagtaactattgacattagattgccattttcttcaatggagtaacaactggcatgtcaaccaaattccagggcaggccccatgcccaggagtaatctgccttacaaactggactcaatgagtatggtttgctttttattgtttatctattttctaaaaagaagacagagagaaggagaggggggaaagagaggaggagaaaaagaatagtatgaagttgagtcagtagaaaattggaggaaaatgaacaatatcaaacaaattagagtgtatgaaagaagagttaggggaaggactgaaggacctgaaggagattgaaaccccataggaagaacaacagtatcaactagacagacacctcaaagctcccagagactaaaccagtaaccaaagaacatacatggactggtccgtgccactgcccctgctacatatgtagcagagcatggccttattatcagtgagaggggaggtccttagtcctgtggaggcttgatgccctagtgtaggaggatgctggagtggtgagatgagagtgggtgggtaggtgggtgggtgggtgggtaggggagcaccctcttagaggtgaacagaagggggaatggggtggaggcatgtggaggggggacctgaaagagggacaacatttgaaatgtaaataaatacaataattaataaaaataataaataaaataccatttattataaataaaaatagtgaaagggccatctaaagcaaaggatggcaattaatagaataagagaagaaaaaggaagttggtaccaatgacagaccatctctcccttctctcctccctttttctttctaagtaaagtgaagtgatgacttgaaactttctgaagttagagagcacaaattctaaatctctttcagcttttccaaggcagctttacagccactatcagctagctccattgtccatctcacaactctgggtggaactctgggttaagcattatgaagagggactttccaatgcatccccttatcaactaggctttatacttcaaccaccagagagatactgtctctgtctctcagcatatcttagaacaacagccaatgtttggaactaattgtgttttgtgtgctcaaacaaaatgaatgtgaatcctatccacgcaaggtcttcttaactgtctcatggaagatgcagatttgttcagttatcagacttcacagttgctagcacctttatgaacattcatctgcttggttttgagttttgttctaaaagaaatcacattaactataagaagtatgagaagtatgagagtatgaagagaaaaatatttcatttccctttcccaaagctgactaagaagtcatgactaggaacagtttgtgtggtttctcctatatattgtttgttcttatttaaacagaaacacagagagacttttttttcatttggacttttaatctttttttaatttttgtttttattagatgttttctttatttacatttcaaatgttatccccttttctagttttccttcccaaaatcccctatccccccccctgctccccctgctccccaacctacccactcccattcctagacctggcattcccctatattggggcatagagccttcacaggaccaagggcctctcctcccattgatgtccaactaggccatcctctgctacaaatatagctagagccacaagttccactatgtgttttctttgactggtggtatagttccaaggagctctgagggtactggttatttcaaattgatgttccttctatggggcttcagtccccttcagctccctgggtatttctctggctccttcattggggaccttgtgctccatccaatggatgactgtgagcatccacttctgtatttgccaggcactggcagagcctcccaggagactcctgtcagcaggctcttgttggcatctgcctggtgtctgggtttggtggttgtttatggggtggatccccaggtggggatctggatggtctctggatggtcattccttcaggctctgctccgaactttgacagagagacttttttgaacaaaggctttacaaaaaatggaccttgctgggtggttgtaccttatgtttttaatcccagcactcaggaggcagactgcgtttaaggccaccctggtctataaaactagttccaggacagccaatgctacacacacacacacacacacacacacacacacacacacacacacaaaaccctatgtcaaaaaaaaattacccctacattttagctatctttctctgtgagaacatttattcatactgcattgtttctatcaatatgatcctgtacaagtgtttcatacttatttgtccagtatattaagtgagcacttcagttgttttaaggttggataattttgttttttccaacaatgttatagtagaccttttttacattgggaaaattattatatataagataaattcttagtaataggattatagagtcataaaacatatgtgttgtttaatttggataccagcagtccaaaggtgtagctgtttcttacatctttgtcaccatagatcaaaaagaaagcattaaaaactacaacatttctgatctgacaggcaaaaagaagtactaactcattataattgcatatttgactttttgaaaatgtagcttaaggccaaaagaagaggtcatcgaatccctcagagttagcataacatgtttgtaggaaacccagcgttttcctttgacgctaggataagctcttcagtccttctcaggtcagtaccaagccatctccccagccccacatttgagtttttttataagcaagatttaacatattttaatgccataagtcatttgttttattcttgtgtgaacatctgattgtatattttacctcttgatttcaactagagtcatttgacctgtctatgctattttcatattatactcatcaagcttactaattttgtaaaattgttcatcctgatttattaaagatcaggaatttaaaccaagttatgtagcaagtctgcgggaaagagcaaagctaattatactctaggacatgtaactttgctggatactcgcgtaagactatcctaagtgacatttcaaatatcttaatagctctctaggatagaagtatacatgcataatagctctttatttttaagtcgccagttcagttctttagcatcttgattcaaaagaaagaagagggctgcattctcaaccagagggaaataaaactgcacagaaatagagaggctgttgtgtggtggaagaatgagttctaacaaaagaacaatagcaaaaatccatctcactcattgcttttcctgtcttcattagcaacacagttgctacgtccaacaaagaaaagctgtcaaggagttgatcatttgaaaaaaaaagaagttttccttgatttattgaatagtggagaaatgtatgagtgataaaatgggtgatgggacaaatctatactatttctcatttcaatttttcagtcatccgcatttcacctaagaagatgatttccaaattccttctatatttgacgtcatgcagacatacatcatcaagattaagaatgcttcgcaatataacagtttctaggttcaaaacctctgtcttcttctggtcctccaagttaaatatccaaattcttaactgcaagttaaagattcaaaactagagtctggattgcacaagaggaggcaaaaacattttttaaatttcaggaatgaatacgtttggaggatagagatgccattcaagaggaaggtgaattcctagagtacccgaatccatgggctccacctccagtacttcctcatgttaggggcactaagatagagtatcaatactggtgaccaaaaggatagtcatggcatcctgactgataataggccaaagcattcttggtgatacagaggtgtgtagtgctttctccaatggtcaatttctctttaacacataacagctttgacaagtttgaagagggggagccctctctaggatagttataccaacagcctcaaatgttactatggttattttttcctactttgatttgaggggaggttttggtaacttaagaaattcacaagagggataagtttgagctccctttgtttgaagtgtgtaaacagcaattatggtatcatgtttgaaacaatctcaaagagcagagaaactcttgagatggtcatgacaaaaatgtttaggctttcagttactcagaatagcctatgaatctgacctcttcacaccactctttatttaaagattgattgattgattgattgattgattgatttaatgtgtgtgagtatactgccctgtcttcagacacaccagaagaggcatcagatcccattacagatgggtgtgagccaccatgtggttgctgggaattgaagtcaggacctcggaaagggcagtgagtgctcttaactgctaagccacctgagcccttcacaccactcttaacactattaactcacttgatcaaccgcagtagtcccttaaatgtgtttcatttgtttgttctttcctcaacataatattcttttattgattctttgcgagtttcccattatgcacctcaatcccactcatttcccagtccttccatgtccatttccactcttgcaagcccccaagaagaaaattaaaaatttacatttacatttttaaaaaagtctcaccaaccctcctgggcaatggcctgctcctctatcaaccacagctttatctttacctatcacagctgccatgggcctccatttccattgtgctcagaaccacaagcttcctccctcattctggcttctccatcatggcttctccatctggcttctccacatttgtcatagtggaatggtggctgcagtgtgtcatgcagtacacacttttgcccaaacagctttacttgctaatgttcattgaaatgagttgttggactgattcaaggcctctggcttctgccacaccctcaatacaagaccctcgctaagacttcccttggataccttgctgttgaccttggtcatggagatcctgcagcatttggttccatagttcaagccccttcacacattccagcagctcatagaagagttggtgccaagtggggtaggcctggatctagctctgggtgatagcaaagttggatagtccaggcttcctctggccaccacaccactaagtggaagccagtgagacgcagagccagatctgctacatccaggccacaacagccagctctcccttgctcatgacaaagctcagcaaggccttcaaaaataaagctggcttcaggtggcagcccagatcacagatatgtgcatagcctacagtggtaacatgagcctcacacatccatacaacctctgtccacatctgaaccaccgacacactaatggctctcagaagatgcagagacctcatgcctcatcatagcctcagatgactgcacatgccaataacatcaacatgccccccccctccaaggcatcaaagcccaaggatatcaccaagtcagcagtcagcagcacagaccacttacatccacatggatctcaggcttcttcacagcttcttcacagcaaggaccacagacaccaacatggcctctgatggcatcacagactactgtggtccttccaggaggtccaatccataaagtgaaactttcctctttgtggacctccgtcattgcccaaagccagggtgattgcacaggtgggaggcatattcagggctgaatttgcatctgcataagctccaggctgttgcacatggcccataccaaccctactgagtgatggcaacctcagccctctctttcaccggtcactgccatcacatctttagttctacctgtctccatggggcatgcactgatcctttttttttctatctttctcacctctccatcagatatgtgattgtcatagtggcatctaccccactccatgtggctgggaagacctggctgtgtttcactctggacttcccccataacctgtaatcacctactttcttatttatattttcattgaaaacattttttcctttaatgtactccgatcatagtttcttttccgccaactccttaccaccccaacccatccaattccacaccttctctttctctttagagaacagatgaagaaaaaaataaaacttgtaaaagcaaagaaaaaagcacaagaaacacacacacacataaatattataaaaacacaaaatcagaaaacacagtacacaagcaaaagatcagtaagaccaaaataaagtaatataagacaaaaagtctacaacagcatcattgagttcattttcttttagccatacacttctaggcatgaggactacacttacatgtggttactatacgcaatgatactcaattggagaagactaatttttcatttgaaagaagatgccagttggagatagcttctgggatagtgatagaggcttatagccagttcccccctcgatgctaaagccccatcctgcttcaacttatgcaggccctgtgcattctgtcacaagctctgtaaattcatatgtgcatcagtcctgttgtgtctggaagacagttttctaggtatcccccatcccttctgactctttcctcctcctcttccatatagttctctgcaccctgccaggacacatcccatttagaactgagtgctcaaaagtatcccattctctatatattgtccagttgtgggtctctgtatttgttcaactctactgcatgaagaagtttctctgatgatgtctgggcaaggcactaatctatgggtatagtagaatgtcataaggagtcatgcgattgctattatcctttagcagaacaatactatttggttttcccttgtgctcttggcctatctaatctcaggttcttggctacccaagcagtgtcaggctccacaaataccatcctgtgaagtggatccttaatccaagaaaggacggattggtcactcctacatcttttgggctacaatttcaccagcaagcacatctaatgcaggcagctcaccactgtagatctcagggtttgtagttgggttggtggttacctttctcctatgggagcaagcagattaccttctgagtaccaaatcaaatatgagaaaaactcattctgctcaaagctcactaaagttctttggtgcttatggaacacggtatgatttgacctgctacctaattggccttcatcacctgtcagttgctcttgctcaaccttctctcaccatactcacttctttgagattttttttgttgttttgttttatatggaacctagaactttttttgatagataaatgttccacctataagttatatccagagaccttttgtgaattgtttttgtctcactattaatgatattgatttgtagctctagaaatggaaaacagggctactttcatgctaggaaaatattctatgattgagctactcagtccctacactcacttatttcaacaattatgtaactcaagtgtctttgaatggttctcatccaagtagttacaaggctaagccttcattgtcctttatatttgcattacaataataactcagaaggcagattccccaccatcaccagtttcttcctaccaccatgctatacttcaggactcttggtgttatcaccacctgacatacatttatgttctgcctgtgttaccttctgtcaaaggtgatctattgttttcacttttgagcctccaatgcccacagtagttttcagaacatggtaggctttccgtaaataatttatgaatgaattaataagtgattttttagaaaaacgtcaaccccaaaaactattgtctagcccatctcttcattttattattgtgaaaagtgacagataaaatatgatctgccaagttcaatgtggtaagttctataagtcaagaaatacagaacttctgactttgtactgagtattatatccatgacactgaaattaaataattctacccttaaatccactctgaatgaagtctacggcatccttcctagacactatgaaagttccttttatctaacttaaatcctacatctttttttttagaagttgctttatgtgcatgcctgttttgcctaatgattgtgcactgcaagttgtgcactgtccattaaggtccagaagagggtgacatatcccctgctactgaagttaaagaaagttgtgagccatcatgtaggtcctctataagagaagcagatactttctaagaacagcaagtgttcttgaccacttagccatctacatcttataagctaaattccaaattctacatcttataagctaaagtatatataataaagtattttctatactttacataaaactaaaggcaagatttgggtctctatagtgccctaaaagatctcaatgtcacaaaataagtttcaaatcacatggcagggatctagagacatatgattagaaggccatgtaagtgacaatatctatgactgcatagtagtgaagtcttggcagaaaatattacaagcatgtactgtaataaggagaaaatatttttaaagtttaaaagccaagtccatttaatgtggagccaactgctcctggcattgaattagaagcattcatttatgatgcagaagtactcatagttcacactgtttgctacccaagcagccttcttttcactaaaactagtaaaggctttgccccagtttctttatctttctgcctttccagtatgggaagtggtttttttctccccctcattaaattaccttatttaaatcagagtgccattgtttccaaagtagctattacttatttataaaccagaaagtggcccaaggtaggactgttgtttctcctgtcaatgctaagctcctctgggtatgtctgatcagagtagaaagtgttttctggatcctataacttagctggaagaaaatgagtaaagctaaactttagtagaaattgttcgtcggccattgtttttcttaacctacccaggaacaagattgagtaaaagagccggtgtcatcgctaacctgtttgtcttcaatactagagaacacaccaggcagaaatatatgtcctgatagcaataccaattagcactcaatcctaaactgttttctttcaaccaggctgaaatatttccttgaagacttgtgaaccttgcatcccaaagattgagaagctaagcatgaagccatcctgtgcctaaagggactgaatgtcaagataggaaagcattatccctatctagagtactataccaagtggttcaactttattattttaaaaaaatcatgattccaaagcactcaatagttaacattggaaagcttcttgctaaatatgggtataatatcactgaagcaatccaactgcacctacttcttgatacacttatcatttcctctgtttctacattttcatttttggccagtttatgaacctggcttctcatttttattttcagaataagccagaaaactgtaacatttatctttaagtgtgtggccagctatttgtagtagttaaaagagtccttttctctcctcccttccctttttccttctctcccttcttctgcctcccttgttttatgttttgttctttcattttgtttgtttcttgagacaggatctcactagagagcccaggctactcttgagccttcgattatcctgcctgcctctgcaacctaagtactgtgattatagacatgcagcaacacatctgctaagcaaaacattcctttaaaagagctctataatagtggcgggggcttgagggtgctgaataacatttgatgggaaaaaggaaatttgcttgtctatacaattccaaactcaggagaagtggagtgacatgctgtccaagatgtagaatggtaactctgtgggaatgtcctcaaaagggttaatcatctgccttaagattgtcatctcccaagtctcttcaaaccagctttgcaatgtgtttatcagatgccacacagggcatgatgaacagtctcggggctgctgttttctgtttactcctctagctgtcaggaagcaagaagcaaattcctcaacctctcaatagcttcactgcttcccatggaaaaggaaatgatctcacaagaatgacatgagaacatgagcagcacttccaaattaccctaaatgtacttgataagcccccactaaagaggtctgactggcatagttggttaagtaaagaagcaagaatacaaagccacattaaattaaaaccttctggagagatcactaaaatctcacacagagatatcttgacaattgttttagggtaaaacctctaacattctgggggatagctagttgccaggagtatgcttaattacaggatcattgggatttcatgaaaaccatggcagtctattctttttacaagcacaaataattttaatgatttgtgttaaataagaatgaactttaaatctattaaggaaaaatgaaaattacaaacatatttttataaaagggagtacaacctcaagcgttagatgcttaacataagccaactttatagaaatctgaagtcagaaacaatatcagtagggaaaaggaaaaacatgagggagaggtgagacaagaaagtgaaacatgaacaagaaccttcacatgcagttttagaaacaggaattcacggcaagaaacagacacaaacctgaccaagaatgaggccctggatgcaacagaaagcaactcgggcttagaataaaaaataaaaaacctacaaccaaggtacccagatcttaaatagcttaacccagatgtctccccataactcccaaattcagaataaaatgtagactttcataactatttaccctggaaagccagtcagaaagatatcattttgtttacataatatacctgttgacatgacaaagtggtcatgtcagagaaagatttatcagtctttttcttttttcgagtgatcagcagaatcccaaactttcttagtaagaggatcttgaaacgattaacttcacaacctccttgtgtactgagctgtaccagttctagctggtagttgttaagctgccttgttctgctcctaacagcaaaactggctgttctctctgcacctccttctgcaaaccctgcggctacacacacttgaatttctgggaagattcgtcaaagaatcctcttctttgaatgcattttaaaagtaaagatcctgaccattcacaaagagggcgtgcaggataaacatgataagcacactcagctagggctttccctgcttctctgccttggctgcttccacatcatgaggaagctcttgtcactcatacatccatattcactgttatggcttttgtagcaggatacactgaaaaggttatgaatcaagcaatctccaacttttgcccacccaccaaccttaaaagtgtataaagagatcaaaacagggtgagttcaaagccaaagtggctaagtcagcaagactgccttaaaataaataaaggtttgcgagtgtagctcagttgcctggcatgtacaaagccctcccacacacagccacacacacacacaaaagatcaaagctgtgctgggattatacagttctgtgatgggaaagtgcctaacatgtgcaagactctgacttgcatacacagcatcgaaaataaaagggaggaaaggtttaaaggaagaaaggggaaaaaagaaaaaggaatgaggaagggattaaatccttacagagatttaatttagtaattcccagaaagagtcaccacaaatagtatgcttctaatctaatgaactgacatttgacagttttctaaactggtaagacattctaagatatggtgactctacagttacagaaaatggaggtgtgcacagatgcacagcagacagcaactatgcacggtaaaaacacacaccatgagcctcctctgattgtgccattaacacccaatggtccaaatcgtgatttcctaatgcatacacaagactgtaaaaatgaataaacatgaaggaaggtcaagaaaatactagaacctcaatcacaatgtaagaaagagataactacagatataactcttcaccatggtgtctcaattaaatagattctctataaccataatgaaggcagagtaaaccatatgatgatattctgtttactaaaggatgctgaattcacgatagaccatttacagatttaataagttgctctgatgccatctcacttattaatctttgatagatgctgataaaactgaaagatacaatcagtagaaaaccacaggccacatgtataataaaaacttccttgcagttccctgtgtgaaaccccatgcatagttcatgaagactctaccactgagttatatatagccccaccctcagaacaaaataaaactcttaaaagcagtttacccatctaacttaatccctaatttatcgtcagttgttttacttcacaatccaaagaggggaacgtgaatgattctatctgtccataaaaacgtgaatgatcatacagatcacagtggctgagttctcaccatttcctgcttgttcaactgaaaatttccaccttgtatgacactcatctgttgaggggaagcaattcaaagtccactgcacagctgacaagtcaggttgaaggagccatcaagactttgccctgaaggaccctttctgggtgacaattaaacagatcttctccattgatggtgtattgtgtacagaagtgttgatgagaatcaggcttagtgaggtacgcaactttgttgatgggctgaggcacatcattgttgctcttgggctatctactgaggaccttgactcttgttgcaacagttggcctgaaggcagtgaagaagagtctgttttctgcaaggactgtttgctttgctaaacctctgcacgtccttggaatgttgcttttagatgcaggatcaggaggcctgctgcaaccttgtaatttccattccaccctactgaaacaaagatcttttacccagaccttcttttcaggcatctcttcactcttgttcgcactgtcaagagattatatgctcagccgatggtaaagagaattcagtcaagcttccagaacattctgattctgtgacagtgccacttgctaataagtctattccaccatttacctgtagactttccataactgaccatcagctacaaaaggaatcaaacctctcctttggttcctctttgaaatcaaatctactattttctgtttctggccttaagttccactccttgctgatctcagctaaagacttcttctggtactttttctttctttctttctttctttctttctttctttctttctctctctctctttctttctccttttctctctttctttcttttctttttctttttctcagatgttctagaagctgtttcagccctcttagaaacaacttcaggaggacttgtggaaacaaagtcacacattaaggattgctgggctttgtcatctttttgtttttgaggctgggtttgtgctgacactttattcacaacctatctgactcagaagagtaaaccacgtttttaacttcttcccttctgcatcacgaaataaatttgctctagatgtgtcttcatcatctgaaagtttactgtcatgtaacaacatttgaaccttaagataaagctggatcatgctgtccggtctgtttatcttgaggtctaggatccaggccgaacagcctgatccaacacagtcacttatacattcactacaggagatgtgctcacaatctcctaaacacatggactatgttagaacattagtgcagtgggaccctacacctcttccaggcaggagagcactgcccagctatgatcccagggccatctgtagctggtcttatggtggcttaaccccagctgacccttggaagcccaggaggcatcctctggaggccacttagcattcccttggagaacttgagaaccacaggacatcttcccaggatcctgccgtgagcagagtttcagagccaaggacacctggggctgcactggcaaaaccagcaatctattctgtatgtcactgcaatccacttaagacatattaacctctagctcccaaaagacttaaagcaccccaatgctgattttatgaaacagaacctcgacagagtgtgaaatcaatcccacatcaattctatgccaagtgtcagttgctcagaattctcacaggtatggctggtgcctttgtagggtctcaagtttgtgactgtgaccacagaggaagctgaactccttcctcattcacctggctgcctttgacaaagaaaagaaatccttgtatctagtgctaagtgctgtattcccagccccaggtttcatccatctttgatttctttatccagtattaactgaaaacaaaagaggaaactcagtacatttaattttgcaaccctttcccctttaaggccttccttggattagcactggtctgcactgctaagatgttgccgcgagtgaaagatcacactgaagctatatagtatctaaatacatgtgtcgttcagatagaggcatatgtttcacaagtgactaaaatgtcatcattgcatttaaaatactttgcctttgcaagtttcaaattgggacacatttgacttcatagaattaaggacaagcaagacatctgataacttcttgattcagtcataatcagtacctatcttgtttacctttctgtgtagagacagtatcccataccccttgtggggggggggagtatagaggaagaaaaacagacatagggcagaaacagtagttagcagccagcgtagctctctttctcatccctaaccagaaccgtacaagctcccaatcctttaacacttggtctgttctgacaagaacagaaggcatctaggcatcatgtttgagatttgagatagcagggttgatgatgcatctaaaagtgatgagagggaaggaagggggaacaaagacaaagagggggaaataagatgagaaggagtaaagagagaggtatggagggatggtgaggtgggaatgcttgtgttatcccctctcaaactgtgataaaggaacacacacacatacacaacacacacatgcacatatgcacctattgattctttttgcatagctggtacagaaacacctgaggaaacaaggacagactcactttgcctcaagttttcagaggcctcagtccacagttggccccatatgcttggataaaacatggtgttggagcatgagtagctgctgcacttcagcaaagacaggaatccagggaagaaaggactaagggacagggaaaactttcaaagctatgtccctagtgccatacattccccaactatgccacatttcctacagtttccactgtcacttcccaaaacaaaaccaccagtttagggacacagtattcagcgtgtgatcctctggggaacattttctgagcataatgaaggcaatgcatgatcagagcagagaaaacgttttcttgtcaataacgttggaaaggacttgattacagttgagtgatgccaccagaatacagcagttcaatcaccaaatgatttaagttgcttttttttctgttcatcaaaagttacttatactttctctcaaaagaataaacaagaaaaaaaattaaaacaaactttaaaaaaaaaagaagttgggggacagggatgcgagcatgatctgggaggggctgggaaaagggaaagaatatgatgaaagtatagggaagtttttaaattaaaagtaagttaattaaacatacacacacacacaccagagttacatgttctttaaattgattctgtctaatcagtgaaccaggaatttaatcttagccactatgtgctgaaaaggagctgttttctgtggtgtatgctgttggggccaccaagcagagatgtttaattctcacgtctctgctgaacaggcaacaaatatttctgaaatgtgtcccacaaagatatctaagggaagttaagcttcttgacgtcacccgggctagtgattctttcttcaaagactttctcattctagtcaagacttgctggacatgaatttacagccccatgaacatttaacgtgaaaagcccctcagaactatcccagataggaattagattgcaaagatcctgtttacaacattgctcccaaagcgccagtgatagtacaaaccaacaaaaatgtttctggtcactatcactattgttgtaggcatgactcatattttcccagaacatccaaagctcagtttccatactgacaatcagtgaggcggggccaacataagaaatattgatgtacccactgcaccctttgcatggtgatggaaaataccatcgtggcacaggatagcaacctccattatgatctcttcatttctgcagtcccagccttcccctagagtccagtgaaacactttaattccagggagtgactcttactcctactctcaagagatgctacttttagtccaggatcaagtaccggtcttgttcctagtcatgaggactctcagaatgagaaacaagtagctcagcagaagagcatctagtcccccaagcttctggtcccctccaacgcagggtctcatataaacaaaattggcttctcatttttgctctgtagtggaggataatcttgcactcttgatttgatcctcttttctccactgcccacatgggaagactacaaacatgaaccaccacatagactctagtctttttgcatcatattttgctgctaatgcctgaacccttaccttattggcctgtgggtctctattttattttttttaatttttatttttattttttgctccactcaaggtactaaatgacaggcaattttagcctcatccagtgggatattgagaacgcaggatccttggtaaatggttgagtcatacaggatctctactaaccaatggattgacatacaaatggattgatagatcaatatgtttattgctggagtgccttagttatagaagcaagtgcttgcttgcttgcttgctctgtctgcacagacatgtcatatcgttcacaatcttgtgcagcagaaaggtcttcctgagacgccaagtaggtgctggaaccatgcacttggattgttcagcttctagaactgtgagacaaatccaaccatccctaaattatctatcctagggttttcagttatagcagctgaaaaatgcactaagatggaaaaggatagagaaaagggagaccactgataacaatcaatacctgaaaacgctgatatatatttggcgatagggtaatgaacagaagctggaagaatgtgaaggtcaagactggacagaaaaacaactacactactaggggcagagcctaaagtgtgactctggtgagggcttagaagacaagagcaagaaaagtctgtaactttatagatataaagtacaggtcatcaaagcaagcccccctccccccatgaaagcaatgtcaaacgtaagtgtgagataaaagttgatagaaatatggacagtaaattctattctattcagtaaatgctgtgaggtcctagatggaactcgggggaaatactggaaactggagtaaaggccatgtttgttatgagatttcttttttaaaatggtatataatgggtaggaccatacaaactgtagatcttaaagaaatgagcaaagaatgagtctgacagaagaaagttctaagtgatgaagcattcagattagtgagtgactaaattttgtgaactccttaacaatattattaattggttctttgagaattttatactattcatgttgacaattgtacatatataatgtattctaattactttctcccccacactctcatatctccctctgatccttatgatttttagctttgttgtatggcccatttagtttagccaggaccgtatgtgtaaccaatggattaacactacccactggagcctcgtgtgatcatgagtgggtacacaactcaaggcaatgactctccttcttgttgatacaccaataaatatgcacaagtgagagctagagcctcttctccatccatgcctgactgtttacaagcccattcttatatagactccatgcatgcaggcatttgtagctgcagagtttgtggttgcaaaggatgtgtctggctcagaacatggcattttccaactcattcttctaccttctgactcttgcattcttgctgtcccttcttccataaaacatttcctgaaccttttaggaaatggtataggtatcttgtttaggtttgagcactcatccaccacttattcttagcatcttttatagccatcagtctctgcactcattaatgttcactgagatgagatgcttctctaaggctaagcatgtcatttgtctataggtagaaacataactatttagaaggcagtttttgatggtgtgttaatttagcttactgatggtattcagttttccaccaaaacctatgatttacttgatttacaataccaaacataaagtccttcctatagaatgggcctcaaacccaatcagagaaaatttcattaccctcacagccataatgccattactacattaatgggtacagcttgcatggcaccttggtctcttagttcatagggttgacagctgggaaaaccattggtgccatttatcttacccagtaggctacacagcaccttctaggactataaaagccagaggaagaaggcttctagttcagttccaacttgatttctctgtattttgcaacagaggtatatgttgttttcaacattaggatcctatcatctagttctgacaggcaatcaaaagaaataaaaaaatgtgtatagtttatgctggagctctaggacttcctgaccagcagcaactcataagaaggtatcctacctctcacattaagacttttgtttaataacccacagcttcctagaacagctttttccagcctccattggctacttttaactgcttgcagtgagatgggatagcaaagaaataacttaaaatagaacttataattaaaagggaaacagagcagaaagatttagaaaattcgcagcccagccatgtgctagagactaaaggaacatttcaaaggaagaaaccaagagtgtaaccgagcaactgtttgataaagagattaatgtgaaaggcagagggaccagcaagataaaggaagaaaagcacattaggcacttcagaaatttttaagtattcccttcccattccaggtttcaggggacaggatggtttgacagatgagcttgggacatgtacacatgctcattgcccaggactgcctcaagtactgcttcacaaattaaactgcaatgcttcttggtcaccctagctaggagtcagtggaacaaggtgttactcaaccttcctctgagaaaatgcaagctctacttggcaaaatctaccttgtgttaattctgctgatatacagaatacaatgaacagagacatggagacatctatctacatttcaaagcatgtttcaaccaaaatgaaaacaaggcagaggagcattgcatgctcagagcaattatggacagccatgactagataaatattgaacaggagtgtggggttagaactatcacagaaactccccatgcaaacaatgcttcctggaactgaagaagtaaggctgccactgagaccttaaaactgcagggctaccaggctgtaactccaacatgatagaggtacagatgaaagatgactttctaaagtattgagagtctaccccctaaccaatatgcctagaaaggattacgtggagtcagtggtgatcattctagaatttaagacctagtgagatttttcctgttgaggttgaggcatgtgtgcagcgtgttaacttctttcttttcaactgcttctcccctctgaaataggaatagcttatagactataatagtttatttggtttgttttctttattcattgccttcattcatgaggacacgatagtttcataactttcctttcacccactaccaaccaaataggctccttttttctaatcatgaaagcacttctatgtctgaactagaatacatggtcataactatcattttcaactctatggctctaaactgcctaaacaaaatagagatcccgagttcctctatacacccaaaagctcctcctttcatttatttcttattttattttgctggcaagcgagttcttatcaagactgtagccaaaaactattgtaaagtaataaatggttgtttacattaaatctgatcatatagttgatggcaaattggttaccatgtaccaccacagttccatgtctataccagagttctccaccctatgtagaaaccattactatgctatctacattaacactagctgtacaatgaacagcaatatggtgaatattcatcttgtcactagaagactaagaaggaatgctgccatcctctttctaaaaaagaaatctgcaaagtgattttatttttaaaaaaatcacatagagaccaatagaaaaggaaacaagaatcatgtttcttcctgaaaggctgtttgtgtcaacttcagcccctggcatttctgcagtggtactcaaaacccaggtcacactagcaaaataggggttcattctgttgtacagtacaagaaatacattggtgagaccatcactcctgaaattttccccatcacaataaaatgtatgcctgttctatttatttcttgactcaggcctttttccatgatttcctggaaaatgtggagaacacacacacacacacacacacacacacacacacacaaagttgcccagtacttcctagttaggtgtctttatgtaagtgtttaacttgtttttagatggcttttctcagatggaacataaagaaattattatacctataagcacagagtgatagtgaagagtaaataatactcctcagtatgttcattttactcagaaaatactcaataaatgctattgttaggtttatccttgccaaggtgaccctgcccactgttctgtgttgatttgattttaaactattgaattaattgtattgtgagcacgtgctcacatgggggcacaaatatatatgtgcctaagtatgtgggtacctgtgccttcctcctaagatgggttggtgcctgatgtcttcttcaatcattcttcaccttattttttgagacaaagtttttccatgaaccagttaggctagattgggtggccacagagcttctaggaatttcctatctctgccccgcccacactggggttataggcacatgtcactacgaccagcattttacatgggcattagttatccgaactagagtcatcatgtttccacagaaactggtttattcactgagccatctctccagccccatattattgatttttatttagctttctaaaaaataggtgaactctgtggcatttttccttgctgtggtttgaatgtaggacatcttctccctaaattcatgttagaagattggtttctgaggtgcaggtattattggtgttcttgggaggagctgtggaccttttgacaatggggcttactgagaggtttttgtatgattgaggctatgcctttaaaaggactgtggcatcaaagccagtacactcttctctcctgctccaacatggactcatgccattgccatctgccaccttttccagaggccagaccaattggccatctgatcttgagtttgaactttcaaatcttagctaaatcttttttctttatgtgtgtattagctcgtatgtttttgtagcaacatgaagctgagtgatgcaattctccaataaatttttttcattgtagttttctaatctaaattattaacctaaatcgttacacacattagcattaaaatcagctgatgtgatccagcaaatcttaattctagttctgttttttcaagtctggaaagcagacacttccctatctggtaccaatgcctgtctctaacgtacctcatgcaccacaactacaagctacctaactttcctgagatgcagaagagaatgtaatagatgtgattagataacagtgttctccatttatgtgtaatacagaaaaatgagatttcacgtctaacagtttctgaacaagattgaccattgatttttctctgacacattagaatagggaggaggtacatagcaggtgggaaagaggtgattgtaatttctattagtctaggcataaggcaggagactcatttccaaatgatgctaccaggctagctctgtgaggaaaatacccattataagatgatgagtgtctgtgaacagatggtattgtgggtatgaatggagtgactactgaaaagggtcttccttttgaaattggaaataagtgattcaaatttcagaaggctgtgataaatttctaccaagaatgcttgcctaagtctagaaaaaaaagatccagaaaattgccaagtagtctatagtgtttagggatgaggtttaaaggaacttacggcatcatttgggtcctttgtgaacaatagctttataaaaagcttgagctagtctccaaagcgaggagattatggatgccatcacccaaccctctttgtcgatagaattttgatgaaaatataaggaaagggactttatctcactctattcattgcaggaatgagcccttaactgagcaattctatcctatgcagatggatctagaaggatcctaatgtgtaatacttagctttcaacaaggattccttgggagaatggtaggaacaaactcagtaggatctaaatgcaaagccagagagaggcaggcaatgtaacgtctttaatggtcatgtccttagcatacatcattgcaaattctcaaattcaatcaagtcgactgatgtaccagggttcttgcagataatataagccaaatttaatttattagcctgatgattttcctctcttcttccaccatccctgccagcttcttttttatttcattaaaaaaaaaaagatatgatttttaactggaagcctaagatcattcggcctgattttttagttcaaagagaatcaagtttatgtaagaaaaaataaaattgaaatctgcatgttacctctatctgaaaaacaaacaaacaaaccagcagtcacaggatagttaaagggacaataacaaattctgatcctcgtacagatttaaaattaacatgtcaaagggtttgttttacttatcaattagtaaggacatttgtaagcagggctctgcagattgtggcacatgaatgaaatcctgtggtcctcacctgcttttgcaaataaaatttggttgggagcacagccacatccaatcatttaagcattgcctgtggctattttgtgctacgatggcaaacacgataaggtcccacaatgctaaaatattcactcttctggtcttagacaggacaaaaatgttatacaccaccaagaatattgaaataaattgatagatgtacgtaaagcttcaattatctgaaaaattatttgtatcccacaagataagaaatatttgcattacgttaggctaacctgggctacaaagtgaaatgctgtctcaaaaacttaagactctttttaaaattactttgctgggaagtgtttcttttggtatacttgtatttgttgtgacagttatagctaaaaacttctcatgttcctctataggcattacacatatacaaactctccatttataccactcccagttgttttagttatgttttcaaccatgttacaaaatcctgggcataaagaacccaagtgaggtgggatttatttgggctcacagtttcagaagattgagttcaaggccaagggggtgtggtgaaacagggttattcaactcatgtcacccaggaagtaagcttacaaattgaacaaagcatgatacagtccataagtaatgctctccccacctacttacctccaactaggtcccacatggtattttcactatctctcaaggattgattctttgattatttcagagccctcagaatctaacctctgttaaaaccatcatgggcatcaagagatgtgctttactaaattcctacactttccagtctgattaagttgacatttcagatcagatcctactacaaaaggctgtactcaacaaaactagaaagcctgggtgaaatggacaacttcctagacagataccaggtaccaaagataaatcaggatcagattaactatctaaacagtcccatttctcctaaagaaatagaatcagtcatcaatagtctcccaaccaaaaaaagcccaggaccagatgggtttagtacagagttcttttttttctttaaaaaagatttatttatttatttattatatgtaagtacactgtagctgtcttcagacactccagaagagggcaccagatcttgttacggatggttgtgagccaccatgtggttgctgggatatgaactcaggacctctggaagagcagtcagtgctcttaaccgctgagccatctctccagtccccaagtgcagagttctatcagaccttcaaagaagacccaattgcaactcttctcaaactattccacaaaatagaaacagaaggtactctacccaattcattctatgaagccacaattactctgatacctaaaccacacaaagatccaacaaagaaagagaacttcagaccaatttcccttatgaatatcaatgcaaaaatactcaacaaaatcctcacaaaccgaatccaagaacacaccaaaatgatcatccataatgaccgagtaggcttcattccagggatgcagggatggtttaatatacgggaatccatcaatgtaacccactatataaacaaactcaaagacaaaaactacatgatcatctcgttagatgaggagaaagcatttgataaaatccaacacccattcatgaaaaaagtcttggaaagatcaggaattcaagacccatacctaaacataataaaatcaatatacagcaaaccagtagccaacatcaaactaaatggtgagaaactcaaagcaatcccactaaaatcagggactagacaaggctgcccactttctccctacctattcaatatagtacttgaagttctagccagagcaattcgacaaccaaaggagatcaaggggatacaaattggaaaggaagaagtcaaaatatcactatttgcagatgatgatatgatagtgtgtgtatatatatatatacatatatatatatatccccaaaaattccaccagagaactcctaaacctgataaacagcttcagtgcagtagctggatataaaattaactcaaacaaatcaatggcctttctctacacaaaggataaatggactgagaaagaaattagggaagcaatacccttcacaatagtcacaaataatataaaataccttggtgtgactctaactaaggaagtaaaagatctgtatgataagaacttcaagtctctgaagaaagaaattgaagatctcagaagatggaaagatctcccatgctcatggattggcaggattaatattgtcaaaatggctatcctgccaaaagcaatctacagattcaatgcaatccccatcaaaattccaactcaattcttcaacaaattagaaagggcaatcttcaaattcatctggaataataaaaacctaggatagcaaaaactatcctcaacaataaaggaacctctggtggaatcaccatgcctgacattaagctgtactacagaggaattgtgataaaaataaaattgcatggtattggtacaatgacagacaggtagatcaatggaatagaattgaagacccagaaatgaacccacacacctatggtcacttgatctttcacaagggagctaaaaccatccagtggaaaaaaagacagcattttcaacaaatggtgctggcacaactggcggttatcatgtagaagaatgtgaattgatccattcttatctccttgtacaaagctccagtctaagtggatcaaatacctccacataagaccagagacactgaaattaataggggagaaagtgagtataagcctcgaagatatgggcacaggggaaaaattcctgagcagaaccaatggcttgtgctgtaagatcaagaattgacaaatgggacctcataaaattgcaaagcttctgtaaggcaaaagacaccgtcaataagacaaaaaggccaacaacagattgggaatggatctttaccaatcgtaaatctgataggggactaatatccaatatatacaaagagctcaagaagctagactacagaaatcaaataaccccattggggtacagagctaaacaaagaattctcagctgaggaataccaaatggctgagaagcacctgaaaaaatgttcaacatccttaatcatcagagaaatgcaaatcaaaacaaccttgagattctacctcaccccagtcagaatggctaagatcaaaacttcaggtgacagcagatgctggcgaggatgtggagaaagaggaacactcctccattgttggtgggattgcaagcttatacaaccactccgaaagtcagtctggaggttcctctgaagattagacataatactaccagaagatccagcaatacctctcctgggcatatccccagaagaagttccaactggtaataagaatacatgctccactatgttcatagcagccttatttataatagccagatgctggaaagaacccagacgtccctcaacagaagaatggatacagaaaatgtgctacatttacacaatggatttcaactcagctattaaaaacaatgaatttatgaaattcttggacaaatggatatatctggaggatatcatccttagtgaggtaacacaattacaaaagaagtcattagatatgcactcactgataagtggatattagcccagaaacatagaacacccaagatacagtttgcgatacacaagaaaatcaagaagagggaagaccaacgggtgggtactttattcctccttagaatagggatcaaaatacccatgaaaggagttatagagacaaagtttggagctaagacgaaaggttggactatccagagactaccccacctggggatccatcccataatcagccaccaaacccagacactattgcatatgccagaaagattttgctgaagggaccctgttataactgtctcatacgaggctatgccagtgcctggcaaacacagaagtggatgctcacagtcatctataagatggaacacagggcccccaatggagaagctagagaaagcacccaaggaactgaaggtgtctgcaaccctataggtggaacaacactatgaaccaaccagtacccccagagctcgtatttctagctgcatatgtagcagaagatggccttgttggctatcactgggaagagaggcctcttggcattgcaaactttatatgccccaatacagggtaaagccaggcccaagaagcaggagtgggtgggtaggggagcagggcggggggggggaggttatagggaactttcgggacagcatttaaaatgtatataaagaaaatatctaataaaaaatactctaaaaaaaagttgacaattcaggttaaccatcctttgctctggactccacctgctcatcaccccaagcccccttcttcccttgatttgagatgtctcaactcccctggttcctgctcccaaagtgatcacattgcaacttcctcctgtgcctttcacagacacttttatgcttcttaactgatgtattccccaaaaatatcagtctgtagatccagagggaacttgtttatgacagactgtgacacaggtatggaagatatgtcaattcagacatgaataaaataaagaggatgccctaatgcaaagccccaacagttgggatgttgagtggaggagactggcagtggtgacttccattcatcctccctcaatcatgcatggtagggtttcatggggttgctttatacctttacttggactccaggaataaaactcgggtcactaggtttgtgtggcaagcacttttacctgcagagccaccaggtagtcattgttgttgagacagggttttgctatgcagctcagacttaagacttacaatgctcctgtctcagcctcttgtgtagacataaattctttgcatcctatttttaataaggattcaacctctcctgtagcccaccacccaacagaggtagtggaagaaaagttatcaggatatgagggaagtggacctgttcagcaatagttttttgggggtgaacttaaacttcttgggcagcagttcagtcccatagcagaacaccaaatacaactcaaaagttgcagaccagtcttctaggaaggcagacaccaggcacaaactggcagctatagtccagtcctttcagcaagcagacaccaggcagctgaaaccaccacaactgccaactggcctagggcaaggccgtggaagtagcaagctgtctcaggaatctcacaagcagttcttgttcaagcttctctcaatggcagtgttaccacaagttgagctcagcagtgcaatgtaagatgaaccaatacatgtgtgtctttagtgaagaatagcatggtggagcaaaccaaaccaaatctcagtgctcagctcccactgtctgtggggtcatatttacactcctccatcaagtgtcctttcacatgtctgctatagccaaacatcctttcacctgtgtctgcttcaggacaacagtctttccatgtgttcgcttttagcaagacagcctttcacctgtgtgccccagcaaaacaccttctgacataaattgccaaagaactagaagtttccacttcattgtatccttgtaactggaattagaggtgattttgagtcacccaacatgagtgctaggacctgaactctagccctcgtgattgaatagagagttgtgctggccactgggccatgcccacagtgctcttttgtacttcttttgagaattgtctgtccagttaagttgttcattttttattattttgtcattcccagaggcccatcagttgatcctaggttcttatccagttgacagttaacactgctcttcccaagaaagcaaaatgtattgtaagacagagaacaatgtaaagcaggatcagaaaggtagctatcctggataaaacctagcaaacgaaatacagggtaagtatgctcattattggaataaatagctccagaaagctttttgtatctcaagcacagacagtctactttcagctccatggctaaccagtaatcatgggtactgctttgggtcttggacagtcctgtcagcactgacaagaagaaagaaaaggaaagaggacggaaagtgtccagagcagggaaggagtgggtgagaggatacagtgagcaagcatgttggaaagcagaccatgcctccaccctcccccagagaaaactgtccaccaggttgtcacccattccaccttctcctcaccattttagatattgtcaaagattgaaaggcatccctacctagagaaaaggacagattttcctgatctgaactctgttctttctgagcagcctatgacaagttgctctctttccatctctccccactgcacggctttatgccagttgtgtttatgttcctttccgggcccactcaggcctatttcttcctgagcctgtaggcttatgttaatttctgagattattctttcctgtgtccaacctattttatgcgtcgagttgttcacttcccgctgtttggtttgtagcttccccttctcgatgttttacaatgtttactcctttctctgccccagcaaaggatgaccagtagctgtcagaggccagtgcagctactcagcaagagaagcaggttcccccgcagtctgcttcccctcaccttcccctccccctcctttctgactattcccctgtttagaagccccttattcaaggggagatggaagcaaaatatgatggaaaacagtacctcttgcttttgtaaggttatgagtaactctagattgttactgctgttgttttttaaaaaattaaaaagaaagtattgattaaaacggtatttttttctattttgtgagaatctcaactgtccctgttcttttttccccatcaaacaggaaacatgaactttggcactatgctctttttttccctcaaacctaataagatcagtatttcccctttgcctggaatgctactcacgcttcacatactcatatctctcttccaaaaagctcccccgtcattgtcccaggcctcctccatcttctagctccatcttctagtttttacatgagtctagggagctccctcatgttccttttccttttgagaccgagtctcctgtatccccagtgttcttgtgtgtgtgtgtgtgtgtgtgtgtgtgtgtgtacatatgtgtgtgtgtatatatatatgcacatagatacacacacacatatatatacatacatacacacacacatatatatacacacatactggggatatttatgtatatatatatatatatatatatatatacatacacatatatatatatacacatactggagattttatatatataatatatatgtatgtgtgtgtatatatatatatatatatatatatatatattccttgaactgatgttcctgtctccatctccaaggagctaagattacaggtattcaccaccctattcaggttcaggttctggttactgaaaccaaagctttgtgcatgtaagacaagtactctactcactcatctgtgaccccagatcttcctgctttctttattggcctgaaaacagactaagtccccaaagatatattttcaagtaggaagactattctaattcatccatcaggctttcagaacttctttgggtgtgctcctaaatgcataaagaacactctactttctagctatagctaccatttccaccaaacataatatcctagagacaacagttttatcaaaggtccttttgatgctgcccatacctggaattccttatttacaatattacttcttcctgaaaatgcctaattctttctattttcctggacctggaagaaattgaattattagcctgtcctttagtctcctaaaggtctatatgcatacaaagtcaataccatttgtgacagacttttctttttgccgttatggctttatttagttgcatgatcttcaaagtcattgcctatcaagtcaatattccagcactctcaacagctcaatgaattctatacatataacatcgtgaactgttatggacttgcgatttgttcaattcagcttcagaaggccaggaacagtatcctctacttctttgtttcccttgttctgttagttagaactgggtatattgtgctaatgtaaatttaagagctgagctcaacagttggacgacctagtttgaattttggctctactactgaaaactacgtaatcattggtatgtccattaacctctctcagctttctcccatgggaagaatatttaccaactgggttgttgtgaatattaagtgagtaaatatgagtaacgtgcttaggaaagtgccaagaacacagcagtccacaaacattaaccatttggttgagcagtcacaagagaaaggaaaattcagtttctgaattaccaatggatgctccttcgtgcctctgactataactttgccctctgtgtttctcatttcatgtgtgtaggttcccacgctgatgatggacacccagttctctgagttcacaccagacatcactcccattatgttggcagcccacaccaacaactatgaaatcatcaaattgcttgtccaaaagagggtcactatcccaaggccccaccagatccgctgcaactgtgtggagtgtgtatccagttcggaggtagatagtctacgtcattctaggtcccgactgaatatatacaaggctctggcaagcccctcgctcattgccttatcaagcgaggaccccatcctcacggcctttcggctgggctgggaactcaaggagctgagcaaagtggaaaatgagttcaaggctgagtacgaggaactttcccagcaatgtaagctctttgccaaggatctcttggaccaagctcggagctccagagaactggagatcatcctcaaccatcgagatgaccacagtgaagaacttgacccacagaagtatcatgacctggccaagctgaaggtggcaatcaaatatcaccagaaagaggtaagctgagataacctctgcttcctggaggtttaaagctctcagggtctacagcatcaaagcaagactcagtagttttctaacacttaacacttcaaacatatgtgtaggttgtatgggcctcatagatccatccatctgtgatgcagacagcttctaggtatttcctttatgaccaaaatgtagtcacctgattctttgaaaggaaagcattttaccattcagcaaatccttgtcaagtactcttctcagtgtttagaatagagaggctaaacaccagtcccacttgtttggagactttttgtaatttttactttagaggatttggctacataaaatttgtaaagataattatcttcataatttatgttatggtatgaatatacttgatcactgattattttacagttaaaaattctcttcatgtaggatattatgaaactatatgggtaactttctattttggacacaaataaataaatgaaatctaactttatcttcacttatattatctatggcaagtgaatttagaatttttgtgataaacaaaatccctctaattctttggaaatggagctagagagattgctcagtggtaaaggacacttacggctcttacagaggacccaggtctggttcccaatgcccacatggtgacacaaccatctgtaactccagtttcaggggatacaatgctctcatctgccctctgtgtgatccaggcacacattcatacatgcagacaaaatagccattaacagaaaataaataaatctttcaaaaactttaagaaaattttctctaacaggatgtagtttgcatatcttaacaagttgaggagaaaagtatattaatttttatttattagtcttatatatgttttcttttccttagtcttgttgttggtggtggtggcagggcagggtgggaaggtgcacacacatgtgatttttggtgttgctctggctggctttagacacctgaccctcttcctatttttttttaaatattttttattacgtattttcctcaattacatttccaatgctatcccaaaagtcccccataccctccccccctgctcccctacccacccattccccctttttggccctggtgttcccctgtactggggcatataacgtttgcctgtccagtgggcctctctttccagtgatggccgactaggccatcttttgatacatatgcagctagagtcaagagctccggggtactggttagttcataatgttgttgcacctacagggttgcagatctctttagctccttggatactttctctagctcctccactgggggccctgtgatccatccaatagctgactgtgagcatccacttctgtgtttgctaggccccggcatagtctcacaagagacagctatatctgggtcctttcagcaaaatcttgctagtgtatgcaatggtgtcagcgtttggaagctgattatgggatggatccctggatatggcagtctttagatggtccatccttttctcttagctccaaactttatctctgtaaatctttccatgggtgttttgttcccaattctaagaaggggcacagtgtccacactttggtcttcgttcttcttgagtttcatgcgtttaacaaattgtatcttatatcttgggtatcctaagtttttgggctaatatccacttatcagtgagtacatattgtgtgagttcctttgtgattgggttacctcactcaggatgatgccttccaggtccatccatttgcctaggaatttcataaattcattccttttaatagctgagtagtactccattgtgtaaatgttcaggtcctcttctttacatggtgaatattcctacccactgtgccacctccccagcctaattattaatctaagttagtcttatgccatcatctgatggaacaaattcaatctgagaatcatgtgttgagaacccataaacaagttgaaaacattttttataatttttattagatattttcttcattaacatttcaaatattatcccaaaagttccctatatccacccccccaccctgctcctctgaaaacatttttaaaggctagttttttcccagtgtctctaattccctaaagaaggctggtgaaaggatggggggggctaggggggatctcacaggccaaaggtattgaaagagcaacaacttctctatgagaatgggagacgtgctcatggtgctgcatgcctgcagttgcaattgaaatcttctattgttatatccacattttcccatttggggaatgcaggtagcactgtatttcagtatggagctctggatttttattttatttgatgcaggatcatagaagactatcttgacgaggagaacagactctgagcttgaattattgaacatgttataactattaaaacttaggggacccttggacttaaagcattttgcactgtcaaacagccatgagacgatgagagacagagacagaatgttatgacttgaagctcagttgttcctaacaggatcatgtttgagtgctttgtctccagcttggggcatgatttgaagaggtgtagaacctttagataatagggcctgggtgtgagaattaggccactagaagcaggccttatggtgacattctagttaccatttctcctggccatcgtcactgcttcctggtgccccagcatgagcacccaataccatagactagctgctctcatcactgtaccttcctcattcttgttaactgtgaccctctgaaaccaagaccccatataaaccttccctcccttaagatatttcatattcctttaggtattttgaaacgataaagaaaaaagaaacaattcttctctaaagggctttttctttttttattggttatttatttacatttcaaatgttatccccttcccagtttcctctctataaaccccccatcccatctccctcctcctgcttctatgagggtgttcccccattctcccaaccactcccacctccctgccctggcattcccctacactggggcatggagccttcacaggaccaagggcctcccctcccactgatgcctgacaaggccatcctctgctacatatgcagctggagccatgggtccctccatgtatactctttagttggtggtttagttcctgggagttctggttggttgatattgttgttcttcctatggggttgcaagctcctttctaaaggactttttcagtgtagtttcccctaataatcattcctacccggattctaatgggctcttcaaaagaatgtcatttggtgaaagactatgctccaaggaattcaacaaaagccaattccaaattataattttttacataaagtagtaggatgaggcagtttctgtctcttagaaacaggtgcagactattgaataatccttacataagaattcaatcttcaggtgattttatactgacatttgttggtacggaatgacttcttaaatgtcataattgcatatattctagcccattgtcacacatgccaaagacttccagagttgtatcattttgtttgtttcatttctaccgttaaaagcaagcagcatgggggtgggtgggtatgggggacttttggtatagcattggaaatgtaaatgatctaaatacctaataaaaaatggaaaaaaaaaagcaagcagcaaaggtgtagtcttcattttacaaatgaagaactgagttcaggaacttctcagagaccatctgacaagtcaggggacaatgaggctcttggtgcaaacttctcagtgtttttactctgtgacatctgtggaacagagtccttttgtggcagtttggtagcctagaaatttactacaaagtaattgaaggtgactgcaagttctttggcttttaaatcaaattttattagctaaaaatctcctacaagtgggcaagcagtttggaacaatagtcaataaagatcataagtgattataacctaataatttgaagaaatggttacatgtaaagatacaggtatatactgtcagcagctcctacacttcagctaatgcagatttgtaccgtgtacgtcaatgccatttaccagcctgtctttcttgattttaacacctctaagttgggctcagaatatagagccttgctccctctccatttctctatgccatacaaaatctgtttttggcattaaccttaaaaagatacaaaacaaggctacttggataatggactagttactccagttttctggaggagagtcaacatctcaattggagacatccagttaacatatttattagtatttctccttttaatttgactctctatctacttaatctatatcaattgccaactagttacttctagcaatagcttacaattggctaattttcataaggcacaggtaagtgaactcagttgggaagtaaccccatctcaaacaactgtgttaactgttagcaatttaaaatgttctctgtactgaaaaataccttccccactagctcttgttcttaagggttttctgattgctaagattagtccttgtcacttttaactctatttctaatcccgtcccatatagcaaacatactcgatacaacagtccccgtcttgaaatagagttacatcttaacagttcttaagtgcacgtaattatacaatcaaggcaaatagtgaaatgtaattggcaaagcagatccacatatgatgaacttgcagcatcttctttttctgatgtttaagaacagcactgtctgttatttgtttaagcctttgtctagagtagacttacaggtttctcttactatgacctgttggagtttattggtggtctatgctttctgacttttaacaaaatcttactaatttactgtggaaacgttacaaagcccatattctagaggtctgcttggattactatctactctctatcaggcatgtagagcatcatttgctctttctcgggtaaattgctcaccaaatagaatctatagtagactggtgacctctctctggatatttttcctgattttgttcaattaatcataatttgagcattattttgacaaaaaattataccctatctcctacagttcaaatttccctggcagcagtatatatttcccctagttgttactaagcccttactcaaagtgtagattatttttttaactttcatactggtctattattattattattggtaaatgttcttataaaatatacaaataatcttacctgttccactaatgataataattattattatccattaacatttcctcctggaatggaaaaataatttcttcttcctttctccaatcttgcaatctccagtctccttaacggaaattaggttcctgttcaatgcatcacctacttgctgctttgtctgtactgtgtacctagaatcttttctatactgggaaaatacgattcaatttgcttattaaacttattgtagcaaggggttacattatgctgcctactgtaatatataattaacccctctaattacaatttgtcataattttcacttgttctgtggatatttttgtcatgtatctgccatgtcagttggctctgaaatcatctgtattaaataccctcttaatctttttaactattatgtgctttaagattctatgtaaattggtaggtaaaaagaccatactgcctatccatggaagtaaaaggattggacggcctaagttggtataataggtgaatttcttacacacttattcagttgatctctgtttcagtgtgggggtgcttcagatattatgttttacccttctgacatgtggagggttattgtgcttcaataccagtctacatcttatttatatttttacctcttaataacaaatattgctaggttaaagttgtaacagtcctaccacattaagcctcccaagtatttgtcttaaactcatttacatacacgaagatgtgtactatccacttccccttgtagaccattttctccaggctgatgacataagcgcttggttttccattgatgaagcctttgttagaccctgtcttgccattctagaacttctctctttgctttttggtacaagcttcaatggtccatcagaggacaatattgcaaaaaagagtttcagcacacatcagcatgtgtgggttggaacccagcatcagtctttccttcggtatcttgaccctagaattctcaaaagtttggccctgggaaacctggaaagctttctttacttttattgcctggtagatgttgcacttacagagttatttaccttactctgccataaaaacctccctctttaaaatacaatgtgccgatgttgtactgtccatgagaaagtactgtactgccatgctggggaacactaactacccttggaatttctcattctcacagagcagtgacgctgctatgagtattggtagagttcatccggtcttcattctattcttaggtagagtcttcttctccttgctattattctgtcttatcatgaagaatcctaatagtacaggtaaagcaagaactatataactaaagccagtcttttgaattaaaatatagaaaaaaatgattttgcccccccaaaaaatcaaggtttacctaatctaaaagtttttaaaaatgcaactatgctgaactagaataaaacagctgtttctgaagcctaagggggggtgatggaaaaaaaatgatgatttttcacatgctggctctcactcactttccgtatcatcctttatggcaggaagtatatccttgtatatctcgttgatatctatcatagtttcatccgtgtcaaggattaggtcatcgtcttctcttactgaaaggattgattctaagtcggaaagatccgcgagatccggtaaggaatcttcctcggcaggaggtgcagctgcttctgcctcttctgctctagcgttctgttgcacggaagggacttgttcctgcgagatgaactgtagtagatcctcagctattcttattagctgggctacacaatcaatcagtccggcaaccagtacagggatagacacagattccatggctcaggcagggagtgtgattatgatggtgatcaagtacagacttagtctagcggtaccacaaacctttttggtggtgttggttaacctctcaaaaaaatgtctggactagtagtctattcctattataatcaccaccagattgtcacttccaagacaaaacagccaatcagatctaataatggaaaaagaaaaagaaaaaaaaaaagatcagtatccacatgctccactatgctcatagcagccttatttataatagccagaagctggaaagaacccagatgcccctcaacagaggaatggatacagaaaatgtgatacatttacataatggagtactactcagctattaaaaagaatgaatttatgaaattcctaggcaaatggatggacctggagggcatcatcctgagtgaggtaacccaatcacaaaagaagtcattagatatgcactcactgataagtggatattagaccagaaacatagaacacccaagatataatttgcaaaacacaagaaaatcaagaagaaggaagaccaatgggtggatacttcattcctccttagaatagggatcaaaatacccatgaaaggagttacagaaacaaagtttggagctaagagaaaaggatggactatccagagactaccccacccagggatccatcccataatcagccatcaaacccagacactattgcatatgccagaaagattttgctgaagggaccctgttatagctgtctcatatgaggctatgtcagtgcctggcaaacacagaagtggatgctcatagtcatctataagatggaacacagggcccccaatggagaagctagagaaagcacccaaggagctggaggggtctacaaccctctaggtggaataacagtatgaactacccagtacccctggagctcatgtctctagctgcatatgtagcagaagatggcctagtcggccatcactgggaagagaggccccttggtattgcaaactttatatgccccagtacaggggaatgccagggccaagaagcaggagtgggtgggtaggggagcaggatggagggagggtatagggaattttcgggatagcatttgaaatgtatataaagaaaatatctaactaaaaatatcagtatctttgaccatttattcccactacatgttatagctacagggtatagttaccaagactcatccaagaggttaaatgagttcttcctttttgacagcctaagggggatctagtgcttctcttttcctttgaatttcccatgatatttatttttgctcagggatttcagcataaagtgagcataggtggttcacatatctctcctgaacacctctatgagaaaggatatatcatcactcagagtctgtaactgtttttattagtttctttgactcgtggccatttatatctgaactgctaaaggcattggtgattttcaaatattaactcattaaagtttccaattgttctgcatcttggggacagatgctttagtgtaataaattgtaaaagctcttcatttattcttattaattaggctatatgatcaataagtctatcaactcttagaggaactgaccctggttccacatctcagcagtcatttctcaatagataaaatactactaaaaagctataacaagttaggttatcttggtgatactgaatcctgcagaactgacaatggctactccattggtttagataagaaaggaacatgttcatttgattatggtggtgaccaattatggcatgaggcctgtagtgctacagaacttcttgaaaatctttggggattgtgtaaattgccaaaatttgcacagttgttgaatattcacacaacaggacactaaccataaataaaaaagaattgtactcctaatagagtcgtgtataaatatgaaaggtattatacttagtggaaaatagaaataaaggaatacacactgcattctgttcatatacaattcaataaaatttatggtgcaaaaaaacaagagaattttgtgtctagggaaatgagaagtaattagagacacgtaagtgaactatgacagtgacaatggttatattttacagagttctaggttatatgagaacatgaaattgacaaatttcattgattgctagtgttaaaagttgtgcatttcattgtatgtcgccctttcttaagtaaccaaacagaatcaaacccctacctgaaaagcatgtcagatgagatggtatgcctataacattgtaacaaattctcaaacttatgaaaggaaggtctattacatataaagcaccaagaaatcaattttacccattcgtgcatctaatcctcaaaataaaataactgtataaagttatgactggaaaaattgaaaatcattaggtagtatatgagttatggccagccacatggtgtggaatagaagttatgccaggactaacttcgaaagacctatgtcaacgggcacacatatgggtgtctatacaaagacatttgctttaatgagtccagagctggcatctcattctcctacacagaaatagaattgaggatgttacttcacttgatatccctataaatcagctaaattatgagttgactgtgtctaatgctaagtgatggagagaagtcataatcaagagtttcatggagcatcaaagatgtgtgtgttcgttcctgtcctctggtgttctgaatgtctctaaatgatcgggtgctactcacctgtaatcgaggcaagatggacaaaggtgttatcctagaaaatgatttctggagttctgctttcaaatagtccacaaatgctcctgcaacaaccaaaaacatataacacacatgcagatggggtggggggaacaaatcacaaaatcagtagacttaaggatatcagaaaggggtggaagcaagtacaaactttgtcatgggagctgacagtagccagcattttcttttctgtggcatttgctaattctgggcacaggttaaagataaaacttggaccaaaccagaaggtgactaccaaagaatgagaaatttcagcgtagctgtggcaaattgcaagaggctagcataatggaagcctggtgtgtgcatgggcagtttttcttacctggaattagctgaggtctaggctagcccctgggcaggaagctctcctcacacaggcacactcctcaaaaaggtacctagcattggaagtgagaaggacatagaagaggccagtgaatcaataaactcaagactacttttgtaggacactttgagcaaacttattctaaaacgtacaagtatatacaaagagccaggcctcttaaggaacaacatgtatactaccagatagcaacctaaaacaaaggaacacatacattgcatagcccctcccatatgtggaagctaaaaagtgtcaatttgactgcagactactgactactagaagttaggaatggacacagggaagggggataaaaggctagataatgggtaccaaaatgaagttagatagaaggaacatgtatgttctcctatggatgccatggatttctatggcatagtagggtcacaacaaagtgtatattttctgagtaactcagaaaatagataatagtaactcaaatattccaatcttaaagaaaaaacatgttaattaccatatttctattagtgcatgctatctaggaggtagtggcacacacctttagtcctagcacttgggaggcagagggaggcagatctctgagttcgaggccaacctggtctacagagtgagttcaaggacagccatagttacacagagaaactctgtcttgaaaaaaaaaagaagtaaacaaaataaaataaaacaaaacaaaaaccctaccagtacatgtttatgtacatatagaaatattatgttgtatgcacatacagaaattgccatataccacgaagttgtacaatattacatgataataacattaaaaattaattaattaaaaaataaaaatagcaaggctaaatttatggctacagagtttaaaatcacatagtactgacacatggatagacaagcaatagaaccatgaccatgatcacacatcaaatactatactatttagaaatgggtagaagacttaaatataaaatataaaaccaatatgtagctcaaaccacaagagaaaacattcgtgatcttaggaaaacaaaatttatcacatacaccgcaaattagcaaagagctctcatcaatcaaaagatacctcaagagagttaaatggtaaattataaggtagaaaaatattcacaaagtattcccaatagaaagttgatacctattctatgcatatgtttttagactcctataaatgaataagagaattcaaatatcataatcaagacaaaataaattaactacttcttcatagaagaggatatttacatgagcaacaagtacacaaattggcatttgtcactattactcatcagataaatgtgcattcaatccataaggacatatatcaaactgcacaagaataggtacatctgaaaggactggtaataagaaatgcagaacaatggaacccctggagctcacatacaactgcaggtaagcatgttggcttgtacaattactttaaaaagctacggatattatctattaaagctaagtctaccttcatctcatgaacctgtagtattactactatctacgcaaattaaatgatgtgaacatctaccagaatacatgtaaaagaaagtaaaaggaaaccagaaatgtagaagtatagtatacatcccatcatttcatttagatgaaatttaaaacaacggttagtgttgtcagcattgtttgaccagcctgtcattaataggagggcaacgaagcataacattaagagaaggttcctcttgctatctatcaccttactgacattctgaccctccctactgggcactaacagccctcctcagtatttttattggtatgcttccgctaaattttgaacacacaaacttcatggtcctgtcctatctgccaggtgtttgatgaatgattttgctcctggagacttgggctttctggtttggggatacttggctttgtgctctatgtaatctaagcctgagctgctcatcttgattgtgatttcgtgatacacatgccaattcttggaagttcggtggcaagcaaaataaatccttttaccttaaaaaaaaaaaaaaaaaaaaaaaaaaaaggctgttagccaaattctagacatttctcgacctgccgtggtctctgaaacacacactccaggcctgatttttcagttgtgctaccaataaatgaagatcagaattaaaaaaaacaaaaacaaaaacaaaagaaaaggttcctttgcctggtgtggaatctctattttatgtcaatacaatgacaagaggtcctgattgtcagacagtttttaattgatgcaacgtgacataacctgcctcttataaggtagctggaaaggagctagagcaaaggtcatctgactgacaactggaatcgttgcatctctgtctcacttttgtcagcatggctaatgaaaagccaccattttttgctcactgagtcttagtctgctattaggcactgcttccatctggaaatctggcaacaatgggacagaaaaggagcaaagaaatccaaagccactgggcccatgtttatagtcgataggctcccctggggcaggcaaggtgaattacttcatattcaaggggaccagagggagttatatgggagtgattaaactgtgtctttggtgagtacaggtgctagttctagattcacaaatagacttttttttctccctctgcagtgttgcagtatcattttgtcacaggcatttaatttaaatgcttaaaccaacaacacttcctttaatggctcctcagctggtggtgggattacacctctcccatcctctgtgctgggactttatctgaagcccaagcagggcttgtgcaacacaaactgcactcagtagagaaagaagaaaagtaaataagtaaacctcaaagtggggtgggaaagaatgagaggggagcagttgagagggtaaatgtgttcaacatacattgtaggaaattctcaaagaatgaataagaaattaatgttattttttaaaaaacacacttctggacacatgtaacttctctttgccctctccacattcagggaaacatcaagaagaccttgatgagtcagcatatggggggtgctggagaggtgggctgggagagggtgggtgggggagcaccctcacacaggcaaaggtgatgggggagggcagatgtgggatggggggcttggtggaggggtaaccaggaagtgggatatcatttgagatgtaaacaaatggaatgatgaattaaaaaaaaaaaaaagacctaccccatcatttcgatatagcaggagcatccctgggagatataatgaaaataatcaacaagatttgcccttgcatttatattttaaagttaaaacttgttgcctttacaaacaactgaatgcagtaaggctatagaacctgacatttgagatgtctatgagccatctttaatttttcaaggaaaatggaaagaagtgtggagctgaagagctaacacagccccttcttgaaaagcatgtaaaaaattaaaaacagaaaccaaattaagaaggagtagggatgcccttgtagtcagcttaaagtaagttcttctatatctctttcttcccctttctaatcagttcattgctgcagagacactcttagactctcgcttaccctgtagaaaaacaacttagatactgccacaaacagtagtttgcaaatttctctttgtcattgtgttagtcaggcacacagtgtttcaccatagtattcaaccatggggtcagccaccttatcttggcttagggaaatataaccagacttgtctctgaaacttagctgctgtaagagtccccatagaagcctggaaaagatgtaatacttccagaaacagttttggccttcaaatggtaccacgtgcaggagaaaaggctgaaagtgagggaaataaaaacataactgaacatgataataaaaagagattcgattcctaattcttcgttcagctttctaagagggaaaaagaaaagttgcaagggttttcaatggagaaaaaaaattagtctatttggcagataccaaaatgatagcagtgccaagcagacttgtattttcatcctaactttactaagtgcagagtttccctaagctatatttactttaatttccttatctgtaggataaagagaacaggtaaattgcatgacttagttcacagagtttcgaatgttcctagttcatggtaagtgtcttagagatgctagttttttgtgctatggaaattctggcatccaggaagtaaggcatggtgcattctggctacttctagtgactcctggaaggtgagaaaaaaagatgcctgcaaaacctggaagtaataggaggtataattcatatacaaataaaaaaaaaaaaaaacaaataggtaacgacttcagactttgataaagatgtgaagagaaggcactctctaggtaatgaaggcatcttacagtatgtctaacatgaattcaccaaaactagttcagactttccaatattcctatgtggcttgttcaaatgacaagagggggggaaagtggcatcttaccctttaccattcctgcctgagttttattctaagtttcaagaacccacttgacatgtataagactgagccctggagttctggctgcctttctctttctgtaaatgccagctggccaagagagactgcattcatccgtttaccaacaggaatgatcagagacaatacagtcctcctctctgcctgaaaatgtgcttacgtcatctgccaaagaatgtgcctttctggttttagtggcttcaaactatgattccagaactccactcagtagctcatcccagggcttcacagattcttccttcggggaaccgtgacctcaaccacgttcacatacattaacctacagtagtcccatcagacagatatttttcttgcacaaatgaaggagtgaaaacccaaacgtatttcatagggcatctcattgaatcttcaaattactgtgaggtcaatagggtaatgggagagagaactatgtctccactatgtatttaagaaaataaaaatccacacaagtcaagcaatccaaggtgcacagctagaaaatggtaaaagctggaacctgatttgctgctctttcaatggtttgcaactgcgaactctctaatccctggggaaaaatcttccaaataccttgttaggacagatacatatccaatgctgcaaaatctaataacatatgtcattaatctattagaataaaatcataaaatcatatatagaccctataggtagaactgccaagggaatatccagaggctaagattcccattttcagtctctccaagaaagaaaatacatttggggctggcaaggtggctcagtgggtaagagcacttactgctcttctgaaggtcctgagttcaaatcccagcaaccacatggtggctcacaaccacccgtaatgagatctgatgccctcttctagtgcatctgaagacagctacagtgtacttaggtataataacaagtaaatctttgggccggagtgagcagggactaagcgagcaagattgaccagagcgagcaggggtcctaaattcaattcccaacaaccacatgaaggcttataaccatctgtacagctacagtgtactcatatacataaaaataaacaaataaatctgaaggaaggaaggaaggaaggaaggaaggaaggaaggaaggaaggaaggaaggaaggaaggaaggaaggaaggaaacacaacttgaacagccaggctatccagtggaatgaatcagctaatttttttccaagccactctgccttccttcactcttgcatgatacaaaacatcaaacagttctctacaggaacataataacacaaaagagaaaattacagtacaagtaacgatctgtgacctaaagtaaatcccaatggcctcttccgctataccactaattgcctatgttaaaataggcaattttcccattgccactgccacccaagaagggtggaaactgtccttttaaatgcaccactaaaggggaagctggtatttatttggcaggagaagaacagaatacttcatgcttggcatactgctaccattggcatctaatccacaagctgctgcattctgcaggggtggcaactattttgtcctcgggataatatagtggaagatacagttatatttatgtacagactttttaatagcaatgcctgtcacccctggtaaagctcacaggaggtgacagaaatggcacagccagaaaaaggcaagccaagtctttagtgccttctggcagctgaatccacagtatcaaagaagaccacctggatctttttcttgggttctagaacattactatacagggaagtatacagtaactgtcccaagagttactgaagtaagccagatttgtcttctgtgtccctccccgaatcacagtaaatacaagggctgaaagttaaatctactgccatatcagctctgatgaccatagtcatcaaacagcaaacagttgcataaatgaacttacactgaagacagtagtgtcaacataaatacaaactggtaaatgtttgatagatttctaataatacataaatggaaacatcattgatccatgagcacatggcaccctcagccacacgggcatatacagaagtatttgacactggcaaataagaaagggtagaggaaagggatttttttttttaaagaagacagacactggggtcagagagacttaggttcaaacctaaaagtttccttatcttgacagttcacttaagcttaccatgactctcagtccttatcagaaataaatatgataacgctttgggcaactataacctttatactttagacaatttttaattgtgggaaaataccctaaccatttaggtaaaacctgaatatgtgtgatctgagttcagatacgcacttaaacattctctctctctctctctctctctctctctctctctctctctctctctctctcttgtatttattgaggaaagcattaacttcctgtaaatttgtgttttgtatcctgtatactgaggatgatgaacatgccacctgtctcaatggatgctataatcatcaagtgagataacttttgaaagatctcttgcaagtcataaggttcaaggcaaaaaaaaaaattaaaaataaaaaaactcaattcaagtagctaaccaaccctttttccagggtttgaagctttacaggattcatgatttttgtcatttaatgaagaaagtcttaggcaacctgaaataatttgaacactgtagtcatcactaaattttaacttgactgagaccatgaatacgatgtaactggccttaagtagacataggtcctagtttaaccttacctattcttctgaggccttaactatcctctaattagaatttaactaagataccccttggaaaaaaagaaagagggaggagagaaaaagagagagagagagagagagagagagagagagaagaagaagaagaaggaggaggaggaggaggaggaggaggaggaggaggagaaaagaaaagacaagaaaagaaaagacaattatgcaggctcaaactctttctgtatctgaaattaaattcttaataggccttctctttctgttctgtatcctggcaaggtgttaaatatattctgaatagatgttaaccagacacaacccatgactaggctaactggattctattaggacttacctaggcttaggcttggctacctcttaacttcactaagcctggaagagaacctccacacaggaacaagtatttagggccataaagggccttaagggggaaatctgggagaaataatacaggaactgacagtagaaaagctctttgtgtggagaagccatgacctgaggatgggttggtcatgcataggcataagaacccccctaagaaccctatggttggttcgagtcattgtgaaggttcaggctaacagagttaagactttaagcccttccgctgctgccaccgccaccacacacatggcccttgaaccaagacaaaaccaactaattctgtcccagcgctctccctctgaaagggctggctacagtaaacaccagccacaagctcctttacagaccagaccagtttttaagccaggactgctgagtgcgatctggtgctggctatcctggagtaggaatgactaaccaaaacctgactgacaccctaaatgggacatgtttaaccagacctagacaggtcatagaagaagcccaatctgcagaaaatgaaaagggctgtaccagacaagctaatagagcaggagctcttaatggtacacactttgcctacccctgggatgtttatacttgctatgcataagacagtggtgaactggtattcttgaccccaggcttaacgtatgttcccaggaagcaagagttaagcaattcttacatcccttagagtcaagaaataagagaaccctgtgctcttacctgtcctttggggaatggttcagacagggtctatgaccaccggtgtggccacaataataatccaccaagttcaacatagccagctctctactcaaatcacaaaagacttaacagttgtttaggagagcagagtctcttggcaaaatcagatagattcattgacagtagtgacccccagaaaacatctgaggattagatttgattaccactgaaaaggaaggcatcctcatggttttaaatgagggctgctgtttttatgctaatcagtcagaattcatatgggaaaatgccaaaaggttattagaaaggattaaggctaggagaaagaaatggaagccaaagaagtacaatatagacaacaagggacctggctggctctgctgatggggcttcatctaataataatgctaggacttctattaggaccatgcatcttgaacaaacaccctggccaggtttatcagaattcaaatgaaagcaattaaaaaaaaaaaactacaagtgatatgccaggaataccaactggtttcgtcgagataggttcctaaggcagtgtgaaggtgaagaggaggaaatgatgcagaataaggcaggaaaagagcaattattagatttccctaagcactatttgtactgctcagttcctagcatgatttcccttgccacctagaacagaatgacctgaagaaatagctgaaacaatgaattgttgcccttaaccacctggccaccaaagcttacacctgtcagctttttttttttttattacgtattttcctcaatgacatttccaatgctatcccaaaagtccctcataccctccccccacttccctacccacccattctcatttttaaagactgccttgaaaaacaaaaggctgcctgccacgtaggcttccctcaaatagcaattgcttgctcaccccaccttgtggctttagaatttaaaatgagaactcaaactggacctggcacagaagctgctctggaactctcctggcttcagctccccggtgaagacagctcctctcttccacgctcagtgatatcagagtgctattccagagagattcgcgcaacaccttctctggatttatagcccagctcagggactaacaaagttttcacaagattgcaactgagatttagatctgggtgggattagagtgggttctgaataacctaaactctgtgtacatcctagtcaaactttaatagggctggctagggctttcaatgtcttgggttctgattagacttaaatagaacctgttgaagcttcagtgtgagagcctcattgggccttagctgaaatgatgatgcttttactgagcttctgccctgatgagagaagaccctcagtggctgactaggtcttaagttacttaactagcccttaaaattgtcatagacccttgccatattctagcaggactcccaaggcttaatataaactgtagctctaactaggcttagcttcagttcccacagcggtattagctgggatttggccctggctaggctttaactggactgtcaaggtgttagctgggccagaataacgttacaatttaatcttaactcagtaaggcctttatcaagatggctaatcttgaagtattcttaagctttgggtgttccttaaaaaagacttgtataagatttaactgtgttgtcaccatgctctcatgacagtcacgggtgtgggccctcccatatatcgtttctgtctaaatcttaacatttggccttgaatcagtctccaattatgtaagtactaccaggatttgactgcacgtaaattaagtgtagactggaattaaactagactttgtctttatttggtgctaccaaagactcaacaacaccaaaagctgacaaatacactttaatacttaaaaaatagtataagtgtgttttaagccaaactagtttgctcttaactcgaatgagacttcaactacaccctaataggactctgacagatctcagtggtgctgaggccctgctaattatatactctcagcataatttgagccctcagtaggccttaactgggctctggccaggcttaacctgggctcagtctttagttaggctttaagtaaaatctaacatttaactacactgaacctctgcctagaagttaaccaggctgaattacactgtggctacacctacaccctggttaagtctaaagtcaattcaataacacgatgtggtttctgggactttcctaggacataattaggctaaaactagaaattaactaggcttaggcttcggtgagggcttaacgaggctctgacttagactaaactaagcttgggccccacctatatcacaaatggcttctaattatatttcaactgggtgtaagtatcagctaggctttaagtagccccctaattgacacttgttttatggtgagaccctatctatgccttaaacagacttagttatacctgagtaatcactacattcacactcacgttatgccttaactgacatctggctacacggaaactagtgctttactgagatagggctaaatcaggctcaggcactgacaagactttacctcttttctagcacataactagagctatgcccagtgtagaactcagctagatttacttacagttcaatgagggctagtccctaggcaatcttaactgaacccttaagagaactaaactgtatttatgaactcctgaggctttaaataaactcttaggggaactaaagtacatttttgaagttgcaacagtttaattacattatgaatagcacttaataggtttatttcctgagagaggggttgtctgggctcctgctagatctaaattagccttatgtgctcaaaagagcttatgtctagtctaagtaaacctgaatgatttggcttctaaaacaatccaaagtagcattggatcctggaaaggcttgaactaagctctaactaggacagaaacttttgcactagctaggttctaaatgcactctaactaacccttaattaggcttagtccctgccaagaccaaaattagactaaattataactgaatgaggctgaagcccaaactatgtcttaactattaagaaagcagaaccaggcttatttcttgcatagaatctaactagtctctctatatacctaaacaggtattagaccctggctagggcttaactgtgatctctaacctaaactagacttaagtgttagctacacattctttgggctctgatcaataatacttacatagactgaggccccacttagacttcagctggattttattctgtgttattaactagtttgaggcacttgctgactatgaactgccctctaataggacttaagtgtgctgtacctcagatttaatccatcttagaccctcactggggtttacataggctgtgattagagcgtgacaaagtttaccacctggctagaactacaggggatcttactagacccaaaatagtcctacactctgagtttggcaaagcttgatctagcaattataactatctagaattaacataaactccaaagagctcttaacctagcaatctagcttttaaggggacctatgcttcaaccatacttgaataagatttttgacaagccttagcaatgctaaggttctagacaagatgaatgagagtgtgagcagattgtgtgtttagtacctatctggctatgtcttagctcagttaactagattttacctagatcataaggcaatgtgtaagtcccaagcttcatataggcacaactatatttaactaagttttgacttctactaaactatgcttaatgccattgcaaggatctggctgtcctgtgactgaaagtaggatgggaccctgaggagagctcggctgaactgtgaatgaagctaaaataaacttagacgttagccaaaggttagcagagctctgaccagcctgaatcagacataagccctgactagtgtttattaggagtcttaactaacagtgactagctttgttaagacttatcaaaacctaaacttggttaagatgtaatcaagtctaattaaattctaggcaggacctgggcctactaaaatattagagtgcatttaaggccgaggtagtctataagcctagcgtagttctagccagaaccctattaagccctaaggctagataaggtatacagagaatgtccaaatgtaactaggatataataaagtcagtggctggagctacagcacgagcttaagattattttttttttttttttgctccttttgctcttagagaagactcaattttggttcctagcatcttagcttgaggatacaatgtcctttgctggcctctgcaaatacctgaattcatgtgcatatacctacacacacacacacttaaaaataaaagaaatactatcaaaaccttaaaaccttaaattgactgactcttagacacacacacacacacagagagagagagagagagagagagagagagagagagagagatttaaaaagaaaacaaatactatcaaaaaccttatatgatctgacccttaactacactgtgaccctccctacaccttaactacactgtgaccctccctacaccttaactacaaacattctgttacatcttaatcaaattgattaagctaagtcttaggtgactgtgactatgtttatgaacttgttaagatttaacaccatgacactcaacgtttagttacattaagaccctagcaagggcttaacatggcagttaataggcactggctagggcttttctggcattggcactgaatagatctaaactaatcttaaaacctaagatttaccttgtttgatattgtttgcttttggagacagggttttagtatgcagccctggatgaactagaactcactatgtagaccggcacagatctgcctatctctgcctctgcctctgcctctcctgtctcctgaatactgagattaaagtcatatgacaccatatctaccctttctctttgggctcaaattcatacacacacacacacacacacacacacacacacacacacacacacacacacaaatctgcttcatgagtgctcagagtgaaagtatatgccactacccctgctagggggtttatgtttgcttgttcattccctgagaaagagtttaattatgtagccctttcctggctagaactcactacgtactcaaggctcaaactcacatctgcctatccctgcccaagcccatgttcctatccattcctctgctcttggcccagccccagccccagccccagccccagccccagccccagccccagccccagccccagccccagtcccagccccagccccagccccagccccagccccagccccagccccagccccagccccagccccagctccagctccagctccagcccctgctgttgccactgctcatacccctgtaccctgaagttgctgttgctgctgctgctgctgctgctgctgctgctgctgctgttgctgccgttgcccttgctatttcccaagtgctgagattaaaggcatgtgtcactttgcctacctccttttttttcctttgcggtgctgaagatagaacccagagtcttgtatacattaagtaagcagtctactgctgaactaagtcctgagaacttctctggttttgaaataggatcttactatgtagcctgattggctgagacgcgctatatatcagactggcttcaaaaccccagcattcttgccctatcagcctcccaggggctggaattgcagaagtgtcaccacgcctatctaaacagtttctaaccaaataaagatcttcactataggttaataatacttaaacacatattaattatacttaggacctagcgtcactctaagaccttttaaaatcttaactatactttagaacccatttagaactaaacttttaactgtgatatctacactttaagtaaagttaaactttattcttaagtagcctaaataggtcttgattaggcttaagtccttagagttaacaagtttaagtcctttccttaattcaagacttaggctttggctaatttacagtcacttttcattaaggataaattcagttctagattccttctagccctgtactcccaccattgttatctgcccttacctctgcaagttggcagtttcaggctgctctctgaatcacacatagaaaaaccaaaagtataaccatcttaccccactgcagcaggaaccaagactgcctctgactccacttcacccagccatgtttataagtgtgacacaggaagcagttatgctatctctcaagaaaccaagggatgtgtttttctgtaacacccaacccggaagtatatttttatcccagtcacatgttctgtacttttccaaagacacttatactttgtaataactttgtaacagatatggaagacagtgttcccatctacggaagacttagctagagcttggatgtacaattcggggttaagaagaaagacagctgacagactagacttgcagtaaagagccttctgtactttttactaactaaactctaagatgtgtagaccgtctgaaccctgtgaagtgagcatatcagactcactgtaatgaagtaggcggtctactgtgtacaactttggcttattataggatattgaaggtttctgttgatcatgaaagaacaagatgataaaatccagaccagagcatgagcagtcatccatatctaatggtttcatggattcttagtgataaaagactggtcatctgttccaaatccccactgcactgtttggtttagaagtgtttttacatatctactttttagttaaacttatgttttctttcgttcatttcttcaaatgctgactggtttattggactttaccatagagcaataggaagatgcacaaaggaatgtatgaagccttcagaatgtgatgtaacaggacaagagagctgagggttttccaaatccttttcccaatgaagctcagtttgcttgcattctctgtgaccagaacaaaataacaccttccataaaccatgggtcaccattaaggtgacatattaaagtcccagtgacacattttttttcagttttttctttctttctcttttattctttttcctttctgcaatgttcacataggattatgatcaccagatgaaagagcaccagaaactctccactctctgttatatttgaccaataagatgtctgtacatttttttctacatcttttcttctatgtggtttgctttttagcccctgaatgccttggattggttaggttggctgcttgcttgcttggtttgttggttgtttgtttggtttgatttgatttggtttggtttggtttactttcaagttttattgttttatcttgttttatttatggttttgagacatggtctcatgtaactcaagctgacttcaaatttactatgtaaccaaagataaccttgacttctacatctttctgttccagtcagagtattatcattataggactatgccatcattcccagttatagggtattattttcttaatcatagccacctgccaccactcctgagtagcaaccaccccccacatttactaacattatatcatcacattctaatttattgttctcagtgtgtgtgtgtgtgtgtgtgtgtgtgtgtgtgtgtgtgtgtgttttaccaaggattgaacccaaagctcctgaaacttaggatagcactctccacaagctatatttctagccccctcactccttttttatttcttctgcctcagcctcagatttctcattttagttagtttttttaaagctggtatacaaagtaatgagttcccatatacagttttcatgcattctctttgttgtctggtttgccccattctcaccctccaaacctctgttcctctcctccctccagtgcctctcttctatcttatatattctattacccctttgttttcaatagagataggcactcctcaaactcaatcctctgccttttcttcacttacaccttcctcttattttattgatttctttacacaaattttcatttcacaaggagtccgaggtagttataatgccatgatataaatttgccccacaattatcacacccagttctaaggtctcaactaccatctctatgcaagcaactttcaaactacctctgcagctctgttggtccttctacctccacagcaaatctatatgtctgaccacctgtgagacgttgtctacagcatcacaaattcagcatagtctcagcttatatgaccaactcattctattccccccccccacacacatacacacacacaccaggtaattccaagttttggagctgagatttcagtgttctggaaatgctctctaaatctcaatctactatggacaagttggtcgtactaactaaaacaatctcattcatatcagtctgaaactaaggcttcctcttagtcgctaggttcccctatgtcgtttgttaacagaggtatctttctgaataaacgtcaactcgtcttcttccatttcttcatatgactgactgctcatttctatctccaaatatctctttcccatttcttcttttgagccccagttttcacctggaccatcaaaagggtctcctactcaatccttctccctccagtcacttgatcaccccactctcattcccttggctaacctcttttccatgttgtaaaacatgatccttcacacagatctgatcatggacaggtggtcatcatttcattgttatggaggtcatctatctggaaccccaagaacagcactaaatgacatttccctagccttggagcacaatgactacatgacatgttaaataacattaagacactaaacattaatataccaaataaattatctgagatgtaagcaaaatgggcagggggatacaatacctcaagaagccagggattctgcgtttgtcaggtccagcttttcttcttcttctttagtcttctggggcatgagagaacaacctcagttaaagcaatgagcaagggaatgagtgttggagaatatatatatgtatgtgtgtatatatacatacatatacatatatacatctttgatatccatttgaaacagattcaactcaatgttacaatctgcagaaacagagatgagttcagagaaaatttcctccctcctccctgctgccttgttgtaagccagtacccttgtagccttcctaacctactaataactcctgttgcgagaccattcaaggctttccatgcaaaactgtttcaaaaaggcaagaattggcatcatcctgagtgaggtaacacattcacaaaggaactcacacaatatgtactcactgataagtggatattagcccaaaaactaggatacccaagatataagatacaatttcctaaacacatgaaactcaagaaaaatgaagactgaagtgtggacactatgcccctccttagaagtgggaacaaaacacccatggaaggagttacagagacaaagtttggagctgagatgaaaggatggaccatgtagagactgccatatccagggatccaccccataatcagcatccaaacgctgacaccattgcatacactagcaagattttattgaaaggacccagatgtagctgtctcttgtgagactatgccgggacctagcaaacacagaagtggatgctcacagtcagctaatggatggatcccagggctcccaatggaggagctagagaaagtacccaaggagctaaagggatctgcaaccctataggtggaacaacattatgaactaaccagtaccccggagctcttgactctagctgcatatgtatcaaaagatggcctagtcggccatcactggaaagagaggcccattggacacgcaaactttatatgccccagtacaggggaacgccagggccaaaaaagggaagtgggtgggtaggggagtgggggtgggtgggtatgggggacttttggtataacattggaaatgtaaatgagctaaatacctaataaaaatgggggggaaaaaaggcaagaatttacttgagggtcatcattatctcttacaggaaataagtaccccatctggataaaggaggtctcccaatataacagaaaacctaaaaatttaactttctatttgttcttagacactggaaagagttgagttatttgtgaagaaattcctcttgaaattggaaggctaacttccacagagacatgagcataactgtaaccagcaaaactgtgacccaaagatttgcctctagaatagagagaatttgcatagtgctcattacttctagaaaattaagaggcacaacccttccccagagcaaactccccttcttccctatctggtgccctgccatcttttttcctcttggcacatttttccttaacttttttttctctgtcacttaattatttcaaaaacaccttacttcccaaactaattctcccttcattttaggtaactggctctaacctaagacagggagaaacatacctacatacccatcacaaataaacatgtatcccttcaatgtttgtttaagttctgtgagtcaaacttcacggccttgcacatacatgctctaccactgagcaaccctctcagccccttttattatttaataccagtaaagcccttctaaacatcgaaggcatcttagccccaaagaaatttagagtctcattagggaaagcaaccaagcattactaggaataaaaataacacactcatttattctctgcagttgctacaggaacttagagattgcagccatcagcatacactggaatgtttttgaaacctttacatctttcaatatggaattcagagtccattcatatgccacacaaagacaaggattctgaaggttaaacaaaatcatgcactggcatctggagccctgccctcccacacatcccacaactctatcctatgtagattaggctcaaagcattcaacaacttgttccatcgtgagtcctctgctgtcgatatcttcccagcacaaactaccctgttaatgtccctgtccccacacttcgactggtaaccataaatacatttcggtcttttccttggcaacccatgaccttagaaaggcaaacactaacaagaaaaagacaaacacagagcgttaggattcaagtgaacattcattatgtgccaggcacagaactatattctatctgtcctcattgctacggaaaatacttgaactgccaattggaaagaacttactatgcaccaggcagccaggcaggatcttacaagcttttatatattgaatctcatacagcaactctgaaacaattatacaaataaagaggctgagacatgaaaatggaaaagaatttgtccaagcacatactgctaagaagtggcaaaaccaaagtctgacttcatatctgtctcattcagcacatacacactaggggctgggtagtgtggtggttatagcacagtcagcagacaagtatattttcatgttaaatgccccattttctcttatgatacctacctctgccagcctaatacaaaagcaaccttaggtagcatgtactgaaataagcatgattttatttccacaaactttactttaaaaaagaagtaatcatgccaggcatggtggctcatgcctttaatcccagcactcgggaggcagaggcaggtggatttctgagttcgaggccagcctggtctacaaagtgagttccaggacagtcagggctatacagagaaaccctgcctcaaaagaagaagaagaagaagaagaagaagaagaagaagaagaagaagaagaagaagaagaagaagaagaagaagaagaagaagaagaggaagaagaaagtaatcctaacagcctatatttgagccaaaggctcttatagtaggcaggtgacccctaaaaaaagtattaaaatagtatgatgactctgactttggttataagacccagcctatgacttagacaagccacaggtttctgtctcaatttccttggtagtatgattaatatactgtgtctcctcggagccatcattgaaagaaataacaatgaaaggaatgaatgattgtaaagcacctggtccacagtcaagttcttagtaattcactactatttaaagcccaccactggggctgcagaattagatgggtagcagagcatttgcctagcatccatgacttccccagccctgctggagctggaaaagaagaaggttgggaaagaacccaactgcaaggaaagaaaaggacatgtgtttggatacttcctacgccccagtgttccccatactcagcagaaattatcattcccattgccttccagataatttgactctctcttcagctggagaaacaatgggcctttatgaacttaccttcctgtctcaaacattatttagaaagtttcctgacctccttgttgctggtccctccctgggaatctcatcctgggagataggagtctggttgctacaatattagaattctactgcaggaattagattcttgccatgatgagtcatgatgactgcctcccagttaggatcctggaggttctaggtgatggaggctcttaatgaacattgctaacttaagtgaattagctgttttgggtatagcctaaaccagaatgtatgtttgttggttgctgttatgttttgtttcatttttgtctggtctggtttggtttggtttggtttggcttggtttggtttgctttggtttggtttggtttggtttggtttggtttggtttggtttggtttgctttggtctggtttggtttggtttggtttggtttgctttgctttggggtggttagttttattttgttttcagtgttgagaactggaatgaagagccctattcttcagacacatcttcaaactgaaaagtgatctcttagaagccttgagaagagtgactgggaagacagaaacacacaggagccacagaccatgattgtcttatgattctgaaaaatagcccagtaaagtaaaaccaccctgcaagtttttatgcctgtttaagtaggggatactcagatttgttaaggaaaagtaaagaggaaaaaactcctaagagagggaagggtcccaagagatagatacccccaagtttctacttcgaatgaaaaacccagtcacacaatccttcctcccagctttcaaagcagccaagagattccacagcttgtcagccatcctttctactgtcctaactcgccagactcccacaacaaaaacttttctctgttatctaccaaactgcccttcatcctctatgatgcagcttgcataacaatctagttttcctctccagaattcgattgttagaggtttttcattggatctgactacaataaggagtgtgctgactccaattgtatgtactttttcaatacaatagctctcttgtacctcaccatcttttctccctcttgccaccaccatcaatcgcccctccagagtttaaagccaataattagcataacaggacacatcacatcaggagaatgtgcagagcgactgacaatggaggcaagcatgatgcattcaaattttgtctaagcatgactgcactgaatcatacatcgcatcatcacagtactatatacacagggagcaacaactctccatatattgtataaaaccaataatgatgaaagtagctaccctttcttgaatgaagagctcatttaaccctcataataatccatgattttaaaaacacatgtttcttagttgtctgacaacttaatcaactctcttagtccttataatgacactacgatacaggttactttataatcctcattttgcagacagggaaacagagtgccagagacattaagtaactttcctatgggcatcctgcaaaatggctgccatttgaatcccagggtctctccgtctgattataaagtaaagactatgcccctaactttgcaatgttatcattagaagcattctatactcctgtagcttgtattattctgtcatgtaatcaaagacacctagccacctgcccaatgttgagaacactgcaaagtacttctcacccatgatctgtctagttgacatcagtcctataaggcaggcaacaccactgttccacaaatacaggctcaaactcaaaggcttgttttcagttccaccacaaatcagagctcaggtgaggctaaaggttcaatacagattcctctccacttaggataggttgttctaacagatccatggccagttcaaaatataagtcaaaactgcctttaatacagctaacctgtataacatcccaacttagctacatagaattctgtagactaccatcacttctcactgtgaccacaggactgactgacagctgtggatcaccaccactgttcagcatcatgagagtttcataccacatagggactgcctaaagatcgaaattttaaattcaaaatatgctttgtattgaatgtgtgcagccttcccactatcctaaaggtaaaaattcataaattagactattatacattttatggagttttgggtgctacaaggcctcagtctgtagccagggctatgctgaactcatgaaaatcttcctgccacagtctttctgagtgctgatactatagggatagaccatcacacctggcttggagggttgtaaaccaaagagtatcaatacaattgttacagatcatttctttacttatctgaaatgtgtatttaatttggcatcctgtgtttgtgtatgttaagctcggcaaacctaatgatgagggctgcctcaccactgggaattacctgacctatggtacaatctgttaatatattattgatctaaatgttatcaaatgtagaattccaaaccccatctggtcctgagggagagacaggaatgcagctgaaatgaggcttgtcaccactagacctcttacattctcccagttttgggcttcagcagccctcaaagaacatccagctgtctcagacatgccaccagaatcagttataactttggttctcatcagattcccaaacccctgctgggtttgtggtattagtttgaccattggtttatctctctctgctttaggatgtttattctccagagtccccttcaagcttcctgagttaagccagttgaattgcaattcccaggtgacctgaccctgaccatgtgccatgtgaattcttgcatggctttactcaactctgaggctctccttttcccttgctttcgcgtgttgtagcacccgctccttccttgctgagaaacttcccaacactggtttccctttccatctagaaagcctttcagggaaggaagaaacccccttccaccctttgctgccctgaagaaaccattgtatagcacaactgttctccaacctgtgggtcacaacccttttggggttgcttatcagataccctgcatatcagatatttacattacgattcataacagtaactaaattatagttatgaagtagcaataaaaacaattttatggttggaggtcaccacaccatgaggaactgtattaaacaattgcagcattagcaaggctgagaaccactgatgtgagacataattcacctggtctaatttcattttcctttcaaagtctgtctacataaccaacacaagagaattagagtatctgtaacggaacccaccgaggtaatacaaaccactgtgtacaattattttcaaacaaaaaaatatacttaaaactatgtgtttggagatagtcttacgctcctagccccacttttcctccattgacttcacagtagtggggctcggggctcggttgacatgggaagtgtttttcccattgacatttcatatcagtctgccatttactttcccctttaaactagcagcccagcagcttctgaatcacatctacaagcaaacagccacaacacagacggcttgtctgtgtcatgtaccgtgcctcaataataccagaatcagaaggatagagggctgggggagggaggaggagaagctgagatcagaatgtaaagttaattcattaatcaattaattatttttttaaaaaaagaaggcatctccttgtggcattaaatttaccatcaaatttgtaacttaactgaagaaatataaaacgccctataaaaccactatgtgtccagtataagggctacttccaatcatatgctgggccagaactccctactaaccgttatttgttggtattcagatgtttgctgccttggagatgatagaaggggcgtgtttaatgaagatacagctacgcaaactcattgctgtggtcaaggaagaacaacggttctcaacagcagtggtcccaacccctttggggttgaatgaccctttcacagggcccacctaaggccatcagaaaacacagatatttgcattctaattcataacgatagcaaaattccaattatgaagaagcaacaagaataattttatggttgggggtcgccacaacatgaggaactgtattaaagggtcacagccttaggaaagttgaaactaccggcctagaatgtattccttacttaacattgtcgttgatggcattcttgaatccagcttgattggtaactacaaagcaaagagaagtcaatgaatctgggatcatttccactgagctgattttcaaacatacccttgttcacaaactatcttttgcagagctgacttctgatataagggaagtctggcctatttcagtgtgtacccacttactgataatgaaagaaagccttcttaaatcatgaactttttttattaaatactttatttacatttcaaatgttatcccctttcctagtttcccctctgaaaaccccctatcccttcccccaaccccctactcaccaacccacccactcccgcttcctggccctgagagtcccctatactggggcatataaccttcacagaaccaagagcctgtccttccactgacgaccgactaggccatcctctgctacatacgcagctagagacatgagtcctaccatgtggtttctttggttggtggtttagtctcagagagctctgtgggtactggttagttcatattgttgttcctcctatgggattacaaaccccttaagctccttgagtactttctctagctccttcattggagaaccttcatgggctttttaaaaaactacatagaaaggctattacctctgatctaattgtaactgatagctattgtttctcactaacttgcatcttccccactggagaaggggaccatttattctctcctgtcaaatcttcataatttcaaagtggactaaagaaagaagaaatatgtgtatctgctagaagctgtccatcttgaagttgtctatttataaacatacaaagacaattcattgcagtaacttcatagaacactgggctctgtgcagctggaggtggtttggctctagcaacagatcctccttggagacccagatcttcagttgatcacgtcccccgacaaaaagtttcatagtatttgcatgctatagcatatacattaaatcatcctcagtttgctaatactactaaatacaatgtaagtgctacttaatagttgctaggctgatcacagggctcccaatggaggagctagagaaagtacccaaggagctaaagggatctgcaaccctataggtggaacaacattatgaactaaccagtaccccggagctcatgtctctagctgcatatgtatcaaaagatggcctagtcggccatcagtggaaagagaggcccattggtcatgcaaactttatatgcctcagtacaggggaacaccagggccaaaaagtgggagtgggggtgggggagtgggggggagggtatggggacttttgggatagcattggaaatgtaaatgaggaaaatacctaataaaaaatattttaaaatagttgctaggctgaattgtttagggaataacaagaataaagtttatacatgctcagatttatgtatttctaaaaagtcctttgtagaatgccaactgcactacttcgcaaacttctggttgttaatacctatgagagaaacctttcttcaagtgtcttttatttcacttctgtacattgtcactgatataaaatcacctggaaatagccactgaggtggttcagtatgggaccaacagtttttatccagatagaggtttggtacttccttccttcattatttctctctgtgtctctgtctctgtctctgtctctgtctctctctctctctctcttctctcattctctctctctcttctctccttctctctctggctctctctccctgtgtctctctctctctctctgtctctctgtctcttctcttcttctttcttcttcttcttcttcctctctctctctctctctctctctctctctctctctctctctctctctgcttttttcttttcttcctttctgctttcttccttggcttcttacagactctgtggcaaggcacaagactgaagaccaactaaggagatactgtttatgcctgatagaggtcctgtctgttaatggtttgttctatctcacaacctggctcacttctcaaaagcccactaatcccagatcctccactcctacaaggaaatcccccctcactttccatcacctctttggatggtggaaactgaagacccagagaaatctgtccctcactttttcttcctctccatgagcacttgctacagcatggggcacagtaggcattgaaatgttagctgtggttattattattacaatgcctctctgactgtgctaaccatagccactgcctaggtttgttaaagtagctttgcctccacttccaatgggcttgcatcctcatgagtctgtttgtacactgagagtatctcacattgaaactgctgtacagcctggttgtgaacccatcaactataaagaagcattgtttggcttcatgctctggtagctgacagggagccatgctactgccactgtccattatcagcaaagatgctcacatggcatatgtctagctcacccccccccaaaaaagttcatatttgtatttcattttgtttattcttcttatttgtttattcttctatttactttgattctttgaggaaatgtctcactcttaggtactagctggcatggaagtcactaacttccatgtggtcctcaaaccttcctaatgctgcaaccctttcatgttgtggtgactctcaaccataaaattacttcatttctacttcataactgtaactttgctactgttatgaatcataatgtaaacatctgacatgcaggatatctgatatgcgagatccccatggaagagtcatttgacaagcccaaatgggtgactagccacagcctgagaaccactgcactaatataatcctggctggcctcaaatgcacagcaataaaattttacatttgaagtacagtttatactgaatgcttactgcttttgtagcgtgagaagcccaagcatcatgaatccggggccatctgcacatataaagggcttttaaaagtacccaaagcacaggaaaggctgtacatattttgtctctgactagtacaactgcttctacagaaatgcctggagggactacagaagttagataaaaagacgaatggtgtctgtgtcttggaggacttggcagggacatgtgctatatgagttatgtgcttgggtggtcaaaaggaaagccagttgatcatttgagtctgaattttcgcagggagaggaggggaggaattgtctcatattgtcaaaggccataaatgccgcacagcatgttgagatagaaatggcatgtgtgaaagtgttcctcccctcagcagcgtaacagtccaatttaaaggccaattcacgggttcttcagagaacaaatataacataaggaccagtaggaagaaccaaagtggtctgggcttaaaggagaaagaataggtcatctgtggttggagaaatcaaggaaggcatccaggaggaagcagcatactctgatttcaagccttttctccagcctttccttaggactttaatgcaggctgattttttttcctgcttctgggtattctatgctgtttcctttctatactgcataggtcttccctttttgattgaatgccctaagtttcgaaagtgtgacaaagccgtgagattttcccaaagctgttaaacagatccaaaacgaatgagtgcctttcattctagacctttctcttacaaaatgctaatgagagataaaatatgcatgagtttctctttaacctttacttggcaaaataatccctgaatttggatcaaagatggccttgatctatgggagccaaccatcttgggacctaacctgtctaccctttgcgtggctcatgcaagcatctaagcacacaggaggttgccctgttaatagtttcatagtaactaggctcttccaggctcaaactcaccccagtctctcaggtcatgcttctcccacaagcactagttagcactgagctggagtatggataaatacttgttggaagtctcatatgcacgccccttgccataagcaaatcaaattctattgtgccatgaggtcagctggtaaatgagctattaaagctgtctgattctttagacagctgtagaaacaaaagccacacatgacaagcttggtaaggggctagggagatggctctcccttctcagaattctgagaagaaagccaaggaacactctagttttctaagagagagatatgctcttgacgatgcaactgtgcatctttcttgccaagaattcttgttccctaacaattggagcaggggctgtctctgactctgttgtctgcctttggatcccgttcccctaactggactgcctggttgggtttcagcatgaaggatgtgcttagtactgttgggacttgatgtctcagagtgggtgatacctaagtggggtcttccccttctctaaggaaaaagggaggaaggaataggggaaggaattgtgagggtgggactgggaagaggagagggggctgtgattgggatggaaagtgaaaaattaatcaatgaaaaaataaagtattggaaagtgaactggggggaaaaaagaagtaaccctgcactaggtaaaaagcaaccacatctcccaacctaaaacatcagctctctgaagggctcggaagccccagaggaggaacatcaataggaactaaccagtacccacagagctccttggaactataccacatggaggaacccatggctctagctgcatatgtagcagaggatggcctagtcggccatcaatgcgaggagaggcccttggtcctgtgaaggttctatgccccagtataggggaatgccaggaccagaaatgggagtgggtgggttggggagcagggggaggaggggataggggatttttggaggggaaactaggaaaggggataacatttgaaatgtaaataaggaaatatctaattaaaaaaaagaaactggccgggcttggtggcacatgcctttaatcccagcactcgggaggcagaggcaggcggatttctgagttcgaggccagcctggtctacaaagtgagctccaggatagccagtgctataaagagaaaccctatctcgaaaaaccaaaaaaaaaaaaagaagaagaagaagaagaagaagaagaagaagaagaagaagaagaagaagaagaagaagaagaagaagaagaagaaagaaacaaactgtaataataataattaaaaaaaatcaggtctcagtctgttggttgctacccctatagggctgaacagacctttcacaggggtcatatatcgagtatgctccatttcagatatttacattacgatttcaagtagtagcaaaattacagttatgaagcagcaatgaatactttatggctgagggttgccacaatatgaggaactggattaaaacattaaggcgtcttccacatcagtaagcactgtgcatttcaattagtgtggcaagatccccaagcaaggtgggaagaaacccagctttctgtgtttttcaaagcatactacccttggattttcagggaatacaatgtctatgagcttagctcaaggtgtcaactgaagtaaggtatcaagtctggctctacctgctaccaacaaatgtaccttagcatcattgccatcatctgtaaaatgaatgataccagtatctgctgttagtgtgtgctgatatatgtgaaatcatggtatctggccctttctaagagctgagcacaaggcaatatacctatgctaagaggtttcctagtggtggtgggtccgtggctgctggggaaggaagagtcagttgctgtcaggagtttggctcctgatgagttagttacagtactggctagttttgtgtcaacttgacacaggttggagttatcacagagaaaggagcttcagttgaggaaatgtctccatgagatccagctgtaaggcattttctcaattagtgatcaagtggggaggtccccttgtgggtgatgccatctctgggctgggagtcttgggttctataagagagcaggctgagcaagccaggagaagcaagccagtaagtaacatccctccatggcctctgcatcagatcctgcttcctgacctgcttgagttccagtcctgacttccttcagtgatgaacagcaacgtgaattaaaacattaaggcttcttccacgtcagtaagcactgtgcatttcaattagtgtggcaagatccccaagcaaggtgggaagaaactgaataaaccctttcctccccaacttgcttcttgtcatgatgtttgtgcaggaatagaaaccctaactaagacagttacccatgctcaagcagatgacttcacatccatgagcattcaggcaagaccaattgggctctgagctattaaaggagagagagagagagagagagagagaggacatgaggtaggaggagaatttgggggggagaggggagggaaaaataaagacaaaatacattgtgtatatgtataaaattgtcaaaaataaatgaaaatgttttaaaatagtattcagcattaaccttatgtcaggcattttgcaaaatactggtgatctaatgaagaatgaagcatgttctgcatccaacaagctattcagaagcttctgtgctccttagacttgattttgccttgtttcattgagttgggtttttgtttgtttgtttgttttttgttttttgtttgttttggttttttatgtccccgagcagaagaactgggggaaaactgtaccatttccctcagttctcacaaatgacaagttaaaatgtcacagacattttcaaaacggcagagtaaggacttttgaaaatctactcttacaaaatagtaccaagaccttgagaatttccttaaaatcaagtttttggggtttttttttcccaaaacactagaaatgagccaaaagcttccaacaatcagagatgaatttatccaaataaaccagctgactattgggaagaatagcaagttctgcagtattttaacatgccctattcccatcttcctttacccagcccacaacaacatcgaaagccaaaagtccctgttggccacactatctgtaaaaattcagcacctggcaccaactggagtgagccgaatggttttaaaataactccaaataaatctatccctagagaattatcagtctatgactgtcaggcaactctctataaagaaaagtatctgtcacagcacttgtcctcctacacctgagtcagtaccaacatcccttttacaagggcattttggaatacagaagcaacagttttttaatatctagtcagcctgaggtggaccataatagttggggaaaataatcgaacaaacaacaaaggcaatctgaatccaacaacatataataaggatcccacacctagccaagtgggatgtatcccaggaatgtgaaagtaattccccataaaatccttccatgtaatgtagctgtggacggaggagtaaaaaccgcaagatcgtgtcacttgacacagagaagactctcagcaaaatccaacaatctttcatggtcaaaacatgtggcaagtgtgaatagaagagaatgtcctcagcagataaatggaaaactacaaaagaccttttgccctaagatctgaattaagacaaatatgcccactctcagtacttcaatcagttcctcactttaccagagatagttcttacttcagttagataagaagcacagctaaacatccagttcagaaaggaagaattaaaagtctgttgtgaaggacatgatctggtatagagaaaaccctgaggaacgaaccagaagacggattctttgtaccaagagagatggctaagactgcaacctatgatatcaacatgcaaaatcagtcagcaattaccatgccagattttgtttttctctgagctctgaactaggcttcaacagaacagaccaaaccaaaatagtcccttccactgactgtcacttaatggaaccaacactttgaggatccagataatattcaaagtaaataagctgtttcattttgtagaatactggttctctcaatttatgaatcatgactaaaagctcattagtgctataaatacattggttacaaatcttatctcttggtagcttctattcactatcaataaagaatccaaaattaaattagaaagaaaatagcatcaaagttaataaagtgttaaccaatagaattaatgaatggaatataaaacctgtaaactgaaaactataaaaaattgtgggaagaaaataaaggctaaataaatggctatttcaaactgattaacttaaaattttaataatgttcaaaattatgtgactagtaaacagcagagccaggagttgaaacaatatagtttatagaattctatagtcgaaaccattagctgtgctttacactcatatctgggctctactgaaaggcaggtaccttaactagctaatataatgtgctaactggaagctaataatagtatttaaatacctttagatactgccacttccttaatatgtgagtaaaacatcaatgtttctctgacagcaggtagggatgtatgcatttcaatcagggtggtaaggtctacaagcaagatatgaagaaattcagctttttgttgttgttgtttctcagatcatactacctatggattatcagagaacacagtgtttatgaacttatcccatagactctaccagactttggtatcatttctgactgttcttcctaccaagaaatgtgccttggtgtcattggcaccatctttaaaatgaattttatctattatattatagaatgtattctatattacaaaccgttatacaaacatgaaaacatgcatatactcactgttctcaatactagtctgcattatttatgatgtctcaagattagatccttttgatgagtttttttaacccctccataccctccagtctaatctagtcatttaaagccacaccaagactgtttcctaggtgggccatgctcttcttcacctctatccatgcgtttacttacattatcctctctgattttgtagcttacactattccctttcttcttcgggatctagccatctcctatacatcctttaatactccactcaggggagctgatcctttgccacagttactggagctgatcctatgccacagcactccatacccaaatattgcagagaaagagctggtctcccaggagtgctggcacacctgtgagcaaaggatccttccagtttccatgtactcccgaagctaaacctatgtcagagctctccatagccaaattcctcccaaagagaactggtctctcaggagtgcagtcacacaggagggacaagccacagtcacagacagcaagaccacctaacatcagcgataaccagatggcaagagacaagggcaagaacattagcaacagaaaccaaggctacttggaatcatcagaaaccagttctcccaccacaccaaacccctgataccacaacacagaggaaaagcaagactctgatttaaaatcacatctcatgatgaagataatggaggactttaagaaggacataaacaactcccttaaagaaatacaggagaacacagctaaagaggtagaactccttaaagagggaacacaaaaatcccataaagaattataggaaaacacaaccaaacaggtgacaaattgaacaaaaacatccaagatctaaaaatggaggtagaaacaataaagaaaacacaaagggagacaactctggagatagaaagcctaggaaacaaatcaggagtcatagttgtgagcattaccaacagaatacaagagatggaagagagaatctcaggtgcagaaaattccatagaaaacatggacacaataatcaaagaaaatgcaaaatgcaaaaggatcctaacttaaaacatccaggaaatccaggacaaaatgagaagaacagacctaaggataatagatatagatgagaataaagattttaaacttaaagggccagtaaatatctcaaaaaaaatattgaagaaaatttcactaacctagagaaaaagatgcccatgaacatacaagaagcacacaaaactccaaatagactggaccagaaaagaaattcctcccaacacataataatcagaacaacaaatgcactaaataaagacagaatattaaaagcagtaagggagaaaggtcaagtaacatataaaggcagacctattagaattacaccagacttctcaccagagactatgaaagccagaagatcctggacaaatattatacagactataagagaacacaaatgccagcccaggctactatacccagcaaaactctcaattaccataggtggagaaaccaaggtattccatgacaaaaccaaatttacacaatatctttccacaaatccagcccttcaaaggataataaagggaaaactccaacataaggagggaaaatacaccctagaaaaccccagaaagatatccttcaacaaacctaaaagcagatagcagcaagaacaaaatcctaaatctaacaataaaaataacaggaagcaacaattacttttccttaatatctcttaatatcaatggactcaattccccaataaaaagacatgggctaacagcctggatacataagcaggacccaacattttgcctcatacaataaacccaccacagggacaaagacagacactatctcagagtaaaagactggaaaacaattttccaagcaaatgttccaaagaaacaagctggagtagccattctaatatcgaataaaatggaatttcaacccaaagttatcaaaaaagacaaggaggggcacttcgtacacatcaaaggttaaatctaccaagatgaactctcaattctgaacatctatgctccaaatgcaagggcatccacattcattaaaggaactttagttaggctcaaagaacacattgtaccacacacaatactagtgggagacttcaacaccacactctcatcaatagacagatcatggaaacagaaactaaacggagacacatggacactaacagaagttatgaaacaaatggagttaacaaatatctatagaacattttatcctaaaacaaaaggatataccttcttctcagcacctcataataccttccccaaaactgaccatgtaattggtcacaaaacaggcctcaacagatacaaaaatattgaaataatcccatgcatcctatcagatcaccacagactaaggctgatcttcaacaacaacataaatattcgaaagccaacattcacgtggaagctgaacaacactctaatcaaagataacttggtcaatgaagaaattaaagactttttagagattaatgaaaatgaagccacaacaaacccaaacttatgggacacaataaaagcagtcctaagaggaaaactcatagctctgagtgctgacaaaaagaaactggaaaaaaacatacactagcagcttgacagcacacataaaagctctaaaacaaaaggaagcaaattcacccaagaggagtagacagcagaaaataatcaaactcaagactgaaatcaacaagtagaaacaagaagaactattcaaagaatcaaccaaaccaggagatggttctttgtgaaaaacaacaagatagataaacccttagccagactaactagagggcacagagacagtatcctaattaacaaaattagaaatgaaaggggagacataacaacagaatctgaggaaatcaaaaacatcaacagatccttctacaaaagcctatattcaacaaaactggaaaacctggatgaaatggacaattttctagatagataccaggtaccaaagttaaatcaggatctgattaatgatctaaacagtcccatatcccctaaagaaatacaagcagtcattaatagtctcacaaccaaaaaaaaaaaaaccaggaccagatgggtttagtgcagagttctatcagaccttcgaagaagacctaattccaattctcgtcaaactattccacaaaatagaaacaggaggtactgtacccaattcaatctatgaagccacaattactctgatacctaaaccacattaagacccaacaaagaaagagaacttcagaccaatttcccttatgaatatcaaagggaaatactcaataaaattctcgcaaactgaatccaagaacacatcaaaatgatcatccataatgatcaagtaggcttcatcgcagggatggcttaatatatggaaatccatcaacgttatccactatataaacaaactcaaagacaaaaaccaaataatcatgtccttagatgctgagaaagcatttgacaaaatccaacgcccattcatgataaaagtcttggaaagatcaggaattcaaggcccatacctaaacataataaaagcaatatacagcaaaccagtagccagcatcaaactaaatggagagaaacttgaaacaatcccactaaaatcagggactaaacaaggctgcccactttctccctacctgttcaatatagttcttgaagtcctagccagagcaattagacacataaaggagatcaaagggatacaaattggaaaggacaaagtcaaaatatcactatttgcagatgatatgatagtataggtaagtgaccctagaaaattcctgaacagaacagcaatggcttgtgctgtgagatagaaaatcaacaaatgggacctcataaattaaaattgcaaagcttctgtaaggtaaaagacaaaaaataataataaaacaaaaaggcaaccaacagattgggaaaagatttttaccaatgctaaatccaatagggggctaattgttgggaattaaaagggggggcgggagtgccctggggaagaaaaatggggggagaagtccaaccagagttcctgtgctctgggcaggggatgcagggagagctgccagatgcttttccactcagctgggcgggcatctaagcctatgaccccactcggcagagggtgaataaggggcagcccccgaccggggagccccccccgaggcgacaccctgtcgccctagggttataggagagagggataagggaagaggttcccaacactgaccagagtgcacagcagatctccatggagcagagactctctatggtttaagagctttattatagaaatgcagggggaaagatagaaggtagaaagaggaggggggaaaggctagagagaacgagagttagagggagagaggagaggagaggggaggggaggggaggggaggggaggggaggggaggggaggggaggggaggggaggagaggagaggagaggagaggagaggagaggagaggagaggagaggagaggagaggagaggagaggagaggacaaagaaaaaggaaagagaagagaggagagaagacaaagagaggggagagaggggtaagagggagacaatagagcaagaagtaagagcataagagtaagagagtgaggtgggggctggacagtcctttttatggtcttcactgttgctaggtaactgggatgtttagcctgaaggtcaaaagcttggtccattgtctatgtgactactgaccacgcttctcttgagggggctgtgggaggtggtaacttagacagggaccagagttccaggagcatgaggaaacacctaccgtgtcatgaaggtgaattatgaccatcgggattcagacctcagctcgactggagaccagcctggaattccccacaactaatatccaatttatataaagaactcaagaagttggattccagaaaaccaaataaccccattaaaaaatggggctcagagctaaacaaagaattctcaactgaggaataccaaacagctgaaaagcgtctgaaaaaatgttcagcatccttaatcaccaaggaaatgcaaatcaaaacaaccctgagattccacttcacaccagtcagaatggctgagatcaaaaattcagatgacagcagatgttggcgaggatgtggagaaagaggaacactcctccattgttggtgggattgcaagcttgtacaaccactctggaagtcagtctggagggtcttcagaaaattggacatagtactaccagaagatccagcaatacctctcctgagcatatacccagaagttccaactggtaataagaacacatgttccactatgttcatagcagccttatttataatagccagaagctggaaagaacccagatgcccctcaacagaggaatggatacagaaaatgtggtacatttacacaatggagtactactcagctattaaaaacaatgaatttatgaattcttaggcaaatggatggacctggagggcatcatcctgagtgaggtaacccagtcacaaaagaacacacatgatatgcactcactgatatggggatattagcccagaaacttagaatacccaagatataatttgcaaaactcatgaaactcaagaaggaagaccaaagtgtggattcttcattccttcttagaatggggaacaaaatacccatggaaggagttacagagacaaagtttggaaccaagactgaaggaaggaccatccagagactgacccacctggggatccatcccataaacaaccaccaaacccagatactattgtatataccaacaagattttgctggcaggaccctgatatagctgtctcctgtgaggctatgccagtgcctggcaaaaacaggagtcacagtcatctattggatggaacacatggtccctaatgaatgagctagagaaagtacccaaggagctaaaggggtctgcaggcctatgggaggaacaacaatatgaactaacccataccccccagagctgtgtctctagttgcatatgtagcagaggataacctagtcggccatcaattggaggagtggcccttggtcttgcaaagattctatgccccagtataggggaatgccaggaccaggaagtgggagtgaatgggttggtgagcaggggggtgggggagggtataggcgatttttggagaggaaactagaaaaggggatagcatttgaaatgtaaatgaagaaatcatctaataaaaaatggaaaaacgattctgagacgactttatctgctatgatgaggcatatttctaaggaggagactctaaactgtaaaacctttttttacaaagcatcctactctttatacatccattttcctcagtagatatgatactctcagttgtcttatttcttttcttttctttttcattgcatctttagatttagttttccccttcagcttccctatatcttcttgggcttctttggcatagtctgtgatgcctagtgtcttagtcagggtttctattcctgaacatacatcatgactaagaagcaagctggggaggaaagggtttattcagcttacacctccacattgctgttcatcaccaaaggaagtcaggatagaaactcacaccaggcaggaacttggaggcaggggctgatgcagaggccatggaaaagtgctgcattctgacttacttcccctggcttgctcaacttgctttcttatagaaccaagactaccagcccagggatggcaccactcacaatgggccctcgcacccttgaccactaattgagaaaatgcttacagatggatctcatggacgcatttcctcaagggaagctcctttccctgtgataactctaacttgtgtcaagttgacacaaaactagccagtacactagaaataaaaaggatctgtatgatttgttaatgaatttgtggaagggacgatgaattcagaggataaaaatattttacaaattagaaaatattttggaccaatgcctggcaaatacagaagtagatactcacagtcatccattggacagagcacaaagtccccaatgaaggagccagagaaagtacccagggagctgaaggggtctgaagccccataggaggaacatcagtatgaactaaccagtgccccagagctccttgcaactataccaccaatcaaagaaaacacatggtggaacttgtagctctagctgtatatgtagcagaggatgactttgtggggcttcaatgggaggagaggcccttggtcctttgaaagctctatgccccagtataggggaatgccaggaccaggaatgggagtgggtgggttggggagcagggggagggggaagggatagaggattttcagaggggaaactaggaaaggggataacacttgaaatgtaaagaaaataatctaaaaaaaataataaaagttttatgaaaaaagaaaatactttggtatagtgtgtgtgtgattgttttacctttgtgaatgtatgtgtgccatatgtgtgcctgtgtccatagaggtgagaaggagacattggatccccctggaactggcgtgttacaaatggttgtcagctaccacgtggttccttagaactgacctgcatcctctacaagaggatcttaaacactgagcgatctttttaagtcacagagattatttttttttcagtttcctaatttccaactgctttagacctaaaagcatatggtggcttaaaagctatagaattttctcatgaatttatctcaaggtaaatattcttggtcagcagaatagttctcttccttgatgatagtaaggggcgtgggctctcaaaaactccccagatggagtatagccacagaggaacactcatggaacacttctatgggctactcctggaacttctgcacatcatttctcttcctatttggttaatgagaacttagtcacatggccagggatactgagaaatatcgtctacccatggagtagactaaggaggagaatgacttgattgagactttctggtcgttgtaaatataataagaaagttgggatagtttgccttaggtgttaggtaaatgatggaagaggtttctgtcctttgtattagtatgctacatggtgtagctatgttcatctgtcccctgggaagcttgaatagtcaaatgtaggcagtatttcaaatcatggttgacagctgagctccctattgactcacttaccaggaagtagcagctgaagggtgacttgcattgctgattattccttaattattaatcactgacactttgtaaattgccttaagtcaaaccccagctgggttagtatacaatattatagtgttgacccccaaatatttttcctgtgttgtatgtctaggctagaatggatattagatagatagcagagtagcaaccttatttattgcaaaccagccaagtgatactcaaaacaaaatgggaaaaaggcaaaaatcaaaaagggaactaatttccatttcaaaccatagccacaggcagagtttattctctggcagtttgcgtttccccaaaccaactgtacacttgacagtgacctcatgtaggataagggaatgaatagaagtaaatcagtctgaaataaaaatcctcaggcttctcaactgagacgcacatatattcccagggaaatttagaaaactgatatccaggctcaatccttcattaccttagggagtctcagcccatccggaatggacctggtgagctcgatttttcaatgtgcttttaatgactctgtcttctctgtgtcacacgggctttcgctggagaagactgtgatggaagtattatgagcattgactttttcctgggctgatctcaggtgcctaacttgttcttttcttttcccagtttgtcgctcagccaaactgccaacaattgctagccaccttgtggtacgatggcttccctggatggcggagaaaacactgggtagtcaagcttctgacctgcatgaccattggattcctgtttcctatgctgtccatagcctatctgatctcacccagaagcaaccttgggcttttcatcaagaaaccctttattaagttcatctgccacacagcatcctatctgaccttcctcttcatgcttctcctggcttctcaacatatcgtcagaacagacctccatgttcaaggacctcccccaactgttgtggaatggatgatactgccttgggttctaggtaagtgaaacagaacaataatgactatgctgtcttctagtcccactttaaaaactactggacatgcattcagtggaatgtgtagctctgactaaagacccctctagtgagcctgtattgagaatctaagaaatgtggttccttctatcctaggttcttctgatcactcaattatgcataagccattgtaaaataagcatattctcagagtttgcatctgctcacctaacatcttttaggattgtaaaataaaaaatgggtgttagttggcttaggggagaaagctttgtgtcagtcactataggcttcaaggaaactagacagggcaagcactgagtattctatttaaaacaccctttgctataaccaggaagcacatggattctgctgatttcttgtgtttgtgtcaatttcatagaatcctagttcaggatctatgtactttttgaatactggtcccacagtcagaagaaaaaaactgagaaattcactctgaccatggtaaaagttgatctccctgtgatcttcagacataatcagatgacactgacctctccagtacatgccatcttctatgtctatgtgactcaaactctgaacctcaagctagcattttgagcatgatttgggattttatcattgacatcttaagtcttaccctgagtctagaagctaacagtatccctaagtgatccatacttaaagtctggtaattgatggccttgaccatggccacatagctttactgaaacatctctgtcatcaggcaaaatttctctctctctccctctctctctctctctctctctctctctctctctcacacacacacacacacacacacacacacacacacacacacacacacacacgggaggagaagagagaaaatagatcctagattatttggggtcacaatgcataacttaagtagttacatctggcaatgtgatccctgcagtacatcaaaacccaggaagagcttttctccttagcacccagagaaaaataatgatagaacaatactgacaaagtcaatttactatagtccaaaatgaaaagaatgggaaatccggtgcctaaaatttcagtagctaaattaaagcttaagcgaaaccacaacagcctcaaattatgaagaacaaagtgaaaaataaatagtttagggagtacttatcaccatcaggggaatggaaattaaaactacttcaaatttttatttcatcctagtcagaatggctagcatcaagaaagtaagtgatactaggtatggggtatggagggggtggggaagagatatcattcactgcttgggagagacttctgcaggcaatgtggaaatcagtgtgatggaatcgtcataaaactatgctattcctgggtcaggtatccaaaaggacccaatatcccaccacagaggcacttgcacatcagtgtttcttgctgcactactgtcaataacaaggaaatggaaccagcctagatgcccatgaaaaaaatggctgagtaatgaagacagggtccatatacagaatgggagtttgttccattgtaaggaataggcaaattgtgaaacatgcaggaaactggatggatccagaaaatattaaattgaacaaggttacctagtctgagaaaggcaaacacttcatgctctcttatatgagtgtgactgaatgtggggcatacaaacagaaaaagaccatgaggtagagaaaagaaaatagaacatacgtgacatgaaagtggaaagtcgaaagggggctaccagggatagaagggaaaaggagcgaggagagagaggtgagaagaatggttaggaacatcgaaggcaaattatgctttatgtttgaaaaacaaaaaacagaaaagtgaaaagcatactagcttttttttttttttttttttttttgtcaagattgggagatgaggtagccaaagaaagaaaggtaagagatctcttacctgctgggcccagttcattggttcatgcctctcatctttattcatttgggggacttctgtggtgatgttcaacactgccttgatatagaaataaacttactgcctccattctttaggtttcatttggggggagataaaggaaatgtgggatggtggattcacggaatacatccatgattggtggaacctgatggattttgcaatgaactccctctacctggcaactatttccttgaagatcgtggcctatgtcaaggtaaaatgggatgtctaccatctttcttcccctgtaattttggcagagttatgtcaataaacttttgcactgggcgcagaaagagtttatggggaaaactattgagtgtcccatctattctaggaaatactacagagacctttttcagtagtgtgtaagtagtatcaacttatgcaaatccagtgaagaaaggaacattctttttccagaggaatccttaagtttctcagactctcagggtaaagttgtcttcagccttcagtgcttaaacatctataacattccttcgaagaatactaatgctcactaaatgcactacctccaaaaagcctcttacccgttatcactttagtaaaatcagttattttatatttgactaatattttccctgctgtagccattggtaagcactcctccttttggagatacacaggacaaaagtgatccctctgtagtacagatattgtcccctctcctttaccttctgagtcattgtttcacagagccaacatccccacttccccacccattctttgtataacaagcagcataaccccagaaactgtacaacacatgggttcacctacaattcacctacaattcttctttatgtcttctgtcaggataatttttcaatttgttaaaatatacacaaatttttattatcactcaccctacatccccctaccggttcagaaaatgtctatactgagcataccctgtcatcttgatactttccccatacataagcaccttgaattattctgaaaattattattaaatacgtacagtttcacttttaatgagacctataaatgagtacagtctggttgtctcatcaacagagatacaactcatgtaagacgaccttccccaagcaaaatgagacaagtgtggagtaaagttccaggtacctctccacaggccactatatctgggggtaaccacaggtctgaatctaggtctgtaatttaataatagaaggcatggctatgctccttctaccctgctttgagtttttccccacaaggtaaggctgacaattcatttcccaagatgtctagtcagtcatgcttttggtattcaatttcacattgaagacttttagaatgggaatatggctgtcccccaagtctccaacaacttcgtttatttttacatccctaatatgcatattgcataaattgtaagaccttgagagttatatagagcatgaatattgaatgcattcatgaaacatttttgaaaagagcccaagagtatgccttatacgtgtgtcgaccatttaacacatgcttacaactttcttaaaagaaaaagcctagtgaaagaaaatgtttgactctctggtgatcctgcctgggttaactccatgtccccctggcactctgctggctaagtatcacagttttccttttcaaccatgcactgtgtgtattacgaatatttttaaaataattaataaaatattatatttttaaatctcctttataagtagagacaccataacttaacaatcttgaacttactaggttttgtttaaccagaaaagtttagaataaatgatgaaaagaatgattttagtctggggtattaaaatgtgtctacagatgctcaacatcagctaattacataatcttcctaatttcactggagaggtttccaaagagctaaatacttctccatatcaatgtataataaacccactcaactaggcttctaagttctgcctcttaacactaaaagaaaacacaaacaagacatgtcacatgcagactttcgatttttaaacatatttatgtgtatggatttttttgtgtgtatgtgtgtacatatgcttagtgctcaagaaggcccgaagagacagactcatcccctaaacttggagttacagatggtttggagccaccatgtgggtattgggaattgaatgcagatcctctacagtaagagtggcaagcagtcttaacctctagtccatctctccagccccaagaatttagatctttcaaactagaacttcgttttgtagtcctctcttccacaaaaatgcaaccagtttagacattcctttaggagaatgagatggaagtttcccaccccctggcccccattggaacacttcaaatcactgttgttccagggcaatatggaaattaaataagacgaacttgcctttaaaattccttaatttattaactaattaattaattttaactgtgtgtggctataaatatattcacacataattgtgaacaagtgctgttaaatgtcttcctcggtggctcgccaccgtcttttttgagacatggtttctcactgaagctggaactcaccatttcaccatttcaggtagatgggttgaccaggaggccctgggatgcacctgtttccaccctcctccccagcagttgcacttgacttttatatgtgtggtagagatctgaactcaggttctcttgctttcacagatccaagttggtttgtttttgtttttgtttttttgttgtttttttttgttgttgttgttgttgttttttacttcttagagtgtaaaattagttaaaatacatactcctcctcacagggattaaagcaacacgaaccaaaagatattcaccacagtaacccaaagaacaactatacatatggctgaccctcagtgtccacagggaaccctttgaatgaggaatagttagcctttcatcttctaggatatcacttcggtccatccctccttcaccttgattaatacacagactagatctaaactgtgctgagttgtgggcatttcttcaacatttactttactagagacataattacctcttcgtgtccatgctatcatggagttccccacgtcagctgatccatcttcagatttttattttggggtaacagaatgtaattcacacctctttgaaaagacgtggggccaagtttcaaactgcagtctgtttcaaagaatgcaagaaatgtcatgtatttcccagtatcactaacctagcttaattaaacatgaatttaatctctcctcccacctgtgaggttgatcaccaccaaccaatccttccacctctcagagttttagtcctgcctctgataaataagcaaactaaactccattggttttcaagccttggattccatgaaaacatatcttcaagcagagacttacaaagaactacagtatatgatatagctcaaagagctaaatttgacataaagaatgggccatctagtctgcttctttggctcccacaatggccgttagatgtctccattgaaccctgagggtctaagaaatacagtttaaattttacagtactagatcaggagttattaagctctggtctatgaaccaaatttggctcaatgtcacatccattcatctatgtactgtctttggtcactttagtgctacaaagggagtgttaagttatgacagagacctacagctgacaaagccaacgtacgcattatctggcacttggtgttgatgtctatcctagatgaactctaaccttattccccacacccatcacctgtctgctaaggagttctccagagctataagatgcagactagagatgtccaatgagaattgtctttcacacttctgcacatccagattccccatcctgtgggcaacagacttccctgtggtagagagagggaatggaaagtcaaatcaattctatactgtgattcattctcattttgaaacataggttctgtttggttatcagcaaagaattgccatctctcacatagatctcaaaacttggaccgacctttgtaacatctgtgttgtgagatcaattcccatttgagtgacatttcatggaagcagtgctagacttaatgttgagggacctggagttcagttctgtctctgccaccaaatttgttgcatgatatttagcaagccactctggatttcagttcctctatttgtaagccaggcataccacccacttgctcactgtgatgcaaaaaactggtttgggtttcctttcctttgaagaaaaaatggaaatgtatgggaaatttggctaagattatagaaaactgatcagcctccaaaacatctatctgaaacagaagcacatatgtggcacagtctctctgattcctctgacaatgaagaatcttggatacacacaagtgattttaacaccatcagttttcttggttgttggaagtgaagtacactgggaagcgcctacaagataatttgacccccaacactttttctcaggaaagatgcctacattcagtcctgagaaattgtgatgcttaaatgagagagcaaagtagttattcttcaaattaaattccaggcaaaacctatcatgtccttgggaaggttaatgatcagttccttgtttttccataccatccttccttgtggaatagagagagtcagtcgtgcagataaatattgaatcacaaacatgtccagcgggtgggaatggtgttatccttttttattctgaaggtaaagggtacaggcagttttaagtgatgatctccaaatcggagtccagtcctcaccatctcccacttctccatgaggctattcctcacattccagaagacagaggtcttcaagaggctggaaataggcaaccaactctataaatctggctattccctttcctccaacttcctgcttcttcatttgcactagaaggcctttctaacttgtaaggttgttaaagaaacagcaaaatacatccatatgctgctaagtggagaagtactaaatttgctacctggaaggttgacatgccatttgcaatggtggagaatacattacaaactgctaaaaatgcagcagaaagctctgaggaaaaggctccctaaggactctctatcagcctgaaactgcaagcagcagagccatgaggatgaacacacaggaggctgcctctatccattatccttcagtaacttcaaattaaccgtgtttcaagccaagctgaggggttgaggtataggtctgagttgaaatttcactaagaagtgaaaatagtttggtacccactagcttgggcaccccaatggctccttttcagaaatactcaacaacaatctggtaagcccgcagttagaaaatgtctgttgataaaccacaggtggctgctgcagatgatggctctgagattccttctgctatgtatatatgcttggtatatatttggataagagtgggagggagagcgttattagcactgtgtactgattgaatggggcaaaaagacaaacaaacagtgacatgcaagaataattttatgtaagcggagtatagagtacatattgtgtgtgtggaagggtgcaaaggggagatttttggaaatactcactgtacttctcatattgtgcacttgtgtgtgtttttttccagtataatggttctcgtccaagggaagaatgggaaatgtggcacccgactctgattgcagaagcactcttcgcaatatccaacattttaagttccttgcgtctcatatccttgttcacagccaactcccatttagggcctctgcagatctctttgggacgaatgctgcttgatatactcaaatttctctttatctactgcctagtactactggcttttgccaacggactgaaccagctttacttttactatgagaccagagctattgatgaacctaacaactgcaaggggatccgatgtgaaaaacagaacaacgccttctccacgtaagatgtgcaccgctctttcctctgttttcattctgtcttcctttttattctgttttccacgcacagcttcatcagtatctcttcatgagagaacagagctatctgcagatctacccaaacggtctagtatagaagaaaattcttccttcaacataggaaagtagcattagaagagaaagagatttaacagagacagagagagccatgctgattccatttttaaaaaggtagttctaagtatttcttgtagtgctcaaagagtggtagccatgaaggatgtgtaagcacaagactattcataggatactcatggctacaaaattaacttcactactgtaagtcaagctcaaagcagagaagacaaaagtatcttaatgaactcccttttgcatgcaaagtaagacagacttgaggcaaaattatagtcagctagcctactagaccaacttaaggattggaggggtggtggtggctggaaatgactctgctccaatttgcagtatagaaggcagctctttgccccggaaaccacaacttctagaaaggtaatttctgtgcttgtgcttcaccttcctactataaagacctgcttctttggaatttttccaccccctgaatggctttagaatgatgagaatagaacagagaaagaaaaagagcaactcgatgtagttgcacatgttatattctctcagaatgcaggaggccaaggaaggaaattcatgagtttgagaatcacctaggctgcacagtggtaccccatctcaaaagagcaaaagcaaaaagaagggaggatgagatggagagagggaaggagttttgaaaggagagagggaggaagaaagaaagaaag

SEQ ID NO: 756 - DNA, 269329 bp, mus musculus; identical to SEQ ID NO: 755

SEQ ID NO: 757 - DNA, 1127 bp, mus musculus
atgtctcagtcttcagaagaatgtgcagctgacgaaggccagacctgtgaagagacccagaaactacaggttgcagcagcctccgtcgatgttgaggagccatgttcctcatctcatcttatggctactagtctgaaggaccagaccagtgaggagacccaagtctccaaggatgtggaggaaccatgttcctcttctcaacttcttatggctagcaaccaggatgatcctgaagatgagacagccagtacttccaggggtcttcagcatccctatgactcttcaagcgagtctgctgagggtcttgataaccaagaagtgcagggtagcccagtcattccaccagatcagtcagatagcacagatttacctgtgatgactgtagatgggaaagttgatttcttggtgaattacatgctgtacaagtatcaggtgaaagagatgatgagtatgaatgatataatgacactcattgtcagagaagatgaagatcgttttcatgaaatcctcatgagagcttctgagcgtgtggagatggtctttgggctggatgtgaaggaagtagatcctatcaaccattgctatgctctctttatcaaattaggtctcaaaaaaaataaaaaataaataaataaaaattaggtctcacctatgatgggatgcacaatgatgagtacagctttcctaaaactgatctcctgatactcatcctgggtgtagtctttatgaagggcaaccgtgccactgaagaggagatttgggaagtgttgaatccaatgggaatctatgctgggatgactcatttcatgtttggtgaccctagagagctgataactgatgagtttgtgagggagcaatacctggaataccagccaatagccaatagtgatcccatacagtatgaatatgtgtgggggctacaggataaagctgaaactagtaagatgagagtgttagagtttgtggccaaggttcatgggtcagaccctactgcgttcctttctcagtatgaagaggcactgattgaagaagaagagagaacccttaccatgctattagaacacgctggctcaagttctgcttctggtgaaagttctagtgacacaagcagcaatttctctcatgtc

SEQ ID NO: 758 - DNA, 128 bp, mus musculus
gtggtgtgctcagagcagggacggtgaaaagaggcctctctgtttacaacacacccaacaggaatctggcaccatgtaacaaggagcacaacactcatgtcctccctgtgagcaagtgccctgcacgt

SEQ ID NO: 759 - DNA, 21417 bp, mus musculus; identical to SEQ ID NO: 107

SEQ ID NO: 760 - DNA, 40294 bp, mus musculus; identical to SEQ ID NO: 108

SEQ ID NO: 761 - DNA, 40294 bp, mus musculus; identical to SEQ ID NO: 108

SEQ ID NO: 762 - DNA, 6687 bp, mus musculus
ggccgccaactaggacgggaagcgttagtgctctgatcacttcgggggaaatcagagcaagcaggcggggtctgagcccacgcttgctgggaaagaagtcacttcaaggttctgccagagctagtgggaggcagaagctcggctggggtttgtagtctagccagcaaggggggagacggggagaagcgcttcagccaaggattcagtcgggaatgggaaggcgccctcggaagggtgggcagtttgggatggaagagggatcaaagggaggacttagatgaggcgagcttagagtgtgaggacgatgagagtatctcttagacaacagagatacaagttgggaaaggctgtgttctgaaatactgcccctatcgtctgcttctctcttatttctccaagcagaatttaaagactgccgttgtaaatccaagagtcaacttgggtccaatccattttcgagcttcaaaactggaattctgtactgagaaaggtatcttgtgtgaacactaggagtccaggtccttaagccagtgctccagctctgtccttttccctccctgttaaatcaagtttcccccatttccaccacttcccctctgtctctttccctccccctttctctcctctctccctccctttctctttctctctcctctctcccttcctctccccctcccctctctctcctctccttccctctccctctctcctccctccctctctcgctccaactctgtccttttccctccattacatcaagtttcccccatttccacctcttcacctctctctctccctccctctttctctccctctcccccctctctctcccctccttccctctccctccctctttttctcctctctcccccctctcttcctctctcctctctctcctttataccctgtccttctccaattcttttccatcccctttttcttcattctttcattccccttctatcaccttatagtcatgatcttagcagcccaggatgtctactgaatcatccccctattgtgacaacagattgtctttataggccggggttagtgccattttcagttagatatggaaagagtctggtggtttccacagctattcctgggtatcttcttttattttttcaaaagtttctccatctagctctgactgtcctggaactctgtagaccaggctggcctcgaactcagagatccacctgctgggatcaaaagtgtgtgccaccactgcccggctttgtaactgtgtgcaagtgcaagcgtgatcaaatgtgtgcacaagccacagacattaggcatcagatcccttggagctggagttacaggtagttgtgaaccacctaacacgagtactcaaagaactctgaaagaactggaagtattcttaaccaccatgccatctctctagtcctattcctgtaactatttttaaataatgtctaaaagctgggaagaatcctaaagagtctaggaaggtgagaaagctcagttgatagaatctgatatgaagctcttttgggaaaccagtcacaggcaacatgagggaataaaatcatcagaggcttgaaatctcacatacatttttaaaagttactatttaattttcaaagattaaatgtagcttgggagaaaattaaattggagccctatctctaaatatatacaaaatccagtttcaaatggattcaaaacaaatgataaaggcaaaactttaggaattgtggaatatataggagagtatctttataaatttagaatatggagaggttgtttgttttactgtttgttgtagtttggttgatttggttttcttcttttttggggggggggagcagggtctctgcattgtcctaactgtcctggaactcactttgtagaccagactggcctcaaactcaagagattcacctgcctctgcctcccaagtgctgggattaaaggcgtgtgccaccacacctggccagttttttatttttattttatactttcatatatgtaccaatgaatatgggtcatatccaccctcatatcaacatctgtcctctaaagccccatcgtatcccacacatttttgtgattcagagtccaattggtcctacccacatgtgcatagtatgcacctgcaagaaaattgacaattccttggcaggtatcaacttctaatagctcttcaactggaaaggagcctcgtccatccatgctggaaggttcactggcttgctcttttaccggtcttgtacaggtctcttgcaggtgaccacagctgctgtgaattcacaagtgcatggctctgtcatatctaaaaggcagcatttcccagtactgccctccatcctccagctctttccattctgtccagtccttgtagcataacggcccctgaactttggagtagtggtgatacacacacatctcatttagggctaggcactcattctagtcacttattctcaacagtttgagcgttgtgagtttctgcataaacttatctagagaaaaaagaagctccttggagagcagcactaaactatgaatataaatacagatatttagaaggcaggttgacagaaatgaccatttagaaaaacagtactagtaggttctccccctagggcctatgacctgcccagacatggacgtttgaccagatttatagtagcaggcatgaattcccttttgtggaccagaaccaggtctcaaatctaatcagagtggttggttacaccctataatagtcatgccattactacaccagtgggcacatcttacctggaaggttggtattatagcatgcagggtccactgctgggtaagatgtcttttctaccctagtgacttggctagcacctggaactcttgaaagctagtcagcctagaggaaattgccttgtcagtcccagatttctctattctcagcagctaagtgtgtgatgccattagcactaggctcttagcatctaattatggtgaacaaccaagagaaagcagcagtagcctatgtgttaggctcctctgggaacctcccttaccaataacttggcattgagatttttatttaataactcatttcttctgggaacacctatgatttttttaaaacatgatggcctgtaacttactatttagtccaaattggcctccaatttttaagtcctacatcagcctcccaactgctgggattatgggtttgacccaacataccttataagaaatttcttcaatgactagaaacgcttctttcaaagaaaaagatgggcacatatgactaaatttaagtttaccaaaattcaccattgggatgtgaaatgagggctagaagagggctcagtggataggaacacttactgggccatggtagagcacacatttaatcccagcactggaggcagatgcagacaaacctctgggttcaaggctagcctggtctacagagaaagttctaggactacagacaggaaccctgtcttggaaaaaaaagaaaaatgtttaaggagataaatttaccctaatttgaatgctacataaaatatgtatgcattgaaacaaagtacccaacagataggtataactttacttaatatatctgtgaaaagtaaacattttgtatacaaaacatccctaaaaggaacacaagatgagtagacattacacaaagcaataaacaaaacggttgaccacatgaaaaggcgtgagacctcattaacaataaaggaaaatctattgaagtcagtaattatgggctgataagatggcttatcaggtaaaggcatttgcagccaggcctgacttgagtttgtttgctctctggattccacatagtggaaggagaaagctaacttttgcaagttgtcctaagacctccacaagtacgctgccgtgtaagtgcatatgtgtgcagacacagaggttaccaccactgttttagtttttttttattatgtgagtgagtgtgtgtgtgtgtgtgtgtgtgtgtagcagtcagagaacttacaagggtcagttctctttcaccatgtggaacaaaggttctctccttccatcatgtgcatccaagggattgaactcaccgggcctggtggcaagcacctttccccactaagccatctccctgacccctgtgtgatttgaatattgtattttatttcaccccattgtatctcacttgactattcaataggtacagagggctggtggctatagataagctaagttcatcttgcaataaatactggctgagaagctatattagtttcatattataataaaaaatcccaaacttaataaacccataaaaacttactttcatacagctctggaaagcagaataccaaaatgggtctcactggactagggatctgaactcaggtcctcaggcttgctagcaagcacttattcactgagccattacccccagccctggcaacattctttaacacagccttcacctcattctttgtgtgtgtgtgtgtgtgggggggtaggtgtgagctttaatgatgagccatttcttcagccttctttaaaagagccctactcaaagccactatccttatctttttggttaacttaagtggtctctacattggccttctagcttcctccaaattgtttcctattgcccattcatcacacaaacaagcagctttcttttctgaaataccatttcccctttattttattacttattatctagtaagataatcaaccccagatgcgttcatattttgggaagcccagttttgacatgttgggggggcaggttacaaacataaaccttttatttctctagtgttacctccttgaaatcctcccctaacctctcattacattgaaattcaaactcatagcagggtcttttttggagatggtttaaaaacaaactttttattacattttatttagtggggggggggcacatgggtatgtacatgtggaggtcagaggacaacttgtaggagttggttctctttctatcatgtgggaccaggggacaaactcagatcatcaggcctgttaacaagtatctttacccactgagccatttcacctgcccttgatacacttttcttgagactgcttcttactctgtagttgaagaggaccttgaacttgtgatcttcctgcctccacctcccccgagtactgagattataggcatgcactacttggttcaggtttacatggtactgtggattacacccagggcttcatggatgctagcaagcacttcaccacactccaggcccattactataggcttcaaagagccagtccttacacacctttttaatttgtctcatgccactatctcttgggtatagtactccaggtacactggcctctcgacattttccacttctttctatagctataacttccactaaccattttgtagctgaaatagttggcataaacaaggaacaatatatagcccatatctaagtttggaagcctgataaaacagaaaccaacataccagctccccaagttaagataggtgtagttgtaatcttagtccttaaagaccgttaaagtattacaacttcaaacaaccctgggttgttttctggtcttttaaacacttggaagacatttactttaaagttgtttatgaagattttgattttgattttcttcgttctttgtgttttgatcatcgtcaccctgtttccaatccttctcagacccaaccccctttccctgcccacccaactttctatgcttttaatttttttcacccatcaagtctaatttgtgctgaaaacatattatttgatttgtggccttctactggaacctggtcaactcaagagtgggcttgcagagcctagtacacacctttaatccaggcaaaggcaggcaaactctgaattcattgccagccttccgggtctacagagtgagttccaggacagcagggctacacagagaaatcttgtcttaaagaaagaaagaaacaaacaaacaaacaaataaataaataaaaagagtgggttctcccctcccagcagctgtctattgccaacagctctttcactaggactgggggctcatacccccttcctttttgcatgctgggatacagtctggctcgagcttacacaggtttatgcatggtaacaagatatctgtgaattcagacatgcagcttcccctggtatgtgcagaagacactattttcctgtattcatccaccacccctgactcttacatctttccaccccttgtacaatgattactgagacttgaaaaggggacgtgatatagaggtcccatttaggggtgagcattctgcagtctgttattctctgcttacaagcactttaacttaaagagtgcaatagtgagacttgctttcagagaattttaacatggattaacaaaggccatcagggattccgggaatattgtctgacgttagaccgaagcttgacttagtgtgatgacagcagagcttgaagacacagataatgaaacgtcataaagtaaaatcaagatataaaacatcagaaagtaaaaccaggatcatagctagtgagatgttataagagagaaagaaatgaaggtatggtatagtcaaggacaatgtcagcattaaagagccattctacctctcgttgctccagatgtataaattagaccttgtatcagatcccagggagctggcagccattgaagctagaa

SEQ ID NO: 763 - DNA, 6687 bp, mus musculus; identical to SEQ ID NO: 762

SEQ ID NO: 764 - DNA, 276 bp, mus musculus
attgttccaccttcctaaacttgtttgacacctctgggaaaatttgggaaccgtaactctgctttggcgtccgatcccaagctgtgtactttgtgctctactcagccctccccgcacccgcacctcccgatggaacgctccactctgattcctttccccccccccctctctgctgtggcacttttgaatttctgacccagcgttccgctcagcagcgtgggattgcgatgccccccacccctccgcatgccccccacacgcctaagagattgttgc

SEQ ID NO: 765 - DNA, 249 bp, mus musculus; identical to SEQ ID NO: 120

SEQ ID NO: 766 - DNA, 311 bp, mus musculus; identical to SEQ ID NO: 122

SEQ ID NO: 767 - DNA, 82 bp, mus musculus
agaggttaaggctttggacttaagatccaatgggcagatgcctgcgtgggtttgaaccccactcccaatattagtgactgta

SEQ ID NO: 768 - DNA, 4572 bp, mus musculus
ggcgggggacggacggggcgaccggcgcgggctagcctgccttcttcctttgcctccgagcgctgtcctaggctggcccctggcctgagggtgcagagccgggtgtgcggatgctcactctgtgtgtgcgcgtgcgcgcgcgcgcgcgcgttttttcaatcttccagccgtaagaagtacttggccctccggaagaaggagagacgtaagaggcgacggcaggcgctcgctcggctcagagaggcaggtagttgttgctctggatgtggaattgctccctctcttcctgctccgccctcccacgcggcctcagacaggctaggctgcccttacatccgccacgtaaatgaggacgactcttaaacttctgatcctcctgcctctgccttcgaagtgtcggggtgacagagtttcggcgaccatggcactttgcaagttgatcggttcgtgcgtgctaggcaaaccactctgccaagtgagctacacccccagcccatgcagctgcttccctcgatttcctgcccagctcatctctgcagctagccaccacaccacttaaaaatggcccgcacgtgacagaacccgatattctaagtggtagagctatacatttagtagattcataaaattagatgtttataagatgaccaagcacttacaaatgcaggcaagagggttgagctcccacagcagtgctaggttaaggtgatggccagccttaccaccggagactgtggaacagtacttgagaactagttcaggagaggcaggctccaacatcaaggatgaaaacaaaaaggaacagtaagctgttgtgttactgatgacaaaaccctcctgctttaagtctgaagctaatctgctacaatttcctaagctcatgtcagttatcccctcccacttgtctcaactggcattctttttttcccccttcaaatttaaactttgaatagaaggtataaacttttcttccattaaaactattttgccagatttttatttatttatttttgaaaagtcttccagtgtacacagagttgaaaaaaaatagaacacttaaatattcatgagtacttctataactttgtaaaatcattaaatatttgcaggctctctttccctctcttccccctctccttttcttgtttgattctgaactcgttgtacagccatgccatgagtatcatgatggaagcattgattaaaaagaagtgcggttagaggaatgcttaagaacgcccgcttagccagcactctggtgctatacgcctttaccccagcactcaggagagaggggcagggggaccagagtcagagttcaaggcccagcacacatgtggaagcttataactactattctttttaagattttttttttgaggtaggatctatatagccttggctggaatttactgtgtagaccaagctggcctgaactcagagatccatttgcttctgccttctgagtgctgggattaaaagctttcccactatgccttaagtttaggtttttaccataattataaaggttaaatatttatcttttttgcatgaataactgaccaaggattgtgagactttacttaataaagtatttgaatttctacagaattggcacagaaagaggaggaagaagatcctcttgctgaagaaaaacgactagaagaagaaaggttgttagaggaagagaggtcagtactaactgaaacacttaaactcattttattgtaatatcagctgtctaccaactagtagcggcttttcatataaaatcttgtaaaaaaatgggttttggaaaataacctcttacaaactaaatccctagctgacaggctaaagttaggtgtctttttttttcctctctttctttttttgtgtgacaaatccagactagtctccaactcaggatcttactgccttagcctaccaaatgctggaattactggcatgtgccactgtacctattttgttgttttggttttttttttgtttgttttttgttttggtttttgagacagggtttctctgtatagccctggctgtcctggaacttactttgtagaccaggctgctcttgaactcagaaatctgcctcccgagtgctaggattaaaggcgtgcaccaccacgcccggctgttttgttttgttttgtttttttagtggaagtattttttatttcttattgataaatatatgtgtgtgtgtatgtatgtatgtatagtaaatatacatataaagtgttgacataaaggcctaattctattgacagtataacgtaagctatatggatgtagcataattgtttattcatagtttttagtcttctatagttcaccagagtggggacagtatggtgatgagagctgttctgctgtggcagcaggaacaatctagaagtaactgctccaggttgtctgtagtcagggagcagggactcagcttcatttttccctttccccttactactccagccaggaactctagtccacagatggcttcatttagggtaagtcttcttcctcagttaataacttctggaaactcccgcaacagacatgaccagagcagtgtttcctaggtggttagaaacctagtcaaataaagattttaaatgagaatcttatactgttggatgtctgggacttattgatttaaggtgacattaccttttggggaggtatgctttgtttgtatgtttgttttaggcaagggtcttgttctataagctcaaattaacctagaacttgtaatcctctctcagcttttcaattgctaggatcattgacatgtatcacctggctagtctgtgcattttcaaagtcaggtttatgattatggctctaaaaaaaacccatggcatctttgtctataatctttgagtttctattccatagaatcaagggattcctatgatttgctttccaaacatttaaacctctagggaaaaggtatgttgtgagttgtgagcatgtctttaaaacaaaagttttaagggagctggaaaaaaggctcactaattgagaacacttactttgctatttcagattatccaagtttggttcccaatggtgactcacgatcctctgaaactcctattccctcagtcttttcacctcttctgcccaccaggcattcacgtgatactcatgcctatttgcttgctgacaaacattcatacacacacaaattaagtaaaggttttaagacaagatgaaatggagttataaaaataaattagtaaatatacattcagccaggtgtggtacaccactttcatctcagcattggggaggcagaggcaggggcatctctgtaagtccagcctcgtctacagagtgagtttcagaagaggatgaggaggaagtaatgttagtgggaaaagaatgcatcgttaggaagaataatgctatgtgaatgtgaaaattcacagatactgctttgacctgtttgcctgagatgaaaacagaaagaaaaggcggaacaggtgcaaatgcttatgaagtaattgtaactaatttctgtctgggaaggtagttgcttttccgagagccacactcccatcttcactgctttatagaaaatatgttcagatttccatgttgtatactggttccctgtcttctatacattctagactaattcccttttgtttttatggactacatcattatattaacaggcagagactgcatgaagaatggttactgagggaagaaaaggcacaagaagaattcagggcaaagaagaaaaaagaagaggaagctcgaaaacggaaggaagaactagaggtaggcattaagtatctagttcattgagtaagtgcttagctgagctaagtctctttaagagctgtttgtcaggagagatgattggaggtcaagagacctggttgttgttctaaacacttggatttgattcccacaccctcgtggtggctcacaaccatccataattctgggtccagggaatccaatgccctcttctgactttgaggtagcaggcatgcatatggtacatacacatagatgtaggcaaagcaccagtacacatcaagtaaaataaggttatttaataataaaaaaacccaggtgtttgttacagggttggagagaaagctcaggagttaagaacacttgctgcttttccagaggacttggcttctgttcccagaacccacatacgcgcttcagtgtgtataccctcacacacatatgcaatacactcataggggcactcaaataaaatctcttttaaataaaagttgtctttcttggggtatagagctcagttatagagctcttgccaggcatgtgcaaggccttggatcccttccccagcatgtgtaaacaaaaggagagctacatatgttaacataaaacataatagaaactgatattgtctctctttccaatgaacactttctaaagcttttcaagtatttactctgtaggccatgtgtttttaagaatgagtgaaaaaaattaccttctctttttcctttaaagagaaagttaaaggcagaatgggaagaacagcagagaaaagagcgagaggaagaggagcagaaacga

SEQ ID NO: 769 - DNA, 30652 bp, mus musculus
ggccctcccctcccctagatcctgctgctgcgttttcccgcttcaccagcagcccaggccaccgcagcagcagcagcaacagccgcagcaacggtagcagtagtctgcatcgcagtccctttctccttctccagcgcgctcctcagtccccggtcaccatgcctaacatcgtgctcttcagcggcagttctcaccaggacctgtcgcagcgcgtggccgatcgcctgggcctggagctgggcaaggtggtcaccaagaagtttagcaaccaggagaccaggtgggagcctcgctggggctgaggcaggggccaaagcatgcccaggccagctccgcgggcgtcatgctctcccttccggggcgggacggcaacaacgcggctgcagagccagggcggctgcgccaggggagaaagaagttcagcaagggacccccaacccccacccccaacccgggtcaccctggagtctctacgcgtatcctctggctgttaaccttctggtggctgggcctccaatacccggacatcggcgacctgtcgacccttgggcaccccaggcccctcttttgcaccggctcgcctggtgtcttcagtccggaaggacaaaatcggggcagttacagagcgtctgggagagtgggcgcagtctgtgggcatcacttcggtgccgggaatggtgggggcggggagacatcggtggatccgcccgccccagtttccaactctctgccagacagaaacccagaatcctgcatggttgaaaaggctctgcacgggtcctgggcactgggtttatcccagggaaactttcgaatgccacttccagccgctggcgatcagagtactgccagctgctcaggtgactctccagagcagcaggctggccaagcgctgccttatccagaaaggtgggtttgtgcgggagttaggcagagcgtgggaaagcgagacgcacgtgttgagcgctcgcacccttcctttaaactttgttgcatctatcattgcgaatagcttctttgtgtttgtggagcttagctgcgcacagcaacaagaccccagtttgttcaaaattccaccggtttctcacattagcaaaaggtgccaccaggcaggcggaagctctcctcagcttagactagggattccttgtcctacttgcccaaagccaatttcttttcccgaattctatttagcacagttaaccaactatacagtgcacagtgacagataaccgttctatatttagtagcgcacgaattcattccgcaagttttacagaaaaaaaaaaagtcattctccgtatttacaaaagttaacttagaaacggattgtagacacaaacgtcaaaactaaaactgaaatttccagaaggaagcacaaaatcttgatgatggaatgaatcgagaatttggttgtgagattaagggcattttttttccttttggttgttttattttggtttggttttcgttttctgggacagacttttgctatgtatttaggctggtattgaactcacccaggtagtagtccaggtaggcttcgaactcacaggagaacccttgtttctacctcccaagcattagaatttcgggtgtgtgtgtcatcagacccagttagattaatattgatgacaaagatgatttttttctagaggttatgtgaatcccgtgtgaccttttctaggtggtaaactccatttacacagcttgggtgataatagaagaaacctgtggacaattcaggtgaaagaactgccactttgtttacttattgacattacatcctgattgaagtcccccctcctccaagccaccccctaaaataaattaattaatgggggaacaaaaggaagtaatccaaaccttccaggagtcggcaacaagaaaacaacaatgaaatgaactgtgacattgaattaagaacagtgaaaaatttattttcataagttaaaaacaacaacaacaacaaaagaatgccactctggggttggggaatgtagttcagttggtagagttgcttgcaggagtttgcatgaagcccctgtgcagcatcagatcaggatatgctggcacacactacgttctcagcccttgggtagaagaagccagagaagtgggaattcaagagcatctttggctacatgagaccatgtctattttttttttctagtacagaggatgtattccaggtctttgtgtatgctaggcaacaagaagattcaaccactgagctccatccccagcgccctttgtagacttcaataaatggagggtgctctaggactttggagaaggatggagctaggtttggacatagcaagattttgttagtccttgtccaagtttcagcggctctgggggaacaactagaataagcctctttgtttagaaggtgttatcatgtaaataaaggagctggctctggagggagtgggttttgaaagtgtaagtgaagcaacccttctttgtaatctcagtgcagcacaatgctgcaaggcctggctaatctccatgatctggctgagtaagggtttactactctaagtcctgtatcagctgataggggaaacttactcagatgttcaggcgggattgttcgtacatttatttaaatagaaagaagccttgtctttagtttgggttatcttttcaccacttttgatcctgacaacgcctaagcttgagaagacccctcagctctactttctgttgaatgggttgaggttttgttctgttctatctggtgtagtggatttgctttccctttctttgagtcaagttctcatgaggtctaggctggtctggagttcactgtgtcactaagtctgcccttgatttcatgttcctcctgccctcacctcccatgcgcggatcatagagtacatgtcccaggataccttgctactccttgctacattttatgttctatcccatagaacattttaaaaggttaatgtgccaacttttctcacaaactacacagaggtggtggttgttttttttcccccctcctcagtcctcaaattaagtgttcctgtttgactgtagagatgagaaaacaaagggcaaaagaaaaaagaaatggattcaatgtatgtaaggtactttttcttcagtgcctcttgctgagtgaggagcagaagtctgaatgttatgccctggtcctcggcacctcagatcctaattttcttaaatgctacttaatcagacaggcactcttcggcttttaccttttcatctgtgaattatttccattgtgcagggagaagtgcatttcagcttctctcccaaccccagcaaatgctccgtgatttggaggacagtgttcgtggttggaatccctggtctcttgtattttttaccctggtttaatttactgctatcagggtccttaacctgtataatgggacccaatgtacaggttactgccacttaacaaatcaccaagaactcaggggcttaaagcaatcagtgttcatttggttcccagacctgaagtttgtgcagatcagagcaagaaaggcttgtttctatctccagcgagggctgctagggtggatactgaggccacaggaccaatttttgaagatagcttacccacgtggctgataagtttggctagcttttgccagaatgttttgactaagatcactccacagggctgcttgggttcccttgtagcattggagctttgttccaagaaggagagtttcaatagacaggaagtagttaagtaccagtttgttatggcctgggcttagaagttggcatatcatcacttctataacattgttttggctaaacacagtgccctcttaggtctagggaaggcacttagattctaaggacaggacctagatcctgttctacagtagaaagaagtgttataattgttgtagtcattaggtattgagtcagtcatatacttccgccttgctgtttgagggtcttctgtctttgggctgatgcacacaacccattagagaactccactccagattggggtgtggaggtctttgtaagtagaagcagaactggctttggaagaaatgttaccatggtgtttcccgtgctcccctggactgctagtcctaggaggattgcagttccttagtgaggaaaggcaggccaaagaatgtgatcttgggggataaacagtcataagaccaagacttgggaaactttctgtaaagagccagatcgtaaatattttaggcattgtgtgccacgtgtctctgttactgctttgtcttacagatctgtaagctacaagtcctgcataggtcagcagggctgccttccttcctgaggcttcaaaggcaagtctattctcatgccttttttagttttcttttcttttctcttacagtctcatgcagccccaggctagccttgaactctcaatatggtagatgatgaccttgaacttcagattctcctgtctccacgtcccaagtactaaaatcacagatgtgtgtcaccatacttgatttagctactgatgaggctctaacttcatgtatattgggcgagcattctaccaaataagctatagccccagtcccccttttcagctttgtgggcaccctgcagccctgggaccttgggaccttcataaatagagtatctctctgattggatttagtcatcacatctgtttctactcttctagtcttcctcttccatcttgaaggctagccattatcacatgcagttaaatgtgaatagttacgtatgacctttctgttttaagatcacttgattagcatgactaattccacctggacatatacatcccttttgtcatataatctaacatattcgaaggaatgcaatataaatgtctttggagggtcttcattactgggactaccaaccgttgttagtgtgtgtgtgtggggcgatgtatgagtacaaaaacagggtgagcactgtattttgtcagcccctgagctatgtaatacttgctttccaaattaagtcagccctatgcatgatggaatcttgttaaatttcaaatgatttgtgtgcaagtattgcacatgaatgtgtgcacatatgtggacgccaaagaagaactctgaggagtcagttctcttttgcacttgaaggattgttcttgcttctgccatgctgtatactccatgctgtctgcctcccaagcttctagatctttctcctatgcaagcctcccacctctccatcagcgttctagggttacagattcatgacaccacatccaactttctctgtaggttccagcgactgaacatactttgttaggcttttatctactaagccacctcattagcccaagaatagtgttcactctttagcactcacaatcaggagatgtgtttccgtttctttttgtgtactgtagcatccatagcagagaaccttaagcaggagtgtgagcaaatagcaaaactagtttttggagccccgcatggtgactcatgcctgttatcctagcacttagtagatggaggcaggaggaaaaggagttcaaagttatcttggctttgactataagtgtgtgccaccaaaccagattctgatggtgtatttttaagtggctatattcaggtgggcacagtgaagttctctgtattctttttttttttttttttttcagtacagcggatggaaccccaagggtttcatatgtgttgatgcaaataatctaccattgagctacttggacaaccccagttttccgaattgtatttcaatataagaaattacacaggcctggagagatggttcagatggttcagactgctcttccagaggtcctgatttcaattctcagcaactgaggtggtgggtcacaaccatctgtaataggatctgatgccctcttctggtgtgtctgaagacagccacagtgtattcacatagataaaataaataagtaaatcgtttttaaaaagactatgaacaggttcaactttttaaaaaaagaaggtacacagaggtaaaattcagttcaagttttttttttttaaagaagttacacagaagcaaaattcacaggatgttcatagtgtttcattttgatttgattgtgtgtgtgtgtgtgtgtgtgtgtgtgtatgtgtgtgtgtgtgtgtgtgtgtgatatgtacatgtctgtgtggtcatgtgttcatagtgtctcagataaatcaaattgttccaactcttggatcagcattgccattttaaaaccagagttctgcgagagctgatctgactctttgtgtgatactctgtggtggatataccaagatgcatgacactttccttctctctggcagccagagaacgtggatgtgctgatttagctcattctgaataccccagaaacctttagacatgtgctttgcaaaaccttgactactatacgacctaactcttttctccaggtgctacaggatgacaaccagcaaagcaaggaagtataccacagggggaaaaaacgaaaacaaaaacaaacaaacaaacaaaaaaacccagaaagtaaaaactggtgtgcagccaagaggtagagagtatctatggcaactgggccattcctgtcatggagctgtgggttgtaggatgtggagatggacttgaagactgacactaagagtttgaaattctgaatgggctgtggggtggcatctgtagcaaataaagtttagcagagaaaaggctaaggtaaaagggtgtgtatacgcacacacaaacacacacacacatacacacacgcacacacacatcgaaacgcaggcttgagagaaaaatacgaatgttgatttagttcacctcatggctcagctctgatcttcatttccagaattcaaatggagctgtccattttttagcttgagtactgatgtgtattgacatgatggcgaggtgggaagtgttcgtctgcatgatggggaagagaggaagaggtgttaaatcctcatcttccatagtgagtagtcaatacctgatgcttcatgaaaaattaggatttgggccttgaatgttagatggagacttgaaaataaatctttattgaaaaagccatcaaagattgaaattgcttatctctgggatgtttaactgttataagccttacagcataaatgtgcatctctctctctctctctctctctctctctctctctctctctctctcagagagagaggctagttcttgttgctttgtagtctgtgcttgcctggaaagcacaggaatgctcttttctcagcctcctgcatgctgggattataggctaaactaatcatactttttcatggtttgattgtgtgtgtgatatgtacatgtctctgtggtcatgtacatgtagaggccgtcttcctctatcctcctctgctttacttcttgaggcagggactctcactgaacctggagttcattcattcggctggctggctggctggtcagcctacaagtgagctctaaggatctgctgtctccattcccccagtgctgggcttatggatatgtttgctgttgctcctggcactttttaaatgttgattttgggggagccaaactgagctcctctacatttttgctgatagtcacattaccgactgagccatttctccagctcctgcgatttgaatttttaagacactatccagtcttaactttaatagtagaaaacattgccataaggaattatcagagaagcctggaacttagaatggctccttgaaaggttagctcttggtcggcctaggggaacttagctcttgcaagggttcccacaccattctttggtaagaatggctccttgtgtgtgaactattaacagctaggaaacaatgcgactgagctcccgcctgcctggtgcgaagctagcattatggaatgcgttagccagtgggtgactccatgaccagcttccagtctgtaagtcttcactagtagacaacacttgccagttatcaccgctcacagctggacactttgggctggacttctgtgacacctgtggggaagaacgcttggaaggtcacacctggacgcccccatatacttttccctttgctgattttgtttggtgtccatagcatctcataagtcacaatcaggattatgactgcagagtcccatgactatacctactgctggattgctgaagttggaggtggtctcaggaagtctcagagactatgatattaaccaatcttgtgatgtctaattgctaattgtcaacatgacagaatctgggatcacctgagagatgagcccctggctctgcttattggggggtgtatcttaattgtgttaactgaggtggaaaggccaagtgtgtagcactgttttctgactgggccctgacctctgtcagtgggaaagagagctgggaagtagcgtgcatccatcactctgctttccgattaagagtgaagtgtgggcagctgcttcaaggcccctccatcttaagttcctagccaggatggacttcaccgtgaactgtgagccaaaataaagtcacttttcttagagtactttaaatagcaaccgacaaagaatcctaagacagatggcgttgttcttttatagtgtcgagatcggtgaaagtgtgagaggggaagatgtctacatcatccagagtggctgcggggagattaatgacaacctgatggagctactcatcatgatcaatgcgtgcaagattgcgtcctcatccagggtgacagctgtgataccctgcttcccctacgcccggcaagataaaaaggacaaggtaggcgaggtgtgtcctgccctagcaacccagtgtgctcaccactgtttcctcacctattgccttcattagactatccagaagcctcagctttcctcttcaatgtaaatatgtgccctcaccttgtctattccagatttgtcactgaacccatcacatgtatcaacacaggcaatgtatgtttcaaaggcagtcaaataccattatccttgttatcatgatagagtgttgtaaggtggtgcatagagttaaatacaaacacacacacacacacacacacacacacacacacacacacacacaccactgaatgagtacaagtgaagaggagaccatccaaattacttcactgccttggatcaaggtgaggtctccagttgaaacattgtgttctttgtttggttggttgtttttctgagacagggtttctctgtgtagccctggctatcctggaactcactttgtagaccaggctggccttgaactcagaaatctgcctgcctctgcctcccaagtgctgggattaaaggcgtgtgccaccaccgactggcgcaacattgtgctcttataagtggtttccattgtaagactgggtaaaggggccatagggtacctgcattgctgcttctaactgcatgcgaattcacagtgctcccccaaagtttaattaaaatcaatactctgtttttataaggagaacagcattaatattgcttattattttagcaaaattcccactagtgtatgtaagtttccaagagaagctgaagaacatacagttgttcttagcctcgttgacacattagagaagattggttaaggccaccatcacaaattaccatgagctgggcagatttacagagcaggaaattattctttagtttgcagaccagatgtctgaggtcaggatgtgtcagagccgtgcttgctatagaatctttcctgccactttcaactccccaggaattcgggcttctcttggtcagtggcctcaatgcttcagtctttgtcttcaagacactcctctgtacgtgtgacactgtcacaggattgaaggctatcttcattctggatgatctcatctcatgatccttcactaatcacatctgtaatgatgctacttccaagtggcattaataggttctgagggtcaggacatggacatagattcttgtatgtctccattcaaatcaccatagtttgatacagcttcctctaagacccccaactgccagcaactggggcctttaggcaatctgttaattctgattacattcctttaggctctgcctatgtcctctatgccatggtttctcctcttgttctgtgtctccccttccatcccttataaggatgcatcattggatttagggccaagcttaatcaaaatgacctcagctcagtatctttacattaacagggtctgcaaaaaactttctacagtgaggcttcattccagactcatgggcagataagaatttggggagacaaaaacattcgcctcatgtcagtgaaaacgaagctattgtttgaaaacagcactcaggatcccatggatttgaaaaataaaactaataaaattatctgcacaaacataaatttatgtcctaagatctccttgaatattaatctattatcttaaggaatgaattccagagtctgtaaggaacacagttctttgttcagtgtttcatcaaaatgtgatatgaagaactttattctttactcaagatgtgatttactttatatgatcaatttttattgcagtcatccaactgtgtgcctcaaaaccagagatcaagaacaatgtataaatgacagatgtggagaggggtagtagggtaggtgggaggtgagactgctcactatgtaaagcatgtatgtgcaaaaccacaaaacatatccaagttaaaatgtatttatagacatttgtgaatttctatttctatataccatgaaatattatttacatttccccccaacaattaaatatgcaaaagaaactttgtagctcattaacagtacccacatatatagtaggctaggttgggcccacaattctcactttgcattagttttatagttagttttgtgttaatgtaactaaaagatctgtgctgagtgacttataaaatgaaggggtttctttagtgaggctgggagatccaaacaactggactctggcatcctggctgctgttcacaatatagaagaataatgaactagccagatgtaaaagggtacgtgtgagcaaaggacaacctagtggagatagacagcttcattttgtttattataacccactcttgtgggaagttgctcactgagatggtaaattttaattttatttgtcaacttgacacaacctagaatcacctaagaagagaatcctatgagggattatcgaggtgaggtttctctgtggtcttgttttggggaatcgtcttggttatattaattcattctggaagatgcagtatgaaagtaggtgacaccattccttaggcttgggtcctgggttgaatgaaaggaaagtgtactgcatctcagtacacatgcattcattcgctctgttcttgactatggatatgactagctgcttgaagtgcctggcccctccactttcccaggatgatagactgtatcctagaattgtgagtcaattaaaccccttatactgtctttgtcagggtgttttatcacagcaacagaaattaaactgacgggcaagcggtttgatatattgccagcatgattaatttgaatcaagttcatgtcctttgtattttgtgtttggctggaggataatggtacattatggcttcttcagtaaattttgttcttacaagggtcctgtccaattgtggggcatatgttcgaactccagattcttctttaaggaatacaaatattgagacacatttggtggtgattgttgacatactgatacatggtaaccttttctaaagtcaaatttcctaacttcttctttattccaaatttatgacagagaaactagctctgcctgccacctgccacctgtcatttgcattgcaggaaatgttttggtcttttgctctgtcccctgattgcaagcattgccccaactactatgccagcaaagagagctctatgggcttctcaaacaccagtaaatttgttatataattttttattatatctagtggtgtgtgtgtgtctgtctgtctgtcgtgtgtgtgtgtgtgcatgcgtggtgtggtgtgtctgtgtgtatgcatttgaaggtcaggacaacttgtggccattgcttctcgcctccaccatgtgagtcccagggattaaacacatgtcaacaggtttcattgcaagtgcctttaccaactaaatcatcttaacctcaccctctcccacccccagtggctttaattgttttcagaactgcactgtgtgaccagctatctaccagtttccccattgtcaaacatttagatatgttttccatttggagccattttgaacctgggtcccatgcctttccaaacttagctgctaatgcacaagataagactatcatcaagcagcatttgatcgaatggcatttgagagacagtaagtgcagctcaggaaactgtcacttactggtggagagaagaaacaggcctgcaacaaatggctgtaaacagaatggcttaaaacagcagccgtgtgctcttgcacaactctggagtccaacattgccaaatcagggaccaacatttgaccgatactgatggatagtaaatgaaattgatgatggataaggtgaacatgttcaggcttggttaagctttgatgtagtgctggtttccaatcattgatcacctccaacaggatgctctagagattaaaaggaagtcaaaggctgactgtgccaggaaacaagtgtccactgctcacactgtcctcagcaagtcttgtacaggtctgtagcctaaagtagccttagagggagtcaagacccatggatttttctggagtcatggcttcctttatttttaatcttacttaagtctctgtatgtgtgtacgtgtgtatctgtacatatgctatagcacacttgtaatcagagggcaatattttggaatcagttttctccttctacttttatgtaggtctaggtcaagcttgtctaggtcaggcttgtataacaagcactctcacctgctgagctccctggctagccttttcagccatgacttctaatggatccgggtagtcagcatgattcaaactatagtaaggaaacagtttacagtttcattcttgcatccaattgaatctgtcaatctgccattcaatgtgtaacatttgcattctgtgaagttttaaaaactgacgtcttcctttcaaccatgcagcttagcctgatgctgggtgggcactgagaatttggtaggagaaagaagaaatgaccagaacctggtaaggtacttcatttcttagtccactgttcccatatctcagtgtctggggactgtgaggacaccaaccatgatttgagatggaggaaggtacttcctacttcctttttgatttttttttcaacttttttttttctgcttcacttagggaggcagaaagccaggtggtatttggatgtcatagaaagccatgtgctacatttaacctagacagaatattcttgttggctacaggaggagctctgggcagccctcccaggctgtctattgttcttttctcttcctttgggaccgtattgcccacggccactaatagcacagtgaagttctgtgtaattgcctctaccaagaagtaccagtggaaagagcccagaaaaaaatctcagggctttaaaacattttccaaacttgtttcatgtctttttaccctttgcactatgaatatagaaaggtttatctagctttgatttgtaagtaccagaacccaagcgcagcttctcacaggaaagaaatggtttcataaatgaccacttaacacaatggaatattcacacaggaaactggcagtgatgtcatagtaattgtcaaaggcatgatgtaagccctggagttgcagctttgcaatgaagtaggctcagttttgaattcaaataccataattcacctggtttgccctttttaaaacatatttaacctctgcacctttggtttccttacttgtagactaaggaccatcttagctggtacagttgaagctcctagcctatcatacacaagtgaacaagctttctgagaagcaccaaatattggtgttgtagcccattggatggttatgacacttcaacttccatcattttagtgtggagactgccatagccaatacgcaaagaaatgggtgtaactgtcccaatgatgcttcatttatgcacactgaaatatgggttttatgtcaccttcacatgctacaaaaatcttatttttgtctgttttccaatgcttttataagagacctttcctagctgcaaaccaggaatcaggcaattctaacctaccagctgacatttgctgggtcctgtagtagacactcagtaattgctagttctcttccctggagagaacagtggattgcgagccaggcagggaataattacttctgagagagtgaagaagggctgtcaccttgaatttttttttagagtcatgtataagattatgttgatattttaatgataaagtggttgacacaagtaaatttctttaatcttgtaatctctgtatgtgtttgtatgtttaggggaatgtgtgtctgtgtgtaagtcctgcacacttccatgtgcctgagaaagtgcatgaactcagacaccatttttctggtgtctggtgctgcctaccttttgtgggtttgtttttgttttgacttgatgagatttctcactggcctgaaacgtgccaggtagacagcctgagagcatcaaacctgtcccctccttcccagcacagggtcgataatgccacagcattttgatgtggactctgagcttgcactcagctgttcatgctcacaaggcaagtgctttgcctacgttaaatgccacactgattgttctctctacaggcttatggtttgaatgagagtggccctctgggtgtatatgtttgaatgcttgttctgaagttggtgggactgttaaggaaagattgggaaatgtggccttgttggatgaagtgtaaaggtttatcagtggggcgtctttgaggtttgagaagcccatgtcaggccagacctctcccccctctctttctctctctttgtatctatctcttaatcatggatgagctataagctctcagcactactctagtaccacacctgccttcctgctgccatactccttgccaagacaatcatggacttaccctctgaaagtgttagcaatcccccaaattaaatgctttctttcctaagttccattggaagccatatctgaggacctggagcagacttctgttggccccatgcttgctgcttccttctctgagttcacaagatctttgcttagttgatttagagggccttgttctcttggtgttctccagcccctcgggctcttccacacagttccctgagccttgagggaagggatttgatggagacatcccattgaaacctgaatgtttcaaggtctctcactctctgcacactgtctagtggtaggtctctgcatttgttcccatctgctgcaggaggaagcttctctgatgatggctgagcatggcactgatctatgagtacagcagaatgtcattaggcgtcattttatcactaaggtttctctttttgaccagtatttggttttacccaaggaccttgggctatctattcacacattcttggtcacctaaacagtgtcactgtagaagaaaggggttatttctggtattctaagaggtacttattattgtgatatttgaaccagactttgaaggatcaaacacatgggtgtagcaaagaatatgtgagattggggcagctaagtatgcgagacaaggtcttggtgttctctagagaaagtgaacagtctactatacaggaaagggtgctgcatcggaggcaagggagagcaatttgcagttagctacaaccagattgaccagagtacttgaatattaaagctgaaaaaatttcgattctttcccaaaggcaacatgaaataccatacaggggagttaaataaagatgggaatatagaggagatcaaaacaaaccccctcccttttaaaaataagatgaagagaggctggaaaaatggctcaatgattgggaacacaggctgttgttacagaggacctgagttctattcctaatccacacgtggtaggtcacaagcatccataactctacttccaagggatacaacgctctcttctggcctctgagggtactgcatgtacagcatatgcagctgtttatacattcaggcaaaagactcacacatctatgtgtgtgtgtgtgtgtatgtatgtgtgtgtaaaggaaaaacacttcccactaggcatgatttttcatgtctttaacctcagctctttggaagtagtaccaggtatcaaggctagccttgtctacataatgagttccagtacagctagggctacatagatagaccctgtctcaaaacagcaataacaacaacaacaaagcaaatagagaatacttccctacagttttactttttagaaaatctgctggtgatgttaggaatgtttccgctgattctgtgtgtatgtaattattgtaaaattaatatatagatgaatgttattttataatattaactatactattgatatttgttggttatatttataaacaatgtaagatatatatattcattataaggtgatatgtatttgtcttttaaacaatagtgttcgaagggaaataaagacaatattcaatattaacattttatacaatattaagattgtattttcttttgtggcttgcatataagaatgtaatggtgttaatgactaatctcctatacatgtctggactatgtctaatgatatctgtgcaatctctttggttgctttgatgtggactttttcattgtctgtgatttatgatgtggaaactaaatctataaagaagttacataactttagaaaaggcatatgacagaagggacaatgaactagtttctctgaatgttcatttctcaattacctataactgttaattctttcatttggcttgtgtgtcactgttcccgtctagagcactcttctgtcagctttggctggccttgccttaaaagtgatttcttaaatcatcttgttgaacctctttgtgttttcttgctatttgaattataggactgtgacattgcatttgcacagtttgactttatccctttaatatttgtattctgtatgtagtgtcaggtgcatggctgcacagtagtgtaaggctggagatgtagtttagtcagtagaatgcttatctgggatacagggattcctggatttcagccttagtaccacagaagttgagcatggtggcacatgcctataatcttaacattcaagaggtaaaggcaggaggatcaggagttcaaggtcagcttgaagactcagggtcagtaacaagcaaacaagccatgccaagtagtagtatatatttagttaccaaatccaatgtatcaaatatatcttttgttgttataacttataatttttcttattggttccatctgattcggttttctcatgactatcattgtgagaggaatctaacaggttccatctttttctgatattaaatccttgtttctattttttagagtcgtgctccaatttctgctaaacttgtggccaatatgctgtcagttgctggggctgatcacatcattaccatggacctgcatgcctctcagatccaggtacaaacattgtgtttctgtccacggttaggtcctaactcccttaactaattttgaaagattttgagtctgcacagctactgtcctggctggctgtctttcctgtggatgccaccattcctaacacaccttgcctccaattcatttatgaggaacagaaatgctttcttatatgttttgtggttccatctaagcttctgtaaattagttagtgtagtagtgcatattgtgtgtgtttgtgtacattgcatgtcttcctcaatcactcgtcagcttaagttttgatgactcggtctctcactgaacctggatctcatcaattcaggaaagttggctgaccgatgagctccaaggatctgcatacctctcctttcccaacactggggtcacagaatgtgcagcatatgcttgtacagcaagttttctatacattcacacaccaggccatctccctagtcctgcaatacacatttttagtttcttcataactttctcttttgtcacaaagacggaccacatttctcagtacctacttatgatatataatgaatgtgaagtatttgatgtgtgcttaagtgctaaaacaacaacaaaaatccacctgtcttccagtttgtcctgcaatgctgttctttctctcggtgcacataaatatcagagcatgcctaggaaatggactggactgaaagatgccttgtggcatcgcaattgttagatttaattctgtaacagttacccacagggatactggtgtataaaagtatcttttggatcaatagttcaaatgttattgaaagatagcaattaccttttaaaaaaatctgtatccaattaaactaagtccctttccccgtggagcgtgctgtgccgtggctgcaaacagtaggcttcttgggaggttttatataggggtttctctaagagaccttggggactgaactttctggtgaatagtcttgtcgcttatctcatcttgtcaccagtccaggcttcagagaggtatatggatcaccattgggaagccccagggcacagtgggcaaggttcacattggccagcccatcatgtgtataataccaacctgtaaaacaaggatttatgcgattgaggtcctacacagggttaagttcaagttccctagctgacagaagagccacatcttttgagagagagagagagagagagagagagagagagagagagagagagagagagagagagagcaccaagtttaatgcggatgaatctgaagagatgttatcgaagaagcaacattttctcaacaagcgtgggacaaatatgtccctaatcatggtccctcaggcatgtggtaggactctgtgttcctgaggctttctgctgtgcttaacccttgaccctgccaatcatgtactctaataaatctcacattcaatcggaaaaccaagtgacattgattttcctccttagggtttctttgatattcctgtggataatttatatgcagaacctgcagttcttcagtggattcgggagaacatcactgaatggagaaactgtattattgtttctccagatgctggaggagccaaaaggtaccatacaagtgataccatacacatctcacctactactttcctgacttctgtatttctctatgtcttaagggagaaagcatgccttgttcgctgggggaaatagttgagtagttaaagctaatgtcccacaagcttgaggactgaagttgggtctgaagagcttatatagatgctgagtacgctttacggtctgtctgtgattttagccttggaagacagggatgggggaattccccaagctatctaactagctcagcgtttaattgagaaacactgcatcaaaaaataaggtaaaagagcaatcaaagcacattcctgacattaacttggagcctccacatgtgtgtgcatacatgcataccacacaaaaacacactgacaacctttatagatagcatgcttagtgtgtgtgtccccgcgcacgtgtgtgcgtgtgtgtgtatgtgtctgtgtgtgtgtgtgtgtgtgtgtgtgtgtgtgtgtgtgtgtgtgtgtgtgtgtgtgtgtttgctggggatagtattataatgtagccctgcccccaccaggaagtttgcttttaattatgcaacattttattttgtaaatgagcaactgaataggtctcaggctttgcctccagaacagaaacccatcactgtcccagcatttcacatcattcatgaaaataaaacaaacacacacatacattctatataataagaattttaattaacacaattgactgaattagtccttctaaccacaaacacttgactggagcaggcacaatagaaaccagtttttcaaaatgtatatggaacaacaagaaagggggctaaagtctgtctacattacagatggggctggactgtactctggtgttctgggggatgtgggtgagatgagaaggggaaggcagcttggcctgtcccacctattcaagtgcctccctaaagcaggatgcgaaaagctaggtccctagccaataagcagagcctttggctgagggagaaagtagtcacccatgagaaatccaaccacaagtttgtgccacaggcaggtgaatatgaggtctccctggggtgttggactccctggactaagaaaattaatacaaaattagtctgacactgcagtacctctatggagaaagacttctacagtttgagttggtagggtatcagtcactgtaccatgtgacctgtcaatctgatcatccaaaatcagccagccctgagggactaacatgcccggattccttgtgtatagatagccaccagggcacaggcagccagtacttaggagatgtagaatgactggcaaatgaacaggtttaacgagaaactgagcgtgctgccacagtggcaacctaaggacatagccctgagtggcagtgtcaaccagctctatggagagcttcaaggggcgcacgaaccactaggggatgtggtgttgtggaggcaacaagaataagattatgctggtcctacacactgcccacactgcaaactgagccttaggaccctgagccttggagaacttgccagctgctatctgggaagacaaacctggtggagtggagtggagttgccaaggtaggggctgccataagaaagggaaagggaaaagagaactctccgcaccaactaaagtaaagaggtttattgatgggagtcaatcatttgagtccagggtaaagaatgaagatcaagcttcagaacaacccaaaagggcagtgatcttgggtgtgtctcagtggtggaaccttggcagtcaggctcatagccctggatttcttctctagcactgcatagacacatttgagtacacacatacacacacacacacacacacacacacacacacacacactcattctcatgtaccttctcctcacttgttgatatcttcatctccttgcagccctagaatcacacttaaaaagacttaagagtggccaataaagtaatcccaatgcattgcgttccctggttctcagaagagcacatgtgttgggctcttagctgctgtccaacagccactggttctcagcacagaagagaagaaaacagggcaggtaactggagagggactctctgacagctgctggaagtgcctctgcacaggaaggagactcacatgaacgacagtggcagttaggttcccaagcccccaactatgcaggtgtcttagtcagggtttctatttctgcacagacatcatgaccaagaagcaagttggggaggaaagggtgtattcggcttacacttccacattgctgttcatcaccaaggaagtcaggactggaactcacacaggtcaggaagcaggagctgatgcagagaccatggagggatgtaccttactggcttgcttcccctggctcgctcagtctgctctcttatagaacccaagactaccagcccagagatggtcccacccaaaaggggccctccccacttgatcactaattgagaaaatgccttacagttggatctcatggaggcatttcctcaactgaagctcctttctctgtggtaactccagcctgtgtcaagttgacacaaaactagccagtacagcagggttgggcttgggagctagcagtagtccattctctagcccagagcatgatgagcacatgtgaccttgggcaagccattgaagttttcccaggtcatgtctttttaaccatgtgagtgactttgcagagtcatttctcctggatttcttccatatcaactttgcagttgatttggaagcttcccaaagtcatgaggtagaacatgcattcacatcattcaaatctcttctaggctaaggggtccggggtgttagataacttgggttataacagcagtaggggattcagaatattttcagatttctgcaactgttactggtaaccacctccacacattttcatcacaccaagaggaaaaatcccatgccccttagcagttgccacccatgtcccctgatcccattggttactccagtgtccctctatgggaagacacataaaaaatgtgttcatatcaattgatcatacagcaaatgaccattttctctggcataaaagaaaaaagaaaatagaactttggcccaagcaagtctaaagaataatagattccatggagttcttttggccctttcccttttcctatcccaactgtctctatctatagccaagaatatcattcatactttcagcaaaaatattgaaacagaggctagtaagatgacccaggagttaaaggtgtctgtatcccagtctgataacctgagcttaatacctgggagcctcataagagaagacctatttcttcaatatattctgactgccacacttgtgctttggcatacatgcatacacacacacacacacacacacacacacacagtaataaaaaattaaagcaaattgaaagaaaatagaaaaggtaactcagcttcatcaagtactgttgttctttccagtgttagggtagtgttcaaacatacatcccctggttccatagacgcagactaccggtaatgtgttcccatgatttgactgtggaacctttcccccagcctcctttgcctgcacacttgcgccacagctgcgttgggggttgtagaacctgggaggcagagtgtcactagaagaaggtcattgtggggttgtagtttataacccagatcagcttctgcttgggtctctgcttcctgttcctctaagatgtggcaaatagaagccacctgctcctgccacaaagaagttgcctactaccagccattttcctatcctggtgggctttatttccttaaatcatgagccgaacgaagttaaccctctccgctttgagttgttctttgtcagggtttggtcacagcagtaaaaataacacagatgcggcacacacttctccacagaggttcttaaaaagcgaactcgctatattttaccagtaattctatagttatctaacatatattcttgatcatttctcaagggaggggggatttattttgctttgtgatttgaaggtacagcctattatggccaggaaggcgtggcatcaggagcatatagcagctagttgctttgcattcttagtcagaacaaaacacaaatgctgggtcttagtgcccctcttttctatttagtgaaagaaaccatttcaacagtgccatgtattttcagggttacctggttgttttcatagctgtgtaatagtctctctcgcgcgcgcatgtgtgtatgtgtgtgtgtgtggtccttcccatgctactcattcataaacactgttgtttgtgtgaaacactgttgtttgtgtgatacaaatttagcagaattgtctgaccttttgcatagttgtctaaataagatacattcctaaaattaaaactgccagcccaaaggcacaggacatttaagttttggtggacagagctcaaagtgggtctttcagaaaagatattccagatagtgttgtccagtatggctgccagagtcttggtacccacccttgctcacatagtgtataatcagtttcagttggcctatgaggcaagtagcctgagatatatcttcttgtgaacttggttgttaggagtgaagtcaggcatcctttctggtgtgatggtttttttctatgagtacaaacttccgtgtcttagctggagacgtttacctgcggattggcaaaggtaggctattaccttttaatgagtatctcaggtatttccccagttttttaactgcctcccacttttatattcttattccctaaagaactttgaaaaccatcttatacttacattttggcttctgggcctatgaagcacttgcctttcccttaaattttttcttcgcttatgattttgcatattttcaaaggtctctttttctcttttaatgttctgatttttcttgcatttgacatttattgggaaataaaaagtaaaataaaaatccaattcccacctatcctccaccagctatctagtcattcaagagctattgaattatccatcctttctgtattggtttaaaacaacattttttattatatactaagttcttctgtcccttgcaaactcccacttttaaaaatcacagaagagggtttgggagatactcagtggataagtgttctttctgcttaagtgtaaggacctgaatttaaattcctagcacctgtttaaaaagctaggcatgaccacataccctgtaactttagcactgtgacgcatatggacagaatgatcggtgtgacttcctggcccagcctaggcccaggttcagtgagagaccctgcttcaaagtataaggtagaaactgatagaacaagcattttgatggatacctctagcctctgggcatttgaacctgcacatacatgtctctctctatgtcacagtttgacagtgtatgtgtgtgtgtgtgtgtgtgtgtgtgtgtgtgtgtagggagggagggagagagagagagagagagagagagagagagagtgagagagagagaaagagagagagagagagattgagactagaacagagtaagtgaccaaatttaaaatgtttttctgtttaaaactcttcagaatgctctcatgtagccactcttgctccctgtgctgggaaagacgggctctttagggatctacagcacatgtaggaatttgtgtcacgtcttttctctttacctggtctgctatacttccgtgtcaccatcatatattgcaatgggctactctcccactgacactcccccttgagcagcctggcaagtcgtgcatgtcacatagagtttatgataagatattgttggcttttttgcttaatgcaaagtcatattccactagagaaaatatctgtttatctggactatcgagactgttttagagaaagctttgaggtcaaatctctccaagtaaggcttgctcttgccacaggaggtcactcttgggtagtctttgaagcttaattgagttgatgaggaacactgactaataagaaagaagtctccctatagtaaatctgtgtgtgtgtgtgtgtgtgtgtgtgtgtgtgtgtgtgtgtgtgtacatatatagtaaatagaaatgtaaagggttgtgggtcaaactaggtgcttaatataaccttttttttcttgattatatatactctgaacatgtggtatcaaaaaattggaaacttggaaagaagaatttaatactttatagcattagagacatcagtaggaatgatttagtgtacttgatgtcctgagaattcacatacagatggcggcttccaaggcttgtcctctgaccttcacaggcatagggtagcctgtacatgcctgcactcacacccatactactaacaagtaacatttgaacagtgtatatatggagagattgctcagagagtaaactgcttgctgtataagtgtgttgccctgagttttacattggtgcccagcaccaatagaaaagctcggtgtgtctcttaacactagtgagacagagacagacagattccaagggcttgctggccagccagccagtctagccataacagtgaacttggggttctgtgagaggcctggctccaaggataaggtggaaagtgatggaagaagacacccaacaccacattctggcttccacacataacaggcaccaaacatagtttttattctagctctttccacctccgatttcaatgggatttgttgtattaacctctcttatgggggacacatcgagtctccattgtgtatgtggaattaattccatgcagctttctcaggaaatgataatagtatagcgacctaggggatttggggaaggaatctttccctttcgctaatgctgcataaactagcaagtcattgacatgtctggaactccacccagatcaggtgtctatgggcctcagtgccaagagccacagagctcactttctttccctggcctctctgcctttctgcctgcctgcttgcagtgggattataaggttacacctggacttagagcttcaaccacaaactgtagtggcttccactgctgtgctgtggacaaggggcccttcctgtttcataccacacaaataaatagaagttattccgtatctacattttacataatctgcccaagcatcttttcttgaaaaaaaaaagctgtctcatgttctgagagcccaccttttcttaattggagtttaaaaggctgatcatgaaattggcatgtgcatagtatatacttgaaaatgattatggggcaaaaagttttacctgccttcaaattatagacttcttctttgaattaactgtttaagtagggaaacttggtagatggacagtgttagaaaggaaagttgtctgctgctatgactacggtttgggttcctgctgtggttttcttgaaatgaattttcaggttgtatactttgcctagtcatatcttcaatctgcctttactgtggaagtgcaattttagtagctataaattcatagcctgactccagggtggatgctgagaatttctgacattcttttctaggtaacccgtctttaccctttacctcttttaagacatcatattttccgtagttttattgtacttgcttaggggattcatttattcagtttattgctcagaggattagagtcttccagtagttctagaaaattctcaggcattgtttccttaaagtatgcgtgtgtgtgtgtgtgtgtctgtctgtctgtctgtctgtctgtctgtctgtctgtgtgagagagagagagagacgggtggggggagctccagaggtcagcctttggtgtcattcttcagcagctgtctgcctgtgttttctgagacagactttgtaactgtgacctagagttcccagttagtcagcctacctaacccactaccacaggaatcctacctctcccaaaactgggataacagacacataccgcttcaccaagcttttaggtaattggtagggctcaaactctgaacttcgtgtgtttgtgtggcaagcactttacctgctaagccacctcccatcctctttttctcttgacagaggacagctagctacttctgcctctttgcactcagttcttcatgactttaagctcattttacatgtttctgatctctccctttttggattacattctagactctaacttcatcttacctttaatccactctatctaggtttttgcattttgttggctgctatgtttataagttcaataaaatttaaatatactattttctatttcacacacaaaaaaacatttcttttctcccaactctttttttaaaattattactatttgtaagtacactgtagctgtctttagacactccagaagagggccccaaattttgttacggatggttgtgagccaccatgtggtttctgggatttgaactcaggaccttcagaagagcagtaagtgctcttaaccactgagccatctctccagcccttctcccaacttttgattgggcattccttattacccttttattcttatccaggcatccattttattgttttaacatgaaaaattccttcatcttcattttcaacttattccagtggctcattctttggtcttatgattttgttacagctgtttctggcttccagtttgagtgtcttgctatccttggatgtcttatgtcccccccaccccccagcccttttgtagaatcctgagatgttgtataatcctgaaaggatttgcacatatttcttttgagttccttgaagaactaccccaaattatcacttttagattcaactctctgcttgtgggttttcatcccatacataatgggaactgaaataagcagccatcaggtgagctgagatgtggtttagcatgttctaaaaacatctgaccttcacccagaatcagaaatgaggcaaggtcaatgcccttcctgttcccataggggcaggacactatatacgcttatctgacagctgcacatttggtcatattgggtaaaaggtattgaggctgtgagaattatgaccgaataagttgtatgaagttccatatgttctagcaatttatctcctagattaatgctcagaagatttgaagaaaggggttcatctatgcatatgccaaaatgcatagccacacaattaatagatatggggtttccttttgcttttgtgatatgttttggaactagacagagtttagtagctgtatatcattgtgaatacacttaatgctgtaaaaaatacatatgctatatatattttactataattttcaaaactactagtcatgttgaaagtgttcagactttggacatggtacactgagtgaagtactaacattgtgtgtgtcatgttgctccctcagtcacaaaaagtgagttttctcagacagttgtctacttcctttgtcttgatggaatcacatactccttttgtagttgtcatctgtagacaacatgatgaataggcctctatgaaatgaatatcttccatgcactgcttctaaatttcgatatatttgtgttagtccctccattttttttaaacctgaattatactgtgattgatacttgttttaaaaattaaaacagggaaacccttaatgccacattgtactggtgcactattttgaaagaggtttcataatcagagtgtatttttctcagacaaacccaaaatgtcatgggctcactccctaccctgacttcccattctctcacatgcacactcgggttctcctgggtcggaaacaatgaacagtcacactggatggcagaggaactagattcaggcaggcaacttctgacaatgtaatactctactgttatgtggaaagttttcagttgagaaccatgcaattgaggtttatttttaaatctcactttttatattgtttgataatgtcatacatgtgtataatatgtcttcctcaaatcctcactcccctctctcacctccagttttgctcctacccccctccacacacacttttccttcctaacttcatttgttattttaaaacttgacttgagctgggcagtggtggggcatgcctttaatcccagcactcaggaggcagaggcaggtggatctctgagttcaaggccagcctggtctacagaatgagttccaggaaagccagggctacacagagaaaccctgtctcgaaaaaacaaaaaccaaaccaaaacaaaacaaaacttgacttgagagatgacttagaagttgagaacactggttccttttccaaaggaccaaggtttgattcccagcccttacatggtaactcacacccatctgtgacagttccaggagatccaacactctcttctggattccatgggcacagtacacacatggtacaccagtcaatacatctatgcatataaaacaaaaataaaatttaaaagaccttcatgttctgagtaagtttacaattttgtgttgggcagtattcatagttgtccttggctacatgcagcctatagattttcaggttgagtagtacatctccacagaaactcattaagcctaaatgatgccccttttcacaaggctgcagattgcctgggtgtactaacaaagacgtttatccctaacttggttccggaaaccaagaaaatgtctaagttttaagcaccttgtcttaagttgttcctgtgagttttaaatgaactcccaaatcctaacaaatgcagtatcagtttcttaaccaacagtcttatctagctgctagggtgccctgacatatgtggtaagatgcaatagatgcaaagttcatcattagcctgtttttccatgtagattgtgtggtatagggtctcaactatgcctggtatgacaagtgtggcccaatccttttcattaccttcactgtggttgcttgctgaatatttaaaatatgtttttcaaaaatagattttatttttgttttcagtgctaggggtggaattcagggactcatatatgctcatgaaaattctgtgacagagtttctcagtgagggcctgcctggagttcactaaatgggctagcatggcttgccaacaagacccagggatctgccagtttctgattccccagtgctaggattatagacatctgctatcattcctgactttttaaacatgagctctggggattgaacggggtccttattcttccaaggcaagcatttcccattgagtcatttcttcagcctagtgcccagcaatatattcttagacattcccttgcttctttccacagggttacatcaattgcagacagactgaatgtggaatttgctttgattcacaaagagagaaagaaagcaaatgaagtggaccggatggttctcgtgggtgatgtgaaggaccgtgtggccatcctggtagacgacatggccgatacatgtggtaccatctgccatgctgcagataagtacgtagggttgctcagaatgacaagagaacatctcc

SEQ ID NO: 770 - DNA, 10302 bp, mus musculus
gcttcaccagcagcccaggccaccgcagcagcagcagcaacagccgcagcaacggtagcagtagtctgcatcgcagtccctttctccttctccagcgcgctcctcagtccccggtcaccatgcctaacatcgtgctcttcagcggcagttctcaccaggacctgtcgcagcgcgtggccgatcgcctgggcctggagctgggcaaggtggtcaccaagaagtttagcaaccaggagaccaggtgggagcctcgctggggctgaggcaggggccaaagcatgcccaggccagctccgcgggcgtcatgctctcccttccggggcgggacggcaacaacgcggctgcagagccagggcggctgcgccaggggagaaagaagttcagcaagggacccccaacccccacccccaacccgggtcaccctggagtctctacgcgtatcctctggctgttaaccttctggtggctgggcctccaatacccggacatcggcgacctgtcgacccttgggcaccccaggcccctcttttgcaccggctcgcctggtgtcttcagtccggaaggacaaaatcggggcagttacagagcgtctgggagagtgggcgcagtctgtgggcatcacttcggtgccgggaatggtgggggcggggagacatcggtggatccgcccgccccagtttccaactctctgccagacagaaacccagaatcctgcatggttgaaaaggctctgcacgggtcctgggcactgggtttatcccagggaaactttcgaatgccacttccagccgctggcgatcagagtactgccagctgctcaggtgactctccagagcagcaggctggccaagcgctgccttatccagaaaggtgggtttgtgcgggagttaggcagagcgtgggaaagcgagacgcacgtgttgagcgctcgcacccttcctttaaactttgttgcatctatcattgcgaatagcttctttgtgtttgtggagcttagctgcgcacagcaacaagaccccagtttgttcaaaattccaccggtttctcacattagcaaaaggtgccaccaggcaggcggaagctctcctcagcttagactagggattccttgtcctacttgcccaaagccaatttcttttcccgaattctatttagcacagttaaccaactatacagtgcacagtgacagataaccgttctatatttagtagcgcacgaattcattccgcaagttttacagaaaaaaaaaaagtcattctccgtatttacaaaagttaacttagaaacggattgtagacacaaacgtcaaaactaaaactgaaatttccagaaggaagcacaaaatcttgatgatggaatgaatcgagaatttggttgtgagattaagggcattttttttccttttggttgttttattttggtttggttttcgttttctgggacagacttttgctatgtatttaggctggtattgaactcacccaggtagtagtccaggtaggcttcgaactcacaggagaacccttgtttctacctcccaagcattagaatttcgggtgtgtgtgtcatcagacccagttagattaatattgatgacaaagatgatttttttctagaggttatgtgaatcccgtgtgaccttttctaggtggtaaactccatttacacagcttgggtgataatagaagaaacctgtggacaattcaggtgaaagaactgccactttgtttacttattgacattacatcctgattgaagtcccccctcctccaagccaccccctaaaataaattaattaatgggggaacaaaaggaagtaatccaaaccttccaggagtcggcaacaagaaaacaacaatgaaatgaactgtgacattgaattaagaacagtgaaaaatttattttcataagttaaaaacaacaacaacaacaaaagaatgccactctggggttggggaatgtagttcagttggtagagttgcttgcaggagtttgcatgaagcccctgtgcagcatcagatcaggatatgctggcacacactacgttctcagcccttgggtagaagaagccagagaagtgggaattcaagagcatctttggctacatgagaccatgtctattttttttttctagtacagaggatgtattccaggtctttgtgtatgctaggcaacaagaagattcaaccactgagctccatccccagcgccctttgtagacttcaataaatggagggtgctctaggactttggagaaggatggagctaggtttggacatagcaagattttgttagtccttgtccaagtttcagcggctctgggggaacaactagaataagcctctttgtttagaaggtgttatcatgtaaataaaggagctggctctggagggagtgggttttgaaagtgtaagtgaagcaacccttctttgtaatctcagtgcagcacaatgctgcaaggcctggctaatctccatgatctggctgagtaagggtttactactctaagtcctgtatcagctgataggggaaacttactcagatgttcaggcgggattgttcgtacatttatttaaatagaaagaagccttgtctttagtttgggttatcttttcaccacttttgatcctgacaacgcctaagcttgagaagacccctcagctctactttctgttgaatgggttgaggttttgttctgttctatctggtgtagtggatttgctttccctttctttgagtcaagttctcatgaggtctaggctggtctggagttcactgtgtcactaagtctgcccttgatttcatgttcctcctgccctcacctcccatgcgcggatcatagagtacatgtcccaggataccttgctactccttgctacattttatgttctatcccatagaacattttaaaaggttaatgtgccaacttttctcacaaactacacagaggtggtggttgttttttttcccccctcctcagtcctcaaattaagtgttcctgtttgactgtagagatgagaaaacaaagggcaaaagaaaaaagaaatggattcaatgtatgtaaggtactttttcttcagtgcctcttgctgagtgaggagcagaagtctgaatgttatgccctggtcctcggcacctcagatcctaattttcttaaatgctacttaatcagacaggcactcttcggcttttaccttttcatctgtgaattatttccattgtgcagggagaagtgcatttcagcttctctcccaaccccagcaaatgctccgtgatttggaggacagtgttcgtggttggaatccctggtctcttgtattttttaccctggtttaatttactgctatcagggtccttaacctgtataatgggacccaatgtacaggttactgccacttaacaaatcaccaagaactcaggggcttaaagcaatcagtgttcatttggttcccagacctgaagtttgtgcagatcagagcaagaaaggcttgtttctatctccagcgagggctgctagggtggatactgaggccacaggaccaatttttgaagatagcttacccacgtggctgataagtttggctagcttttgccagaatgttttgactaagatcactccacagggctgcttgggttcccttgtagcattggagctttgttccaagaaggagagtttcaatagacaggaagtagttaagtaccagtttgttatggcctgggcttagaagttggcatatcatcacttctataacattgttttggctaaacacagtgccctcttaggtctagggaaggcacttagattctaaggacaggacctagatcctgttctacagtagaaagaagtgttataattgttgtagtcattaggtattgagtcagtcatatacttccgccttgctgtttgagggtcttctgtctttgggctgatgcacacaacccattagagaactccactccagattggggtgtggaggtctttgtaagtagaagcagaactggctttggaagaaatgttaccatggtgtttcccgtgctcccctggactgctagtcctaggaggattgcagttccttagtgaggaaaggcaggccaaagaatgtgatcttgggggataaacagtcataagaccaagacttgggaaactttctgtaaagagccagatcgtaaatattttaggcattgtgtgccacgtgtctctgttactgctttgtcttacagatctgtaagctacaagtcctgcataggtcagcagggctgccttccttcctgaggcttcaaaggcaagtctattctcatgccttttttagttttcttttcttttctcttacagtctcatgcagccccaggctagccttgaactctcaatatggtagatgatgaccttgaacttcagattctcctgtctccacgtcccaagtactaaaatcacagatgtgtgtcaccatacttgatttagctactgatgaggctctaacttcatgtatattgggcgagcattctaccaaataagctatagccccagtcccccttttcagctttgtgggcaccctgcagccctgggaccttgggaccttcataaatagagtatctctctgattggatttagtcatcacatctgtttctactcttctagtcttcctcttccatcttgaaggctagccattatcacatgcagttaaatgtgaatagttacgtatgacctttctgttttaagatcacttgattagcatgactaattccacctggacatatacatcccttttgtcatataatctaacatattcgaaggaatgcaatataaatgtctttggagggtcttcattactgggactaccaaccgttgttagtgtgtgtgtgtggggcgatgtatgagtacaaaaacagggtgagcactgtattttgtcagcccctgagctatgtaatacttgctttccaaattaagtcagccctatgcatgatggaatcttgttaaatttcaaatgatttgtgtgcaagtattgcacatgaatgtgtgcacatatgtggacgccaaagaagaactctgaggagtcagttctcttttgcacttgaaggattgttcttgcttctgccatgctgtatactccatgctgtctgcctcccaagcttctagatctttctcctatgcaagcctcccacctctccatcagcgttctagggttacagattcatgacaccacatccaactttctctgtaggttccagcgactgaacatactttgttaggcttttatctactaagccacctcattagcccaagaatagtgttcactctttagcactcacaatcaggagatgtgtttccgtttctttttgtgtactgtagcatccatagcagagaaccttaagcaggagtgtgagcaaatagcaaaactagtttttggagccccgcatggtgactcatgcctgttatcctagcacttagtagatggaggcaggaggaaaaggagttcaaagttatcttggctttgactataagtgtgtgccaccaaaccagattctgatggtgtatttttaagtggctatattcaggtgggcacagtgaagttctctgtattctttttttttttttttttttcagtacagcggatggaaccccaagggtttcatatgtgttgatgcaaataatctaccattgagctacttggacaaccccagttttccgaattgtatttcaatataagaaattacacaggcctggagagatggttcagatggttcagactgctcttccagaggtcctgatttcaattctcagcaactgaggtggtgggtcacaaccatctgtaataggatctgatgccctcttctggtgtgtctgaagacagccacagtgtattcacatagataaaataaataagtaaatcgtttttaaaaagactatgaacaggttcaactttttaaaaaaagaaggtacacagaggtaaaattcagttcaagttttttttttttaaagaagttacacagaagcaaaattcacaggatgttcatagtgtttcattttgatttgattgtgtgtgtgtgtgtgtgtgtgtgtgtgtatgtgtgtgtgtgtgtgtgtgtgtgatatgtacatgtctgtgtggtcatgtgttcatagtgtctcagataaatcaaattgttccaactcttggatcagcattgccattttaaaaccagagttctgcgagagctgatctgactctttgtgtgatactctgtggtggatataccaagatgcatgacactttccttctctctggcagccagagaacgtggatgtgctgatttagctcattctgaataccccagaaacctttagacatgtgctttgcaaaaccttgactactatacgacctaactcttttctccaggtgctacaggatgacaaccagcaaagcaaggaagtataccacagggggaaaaaacgaaaacaaaaacaaacaaacaaacaaaaaaacccagaaagtaaaaactggtgtgcagccaagaggtagagagtatctatggcaactgggccattcctgtcatggagctgtgggttgtaggatgtggagatggacttgaagactgacactaagagtttgaaattctgaatgggctgtggggtggcatctgtagcaaataaagtttagcagagaaaaggctaaggtaaaagggtgtgtatacgcacacacaaacacacacacacatacacacacgcacacacacatcgaaacgcaggcttgagagaaaaatacgaatgttgatttagttcacctcatggctcagctctgatcttcatttccagaattcaaatggagctgtccattttttagcttgagtactgatgtgtattgacatgatggcgaggtgggaagtgttcgtctgcatgatggggaagagaggaagaggtgttaaatcctcatcttccatagtgagtagtcaatacctgatgcttcatgaaaaattaggatttgggccttgaatgttagatggagacttgaaaataaatctttattgaaaaagccatcaaagattgaaattgcttatctctgggatgtttaactgttataagccttacagcataaatgtgcatctctctctctctctctctctctctctctctctctctctctctctcagagagagaggctagttcttgttgctttgtagtctgtgcttgcctggaaagcacaggaatgctcttttctcagcctcctgcatgctgggattataggctaaactaatcatactttttcatggtttgattgtgtgtgtgatatgtacatgtctctgtggtcatgtacatgtagaggccgtcttcctctatcctcctctgctttacttcttgaggcagggactctcactgaacctggagttcattcattcggctggctggctggctggtcagcctacaagtgagctctaaggatctgctgtctccattcccccagtgctgggcttatggatatgtttgctgttgctcctggcactttttaaatgttgattttgggggagccaaactgagctcctctacatttttgctgatagtcacattaccgactgagccatttctccagctcctgcgatttgaatttttaagacactatccagtcttaactttaatagtagaaaacattgccataaggaattatcagagaagcctggaacttagaatggctccttgaaaggttagctcttggtcggcctaggggaacttagctcttgcaagggttcccacaccattctttggtaagaatggctccttgtgtgtgaactattaacagctaggaaacaatgcgactgagctcccgcctgcctggtgcgaagctagcattatggaatgcgttagccagtgggtgactccatgaccagcttccagtctgtaagtcttcactagtagacaacacttgccagttatcaccgctcacagctggacactttgggctggacttctgtgacacctgtggggaagaacgcttggaaggtcacacctggacgcccccatatacttttccctttgctgattttgtttggtgtccatagcatctcataagtcacaatcaggattatgactgcagagtcccatgactatacctactgctggattgctgaagttggaggtggtctcaggaagtctcagagactatgatattaaccaatcttgtgatgtctaattgctaattgtcaacatgacagaatctgggatcacctgagagatgagcccctggctctgcttattggggggtgtatcttaattgtgttaactgaggtggaaaggccaagtgtgtagcactgttttctgactgggccctgacctctgtcagtgggaaagagagctgggaagtagcgtgcatccatcactctgctttccgattaagagtgaagtgtgggcagctgcttcaaggcccctccatcttaagttcctagccaggatggacttcaccgtgaactgtgagccaaaataaagtcacttttcttagagtactttaaatagcaaccgacaaagaatcctaagacagatggcgttgttcttttatagtgtcgagatcggtgaaagtgtgagaggggaagatgtctacatcatccagagtggctgcggggagattaatgacaacctgatggagctactcatcatgatcaatgcgtgcaagattgcgtcctcatccagggtgacagctgtgataccctgcttcccctacgcccggcaagataaaaaggacaaggtaggcgaggtgtgtcctgccctagcaacccagtgtgctcaccactgtttcctcacctattgccttcattagactatccagaagcctcagctttcctcttcaatgtaaatatgtgccctcaccttgtctattccagatttgtcactgaacccatcacatgtatcaacacaggcaatgtatgtttcaaaggcagtcaaataccattatccttgttatcatgatagagtgttgtaaggtggtgcatagagttaaatacaaacacacacacacacacacacacacacacacacacacacacacacaccactgaatgagtacaagtgaagaggagaccatccaaattacttcactgccttggatcaaggtgaggtctccagttgaaacattgtgttctttgtttggttggttgtttttctgagacagggtttctctgtgtagccctggctatcctggaactcactttgtagaccaggctggccttgaactcagaaatctgcctgcctctgcctcccaagtgctgggattaaaggcgtgtgccaccaccgactggcgcaacattgtgctcttataagtggtttccattgtaagactgggtaaaggggccatagggtacctgcattgctgcttctaactgcatgcgaattcacagtgctcccccaaagtttaattaaaatcaatactctgtttttataaggagaacagcattaatattgcttattattttagcaaaattcccactagtgtatgtaagtttccaagagaagctgaagaacatacagttgttcttagcctcgttgacacattagagaagattggttaaggccaccatcacaaattaccatgagctgggcagatttacagagcaggaaattattctttagtttgcagaccagatgtctgaggtcaggatgtgtcagagccgtgcttgctatagaatctttcctgccactttcaactccccaggaattcgggcttctcttggtcagtggcctcaatgcttcagtctttgtcttcaagacactcctctgtacgtgtgacactgtcacaggattgaaggctatcttcattctggatgatctcatctcatgatccttcactaatcacatctgtaatgatgctacttccaagtggcattaataggttctgagggtcaggacatggacatagattcttgtatgtctccattcaaatcaccatagtttgatacagcttcctctaagacccccaactgccagcaactggggcctttaggcaatctgttaattctgattacattcctttaggctctgcctatgtcctctatgccatggtttctcctcttgttctgtgtctccccttccatcccttataaggatgcatcattggatttagggccaagcttaatcaaaatgacctcagctcagtatctttacattaacagggtctgcaaaaaactttctacagtgaggcttcattccagactcatgggcagataagaatttggggagacaaaaacattcgcctcatgtcagtgaaaacgaagctattgtttgaaaacagcactcaggatcccatggatttgaaaaataaaactaataaaattatctgcacaaac

SEQ ID NO: 771 - DNA, 10302 bp, mus musculus; identical to SEQ ID NO: 770

SEQ ID NO: 772 - DNA, 13727 bp, mus musculus
agtctcccagatcgagttaatcacgctccttcgtttacatctgggcctttttagttgtagaccagacatgacagtgtgttggcccacaggttttatgaaaacagcttgtgagacgtttcagactgtagaatgaatgttttttttttccattttgtatttttaaagactatgaaagcgatgacgaatcatacgaagtgttggatttaactgaatatgcaagaagacaccactggtggaatcgagtatttggccacagttccggacctatggtagaaaaatactcagtagctactcagattgtaatgggtggcgtgactggctggtgagaacattcttttcattaaattttagtgggaacctggctcttgtccttttgtaaatggcacagcctccataaatcttcagtggctccccacttttaaattccagaagaacacaactttggggcttttcccggatcttattggttgtatcagccttcagatagtcctggttggattttgatgatttccctctgtcaaaggcccaccatagttccacttccaccctttacacttcctttaattcattaacaaattttcaacttaagcaagttaattataagtaagttgttacttgctattcagtgccaataactggaaaaaacatgagaactcccattgcagaactagcctctaagattctcagctctgtacatagaagcattaatggtctgtaaaaattattcacaatgatgcatcagattctacattttttgtgtactggttctgattatgatagtgctttgaagaagatctgagaagattgcctttgctttagaattaatgcaatgattacttattatgcaataatttggagtacaataaggagtggctaataaccattaatcaagcaacagctcatgtaagcacatatttacattgttgttaccatgtattttaattctattatttttggaataaaatattaaccagataaaaaggggcagaaacagttcagtattttgaaatatgttgatgactcttttttttttgaagtgacagtgattaagttgtaagcattttttttctttacatttaaggtaaattcatcttgtgctaattaaaatatttacatacttcctcttggcatgggaaaatgacatttattcatgtgtgttttccatgaacctcggaataatgatgccccatgccttcttgtaaatgccatttcataatttaaaacaaacaaagaacaattatggtgaagattccatggagcacaggcacagtattaatactgctttattgaaaaatcatacagttagaagggaaatttctgctcagggcctcggtcaattagatgattcactgtaggatgattacaactctgcccccttaaatgcatttataatttggtgccagaggtgattggttagtgagaatcatggcggaaagccagatcgttgcacattttcttcttacagacctaacctgctaagaaggcccataactgccaggtcttcctgaaaaccctaatggcagagcagaagttagtagtgactggtacacagcttgtgtagctgtagcattcaacctggggtttaatgaagacctcactacttgcttttttctttgttcttccttactgactcctgtataagaaccatattcttgataataataacaacaacaacagtagtaatacatttggattgtcagtatcagacaagtattcaacccaggagctatgtaatagtttgtgggtatttgttttttacatccatctatttgtgtggggggcacagatgtgtcccagtatatatgtggaggtcagaggacagctagtaggagtttgatctttaccatgtgagttttggggatcaaactgggctctttagacttggtagcaagtgctttgacctgctcaactctctctatgacctggtctgtgtaataggacacttatattcaggtggcttgtttttgtttttgttttatgtgggcacaaattcaggaccttgcaagcattctaactctaagtgatattgccagctacataggtgatttgttggaatgatttgaactgtagtttagattcagagtagaaaacatttgaaatctttttaggatataacattgatgtgatattgtggcataaaagaggaacagttaatataggcataaacctaacttaacacttgagaccgaccagctcaagacatgaatagcctaaggagattggatttagccataagtttttggtaataagaaatgaaaactagtatgagaaaaggtggttgctaggagacctggaggccttgaatactgaatctgcttttagagtgtgatccagaagcagagctatggaatcccaacattacattccaaaggtaacgatgcccctaagagtggaaaggagggctggcaagatagctcagcaagtaggcttgatgccaagcttggtgacctgagttttatccacaggtaccacatggtggagagaaccaattcatgtacattgtgcttggccatgtgtgaatgtttagacacacacactacataaaaaattaataataaaaataggaaggagaaaacaggtaatgttttctagatggggtatttgaagataaggatgggagtctgagatgaatatgacctggcaaatgggggatactaccatcagttagaaattggggcctcagtagcagctgtttgggctgcgtgtgtgtccctgtgacatgacttctattgaattaagggctactgtgctccagtatgacctcatcttgcttaattacataaacagtgacctgatttccaagtacagtctcatgaaggacactaatttggtgggaagaccaattcagggcacaagactaggattagaaatctgcgatacttttgtagaatagtgaagggaccatgagtatgctcaggaggtataggctgacattacaaagttagatgagacaaaacaatacagaaaattaatactagataaggaaggtgtgagaaatatgggcagtgtaatcatctaagtggaataacacaaggggcaggaaagtttttcataggcaggaaattaataacacaaagatgttgatgcatttgaaactaactgcattggagctggtttggatagagtgagtgttgtccaggtgttatgaaacaccctgaccgcattaagcaaaccaaacaagtgactactgtgggaaattttagcttacacaaatgcaggagtataatgaacccacgtactcctgattgttttcaatagctgctcttttgattttccttttaagtctccctcttctcaccttttcctcatttcacagcaaatcctaagacattttagagtttgcattttaaccaccctgtatgactgaaggaaaacactgaatatttctgagtgggcaaaggagactatcaaaagaaattgaaacacattaagcttttattaggaaagcaataaaatgtagacgaaatttagtacatcaatgattgttctcatcttttgttatttctgtcattaaaggtgtgcaggatttttattccagaaggttggaaaacttgctgcaactgcagtaggtggtggtttccttcttcttcaggtatgttaagacctttatatgtcaatgtttgcaaagagcagagaatgttacctatctatttcattcctggtcatttcaatagaaggtataatttttcttttacacattcgtttatagaagaaccataatgagctttgaaagcttgtatctgtcatgcaagaaaacaaatacttctagattctctactatgctcacagtgtgatgtgatgtctgagtcccagctactcaggaggcagagggaggaggaccacaagtccaaagcaagacataatcttcaaaccaaaccgaacagatttggggatgtatcttagtagttgagcctttgaactttaccagtatcctgggcttatggatgtgtgcagccatacctggtttagatcgcactgtgtatacattatagttttcccataaactaatgcaacacattgagcaactaatcacgtttctgacaatttttttaaactgaagaaccagagccaagtgtggtggtataggcctggaatcccagcacttcaaaggctgagagaggttaagacagaagaatatagaaatccaggccagccttggcctgccagatatatattgagacattctgggggagagaagtcaaaaaggaaggaagaagcagaaagtggaaatttaactttaaaaaaataaccataatcctatctatagtcctatttccgcaacaggtggattaaagttttaattttgttcctgctcttttaggggtaaaatcctttgctagcaagaatgtttatgaggatattatctaccattatgtctgtttgatatatattttccttaaaatagcatttcctgaagaagatcaaatacagtaaatctcaaaattgaagatctctgggaataaatgttagcaattttaaagatgcagagaactgttagttataccagatttaagaaatgattgctgttcgtggcgaccagaatctgactttagtgcctaagccatcgatcctgtaataaccaacatagtcatcttacgtgcaaagagatagcatttatatgaattgagtgctggtgtaagtagtttcctagccagctgttttaaggctatattttcattaataacaatattaagaataatatttcttgtgctagaagtaaagtaatgtgattaatttctaaatttggttatttggatgtatgctagtatttatacagaagaggatttcacttatgctgatttggcttgcacttgtatagaatgatacagatgatatgatagatagacgtaagtctgtcagtattttgaaaactgagttgtcatttctgttcagtgtgaagggcactagactgaagcagagtggactaaaactgttgacagaattgaattgtgtgtttgttttcatctacttttgcatgtttgcctcttagaagtctatttcagttgttcagtattcactgttgaaatccacatttttatcaaggtacttcctacttttctaagcctgtcatttttggagtctaaagcagaaggacataggtcctgtctgagtcaaatcacttttacccacagatataattagccttgaaaacacagtaagagggacctgaaagaaaaactagagaaagaaacatcagcttttaagctaattaattgcttaacatgcttaggcctgattccatagttcataacatttgcttataattaaagataactattagtttgggttaagacttaaagctttgctggtaacaatattaaatgtttctcagtagatatttatcatattgccttcttaaaatagacattggagctgctctgagtacagtagtatttacaactaaggagtcctagccaattccagatttctctgcttaactttagaaaagtagacaatgctatatgagtatttcagctttctacagttatatgtgcccataaataagggacacatacttgcatagggcttgtcagagcttaatcctctactccttctatcctgactttacccctcccttgaagcagcctctaacttctcacagagcctccttttccctgactgacacatttttgatctttcagctgcaggagttcactattggcttcacattatggaatattcactgttctttttgagtcatcctgttctatttccacctgaatgctttctgtccctctgccatgtcctctggccccatcttgagtattatttcatagttatgcacctatgattaagtgagcttcttgattcatgttttcttttaattgaaaatgcatacaatacattctgatcatggttccccctctcccattcctccaagattctcccacctccataccactcagctccttactttctttgtctcttcagaaaacaggcatatcaaacagaataaaaatgaacagattcattttctttttaatgcagaaaaagcaacagaaacactgaggtttagacccttatttcgagtaaggcatctgggattgttttgttttgatgtattcctattatctcagtcttctcttggaggaatatgcattaggtgacctgtttagtgttctggggagggccgtctcaggatcttcagtcctgctagttttctaggggattttcctttcagaaccattctagataatccctttgctttgtcttggtttcctattttcaagggacatgccttcccattattacatcttcaagtaacttgtagagaaaataagtatgaacagtgtaatttttgagatttgttttttcatgtctgacattttcattgtgtcccccatttgagtaataatgtagctgagtttagatattgctgcattgtcttcaagttcagtgttgctgtttaaagtctcaaacagttctagtgcctggccatttatctgtatgcagacctccctccccgcccactcccaccccccacctcccagcaaatccttagcagattttgtgtgtgtttctggtttgtcacattgtagtccttggtgtgggcctgttcttacccattgtaacccttttcaactcaaacactttggctttttttgatattagctaataaattcctgttctttgtttactctctgcactgcctggccagtatattttctatgatgtggatctcctagactggctgtctatttttcatagcttagcttcctgtttttttttagttctccttttggtttactttctgggaaatattttcaacttcagtttctagcagtttttcatttctactttttatgtctattaatttattgttactgagaattcactaggcaagcattctgccactgccatacatgtagcaccaacccttgtgcttatttaattcctatgagatatttatgatatgatagatatgcaaatatatataaatatatatacatatttatagatgtatttaaagagattcagaggtggactgtgtttatatgaaattgaccctcctgaattcatttttgttatgtagtagaacactaacatcagtggaaaccactttaactgcttgtctgtagcccatgaagataggaagaaattgtgtgctttgatgccttctctaatttgaattgaaaacaaaaggtttttaaaagctcccacagaggcttgatatgttagcccaaggggagctcaaccttttaaaggagaagcggatgggaggggtaactaggaggggagcagtaagcgagatgtaaagtgaatttaaaaagaagaataactgttttcttttttcttttttaaaagagtgactgggctgacattttttaaattgccaggtgctagtttgaagtaattgccttttttggccacaggtcttgagtgttgggtcaaatggtctctcgtgtatgaagttcttagtttttatacagaatgtttatctaccagtttatttttttcagtgttacagacaacactgcagtgatagctgtctgtttgcagtactggagattgagcccagggcctcatgtgtatgcctggcagaccttctgccactgagctacaaaccattttcatctttcacattcctctgagacaaaacaaacatattaaagccttttgattaccaagtgcttctagtaagaataaatcgattgcatttccatgttagtactaaggattaaaatcagggtttcatgctgatatagcagaccctttgcctactgagtcatttcctctgcatgtctgcttgcctttttatttccttcctttctccctccctcccccctcccttccatccatccatccatctattgatccatccatccatttttcctttgcttccctccttctagtccatccccctccctccccctccttccctgttttttttcttcttgtggtattaggggtcaaacacagggccttatacatacttaagcaaatgctttaccactgtgctacattttcagctcttgttttgttgtaaaacctctccctacagcttttgcttccataatttttgtttttggttggtgttttgttgttttgttttgcaatgttaagaattaaacatgcagccccagccccttgtctaagtgtacccctccccttcctagcttgtattaaaaaccttccagtggtggtgcacgcctttaatcccagcacttgggaggcagaggcaggtggatttctgagtttgaggccagcctggtctacagagtgagtaccaagacaggcagggctgtcagaaaaaaaaaagccttctgtcctctgtgtctgatgatgtgttcctgtttaagaactaggcactaaaatttgatgtaactctaaattcttaatgggagtctttatttcagaaaatctcgctagtctaagaaaaaaaaaattctgaagaagtgaaattgggaattggggagtcttcccagtgaatcatttatggtgaggctgacaaacaagaagccccatccttacctccttacagcttctaaacaaaaatgaatctttgtctgaaagcttggtgctatttttaacatgtttttttgtttgtttatttgtttggttggttttttgagtttttttgtttttgttttgtttggtttttgttttgttttgtttttgttttgtttttgttttgtttttcgagacagggtttctctgtatagccctggctgtcctggaactcacttttttttattattactaggtattttcctcgtttacattttcaatgctatcccaaaggtccccaatacccacccccccactcccctacccacccactcccactttttggccctggcattcccctgtactggggcatataaagtttgcaagtccaatgggcctctctttgcagtgatggccaactaggccatcttttgatacatatgcagctagagacaagagctccggggtactggttagttcatattgttgtggaactcacttttgtagaccaggctggcctcgaactcagaaatctgcgtgcctctgcctcccaagtgctgggattaaaggtgtgcaccaccatgcccggctaatggagaactttttatgctaataaagcttctttacccagtgtcattaaatattgaagtagtgtaggaaaatcaaatacatttcaaaaagtggtcatcattgttccacttttctccagtctgcctagtttgcatttctttatagttatatagataagttagaagtgaacgtgtcaaggaaatctcatctgtggaaaccattttctcattcactcgtaaacataataggaaccattgggataatctagtccggttactttgttgagtgctccttgaaacaggttggttagcacagttttggaaatttaatatttattcatggtctttattatcattcacccagcatttctcactcatcttcttgcatgacattatttgttaccagggatacagttattcacagtttttataatcctatggtcaaggccaagctggatgggtgcctgtggtgtggtgagagtgcaggaaaggaacttgaattgcttggaggtgttggagaggaggaccccagagggacattgaactaatcatctaaagatttctcatctctctgcaactgtgtgatactctacttcagtgtgtgttaacatggagagcattttggctattctaacaataactaaagccatgcacatgcataaaatctttgcatttcaataaaaagatctgttgaaattcaacctacgttaagttctctaaaggttacaaagcaatcaactagtttgaatactttgtaaggcaacttttcagtttttatctagaaagtctcctttaaagttcattatcacttctctgcctatgatccacatcactgtgtcgtcaggctctaccagaaaagtttgatgacaaacaatttgatcacctctctagctgaggccagagtctgacgggtacctggtgagtgagtattaggaagagcttcaggtaaacagtctactgtggaatcagtcacagagacaaatagaacctaaggtgcaggtcagatgctttatatgaaatcagatatttttgttatttgaaatattttatatgtgcttaaaagccttgaatatggttaaaagtctataaagaatgtatcagactgatagaagtgacttataatagcatatatagtttaattatttacttcttgtgtacttatttatatttagattttacttacactggttacatctccctattgttcctgttccagttttgccattggcccagtagcttcttcatgtaagggttcttaagatgaataagcatttagctatagtttttataagagcattaattatctgaaatttattatggaaagcaattactataaagtttttaaatgaaaatgaaagcccatcgttccttccctttcctacctccaactctctctacataccctgctgtcaaacttcatggcctccttccctttgttattattacatataggtataaatgcatgcatttagtgttgcatgtatgtatatgatttcagagatgacaacttggaaccagatacccaattagagtctctactctggggttgactaattctccccatttcaggaatcattagttgcctgtagttctttgtgtaagggtggggccccatgagaagactttctcttccattagagctgtgtatttggtattctcactgttcaggtcctctttaagcagccgtattggtgagatttcatgggtgtagcttacctgccatttgaaggagacaagaccttacagcaaatttcctggtcccttgcctcttagattctcccccttttattctgagatattccatgagccttagatggagcaattgtgttatagatgtatctctcatgtctgagttgtgttttgtaatcatatccatctgttgcaaagcaaagctgctttgattatggataaaagctacacttctctggatatcaagagaagtatttagaatgcagttgggaattatgatgattaaagtagcagtactagactcacctctgaggtccatgatttcactacttctgtggggctggctaggtttccagtaagtactagacagacttttcttcctgttgagcaggccttaagtccaaatggatagctatctgtcggctactaccacaatataagtgtcactattgtgcctttagggctatcttcttatactagtaatagttgtgattaataggcataatggatgggtaggacagttggttgttttttttcccccttgacattttgtatagcatctcctggtactaagagagctagtcctcagggagaaaggttccagatcatgtctagctcagatccttcaagtcctctgcttgaagtgcatggtgtgttcagcaatgtatacttaatttcaacttctgggagattacaaaaggcagtagcaatagcctatattattttgggagtctcttggactcctgaacaactcaagatggcatttttcatcagcttttgtttaacagtcagtggctcttgtgggtagtattgtcagcccaagtggcataactttatgagtgtgtgtgtatacatatatgtatatataaatgatactgcacattatatttacatataatgtgcagtatcatttatattatacattttaggtaaataaaaaataatgtgattccttatgacttttttcaaacatccttagttctattttccttctcctcatgctccttgttctgtattgacctcccccgccccagttaagcctcgttgcccatttgtcttccccctgcccctgcatatcagctgtatcctgctattcccatctctagcacaccctgtacttttgagcccctttttctttcctgatttctgtggttagcccaggttatatattcaaacctgaagatttggaggtaggaaccacaggtgagagagaacatgtggtattggtctttctgggtctgggctacctcattcagtaaaatgtttcctagtttggtttacttagaaattctttcaattttctttacaactgaatagcattccatagtatatatgtaccacattttcataacccattcatcagttgtaggcctttaagttgtttccatttcctacctattgtgaacagaagagcaatgcacatggatggctgagcaggtgtctgtgtgtggagatgagtctgttgggcatttgccaaagaggagtgtagctgcgttatttggtggaattatttttagcttttttttaaaaagaattttccacactgatatccaaatgaactacatcagtttgcagtctcaccaacagtaaatgaaggttcccttttccccacactctcttcttaaattaagtcgattcagagctagtgaagtgcctttatcaggctatttgaaatttctttaataacttgtcaactgattgctttctgattactaggtatttcacatctatttaagtaaaaggtactttttattagtcatacactttagataatctgtctttttagctgattccctattctaaagggtaggatgaaagctgttataatacagctttttgaatctttcctggcatgcactatatttttcttaactctgtgttgattgcatctaaggagctggttagttactgtgttaaaactctgcatttccaactgcaccagagcactgctaagaagagtggggacaaagttccctttgttcagttcctattgactgagtacattggcgaggccataacagtttcttccttagaggctccagggattcctgcaaaacgccacggccttctacttctgggctagtattcattctcattgcatgtctgcaggttgccagtcacagtggctatgtacagatcgactggaagagagttgaaaaagatgtaaacaaagcaaagagacagataaagaagcgagcaaataaagcagcacctgaaatcaacaatataattgaagaagtaagacaatgagactctttgccttctgttctttgataacaggtctcacagaaagtatgattggggattacattatcttaatgatgtttgagccaagcacggtagctcatacctaccattctagcacttaggagactgaatcagggggattgctatgaattatagaccagcctgttagcttgagctacaaaataaaattgtgttttaagaaagcaaagcagcccccccccccaaaaaaaaggaagaaagaaaggaagaaagaaaatagttgggaatgttatttatctggaattcagtaaataagaagttcttttgaatacatatatacattttgataaatacatcgtttaccatgtgcaagaatacaatttagaggcaccatatccatacatgcttctgtacagttatttccactatccatttgcataacttaaaaattttattaagtactatttccccaaatttcccttcccctaacctctatttggttttgggactgtcgattaattagagtgtgcataagtagaattgtgcatttgtccttctgttgtcctatttcattcaaagtaatatgtaatgtaatctagttaacataatatattaatatctaattcagtgtaatatttgtagcatcattatgagtatttttattgacactttgatttttaggcaacagactttatcaagcagaacattgtgatatccagcggcttcgtgggaggctttttgctaggcctggcatcttaaggacttgaaggctctatggtagtggatccaacaatg

SEQ ID NO: 773 - DNA, 436 bp, mus musculus
gggcgcgcggacacggacacacgagctgggctacagcctcccggacacctccggaggcgttgagcgccataactgtggcggccgttcccttcggagtcccctccgggtgcccctttccgtgcttgtcctgtgctatcagggactcttggggccagacctcggggctagagggcatgctctttctgctgcctgtggctgccgggtccgagcagcgagagggcgcaccctggctgtttgagccttgcggagcgggaagatactgagggtccggagagggcaagacgggcagtgtggggagcaaccaggcactctgagagctgaaatgccaacctagtgggagtgcgggtgcccttccgtcctcgaactttcctttctccagtcattgttaggacgcagtgagtgttcgaagcccgcaatcgccctgaggtctaggggt

SEQ ID NO: 774 - DNA, 31412 bp, mus musculus; identical to SEQ ID NO: 29

SEQ ID NO: 775 - DNA, 31412 bp, mus musculus; identical to SEQ ID NO: 29

SEQ ID NO: 776 - DNA, 31412 bp, mus musculus; identical to SEQ ID NO: 29

SEQ ID NO: 777 - DNA, 31412 bp, mus musculus; identical to SEQ ID NO: 29

SEQ ID NO: 778 - DNA, 33989 bp, mus musculus
gtggtaggagtcacgtggttgcgttttatataacgcttcgctgagacaagacagttattaggcagcgcggggcagccggcatggagctcgggaggcgaggcagactcgcgcgcgcggcgatcccgccttctcgctcgcgcagcccgctcccagccgccgctctttcctgctagttccctgttcctagacgcctctcctcactccaacctccgcagttccttctctcaatggattcccttcagaccgcacagatggtgagcttgtccgccgagctcggcagcaacaacttggagctggcggagccggaggagccggggacatcagcggccgcagggcagtcagccgcccacccggaggaggtgacacccgagggctcccaagctctcggggctcaagagcccgagcaaagcctgcctctggcggtcccgacaccgctggagtgcaaagtcctgctcacgcaggcggatgccttggcatctgaggggcaccttcgggaagccctcgaggtgtaccgacagctctccgagaggcagcagctcgtagcggagcagctggagcagctagtgcgctgcttggccgacagtgtcccgcaagaggagctggcctccgactcgagcggcacttcgagctgctgcgccgcggcgctgaaagaggcaggggaggccgcggccgtggcccccgaggtatgggatggctttaagtgcaagaagtgtcacgggtttctctcagacccggtgtccctgtggtgcggccacaccttttgtaaactgtgcctggagcgcgggcgagccgccgatcggcgctgcgctctgtgcggggtcaagctctccgctctgatggcggccagtgggagggcacgcgggccgcggcgcgcggggcagccggcgcccctgcaactgcgagttaacgtggtactcagcggcctcctgggcaagttgttcccgggccccgcgcgggcgtcgcaactccggcacgagggcaaccggctgttccgcgagcaccaggtggaggcagctctgctcaagtacaacgaggctgttcgtctaggtgagtcccccccaccccccatgcgccgccacaggggccgtgcgggcttgctcgccacgcgaggggggcgggggagcgatccctgctgggaggcgggggcggggggacggaccggactgatttggtttcgcgcgcgcgcgcgcgcgcgcgggctggggggtggggtggcgagggaagagcccgtggcccacgaggaggagggagggggcattgcaaggagtttgtcttccctactttagcttttttttaaaagctgtgtctcagtcttctgattggtcctatagctttttttttcttttctcgtgctctttccctctctcctgcttgctttcctgctcctatacctcctggttccagtttcttagtttatcccgttcgtctcttttttgcgcattttttttctcagttttgtcgctgtttcggtcttgctcagtgtcactgtctctagttcacggtctttcctggacactttggagctcgctcttacacctgccggtacctcccctatcagcagaagaacttggcactattttccaaactcccgcgcggtcctcctggcttttaccaaccggaggtggcttgcgggcgcctgagtccgtggctcccgcctctgggagttgtcccttccggggccgaggctccctgtggggtgggtcccgcctggaattaggtcaggagagcactggttgcataaggccctcgagccagcccgggccggcggcccctcccccgcgcgggcgggcgggcaggcaagcgggcgggcgggcgggcggggattgtgtaacgctgaggtaactgaagtgggccacgctcgcctcagaaaccatcccgcgagcgtgtgcggggggcggagggggggggggctcgctccccgctgccctgtgactcattgtcaccgtttcctatcacacgattccttggctgaaatagatgcacttgccccgccccctccacccgctgcagttagacagccagttccccgacatcgaaccctttgacccctctaacccaatgaatggcaggactaggcaactgctcgggatcccccccccccaaggcaacaagggactgatcacaaaggggccatgcctctgtttaacctgctccaagagttgcccaagagagtgggctttgtagcttcaagggcaacccgggcagtcccacatctctgctggactggagtaccagagttttcccagggacctgtttgcaccttctgcctcctcccactccaacccaggaagtggccttggaaccaccagctgatgccagccagcacctaggcaggcaggcaaggcagggcgatgtgtccaaccaaacgtgctggtgtggagggagttggctaagcagaaggggctgtagggtcctaggacctcctaggcaatctctggtggatagaggagggatgggatggagtctccccacatttcagtcccacccaagccagcaacaggtaatgcagaagggagcaaaaccagtggctatgagaactggggaacacagatatcctcacaacacataccctgcttgtgtctaaacaaagcaggctgtgagctgccaatgggctagtgggtgtgtgattcagagaagtgtcagagagtactgtaaactctatgctaaaatcaagagcaagtaatgggcacccaggtcagcccagagcatacatccttcaggggatggcatagaggcagacatcaaagcctgtttctggcagcagaagctgtagcctagagcttgtgaaagggcgaagccatatgaatgaaagaggtaggggccacttaagtatggaattctaaggggggctggatactttcatccacgggctagccaggaagcctcttcccaccttcctctttgtcactgctatcacttccccaggaagactctttcctgtacctttgttaataatctccttggagcagtcagggtaaaaaaaaaaaaaagtcaataccatccatcttcaccattctaaggggaaatgggccccttccacggactatatttatcctggaactggctaatgttctattattctaaaagctgtacccacactcagtaaaaggaactttcctctacccaagcctcaaaacttgaacattaaccagcagtgactcgaaccagctgtgtgacctatcacttcacctcattggccttagttttcctatctgaagaatgggtgggttgaagacctactcaggcctggattctagtgattcagtgatggtgacaataagactcctaaaagttgtgtcaagaaggtactttctcattttgccatcactaggaggatggaccttgtaaatgcatagctgtttctccaggaaaggtttataccataagcactgaccattagggagagagggaggttttttgtctttgttgttgttttgtttgttttctttttgttttttgggttttttgttttgttttggggtttttggggagtttttttgttgtttgtttgtttgttttttgttttggtttggatttttttgttttgtttttcgagactggggttctccctggctgtcctggaactcactctgtagaccaggctggcctctaactgagaaatcctcctgcctctgcctcccaggtgctgggattaaaggtgtgtgccaccatgcccggcttgggggaggtattggtatgctggagttattgttaggctacaggtcatccctactagatgactagcatggacttgccttgcttggggtcaaggtatgggtcccaattggcttcctctctctctctcttccctggcctcattctttttggatggtggctcatttagaagccaggttgttgggcactagcagtgtgcatctgcagaacagtgccagggtttcctctaggtgaaaatttctaatgtattgtggacacttcacctcttaggaactgcttgaaaaaggagggcaacattactgctttgcatggacaagctatggtgttggtcaggacaatattaggactggaaatgacacttaactctttgggtttagtagaaagagcttacataacttttctttcctcaagctccatcctcatacaggatttatcatgtgcttctgctgggggccattaataagggcttttttttctcatttcggcagctccaaacgaccatttgctttatagcaatcggtcccaaatttatttcaccttggagtctcatgaggatgcactgcatgatgcagaaatagcatgtaaactacggccaatgggttttaaggtgagtgtgggacaagagggatggaaaggggctatgctatagagagactggcaagaagggctgtctccctggggcagaagatgctagagcttctgcagaataggggagaaaactttctaatgagctggacagtgcagggcatcccttgataaagggaggtctaagtctgcaagggatctcaataaatctacattcagttgataaccttcaggatagccttgtctttattttttttttcaaatatggaatcagtagtacaacctgacttcatgtctcagctcttctacttttcttaactgtacagccttggggagattacttcattttggtgccctcacctataacatgcttatatccaaagcatccttctaaataggactgttgtggagattatataaggtcacgtaggggagatgcttggaacaatgcatgtagcattatataagcatttgctaccaccaccaccaccaccaccaccaccatcactcatacatttttagggataatagggagaggaatataagaaagatattcctgctctgatccttcaggataactactgatagccatgctttttgaaagctcaaacagcttttgggtttttaaagcgagatcttcatatttgcacaatggctgtgccattttgaatcattaatacagtcatttgacatgccagtataccccccaatctaagtcacatgggagaggtgggaagaaagacagagtagacatcaagagaggggaatacctgaatacaaagcatcactttctatgtctctgcctggcatcaggaccaatctcctccacatacctgtagactgtttagtagaattgggtctgtttatgaatctttgcaaagtgtgaccacgggaaagtggctacattctctgaaactcaagcacccttacttgttaaatgatgctattgctgtctgccatgattgtttcacaggtatgtataaggatcaacagtgagaatgacaactagaacatcctgcaagctgtaaccattataggttcttgtacaacccaaggtagcaaaagcagtgtctccaagaccagggccactgtgatttatctgaatctcatggggtcaggtgtcctcaggtgtcctctgaatccagaatgttctgatggtagaaagaccatggattaggcaatacctctaataatcttcaggcaacccccctatgtgtctaattaaacacactgcagcaatttacatgcaaaatcacactgaatagtataaatactatacaacagtttataacagtttcgttcagatgttggtgcctagtgatgatgttaaacctatgaaaatattggataatcagaagttttacatatctaggaacttccgataaggccttgtgaagttgggtgtggtggcatgaccctgcattgggattccaggaggatcatggttgagctcagcctggactattacagtgagcccttctgggggaaaaaccttacatgtggactggtaaactttgtctatactattagagtgaatcacattggtctgtaatgagagttttcatggacgtgattgaccagtgtgttttctttcccaagaaacatatttacagctcaatacaagtctccaataccttaagttgccactgaaatgggctaacatgtgagttaggtagctgtcttgggataagaggggcttgcagccatttccactggaaaactaaatctggataccatgatgggaagagcactgagacttatgttctagatgcagtgagaaaagggatttccaccatgaaggaggaattggtgcaagtacttggcaggggtgccatttccctatagctgggaaaaaagggaaagggagcattcagaggactctgctggcttgggggctgaaagcttctaatgcatatacctccatactctgagttttgtatttcccaccatttctatatgagatgccataagggagccagtccggtaggcagcccaatttcatctagggcttaatgtcatcaccgcaccttgctggtagtataggtgtcagtggggtaagctggccaccctgagaaagtgaggcatgtgagttgctactctgttgattaccgggaccccagaggcctctccagttttccaggacttagcaccctatagctgttctggagcatagtgctagcctttctcccgaaggccactgttggcagaaataacaagggagtgtggcagccaagattaggctcgagaaagaagcaagggtgtggaaagaggtccccaagaggtttgtggctgtggctcctagccaagtcctgacaccatgcagacacatgttagaagaggaggtagaggtagacttcctctgaggcttcccagttgtttgttgtactttggtcaagttctctctctctggatctccctttggttgtctttgaaatgggatttaaaatagtttaccattaggacagagatgaaaatctaagtctttagacaagactctgcctgatagtgactgctcagtaggtactcagcgattgctgttaattgtagctacattaagaaggtgaataagatgggactgactgctactgttttcttccaggcacacttcagaaaagcacaagctttagccactctaggcaaggtgaaagaagcactcaaagaatttctctactgcgtatcccttgatggaaagaacaagagcgccagatctgaagctcaaagggtgagttgagtgacctagggttaggtgtctagtagacccccgtcactctgtcttctttagggagaaggatgaagatgctaccctcctcagtatttgtggtcctgagtgggtgcttctctgggtttaaggggcatgagagagatgccaactgattgcccagaagccccatcattgtggtatgtactatcaaattggcaggtttttttttaggagtcagtaatgaatgctttgactcagaatcagtaggatataaaacaaaactaaaccaagtaagctaacctggagatgaaggctcactgaagagtatctttgtggatgagggcctgatagtgggagctgcttagaactgtataacttttctttggctgaatcacacgtttcgctagccacacatgaaggacagctcctgggaagggtcactgatgtctccatgttgcttgccacatacagaacttaaaccttcaactcttctgctagaaaattaaacctactatctcgcaaatgcaagtcagagatcattatgaaagaatataattagcccttctaactcttcgctttcaggagattgtgattgtaaaacaaatatcatgagaaatgccaggaacttgattaaaaggtcaagcatcttcattggatgggctttgacttttattgctttttgtacatttattcttctggtgtctgaataattggcctgaaagttggatgctgacactcagtgattgtttttggtttcctgccgccatactctcattcaacaccaggccacaagcccttctatccaccaccaccctttgtaatgctttggctggggaggggtggaaaaaagtaggcaagagacaggatttgtctctgaagactctagaagggaatatttagcaaaactaataaagttgacagaggctggactctagcaagaaatttcctgtctggaaaaaaaatgacctgatttgtgtgtgtgtgtgtgtggggggggtaagattttattgaaaggggtgtggatcaagcagaattattagccatgggcctttcttaaaacttaagtgtagtcagtccatagtataacattagctgagcattccacttagttcccataactcactgttatttctctagatgagaaatctgaggctcagtgactttcttgaggccacctgcttctttgcttttattttgccttcaggtggccccagaggttctggtatcatcagttgaactaacctcactccagtttgcttttatagataggctgttgtcatttctatacctgcctgatgaaaggcacggcattgtgtgaaactctggagacccaaggaagcctaagtgcctattggaacttacaagctttttttttctttttttttttctttttttggttaagatgaatgccaggcaatacaagtgaatgtgtacttacaagaagtattataaaattctgaaattaatgtaacaatttggaggcaaatttctgctgaatgtgatgaagctatagcagccatttaaacatactgagaggcttcgactgtgtgtattcactggattattctagttttagggctaaacatttgaaaactagtccacatgcactgggtattaataagccttctcataacccacagccctgtgatttattttaaactacagattttctttcttaacccagttgggcctttctatggctaaagttagagcagaattgacttttcattcatatggaatgattattctcactgaaagttgaccctaacttttgttttccaaagacattgaaaaggcctacagagagatcttaggcagtaaagctaagaagagaactgctatgttatttctgccttgtttcctttgattttggctcctggccgccttttcttcatattaccttgtgtcttttcgaccttgttcttgggtgctatatggccccctccaggtagactgtctcagaagtggatatattctttttggtccttgagtaggatttctgataatcagttcaattcctggggagtgttgtgcactaaatgattatatgtatgaccctgggcactaggtgtgtcttccaacctttgtcagtttatatctggaaaatagggttttagcactgcaaggggacataaacatctcattgaggatgagaggcacctgagttctaggcttcttcttgatcccttggatgtataaatgccaacatcatttccatgaatatgttgtatatttgctaagcacttatcgctggctggagagaaagacttattctgtgacacacttctcgtgcaaagtaagatggtatagtttaaggtttggtattctcttctatagaggcaggaaaaggcagatgacatcagagagatgggagtactggggcaaggcagcacttgagcagaacttggaatactgagtagggcttggatgtatggaaagtgctgatagatacagaaaggagcatcatgaagaaacctcagaggacaagcagaagagtaaacccacctttgaatttagcattcttgcaaagtctcttgataaatgaacacttcggactatggagactgaataacagtgtggggcatttttagtggctttccaaacatggcagggtcttctaagtgataaacatttgagtatgttttggaagttcagtgatctctttcttgttgtattatgcacgtacacacacaggatagatctatggatggatacatgcatgcatgcatacatacatacatacttacataaaatccctaacccctaatggcttaggggagagtggaaacaagaatgtaaatagctaatggtgtaacctgcacccaaatgcttatctctgacccctagacccttttgttctctcttctcccttgccagtgtatccaattgcaagggaacctgcctgaccctaggtacttgaacttaaaatctagaaatctctgaagagatgactgggatgaggaagaggctagaagtgggagaggaagtttgagctctgctttcttaacacttcattgctcagatccccaaccctgaaggaattaaaggtccaggggtgacaatgtggacaaggagagcaaaatggaaaaacagaaaagcagcagcaaacaatgtagattggttgacttctcagcccatcgagttgttacggatttgactctgtattcttcctagtttgcttttcctttgctgtgataaacaccattaccaaaagcaacttgggaaacagagttaattttccttacacatcccaggtcacagtctatcactgattgaagtcagggcaggaactcaaagcaggagcctggagacaggaactcaaacagaggaatctgcttactggcttgtgtctcagcatcacaatcagtcacctttcttgtacacactggcaccacctgcccagggttggcacgacccacactgtgctggtacttcctacattaatcattaatcaagaaaatacccaaacatatttgcctacaggccaatctgatacagacattttcttatgtaccctttcctcaggatgacctagtttaaaaaaaaaaaacacctaatacatgaggtatctattctgacttcacctctatgtttccttcaattaagatagattttaaagccccattgcagacatttctgcagaatggtggcaccatcgaggtgactatgaataatgtaggcatctgtcatgccttctcaaaaccctgattcctggctcatacttcagacctggggagattgaagctggacccatggacctgacactttcataagctcctgggtgattctttttgaaaaagatgtattttactttttcaatatgtgtatatgtttgagtctgtgtattgggtgtctgtacatgaggactggtacccctggccatcagaggtttcagatatgctggagctggaatgacaggtggatgtgaggcactctacatgtgtgctgggaatcaaactcggctcctctgcgagaacagtatgtgctcttaatgactaagcaatctttctttccccctgttcctaaatgagtctgtgtgtttatgcaacaacctctccttagtgtgtctagggacatggctccaaggcttcctcattagagttttgccttgcaagctgtgctctctggttccccatccctccccctgcaccttagtctagcacctgtagaaacttgagtagtgaagtcttctgttttatgtcacagcttctctttagtttcttttcaccatcagtcccgggggagtctcaggaacattctcccgatatcctgaagctgttggcacctcaccctagattaaaggaacacgtagagtcaatggctactgaaggcaccagccataatctaccaaagttgtcacaggtaaaactcaactcacccagctcgctcatgatgcttcatttggctcttttgtgggcacacgacaagtgagccctacctctcctactttggttcctgagggaaaaagaaagatggagttgataatggctgtgtcctttgcttaaaaactacaactgggaatttcaggcatggtccaaaagtttatgaatttattatatttgtagtcttggtcagattgagaaaatagagaaatttgatagaaatataaagagattggcccacttcccctaaagccctataactggggtgtgcttattgactctgtcttggtccaatccggaaaatagatttgatacaactataaagagattggcctacttctgaaagcctttaactgggactttagctttggggaagatgctgatggcctttgagtaccagtgagatccttgtgcaacgttgattccatttggggaccaaatggagagaatttcttgctcttgcactataccttacacgtaagtaggcttcttatgcacatctatagcaaagtagagcacgagagctgagttgagaaggatgacaaaaaaaaaggaacagagagatgggcttcaggtgctggcctttctagcacagggtaagtgggcagaagttggggttcagaagaccagacttgaagcaaagtttaacactgaatacctgggcacctttggggagttgtttcttctccatttgtgcctgaagttcctcacttgtatctaagccctggatgttcacatcttcccagtctctgcccctgctctagagaaggaatagaatgcaaggtagctgacttttcttggtgatggcagaactcagaatatctcttgaaatcagagagcccccagtggtcattagtacaggactaagacagcgaacactagaccagaggacctggagtggggacttctacttgcaactcagtctgaaatgaaggaaatagaacctctgcctttccactgtgagcagaccaggcaacagcgaatgcatttccaccaaaactttgcttggcaaggccttgtcctgtgtggacagtactctgggctcacagaaaatcaaaactgtagtattggggattttttttttaagttcttgaaaccatctgaacacccagggatacaggctaagaaacatcgcatcctttcctctgctcttcgttgtttcctctcacctgtgtccactgcgacttttggcagggcttagaggggaaacaaccttttgctgtcaaatatggatgtgggttatagagaaggttctccagagcaatgggaataaacacattttcgggattattttaggttgcattttcaaatatccttttcctagatgaaattctgtaaaagcttagagacagactattagaccaaattatttttgtcttctctttagacttttcacagaaaatggagcaaacagactaaataatctttttatgaaaaataaaaaaaccatatagctctggagcatgagttacttcggcaggcttgtacagagctggcctaaagtcctctgaaagatgtctatgaatgacagtcagggtgaggggaagtaaccagtaacaggatatcccctcactgagtgctttgccttccttacagaccactggggaatgctttggctaggagggaagagtgatgcttcccttgtagttcccccttcacccctgctcagccaacttgtccttccatgtgcctgttgtccttgtttagagaagttctcctaactctactgaagctaggcatgtctttgacatagataagatgtcaccgataagcctcaaggctgtccctccgttgagttgcgtagccactgtgtattcaggagtgaggatcagagctatgtttctctttgtcccctcagggtaagactattggaggaccaatcttggtcccaagcagcttctgatctctgggtttttgcttcacctaggagaatctggagcttccccattgttctaatcaggagggagcagcagctgcagaagagagcagcagcctagcaaattccgctcaaggaaaggtgagtagtaaagaagacagaaagaaagatcaggaaggagaggaccgggatgctgcctccgtcaggaccggcaaatgccaggaaaagaagagaaatcgttgccaaatcgaaacccaagaagacacagaattgcctaataaagtctccaaacaaggtactaattctacccaggaagaaagtatcataatgcagatgactgggctcgctgacctatgtagttacactctctggggacccctctagttcagagtatatggcctagctctggcatttaccaactatgaaatcccaggggttgctgtgacggttctttgagagtgtattggtaactatcatactgaaagtactatgtgatataatgtgatatagctctgttatagtgtaatatagatcatccatagtcaggacatctggtcaagcacccgatcaatcaagggatgacatctcatgcttttccatcatgtcactttcctccaggataaccacttcctgcctcatcccagttgtgggaatgtaggatggcagaggtgtgctcaggtctcgttcggttgtgccctgagaagcagcagctacagcttcatatctttccaagagaggttggcagtgccaagactgatctcagctttgaagacctggctcagtccagggagttaccaccaccgctgctgctgctgctgctgtgcctactgaatttgaatgaccttagccaggagctcctagtcttggacttctctgtctatgggccctgctaaaatgcctctgggagcgcacttcagggaaccctactggcaattgctcaggcagccactaaattaaactctgggggagattgagattgaaaaccagaaagacatttttcccccagaagtattgtctgtaaaaataaaacgagttgctccatccctgatttactgtttcctaaatcacagattttcctgctgagcagggagccaaaccagatctcagtaatccacttggatcctttgatgcatctgaccttgaatgctcactgtgtatgaggtatgtgatgtgggccagcacttgactgcctagtatttcctgctctttagtagctggacctttctgctggtgacttaactactgagttggttagtatgtaaaatcatggcactgatgaaatgtaaaccacattgtcacatgagagagctggtgtccaagcttacaaactgtgttctttacagccttagatctcaatttaaagagacatggaaagtggcaaggcaatacacctttcaaaggtcaaaaatggatgggccacgtgttgaatatgcctactatttggtcttcattagatttgattttgttatatatgactgtactgaaacaagacatatattttccagcttcccataatcccattgttttataccagcctgtcttacattattgtttgagccttagagttttttgaacttgtaacactgaatctaaactactaagttaagaactcaatgctcaagggttaatgtagatcccacaagcattttctttgaaagccaaatagaagcctaaattgatttgtgtttatgctatctgatgaacagtacatgtaacagatacttggtcaagtattttccttgcagctagtatgtgatctctactttctcgggtctctgaagagcagtttatccagatatcccacttcaaaaacaaataaaagtttatttcatttcatagctgtgatttagtggctaagagaagaggctctgaagtcaatgtttgaaccctagctcttttgacctacagactctggtcctagagcaaataacgtttgctaccatgatttgtttttttagtaaaggacagtggaatcaactccatcagttgtgacggttaattaagaaaaattatttaatgtttagagtagtgactggaaaacagtaagtactcaaaaaaaatttaactaatttttttcttcctactcattggtctttaatgttagatccagggacctcagaagaaactctatgtatacattcgaatagatgcatgaattcattgaagcaatatgtaaagtgtgcatatgtatgggtggatgtgtttctaagatagaagcatactgcttgcattagattctcaaatgtgctgatttttctccaaaagcattaagacggaacttaaatacttgaacaaatgtttgcctgccttttgagagcacttactcttctgttatctgtcatgtgtaagtcattatattctgaatgacatttttggtcatgtgaataagaacaaggcaactattatgcgatatagactcttcttaggaaaaatatatgtatatatgttcgcgcatatatatgtatacatatatatatatacacatgtgtacatatatacatacacacacatacattcttgggtctaggggaatagttcagtggcacagcactattcatgagattctggattcattaaccattattatcacaacaacaacaatagtaaaataatagtatataaaaaatctgtagtagcaaaatttgttcacaagcatataaaagtctcacacaactcagaagacacagcatagatgcagtcaaattaagcttcacacatcctgtcagtagtctgtttaagtggtgtggacaagaatggaatgaacaacagtaccagatcctttttactgcctcacccagaccctcactacagagtggcaagcgcatcatgctaaagccaaggtatgagatagcaaaaacctgctttcaagcagagaatgggccctgcagccaccacaccagctctgtgtctctaaagcctgtgataggcgctgtgaattccatttaatttagcttactcagaaagagcaggtctttgttctgcttaaccctccttaacactcctgccaaaatccaggcgacacaaaatcaaacatcctgtttgtattttctctgtggaataaaaatcctgaggttgaaattcctttgttcctcttccttttcttttcctctttcatcttctttgtccgtaatcacaagggactttgtagaagagttaggaatttgctccaagaaataaacacacagaggataagcaccccttctagtttgcaccctctgagcttaaaaaccattgtggccccttgttccatatttggccagagtagatgttatggaggctactaaattatagctagactttcactaccttctggtgtaagaaacctgatctaaagctctttacatttcagcccttgagaagaaacatgtagcttcccttccaacaggatttgtctgttaagttacacatcagttcttgaaggagtgaatttgtttgcctgtatttttcttgtcttgaaagtttcttttcccacttgtagctattgctgttttctctgtggttgtccttaggttttgttttggccctcctgtgtctttagaagagaggttttgtacttggttacttttcttgttgctgtgactaaatatttgaccagaagcaatttaaaggaagaaatgtttgttctggcttaccattggaggggatcattgtctcatggtgagcaagacatagcagcaggtgggaggaaatgtggctgtgagctccagggtcctgctgctcgaaatgatttcacaacatacaggagacacagagtagtgaatgttggcgctcaactcacattctccttttttgagttctatcagatcccagcccatgacatggtgcagcccacagttaagatgtgtctttgcacttcaaattaatctagataatgtctctcaggcgtactcagaggttaacccgagcttcagttgaggaaatgcctccatgagatccagctgtaaggcattttctcaattagtgatcaagggaggagatccccttgtgggtgggaccatctctgggctggtagtcttgggttctataagggaggaggctgagaaagccaggggaaggaagccagtaaagaacatccctccatggcctctgcatcagctcctggttcctgacctgcctgagttccagtcctgacttccttggtgatgaacagcagtatggaagtgtaagccgaataaaccctttcctccccaactgcttcttggtcatgatgtttgtgcaggaatagaaaccctgactgagacaggtgtcaaattgacaattgatattaatcatcacagaggctaagacttcaggtaatttcaagtcgcctggccatgaaattagacatttgtaccacctgtacaagtttgtagactgaaatctaagcctgtggtgttgtcctggaagagagaagttagacagaccatgaatgtatatattttgattctagagagcaaattgattggtttgtaagtttcacagagaaagggtagaaagtgtgactggaaccaggtatagtggctcacattgtaatcctagcactagggatggagatgtaggaagattaggagttcaaggtcatccttggctacacaaagagtttaaggtcatcttgggctacatgcggccttttttttttttttttttttttttttaatggaggagtaattggagaatacacctatgttttttttttttcagtctccaagttcccattgctaaattggaagaattccattcaaggaagtcttcccttaatctcaacaccttagaaccctgccctgcagtcactggaggcaggaaatcctcctttagttttacctggtatacatcaccggagccattggagctcatcaatggaaagcaatacctttgggataataagatcttttgaaattagaagtgagaatatttgctacctgagcttgttatccaatggcccagtgacattggtgacaagtaaaaggatcagctttatatataatctagttatagctccctaagtcactgggtattaaggcagtttacttttctttctttctctctttccctcccccttctttctccccctttgctataatctgattgcaaaacaacacaatgcaaggatgtcactggtggagaaagatagctctttctagataaggcaggcattttatctggactgacatctaactgaaggcatttattcttactattgtttaccccatcactctgataatgtgaaatgctttcttgtgagacaagctggccctgctctgatttaaaaatgtctccccaaagtgttttcaaaatccctatcttaaatgggtaaaggacagacattccagtttatacctctatcatcataggtaagagtctttttgtttatctttctagagtcagaaagaagggagagtatcagaaagggaaggagaaaagtgtatgtggacgtgtgtacatctacagatggatcactggctggctggctcgctggaatgtatttgaatgtgtggatacaatatagtcctggctatcttgtagagtaaaggaggaagagtagctggaaagtcagacttgattatatattccaaactttctgcctactagctagtagtgtaatcttgggcatgttatctcatctgtttgagttttaatttccttagcagtaaaatagagttactcacaattaccatttattaatatataaagttaattttaatgaaaaatagcattgcatacagccagaaatatagtaatataaatgtatgtgtgtatgtatgtatgtatgtatataaacacatatacatatatatctttgatgggagcaaaaaccaaagagcacatggctctgcgttaggaaggcaacctctggaaggggtggcaggacttctccccataaacattatattgggtggaataaggagtctgggatcccagttgcagggaagaaaagctttgtgtacaaatgaatgtgcacctgggagtgttgcggctgctgctccaaattcctgcctgtgcacatagggaacactggagggagagggttaaagacaggcacagccaggagaaaagcagtttttgtacttaaaccctgctagggaatagcaaggcacatcatcctatctacctacccttcagtatcttggtgatagttaggaggtacaggatgtaaaaacagggaaacgtgtgtgtgtgtgtgtgtgtgtgtgtgtgtgtgtgtgttagttaggaggtacaggatgtaaaaatcagggaaacttgtatatatacatatacatatatattgttaaaggtacaatatgctcaattatgaagttctcgagaaaaagtgttttgtatattagtagtagataacatattaatcatcatccttatatgtataaccaaataatatgttaaagcattcagataagctgaatagtatatgtctgtaacactaatactcagaagtttaaaacaggttaattaggagttacaggccagcctgagctacagagtaagaacttgcccctgaaaaacacccagggcaaggaatctaggggaggtaatacattcttctatttctagtacttgagaaactgaggcaagaagtttgccagggatatgaggctaatctggcttgctgcatagcaagaccttatctttaaagaaaattggccatgtggtttggtgatagaatacttttctcacatgtgtaaggctttgggtttgatttaacacacacacacaggagggcgggaagagagagagaaagagaaacaaaatagatgcacagaattcaagtagtaaaaaaataattgttctggattggcctttgtgatctttgatcacctcagtggttcctgaatcagctctgaaatcatactttagaaacacattcttgttgtaaaatatatatgttctgtagaaaatattgtaaagagccatgtttccacttggtttccaaagtgagatatcagcaggaccccagcagttgtccatatgcctttttgcaatcaggaccattactcctgtggtgatttcagtgaaatgtcccccattgtctcagttggtggcactgtttggagaggcataagaggtatggtcttggtggaggaagtgcatctctgggtgcaggctttgaggtttcaaagacttctatgatccccagatcactttctctgttgcttgcttgaggtttgagaagtgagctctcagcttcaagctccagccactttgtcacctactatccttgcaggaccttaaccctctggaactgtaaagctcaaataaactctctcctatagaattgccttggtcatgatgctctctcacagcaatataaaagtaactaatacaaccccaaaacttctatcttgagttcgattttgttcctcatagttttaccatgtaaatatgcagctgtaaatggtatcagctggtttggcctaagtcctaaaactcaggtagaatccagtgattggttttgttttgttttgttgtttttatttacatgaacatgtaagcaaagtttgttcattttcattagcatatagcatcccattgtgtgagtattccagtctctttagtctattgtagagggatgcttgagttagctctagtttggaataccatggatggccactatttctgcaagtgccactgtatgcctgtttttctactagacattttgtttctcttactgctttagatatttcttttcttagaagctctaggtatgttttaaatacaagccttttcttacctgcatgttgcaaaaattccctcttactccatagcttgccctttcagtgatgcttttagataaacttaaatgaaacgttcttcatcttatcccagtcaaaactaacaatcttttcatttatagtgtttctttgagttttctttatctttatctctgtgtcataagtatgttctcttattttatgttctgaaagctgtattactttattttatttttggcttatttttcagatcacctggaattgattgttgtgtatgatgtaaaagatggtccacttttatttcctcatacagatagccattataacatttatagaaaatgctatttgtgcattaaaaatactcccatggccctgttttaaaatgcttcatttgtcataagtcaagaatccatgtctgggtctattcctgagctttctattctgttccatggatctatttgtccttatgttagtacaccccgttttaatcaccgtggctttataataacttctgatgcttggcggagcaagtcctcccacatccttgttcttcagatgtgtcttggcactcagccctttgcatttccttattgcatttagaaatcagcttgccaagttttcccccaaacaaatcaacaaataaaataacacattgcgatgtattgagattcaccagatgtttatagtttttttaattgatttttttgagaatttcatatctcagtactgtatttacataattttcacctttctccctccaactcataactgtgtcccttcctcctcctccttgaatcattgacttcttcttcttcttttgatctcttttttaattaaatatatgatatcatataatgtgaggctgacagtttcttcctttcaactgaacactcttgggaactcaaaataagctgatcaagatttgtctcccttttgtctatactcaccatcttgttaaatgtgagccccacttcttaagtcatcattagctgacccctaactcctgatgctgtttctgatgagcttctctttatacaaagtacatctatgcatatctgaatgtgcagaacacttttcattaagggtccccagattgctttagaaacatcttcctttcccaaagcaactaaaataagatctaatggaagtatggtacatatttttatatgtaggtagatgtgcgaacatatttaactattgatagtgactgaattaacaatattacttattaccactggggaagttatccatccacacaaaaggcagacaccaactgttacttaaataaatagaaggttcaagggtagcaaacacagagtttttctccatagtaacattatgtacagagtctgtgtgtatgcatgtgtgtacctctctgtgtgtatctgtgtgcttacaatataatcaggtaaacaggttggctaaacaattttgttttataatggaatctattcagacactgagcactaatctgaactttcttggaccagacaggaaaaggctagaattaatgttacaaaatgatttggttatgccacaaaaaattagcaatgcttctttctatatgtagctcaggaataaaaagaaaatgcttttctgaggtgtgacaacacaaaaggagtgccctctcccacaggctttgacaaacagtactgtgagaacttaactgccaatgtccctgtctgggttttttttttttttttgatcttattatagttttctcctattcatttcctaaatttcagattattctatgagccagtcacaacaccttgtggacacaccttttgcttgaaatgtcttgagagatgcctagatcataatgcaaagtgtccactgtgcaaagacgttcttttacaggtaaaccctctttcttctttggttgtgttagcttattttgtattaacactgtgctcagctgtatccaaagccactgtactgtgcttgaccaaaatatgccacccccaccatctgtttatttctgctgtctcctagacatccttcctctctccacaaagtccttcaggaaaatgaggcaacatctagcttttcaataactgtcagtaatgaagttcatttgtgttagaagcaaaaacatgcaatagatgataaacacaaggcttggttctgatcccattgtggaacctcgtaaacaataatcttgagtgattttttgcttccactatccttgaactagatagctctgacttctgcatatgatgtttatttgtgcttcaaagaggtcggctgctaaaggcccctgccaccacaccctcaaaaaccctctcagatcttcaaggtggtcttcttttttacagctgctcaggagccactgttcttactagcagatacttgactgcttgtaaagctctgaggacttcagattctttaaaatgaaccccaccagcttacatcttcaagtgggtcttatggagtttcctgtggcgaaagacaggattcttgctttccttccttcagagacttatcaatctcagcttccaaccagtattaatattgctttgcactaaaatacttgaagagaggtagcagaataataaataatgccacattagttctagagaatagtggtgcatgctgtctcacgatttggaaagctgagataggagctctgtgagttcagggtctacctaagacacatagaaagaccttgtctcatgaatacaagggactatatacaggttcctattgggtccatataagtatatgttaagactttaactcttgacaataagaagatggaatgagcccaacatccagggtagccttgaggatgtgtattgggattgggaaactgctgaagtcacagctttcctttgattaaagaggtgggatttgcaacctgattgtagattaaaaaaaaaattccatggtcctatttaaatgaaacatctatgttgtgttaacatgacaaagttcagaccaacagaagggaaaaagtaccatatgctcagcctctggagtctggagaaaagcactgttaccattttagagggtctgcttcctggagttttgttttagcatcaccagaggggtcactttcctccttaaattgcctacctcttaagtcactgcttctaaagtctgggactaggccttttttttttgtttgttttgttttggtttttttttgttttttgtttttttttttttttgcccctgttgccagtcaatggcagtagctgataaggcatcctttaggcagatgctgtggagtcagaagagactcagaggctagaagatattctcatctatctctgtattcattcacggccgtacttaacaaagagataaatattctagtcatgttcatggcagaatagactcctggagaagaaaatggtcttaaaagcaacaatttggtactcaggagctccctctactgggccccacagcaatcaattctctgcagatattatttatttattattatttgaggagtccatatgaatactgtatttacttccttttcccctcccactctccatccaacgctgcttgtgtttccccactccctacaaattttgagacttcttattctttaactgttgtttcatgtatggtgcatgtataaataaataaatacaacttcctgagttcctttagtgttgctcatatacatatgttcttaaggctcaccacttgatattggataaccaattatggggcttctccctggagaggagtgattcttcctaactcagtagtcactagttgcctgtagctattcagctaggagtaaggcctcaggagatttcctccatcctccttgacaagttttctggtgttgtctcttgttaaggtcttgttgaggaaacttttaggatttcatgggtacaaggttcctgtcatttacaaagaaagccatctcgaagcacacaccttggtcccctggctctttcaatctttctgccccctcgtctagaatgtcctgagctttacaagcaggggttgtgttgtagttgaatcaactggggatgagcaccacatagtgaattgctctctgcattttcacaaaacctgtacatggctgttagcatgtgtgtgctatttattttaactaaagacttaaagacttggaaatatctaggagccaggcattcgattgggatggaggtgggggcaggacatgaaaggatatatgaacattgccttttggttccctgaatcctttgaccagagtctttcagcactacccagagagagcttataaacataacaataaagaaagcaaaaaggaaatatgttccacccctctttagttcaaacatgaacatgatctcaaatccaaagctctagctcatctgtgagattttcaaaagtttaatgccattattttctttgttaaaatacttttttctaattataaaggatcaattgtatatttttaaagaaaatcaaaactcttaacatccaaaagatacacacattgtggctgtatttgcttgcaaattttgggtccaaataacaacatttcatgatttgactacttatgtgggctacgtccgaagttttctgtgttcttctgtgacctatataatagttcattaccttgtccctcttctagtgcttgccatcaagaaaatatagcaaaaatgtaatcctggaagaactcatagctacgttcctgccagaagaattcaaggaacgaaagaggctttatgaagaggaaatggaagagctttctaagtatgtatactcttgtctgtattttccatttcatgcacaccagctcaggaaaactgtcacgtttcttaccagctccttactcaaatgatatcatgtgaatagtctgaaataaccatggttatttacatatttacagtatgaagtcaacaagtgctatagaccacccctcccatccccctcagaagcagttaaacttttcccagcacgcttccaaagaagctcatcagccacaccacagaatcacctgctgcatctcagcaccagtgagcgcatagtgtgaggagtgacttgaggagcagcttaattaggagaccacatgaaacaattagaagattccttggagtccttaagcaggtgatagggtggttaaagagtggtgtgacgcaggtgcacgcccggggttaagactcagctgcttcagtaagtatgctttgtagacctagataaaatgctctttcacctctctgggaggaacttgaagaagatagctcttacatcatagacttgttctgaagacccaaagagtttgtacatagcaagtactgaatatgtggcaatagcacctgtgcgtgtttcctctgccgcacacagtgttagaggcaaaaggtcgggatgaagacataattacatcttcaggggctctgcctcttgtgcacttagcagaaaaagcaggaaataatagcagcagaaaaagcaggaaataatagctaaggctggcctcgatgagtgttgccctcctccctactctccacaagggtggatcatcacggcattctgaaggtgaactgtttcctgaggggggggaaactcttctgcttatatgcctcctgggaagagaccatgtttgaactgtgcacccagttggtttggatgtgccttttggctcatataatgttttcctcagagactagaaatctttgtttctcactgactttttttttttttttttttttttggtttttcgagatagggttcctctgtatagccctggctgttctggaactcactttgtagaccaggctggcctcgaactcagaaatccaccagcctctacctctccagtgctgggattaaaggcgtgcaccaccacgcctggctcattgacttttatagtgaaactaccctgtacatttgtagcttttttccctgattctttacttaatctttaacctttctcagtctttttctcagctatcacttaaggttgtactactggagcattgtgagggctcttctgtcataaaggcatctcagacctatccccttttaagatggaggcagctggcagctggctatacatttcttggcccatttaggtgtagtgtccctgtactggatttattacataattcagaggaccaggatctatgaagagctggcccagtaggggattcccagtgggccatgtgcatgaattttcgagggtatccattgaaaagcagattcctgtatcccagttccagagtgaatgcatcagtagctctggaggcccagtcatctaggtttaagagttccccattattctaatgtccaaaagcatttgagcatcactggaatacattattcttggcagcctattgctggctactcctcctggctgagtctgctcggaatgatctctaaaggctttgcaaattagagctgcatataaggactttgcaggaggttttctactgctcctctgaaagctggcacacgtagaccatcagtgccctttatgcctcaagcaaaggtgcctcacctgaatctgtccagttggccagagaaagaggtgagggggtaacagagggagcgaaggaaggaagaagtagcagagctgtcatgcacagtaagtttatagagaactaatcaacaaatttagactgtgtgatgacagtttaggcttccagccttggcatagtctgcactggatcataggacttggcctacaagatggggtgcatttcagtgtttttctatcgtccgttaaatcttcgatgactccttgtctttctccaagggaaacatatcatgacgtttgaccagtctttctgtgttctgaccccttggattgagatacatctcatcttctattcttgacagcttaaataagaatgtccctattttcgtgtgcaccatggcctatcccaccgttccttgtcccttgcacatctttgagccttgttaccgcctgatgattcggagatgtattgagacaggcacaagacagtttggcatgtgccttggagatcctgtcaaagggtaagtgaagagacctagacagcagggaagttgggtggagaggtatttatgctttactttggaaacatcctagaggtgggatcaacaagtccatgaggcaagctcaaaaaacaccaagcatctgtgagggtgaaagtctctcttgtgcctgcattacagtatgagaatctcattattctagagaaccctagagggagggagtgtttcatccagcaggtgacatatattaaaaaaaacttgtcttgtaggcttatggctgtagctcagcctgcctaccagtcacaaagccctgagatcaatgctcagcactacataaagcagaagggtattgcacacctacaatcccaactatagggaagtagaggcaagagaatacaagttttaaggtcattcttgattacctatgaggttcaaggacagtttggaacacatgaaagcctgtctcagaaacaaacaacacagatgaaacatgttgtcttgttaagagtgttaagtcctagagttaagctacccacttttacatgtgagcaatggccttgaagtctactactaagattctggcatttgataatagtcattgtttgtatggaggattaaatccagagccttgcacatgctaggcaggcactctaccactaaccaagcaggtttcattttattttgacaccaggtaccacaaacttgcccgagcaagcctcaagtctgagattctcctgttaatagcctcttttgtatctaggactataactgtgtactatcatgttcaggatgtgataaggccttcttgtgtcctaacatggtagaaagacaaagtgacttttgggctagcattggaaatgtaattgaggaaaatacataataaaaaaaaaaagacaaagtgagagacagtgaccccaacctgcctcttaacaatgaatgtgctcttgcagtaattaatccacacatgtgagcagacttctcatagcctgatcacttcttaaaagccctgccttctaacagtgttaaaatgacaattaaatttcaacacaagctttgaggaggataaacattcaagccatagcactggtacatagtatgtgcttagcaaatggtagcagttataccattatgttcaggtctctttttttcactgatgtttcctattgtgtagctgtggtggtagatctgggcacagaaatcctgtagtaatcagctcaatgtgttaagaatggctggggtccaggccaagaacaatagaactcaccaacaatctactttcttgacttgattctcaataaacaggtttgtagaatatggctgcatcttagagatcagaaatgtccaattcttttctgatggccgatcggtggtagacagcataggcaagaggcgcttcaaagtgctccatcagggtcaacgggatggctacaacactgctgacattgaatacattgaagatcaaaaggtgagggtggccagtgccaagaaacctggaagccaaattatcaatgtagcttggtatacaaagatgattgcaaagtgggctctcagaattgccgtgagaccttggggtttctcataaaattgctcctgagataatgctgctggactgctgcccaattgcacccatagtcttctctttccctgttattctccctgcttagccaaattgtagttatgtttaatgtttgtctagactaatccctggacccattccgcctatgttaggtctctgctgggaacaccaagggctcaatttagcatggggtctacatataagtattttaactatggattgatttatattgtccaactcatttcttctgagattattgatgatatatataaatttgcatctttaaaatgtgcaacctgcccaagagcactcttcctaaatcaaagttgtttgccatcccttaaagcaaaaatggtcacatgtccaattaagccttgcttttctgagctaatgggtagataaagacatcaggaaccctatgttcgattatattccttatgtaatggattaatatatgatagttggataaatgcatttgaccttgaaaacatactgaggcacacatatagtagtatctgccttcccagtgagtaggaaagaaatgaatataaaaatggaaggaacagaggcatgccttaaaccagcacgatgcgccttcagctgtgccagatcaagcctctgtctctctgcttgctgtttgaggcatcgttctcaaagctttgccttcctgctttctctgccatattggtacaccaggtgctgggtgttccatatcttacacaagagattgcctgatgagtgaaggggaggcaggtcagattctcagaagagagtcaggtgttgaaaacagttctaaggcagattcaggagatggtgattgcttcactttcattctgatggtttcaggttcagggagatgattgtgctgaacttatggggttacacaactgtgtgtatgagcaagcgtcatcatggtttcactcgctcaaagcatctctgaagaatcggatactaaatcactttggtccaatgccagagaaggacgaagacccccaggtatataaaaatatctacttatgatatgttggcccaccacgtggggctgtccagggtttgtgattagatgggtgtgtagttgtcatgcagcaagtcaagtgcagaatatggtatggtgtagctagggagtgagcatcatgagtaaggccaaaagggtctgaattgaatgaacaaagataaatagtaggaacttggacctaagacagatattgagaaataagtgagacgagaggaagggagcacagataccaccaacaaaactatcggtggcagtccagagccacaccataggaatgttagggtgacagaatctatgcaaaggccagggactaagagaggtgataccaaaggttactacttccagccagcttcatgtccccactgttgcaggagctgggaggtagggtcgcctatcttataagaacacagctgcataaaccttcctgtccatggccctgcaagtctagaccttccctgttttccctaacctgaccaggtcctaagaaaactgaccgccaaggacatagtttgttaggttctactggattgtcttctgtgaggaccagctttctgtgagctcaggctgcagaaagccttgcctctctgctttcaatcaggcaatgtttgtgggggaattccagtttggagattagatggcctatgcaaatatatattcttagtgctgtaatctggctattccatagaatcactcctgtaacttctttgatttcttttttaatgtatgcttcctgattctatcactatagaaaattcattatatatatataatgcattgcctacctttctaactgtgaccttgggtaaatcccttcccctctttcaatttttctctaaaatcagaaaggatcattaaaaatctctaaatttcttcctcctcttacattctgagactccaaaatgcctcagttccctaattggctgaggtgtcttgtttccctcagagcacagagtggtttttccccttcctgatacagaggcatcactccgatgttctaaagagagcaaggtcaccaagtgctttctggtgatccagctcttggctgttgtgactcaagaagtcagcataactctgaacaaggtcatgttcaagcttaatgttccccttcacctgctggggaacattctctcccagtcagacaaaagataaagatcagcagtgctaaccacatcttccacaggagaaaacacagatgcctccgtgtgattcataaggccttaatgacatagcaagctcaaatcatttccttccttattagttttgctatcgtgttgccttggtggtggcagcagcagcaaaaactcatccagcttgctctagctaaccctgtagccccaagcagttccgcgaataaggatgttgtaccttagtgggaggtttcttagaaacagccagagttaacatcagcttaagtagctctgttgctgatcctggggaaattcaaaggatcaacctggtagtgtccacatgaagctaaagatacagagaagccaagagttcacagacattcagggagtaacacatggaacaatttggagtgaaagaaccccatccacgtggaaggagttaaatcagccacatgtgcttctctacaagctgaaagctgacctgctttgaaagttgtggaaagaaaactcactcgaggtttagtaataaatgtctaaaacgtgtgctaaggacgcttatgaccaagagaattttggtgaaggattgataaggagtgtgaaatgtctttttaaaaggaaaacctgagggttaacacaaatgtgttttctaattggaatgtttgctgttttttttttgagactggaaatcatagctcttggttacaggggagaagatagctatagctgttagtgacatggtatatttagacttcagccttccaccacataaaaaactgatgggacttaaaagacatactaagcccagagagtcataggattaaaggcccaattttaaatggatcagtccaacggacctaaccaaaccctgagaagtaaaagggacaaagtggtgggtactccatctcttaaaatcagacagcctagcagggcgtggtggcacacgcctttaatactagcacttgggaggcagaggcaggtggatttctgagttcaaggccagcctgtctacagagtaagttccaggagaaaccctgtcttgaaaaccaaaaaaaaaaaaaaaaaaaaaaaaaaaaaaaaaaaagacagcctagggagcatagtgaatctgttaaaatgttgatttccttggtttaacaagtaccaaatatgattgtggctccaatgagaaagaagacctcagtcctggagggctaaggcacttctattccaagagaacattcagtaaccagagctcttccatcacaaagctctgccatctttagagggttactttttcttgattgaccaagactgatcatcaccatgtcttcagtcttgctagagaaatggggaagagacggagagatggctcagagattaagagcactgactgctcttccagaggacccggattcaagtcccaacacccacatggtggctcaaaaccaccagttaatggaaatctgacacccttttctgacttctgtagtgcacagacagacatgcatgcaggcaaaacaccatacacataaaataattaaaaacatttaaaagaaattttaaaaaattggaagaaagaggagggaagagactacatgttcttttcccataaaatgatgggaacttagatgtatcacctctctttgtttttagccaaaatttgaccttatggcctcacctagctgcaaagatgcctgagaagtaacagttttcctcatcccctgccaccatgtatgcttagctgaaataaaagaggaaaacaatgcctctcagcaatgtgtgccacacacagaagcagttccatgtgtgatactttactgtatgcatgtggacttctatacatggactacatgggatccatgaactgtgtttctctgttgcaggttaatccgaatggtccagcctggtgctggtggacactggcggttcttcctctggaaagcagagctcagcttcccttcctagcaatgaggtccttaaaggacagattgaatggtattcggcgtatcctggcctttatatcgagaaaccaaaattaaagggactggattgtggaagaggaatttctaccctctccactgccccgaggcaatgttcttgtaaacatatctaattgcaataacaccttaacagaagagagtaccctagatagatgttgttattctttttgaccacacagaaatgaggtagaaagaccaaaaggatgtgacctgtttgacttactgtcttcaaatgcttcttgaaacactatactaacacacaaatagcagaagtgtgaagaagtcaaaaagagttgatgtttagcatcaatttttctgaagttaaaaaagtgagttgttgttcatagctaaatgagtgtgtggttgaaatgtcaagcagagatactaatgttactgcattctttcactgacttgaggtctcatttcaaatggttcaggttttataaagcattgtaaaaaat

SEQ ID NO: 779 - DNA, 33989 bp, mus musculus; identical to SEQ ID NO: 778

SEQ ID NO: 780 - DNA, 33989 bp, mus musculus; identical to SEQ ID NO: 778

SEQ ID NO: 781 - DNA, 33989 bp, mus musculus; identical to SEQ ID NO: 778

SEQ ID NO: 782 - DNA, 153 bp, mus musculus
ctgagagggaagactagccagcactaatccaaaccagacatacccactctgttacgtctcagagtccagccaatcaaaagcacatgtgccaaaggctttttagtgaactctcactcttcctttctgctttcagacattttagaaaattacgtt

SEQ ID NO: 783 - DNA, 4528 bp, mus musculus
aagggaatgggggtagaagaaagggtatgctggcaggacgggaaatcctggggaatcactcaagacagcacagcctggacatacgtagcagaatgatcagtccttgaatttgatttctattctactccaaacgcagagagagagagagagagagagagagagagagagagagagagagagagagagagagagagagagagagagagagagagaggtggggggtggtggtggtgagagcactagaaaaataggatccagcgcaagcccgcgcatcttctgaagtcgcgctttcctcttcagcggaatgaagggggaggggcacctttcaacaccttcctaaaatctagaggtccgctaccgtcttgcaccaacttggaggcccctcgagggtgcttttcggtagctacaaacgaattttaagaaataaaaaacaaaacgaaacaaaacaaaacaattgcctttcgctgttaggcaccttcctaagtcttcgctgggagaagaaattaatttggagccttgggtaagagtgaagggattgtggagccataattccacctaaacttaaaaattgtcactttaatctagcccaattcgtcgtttctatcatatttcacattctgcaaaactcctctgtcccgaatctctgccattcagtcttctcagctcttctccgatgaatttgctggaacatgcacaggggaggggcaaggagattgagcccagtgtgagctctccgctgcctgcaaaagactcagtcgcaacaaatttcgttcaagggcccccgaaagtgttatcatctgaacggtggaaggcctgtcagtagaagccctgcacttttcatttttaaggtcgtagttatctggtgctggatgcaaaatgaggccaaggtctggggtccaaatccgaacccagcagtaccagactttccagtaccctccccgccccccactccacccctcgcatacacaggcacacagaactccaaaagcactccttgccttggccagctgcggcgctaccatggctcaggcgctacagcatgaaagagctgggcgcgagagggcgagggttctgcagagcccatcccaactgtgtgcggcaaccacctgcaaaccaaaccctccccacccagaaccccgtctgcggggactgagcagactggaggcacagggctgaaaggcttgctacctgacactgctttgtgggtttcagaacaagatgaagagagttctctcttgtattcccagggcccccagcctgtcttgcatttttctaaatgtctgggcaacaagaagctgagctcggcagtgcagggaagggactcatagatctcaaaagacaaggaacgaacaatcatcacaaatagcgtttggtaaagaatccacaggccaaactcagtagaaaattcttgagtagagtaatagataattctaggttcccacagtgtggacaggggagtctccccggagttccctggcgctgggcccacagcctaggcctgaatcagcatctagcatctaggatactccacttaactaagctctgggttagtgttctgcctcgaagggcagcatttctgaggggattccttttacgggcaagacacaatcgtagtccccaaaattaaatgtcacacacacacacacacacacacacacacacacacacacacacacaccaccgcccgcaccagggtgcctgcactacttttgcgggctgctctgaaggaagcagacagggaattgtgaagatagtaatttgactcctgcgcacctccaacagctcccagcaaccccctcctccactttggcaacagcgcccccaagcgctgatacaccgctactacatcagagcatcctcttcacttccaacagcacatttgtaatttactgagccttttttttttttgatatctccatgtcctgagtaatttactaaaaaggtgaaggtagtagatttcagcacctttaggtaaacgtttgtgagacctgcagagcattaaggttcttgtgtgggcagccacctgtttccagggatgctcgaggctgggacttgctgagatccactctgcggcaaagctgacccaggtaagcaaatccaaatccattcaaaccttcgaacctgagaattaatacgtcaccaacatcgcagcgtgccaagcatttttgcaacattccaataaacattgcacactctcttttaggaaggggctatcaagaaatacgtacaaggtaaagcacaagcgcgcagaggcagcatcctatcttatagcaactcccagcttggctcctttcagatacgaaatcctggaaatggtggacaccgtatgggttgtggaagaaacctgctgtcacagtttatatacttattgagtaaggcttctaggccattagaaaccaagctaatgggtggttagagtagctggagcttgattaagataaactttgtggtgaaggaagttttgagcttgcttcaaatgaggggaggaattcagattcaaatagagatgagggttttgattagggggaccaagggaggggcaagacgatcctatctggaagggtgaagcacacctccagagctccatcacatacctcctctggtatctggcatggaggtggggcactgcagagagggagggttgcagcggttctgcagagaggctactggggggtgcaggcagtgccaatgatgagattttggactctcactgctattgcttgcaataatagtagtttaaatactaggtaccacgtagacagggtggtgaagcgcttgcggttttgacacattagccaccgagttttcagttctggggagcattcagagtgtgctctatttccaaaagttaatcctatgagcatagccacatccatttgcacgattcctccaaccgactctttctactagaaggaaagcaattatgaggtgtcgccacttgtttgtgttgtttttcaataaccatcagctccttctttgctgtgtatgtgatacggcaaaaagcactgtgttccagctcttgagggcatttttaagtagctcattgtgtctgagctctttgtttgttaaaaaattagtctactaaataaaacccaaataagatggtcctgtgctcacaaagtcatcatctaagggcagtcccaaattgtacctgagtaagaacaaggttcttctcctgccttctgaaatcgagcaacaagcaggtcaatgacatgagtccatacaatcatctgcctttcaggatccttggccacaccttcagagtactttaggtatgccttattccaagcagacatggactttattaaatcaaactgaaaccacaggcaaatggggaggggtgcctctttatttcaaaaagaatttacccaagagttcttgaaaatagtcaactctccaagtgcagctagaaacatttgacttgcaattaaagtctttgtaatataaaataaagggtggctggcagaacagagaatagtttatctagtgccctaagaggtttcctagcagtttgatccaatataaatcttatctggagacaagccccctgcaaggtagcaagatcttttgttttttttttttttttgtttttgtttttttttcaacagaatgaatttcaatccagattctaaagcaaatgagaaaaaaaaaaaaagattttcaaatgacaccatgtggtttgctgagtcacttttctgacctggctcctgggcttttaagagttagagtgatgtttgcaaagcagactcaaggactgtggagaagatgaaaggtcagtggataggaatcagcaggtcagcgaggcaataaattagaaagatcatgccgacaacattcctgctcctccaacctagtctctaaggttacacagtctctatgtgagccggtcttgctgtattgggggcgagaagggctgtgtgtatggcaagcagaaggcaagaaatgaatgggaggctgtgttggtaaactgattttagagcgccacagtgaagctaactgggagactcaccaggtagctaccatgagatggaattaggaacccttctttacagactcctttgggtgtcatgaaaaaaacaagagggataaggaacttgcaggtagatgaaataaatcctgtctgtcctaaccctacccttctctccccttccccaaaccaggcaatcatgctctgcagtgagcagactcatttgcaactccccttacctcccctcccacggtgacacaggagccttggtgctaggggcctgtacctgctggaactgcttccacagtttggtgtaaaacagtcttagaatagtattgtattagacttgtacctgatgagtcacatctcttagtttcaaggatgacgtcaggggaggccgccagccccttctacccctcctccctcagagccttcagcaatgattacactgggaaagccagggtggcatttttgacactgctcttctatatggagggaggtttcagcaggaggctgtgagaacagacatcgcccctgctccccgtgagctctcgtgggcct

SEQ ID NO: 784 - DNA, 4528 bp, mus musculus; identical to SEQ ID NO: 783

SEQ ID NO: 785 - DNA, 20145 bp, mus musculus
cgcccccgcctcccaggccgctcgggtcctcctctccaccccccactccgcgagggtgacgccgcctctccacgggcgccgcgtgaccggaagtggcgccatctttagcctcttgtgctattgacaataacaagccttggctcgctccccctccccctccagccctgcagctcccctccctgagagagggagaaaaggaggaggagctgcaagcttcactggctccctctccccagtcgcgcctgcggaaagtggggaagaggggacgaaagcaggggaggggggacggcagggctgtttacctgtctgcctccttcacccccccaccccccgttctgttcactgccggtgtcagcctatccgccttcccaagccctcccattcccccggtgtgcccccccccccactttcctcctcgtcctctgtgcttctcctcttccttcccttccccctccagcattgccacctctcctacaagcacgcaggcacataaacgtaggcttttgatgctcctctgcctgttgaccccgctattttcatgtttccaacaggtttttcttcccccaatccctctgctgcttctgctgctgctcaggaggtcagatctgccactgatggtaataccagcaccactccgcccacctctgccaagaagagaaagttaaacagcagcagtagcagcagtaacagtagtaacgagagagaagactttgattccacctcttcctcttccacccctccacaacccagagattcggcgtccccttcaacctcgtccttctgccttggggttccagtggccacttccagccacgtacctatacagaagaagctgcggtttgaagacaccctggagtttgtagggattgatacgaaaatggctgaggaatcttcctcctcatcttcctcatcttcgccaactgctgcaacctcacagcagcagcagcagcaacaacttaaaactaagagtatattaatttcttctgtggcttcagtgcaccatgcaaacggcctggctaaatcttctaccgcggtctctagctttgctaacagcaagcccggctcagctaagaagttagtgatcaagaactttaaaggtaaccaaggccaaaatccataatcacctactaagaatttgacacttgagcagtcacgtgtgtgctatttatgttaatatattgaacagtatagaggttgcctaatgttttatgcgtaatcaatgagtggaagggaggtcctgtttttggtggagggttctttcccgaggtgtttgtgtccttcctgtgaagcatactctttgagtgtttccatccaatgtttttgaggtctgtctcacccgttctagttctatttgatctgctgttccttcccacattgacagtatggttgatagagattttactggtgagaaacttgttttctaatgaggtccatttcaggtgcatagtgagtcttggcactactgagattcttgtttttataggccacatactccaatccctaaaaatgtaggtagcaagggtgacagtttcctttttaaatgagatttatggttaggttttaagtgtagagtactgtatttgtgaaactagcagagtttggcgaaacatcttttgggtttctgcaatccttcccgaaggtaaggtctgaaaacgaaaactgctgtgtatatacaccgaagtagtgactatcactagtctaaaggtagaaaccgttaactgcgtctttcgtcactacaatgggctcttaagtactgacctgcagatattagaaaatgtgtgtatcctggtgtttgagattactgcttaggagtttgatgaacatagaaagtcagggtttaaaatgtattttgacttaactttttatctgttgaatgtgtttctgttttcctggtttatttttttcaccctcctcagcttgtgcaggtaactagatgctagaactgtattcaagatggggaagtgaatgaatgaacttaaggccttggtggctaagtattagcttgtgattgaaatgttggtgtgaaaaagagcactgtgctacttgtctgaagcagggggttatatatagtattgtttatttttaaccctttccatcctcatgctctcaagagtcttaaattctttctgatttattagtagagctttctaaagtgaatatgaactgtatttatagatttattcattcattgtttcatttaaagaaaaccaaagtaatagggaaggttttttttttttttttttaagaaatgagctgtgattctaatttcatttgcaaattgatttctcctgaaggcattagggcgtttgaaatctttaatttgtttaacttatcacagatgaatgaagtttaaagtctacattaaatttctttctattctgaaaatgctgcataggttctggagtcatttaggtgttacttcggttttgttttgtttgacatttgattttgttcctttaaaatgaagaaatgttgtgattctgtgactgctgcatacattagggagtcaatcagacctgaatcggaatcccagctttgccattgactagttatggtgaccttgggcgagcttagcaaatgagttccaggctcactttcttcagctgtaaagttggggttgctaagattccctgcgaatgtgttattgttgagacaatttctataaagtttctgaaatacttttcatatagtgtgtactcagtattttaaatcttccctacaagattcatgtcagcttctgttttacacgtgataaaacaagatcagaactgctatttttatctgtcattctcaaatttttatatttgaagcagtaacaatcaataggagaaaaaaataccttcaattttcataggtgaatcaaaataacagtattttggcatcttaaattttgtttatattgaacttttaaatatcacagttaccttaatgttgaggtattaaaaggatcctaaaatagcagtactgttctattttatagttctttggttactatatccttaatatttttctaattttgtttgcatattatttagataagcctaaattaccagaaaactatacggatgagacatggcaaaagctaaaagaagcagtggaagccattcagaatagtacttcaattaagtacaatttagaagaactctaccaggtatgtattagtatgtaaaaccacactttaccaacataagctaagatggaatgcatttgtattttcctttttttaaagatttattttgtatgtgcatgtgctagagtgtgtgtgtgtgtgtgtgtgtttgtgtgtgtgtgtgcatgcgcacacaaaacatgtgtgcccttggagaccagggcttaggttccttctaagctggagctataggcagttgtgagctgtctgacatgggtgctgggaatcagatttggaaagagttctcttaactgtcccctgtattttaacgtcctgaagtacattctttagtagagttttgatcacttactagttaaatggtgccttctttttttatgatcataacacacagtattacttcagctggggatccataattggacagttctgataaggctttattaatattttggtatagtagaggtatgacccagactgggctgttatagcatagattagctattctttttctgtgggttgtcatttctgttgcggtagctcttgtttagttctcttacctacatataggaaaggcctcaagacctgcagctctttacattcctgcatcctttcttctgccttagttttttaaaaaattatgtttacttgtcctgtgtgtatatgtgtgggcaagccatgtgtggaggtcagaggacaatttatgggaatcagttctttctttccaccttatgggttccagggattgaacacaagttattaggcttgatggtaagtgcctttacctgctgaccatctccctcttgtaaataatttttaaaaattgcatgtgtggttatgaaagagaggggagagaagaaagactctgtgtgtgtgtgtgtgtgtgtgtgtgtgtgtattatagcacacatgtggaagtcagaggacagcttgcagaaattggcctcttttttcaccatgtatgttgtgcgcaggatcagactcaggttgtcatgtttggtgctaagcaccttttactaatccgttagtcttctcgttggccctgcctcattcttttttttttttctctcaagacttggtttctctgtgtagtcatggctctcctgcaacttactctgtagactaggctgtgtgtgccaccaaagtgctgggattaaagatgtgcaccaccaccaccctgtacctgactttttttttttaatttaaaagcatctgtacaaaggaagcttttttttttaaagatttatttatttagtttatgtatgtgagtacactgttgctgtcttcagacacaccagaagagggcatcagatctcactacagatggttgtgagccaccatgtggttgctgggaattgaactcacgatctctggaagagcagtgagtgctctgaaccatggagacatctctccagcctgactctttgagacagggtttttctgtgtagctctggctgtcctggaactcaactttgtagaccaggctggccttgaactcagaaatctgcctgcctctgcctcctaagtgctgggaataaaggtgtgcgccaccatgcccagctctgactcattttttttgaacgcactaaagctttattacaaaaggagttaactgctagagatggccctccagtctttctctgtgtcctcttccttcccaagatacacttccaggggaggtcaagggtccattgtagaaggggtgtctaggaaagtgaaatatggtagtattttttccaaagttcctccagatccttctaggtgctgttgaccatcttctggtagaagaggtagggacttcagctcttattttcaagatcctccatagctatggctgactagtcctggttgacttggagggggctttcacttacatggctgctttttctctgactcatttttaatagtagttttgcactttttgtcttgagcttcttctgtctcctggtctacaggatgcaccttattccagaaatgagcaatagcttgtagcccaacaccttagtctgaaattcatgtttgtttttcctgaattaaaagtgttttgttgcctggcagtggcggcacatgcctttattcccagcacttgggaggcagaggcaggtggatttctgagttcgaggccagcctggtctacagagcgagttccaggacagccagggctacacagagaaaccctgtctcgaaaaaccaaaaatgtggaataggagttagaggacacatttgggggacacatttgggatttaattttgactattgctgctattctttttttttaagatttatttattgtaatgtaagaatgtaagtactctgtagttgtcttcagacacaccagaagaggacatcagatctcattacggatggttgtgagcaaccatgtggttgctgggatttgaactgaggacctttggaagagtagtcagtgttcataaccatggagccatctctccagccccatattgctgctattctaatctttggcaaacaataaacactgtcagctttcgtttcctcctctataaaacaggcaaactagtgcctgcctttcttccttgctaggtggctaataaagaatgcaataagatgtttgtaaaacaaaacaaacaccttaatgaagcactacgatacataaattaagctgatgttagcattagtcacactttttacaaactatagtgtagctctttttatctgtaatacataagatagagatccctggtttctttctttttgctgtggaaatgaagtgagtcagtgtaggcagcacacagctgtgttcaggtgctgctgcagtagacatgtcagctgggagtgatccgaagctgttacttggggctcagtctacctcatttggttctttggtcccagtataggtttgcttcctgaatagtaaaacaacaaaagtgcaaagaagaaatttgagtaagaaaggtcttaaaagattccatgacgtctacatactgtgtctgatagataacctacggagcaaatccattttctagtacatttaaccactggtgaaactcttaggaagtatttggtctgatctccactcctaagcaggaaagtgagtctcagaatttaaattactggttgaatagggaaggtcaaactacgatgtttgattctttctttagtagattttccactgctgttctgcttcactaataacaccacagcaccttaaatacccattggacagcagggttcaaagcaggagaaaagagctatgggaacagctgctctgtgtttccattggttgtgtagtctttatttgggtgtgctagtgcacagcctgtgtaattgcagtatttgtgtattttaaattcataccatactgatggtagctattaaggagccctatttatttaccttaagtattttccctgagtttttgatttgaagatatcttccttgctatattgattgtgttacttcctttcatgtttaaagaatatatgtaagttgtttgtgtgtatttttgatttcttgtacttaaggtgtacttactgttcttgagttgtatttctttgtcctaaggtcacaagcgcctagttattatactgggaactgcttgtaatctcagcactttagaggctggggagtcggaaggattttgatttcaaggccagactggtttatatagggagaccttgtctcaaagcagacctcaaaaagataaagccacaagtgcctatacaacataacaccttactgcttttgtaagcatattttaatgttttatgttttttaattaatgtactggctagttttgtgtcaacttgacacagctggagttatcacagagaaaggagcttcagttgaggaaatgcctccatgagatccagctgtaaggctttttctcaattagtgatcaagggggaaggaccccttgtgggtgggaccatctctgggctgaatagtcctggttctataagggagcagcctgagcaagccaggggaagcaagccagtaaagaacatcactccatggcctctgtatcagctcctgcttcctgacctgtttgagttccagtcctgacttccttcagtgatgaacagcagtatggaagtgtaagctgaataaaccctttcttccccaacttgcttcttggtcatgatgtttgtgcaggaatagaaaccctaagacaattaattaattaattttatttactggagctgtcttcagacacaccagaagagggcatcagatcccattacagagccaccgtgtggttgctgggatttgaactcaggaccttagaaagagcagtcagtgctcttaaccactgagccatctctccaacccctgttttatgttttttaattcttttgtaaatgttccttgatctatcttaaaaacattgagataaatttaatttctaaaaaagggcatgacgctgttgccattgtgttttcagtaagcacatactgtctttattgtttaaatttttttttttttttgaggcagggttcctttatataaccctggctgtcctggagttcagtattataattagagtaggttggcctcaagttcatagacatctatctgtacactatgctgtctttttatgttttatgtttattttatttctgagatggggtctcattgtatatatctacctgttctcaaactcctatagaccagactggccttactgagatctactgcctctgccttccaaggacttggattaacatgtgcctgtcctactgtttttttaaaactgtactttaaatgataattattcctgagttttaaaattttctttcttaagaaccttgaaatctttgagagtgaggatatgcatctctaagtacacagatgatcgtcaattataaaatgtgattacttaagcagtctgttagagcagaacacttattcttaccagttttgataactagctattagtgtctcaaattttaactgctttcatctgtttgtgtttattttaagatttgttttaattataatttacttaatataaatattaatttatagttatatgtaatatgtagaattctataattgtaatttaatatatttgggtattttgtctgtatgtttatctgtatattacatgtgtacagtgtccttatactccagaagcaggcattagatccccatggaactgtaattacagatagtagttagtgtcttctgagtgctccaaatggaacctgggttctctgcaagaacaagaagtacatctctcagccgggcgtggtagcacacgcctttaatcccagcactccggaggcagaggcaggtggatttctgagttcgaagccagcctggtctacaaagtgagttccaggaaagctagggctatacagagaaagcctgtctcgaaaaaaaacaaacaaaaaagaagtacatctctccagccctgttttgatttttgaaatttgtttttttgagatactcaggctggcataggactctcatggtcttaaactcatgaaagtcttcttgtttcaatgtaggattacaggcatgagcaccacacctgccttaaccctactggtgacttagatcataatctgttacatatttctttttctttgaaagaatcattagtcaccttgaatgaatcactaatcatttttaagatgtgtatacacaaaataaaggtccttgacaacgttttatcttattgaaggattgttttgctacatggtgttgtgtgagaaaagttttcctggggagctgcaatacatacatctactcaccctagataaggaagcctcaatagactaaagtataggaagttgagcttggtgaagcagtgagttttattggggttacttacaggagcagaaatgtcccaaagacatcactaaaccctgggtgacagagctcacaaagctgggagcctagaagaactaactgcacagcctgcaggctgggcaacaggttggagcatgtcctttccaggtgcctcagttgctccaaaccccttccaggaagttgagctggtatcagagtctttgtagttgagtttgactttgcagctcagcttccttctgtctggggtttttcagcgtttactgtgcactctgtcagagaggggcctagtaaagtgggtcagttgcaggggcttcctcacgtcctttttcctgcttaaggagcttcctacaggatggaatggaggaaactcaatgcaaaaaaacgacagaaaacaattttatgattgatttcttttttttccgcacaagttattagtgttttgttttacgtataatatattgtcttaaccttttttactagatgtaaaacaagataattatattttattgctacatgttactgaatttttacagttctctttctgttttagtgagggaggatcttacgctgtataggccaggctgtccttgagagttgagtgtttctgctgtctcatgctcctgaatgttgggcttacaagaatatggtaccatacatcagcctggcctagagttcgtagggattcacctgcctctgcctaacccttagtcagtccgcatcctcaccagcatgggctgtcactgttttattgaacttggccagcatgctgtgccactaccacaaccaggtctctttcataaacttagttaatcgtgtgtgctcccgtgtttggtagggaagaaaccacatgccatagaggttagaggacacctttatcaattcgtcagtgcagctcatgtcttcaggcctcaagtgcctttcctccccgagttacctcaccagccaattgttttcctttctttaactattaaagtttgagaaatgaattggatggtggtgatgcacgcctttaatcccagcacttggggtttgcagagacaggtggatatctgtgagtttgagggcaacctggactacagagttccaggacagccagggctacacaaaaaaaccttatctcaaacaaacaaaatgttttaaaaaaatacctaattttaataagcctatgacaaaagttcagcacattgtggtaattctttatttttcttactgttttcgttaatgaaacatttcattccttttactatttatatatatacatattttcaaacaagttgttagggagggtagttttgtgtttttgatgtgatgtgtgggttttgggggataaggcctgggatttgagaagtaagggttaaaaacttggtaaatgtttgtattttatgcctgactaccttcaaaagctttaagagcctgcgtttactcccggtctttaaggttgctaggttgtgaactcaagacctcatgcatgctaagtaaacagtgtgccgctgagcccactggaaacattctctcctgtctgccagccaagcatagatgaggctatatggaaagcgcagctccgcttgctttcttactattctccttaggactcaatccatttctctctgggtctttggcagacttggagactttttctaacttccctctcctaaaggctgtggtagggagctttatctctgattattactataaaaacacttagctcacactatagttttctgatcatgtttttcattctagtatgcaggatgtaatgtaatgtcacatacacacactttaaatctcaaagtattaaaaaataacttatgactatgtgatcactctgtcattaagcaaaatcaaggtgacaggctatacacatacaaagcaagagtattgatttagtgacaagtcagtgaagtgtggtgggtcagagcattaggcaaatctgacagtgaaaggagttaccatattttaccgtatttggaagaagtggtacctagttgaatagtaacagaaaatgtgctgtcttgtgggagaagataatagatatgtcaagaactgttttatggggtaaaagagaacacagaaaaggaagtaggatagataggatttattgaagaataagtagggaaactgggcgctggagagatggctcagcagttaagagcactgactgctgttccaaaggtcctgagttcaattcccagcaaccacatggtggctcacaaccatccataatatatgatgcccacttctgatgtgtctgaagacagctacagtggacttatatataataataaatctttcaaaaaaaaagtagagaaagtaaaaaaaaaagtgtgtattatgtcattgacaacctaagcaggaaatgagaaatgcttgagaaaaatgagtcagccactcaaagaacaagatacagtaaaaagtgctataaagggagaaagaaagtctgtctaggatcagtatgactagaggagcacatgaaataaacaaatgcacccttaggcatttgtgacttaaccccaggttacatggactaactgagtctttctcagggaagacttggttttcctatttctccagagctgttaaatctgatgggtctcttctctcctttttaggattgatgtttttcctccagtggttaaggagatttctttttaagctttagggtttgttgttgttgttgttgttttttaatgtgatcacaggacttgcactctagcaatgtgacttctagcttcatgttgacagaattccactcagaccaacagagtttggactcccccagtcctttttaatgggatatttgtcttccattgtggtgagagcagaatcttggtattacgtgaccacacctgttgctttaaactgaaaggcttttgatacacacaataagaaacacataaaatctgaacttgttaaggtttgaggataaattcaagtattctaatgaagtaaattatttgtaacaaaaaagcttttgtatgtagtagttgctctgaattggatatcctcacggggaagaacttcacatgattctcttcagcctttacctttagtatagccagcataaacatacaaatgtggacttagtttgttttttacctacagtgctctattttcttgtttaagagtgtgtgtgtgtgtgtgtgacttaagttttctaggctagcccaaaacttctaatgctcctgcttcagcatcctgggttgatgccatgcttttgttttttaaaattgacaaatactttattttcaatgagctgatacagtgtataacaaaataatgacttcatgtgataattgagacccctacgccaactttatcctgtcctaacaaagtacctgtttcatcttgcaggctgtagaaaatctttgttctcataagatttctgcaaatttgtataagcagctgaggcagatatgtgaagatcacatcaaagcacagattcatcagttcagagaatatccttttcaaaagaaaatgtcacatttatttatgtatgtattttatgtttgttctacttgtatgcctacatgagagaagaaggcatcaggagagaagagggtagtattgtccattgcagatggttgtgagccactacatggttgctagaaatttaaccaaggacctctggaagaacagccagtattcttaactgctcagccatctatctctccagcccctcaaaacaaagtatcttagtttgtctcattacctctcactacttagctcagtttgaaatggaatgcctgtgctggtagatttatttttgtcctgctatctctaaaggaaagaacaaaattttgaaacttttcaatgtgagagtcaaaatctacaagtatggtacttaattaagtaaaaatttcctgtcataaacctgtcctggcaaatttccatttgaaggaaatctcaaatagaaaacataatgctcagttatgtttaagactagttttaaaggtaggttaagggggatcatatttggttctgcagtttaaaaaaaagaattatgtttataatttgtatttaatatcagtatgtgggatattctgtattaaagacaactatgtttttatattacacatatgaaacattttaaaatctccttaacacctgtctcatggattcattggatagtgttctttttctcaaaaagatcgatagatgctggcaaaaccactgtaggcaaatggtaagtcggcagtacttgagttcagaaacattgaggtggtagaatgtttttgatagctttcctggaagaattgggatatagctgagtggtaaagtctggaatttattctttatattaatgcaagtagaaatcttgaaatccactttccaccttctaaataccatgggtacacgtttaaaatagctttaccccctagcactgctgctaaggaagactaagtgtaccttggattccctcttttttttttctgagacaagatcaccttatgtagtacaggctggcctgaaattcaagatctttctgtcttacttagcctcttgagttctgggattataggcatgcaccccatgcctacctccagtttttcttttcagttaagtaacaaagatgtcagaggaccatcttaattctctgttctctagaaacaccacaaggattaatagaatagtttaaagataaatatatgggacatctcagatacatttatttatttgttaagttggatcctagtagtctatttaaaacaccacaaggattaatagaatagtttaaagataaatatatgggacatctcagatacatttatttatttgttaagttggatcctagtagtctatttaatgtaaaatcttccaaattctcattttaagagctaatactgaagattcaaatttacaaaaattgcttgatttttttttccttcttatttgacagataatgatcaggagcatttttttgtttctggatagaacttatgttcttcagaattcaatgctaccctccatttggtaaggatgccagaagattattatgaaaattttgttacataccatagtcttaattattataacaaaagagaacaagctgtattcagaatattctcctaaaaattcccatttggatcctagcattttggggggggttgttttgttttgcctactctaatgtattagcagatagctaacctcatagtgtatgaagacatttcttcattaggtatgaagatcttaaagtttactctagaatttctgtgcctgaatcttagagctgctgctcactaacgttttgctcttttatttttcttgttactttacagtaaaagtcttgtttgttttatgaaagtaagatagcataatgtcttggtccttcagcaggtgcttagcatactttattaatggggaggggaattgagagagtagtagaggcagagagagagaggagagaagtagaggccacacatggagagaggggggaatggggaggaggggaagaggtgaggggacagagtgggagcaagaaggtaagagcaagagcctgattttagagttttgaagccatttatgaatgaccaaataagctgctcaatgccagtatagtggaaagtattttgtctttgaactaattttatttctaatttcactaagaggaaataagacactaaaacctagttatggaagaagccaggaattcagcttcagttctcatttaagacaaaatgggtttcctatatgctttaataatgttattcaaaattaaatgtggatttttttttataattactacttcaaagtctgaggacccagactttgataagtcagcctgtgcacatgtggtattgccaattcagatgatacttttttgtttttaattttagggacatgggattagagttatttagggctcatattataagtgatcaaaaagtacagacaaaaacgattgatggcatccttctcttgattgagagagagcggaatggtgaagcaattgatagaagtttacttcgaagccttttaagtatgctgtctgatttgcaagtaagttgtacttaacactcactgtgctacctacaaatctgattactgttcatagtttgtctgcaatccatggagtgttgttcaaatggagttctgatggaagtcattcagtaaatacttaatgattaagcaaatacttttgttttcccttttttctagatttaccaagattcttttgaacagcaatttttgcaagaaactaatcggctttacgcagccgaaggtcagaagttaatgcaagaaagagaggtattttaaaatgtttaatgactccagtgtctcttacaatagccatttccttgtagaacacaaacttccctttgtatttctgttcccgacatggccatgctcttctctcacttaggtgctcctttctctcctctctccttaaaggccacaatgctggatcataaactctacctctaactttacatatgcttctccctgtcacatttgacggggctcttacctggatcttttggacttgacattttctgaatgatttaaggggaggaaaacaataatataaaaaactatctttgtaggttcctgagtatcttcatcatgttaataaacgcctagaagaagaagctgacagacttattacttacttagatcagaccacccagtaagtattacatgctcagcctaatagtcttaaaactgttgataaaacactttaggcatcttaaacttgtagtaattttcacgtgtgatttagtctttagcagttgtttttataatgtgagcttaaagttattatcttccctggctaattagattgaatcaaggatttgattattggtttggtgtatgtttagtgtgtaattttaaaataatactagaggttgatgggatcttgaaaacttggtgtttttgagtcagagtttcactaaaacccaacttgccctggaactcgtggtcttccatgccaggctcccaaattctgggattataggcatgcatcaccatgcccggcttgtaaaatccttagactgattaaaattcagggagtgggtgttcagagagaaactgcttctgtactttgtaaatctcagcaaccaagtggtttcattaagcagcgtagatagctgtttcaccttcttagtaaaaagcaagaaaacttggaaaaagtactagccttagcaagaccatggagatcattacattgagcaaattctgaaatacattatttttcttcctttaggcgtaatgtaaaatatttttgacacatggtttagaaatggcaaaattaatgcaaaatgactttttagctttgttctttctagaagctttaaattttcaaggtcaaatctcaattctgtttttccccctttcaggaagtcactaattgcttctgttgaaaaacaacttctaggtgaacacttaacggcaattcttcaaaaaggtaacttgtaatttgtaaataagaggttactagggctggagaaatggctcagtagttaagggtacttgttgcttttgcagagggctcaagtttaattcccagcacccacatgacggtggctcacaaccattagcaattgtagtttcgggggtgggagggtgtaatactcttcttccatcctctatgtacaccaggcatacacacacacagtgcacatacatacaggaaaaacactaatgcatgctgctgctgctgctgctgttttattcttaacatgtggagccaagaacttctaaacattagtgatattacagcataatctgaatttttactcacgtaaattctcgttatacttcagaccagtatcacgatagaaatttcaacttaacattttattgaaatgcatggcaattttatttactttgtgattctcatattttaataccaaaatatttcaaaccaggtttaaatagcctccttgatgaaaaccgaattcaagatttgtctctcctgtatcagctcttcagtagagttcggggtggagttcaggttctcttacagcagtggattgagtatatcaaggtaggaacagtttgcttgttgacatttttcctcactgtttcctaatctatgtaccaagagggtcacaaagcatttcttgttagatgggaagtttttttaaaagtgaaaaaaattgggctggcgagatggctcagagtgtaagagcactgactgctcttccaaaggtcctgagttcaaatcccagcaaccacatggtggctcacaaccatctgaatgagatctgactccctcttctggtgtgtctgacgacagctacagtgtacttacatataataataaataaatcttttttttaaaaagtgaaaaaaattaaaacgtcatcctgagaatggcggctgtgtggcatatcagcaataaaacttaagtaatattttatgggatttctagctcttaagatttaagccaggaatatgggaaattgttggagttctgaagccatttggttaaaataagtgtaggatctgttcttacaagtttgaaccataaatccttccttctcctccttccctctatctccctccctgaccatattgcttttttgttttgttttgtttttttcgagacagggtttctctgtatagccctggctgtcctggaactcactctgtagatcaggctggcctcgaactcagaaatccacctgcctctgcctcccaagtgctgggattaaaggcgtgcgccaccactgcctggccacattgctatttttaaaagtacagatccgactttcttaacaatgaaagaaaagttcctatagtcttaataggttatcgtgtatccggtgataacttgttatttttgtttataagtgagtattatctgtttcggtttttcatttccttcagagacaactgtaccttttatgattattaagtacatgtgccaacttagaatatgacttggtgaatattttccctgtggataaatcaattactataaaattacaccattttcattttcaggcttttggaagtaccattgttattaatcctgaaaaagataaaactatggttcaagaattattggactttaaagataaagttgaccatataattgatacctgctttctgaaaaatgaaaaatttatcaatgccatgaaagaagcttttgaaacattcattaataaaagaccaaataagccagctgaactgataggtatgtttcacattctcttctgggtgtgtaatgttcttttattgataaactctgaggtaatatcatattgtacccattcctggtttgtttgatgttgtttagccagtaatactaagtctgagaagagacactaaggatctggatgtgagaaagagtctgtcaagctgaacagcgtctcatagtctttatatcaagcatgatataaactctatgtgaggtagaacattgggccccatttacttgtagtgaggaagcttgactctgtgctttccaagcttgttgtgatttagacatgggacagcgtgctgttgtctgaaagtttccagttacagctacagggaaagggcagcatgaaattccaatgcaaatgaataaaaagtctacgatgaaaataaatctaatgagacaggctcactgagtatacaggtgtgttgcagtgtttctcaagcaaggttctcacacatgcactcatgatgctagtatatgtgccctagaaaactaggtcatctgaaaggatggagttggatttggttaaagtctaattatatttaaatttaaacattttataaattgtgccttcgatgtttctgatttagtcaaatacaaaagtaatgtttaagaacactgaccatttgtgtaaaatagaaactttagagagtacctgtgttttctggtgactttgtttacacagggctacttggagcccccactatgcgctgtctctatctcattttaagttttttctttttctctcttttttttttaactctgaaagtgagggtttgaacccagagacctgcacatggtaggcagaaactctactacggtgctctatatatagtccttccatatcatactggaaagtatactcagtctggattccaattcggtgcatttacttgtagtatttgttagccctgtgacagtgacacggtgacttgatcttcctttcgttggaggccataaaatgcatgtacatatagcacaaatactgaaagagttagtattttatagtcctattggggtatgtgtagtagtcagtacctttcagacacccgtggtcactaaactatagtttttctccattttagctaagtatgtggattcaaaacttcgtgcaggcaacaaagaagctacagatgaagagcttgagaaaatgttggataaaataatgattatatttagatttatctatggtaagtgttgattactgctttcacatttttcttttaaaataaagcacttagggagccaggcatagtgatagagacctgtaatccagaattcaggaggctgaggcaatattgctgtgtaggtcacatagtatgagcccagccagggcaatatagcaaggccctgtctcaaaacaaacagaaaacaaaacaaagaaagcactcctttaggaactaaaaacttttatataacccagagagactttgagaactacagggtctattttatttattgcatattttagatcattaagaacagttgaggaatgcaactaaattgccttgtattttgacctttccactattaagaacctgggattttactgcttgtttaatctctttgagttttggtgctaatagaaccaatgtattaggttttttcccctgaaaaatagttaatacagtcttaatttgttttatagtaaaagaacttttgaaatgtctggcacagacatggacctccagtgttcttgggtttaataaacttggataaaatgtataaaattaaataacttgtcgtgttgtaataaactttttaaagccattttcttacagctttacttggcatatcatgagtgttatcttttttatttaatacaggtaaagatgtttttgaggccttctataagaaagatttagccaaacgcctattagttggcaagagtgcatcagtagatgctgaaaaatcaatgctgtccaaactgaaacacggtatgtttgccattctttttttttaatatcagggttttttaaaaaatatttgtcggaaattatggcttaattatactcttttcgtcgattgctgctttggttgatcattttatatacacatgaaaacataaatt

SEQ ID NO: 786 - DNA, 4704 bp, mus musculus
tggtggtttggacttgagaacatttttttctaagagaaatgtgtattttgtttttatttttgaagatagatttgatatgcagcacaagttagctttgaactcatggtgattgtcctagttcaacttcccaagtactgggattccaggtgagcaccacttctgattcccaagcacacttaaacacacatgcatgcatatttggaaaagattttaagattttaatatatccaacttaaaaatacttgcataaacatatttggaggaagagtcttgaattcttcgtgatatgcttgtatagctctcatatggatcgcaggcatgagctagcatgcctggctgggacttttagtttagttttgaatcagggcctcttttacatagttctggttgtcctggaactcatataggaaccaggcttacctcacaggtttcctcctgcccctgcctcacaactgctgggattaaaagctaaggatgcatttttaaataaatctaacttggaaaggctgtatagcccctaccttaactattctagttcccataattatagggctcagtagaaaaaaaggcagcagatattaataatgaatgtaataggtcaaataaatgcatttagagacactgtaatgtagattcaaacaataaggaacaagtgaaacctatataaataactagccgggcggtggtggtgcaggcctttaatcccagcacttgggaggcagaggcaggtggatttctgagttcgaggcctgcctggtctacagagtgagttctagggcagccagggctacacagagaaaccctgttttgaaaaacaaacaaacaaacaaaacaacaacaacaacaaaaaacaacaaaaaaaggaaataactacaggagtgaaaaatagtatatcttactcaactctttcaaaggaaggcccaaggagctgtaagtagtggtatatacctatattcccacaacctgggaagctgaaataggcaagtgccatgagttcaaggccagtacatgagactttatctcaaaaacaaacaaacaaacaaacaaatcagaaatagaagaactagtaacaaactgagacagcttcaaatcaaaatagtcttcatgtatagcacaactaatgttggattttttattcttttgagttagggtttcactatatacccctggcgagcatagaagttgctgtgtagaccaggctggtctcaaacttgaagatcttcttgcttctgcctcctaagcactggaagtaaaggtgtgcatcaccacatttggctatgctgatctttaagccatgatcacgtgattcctataatctgctttgtctaaggattgctagggaggaaacccactccctctttttttctcctatttgtttttgaaacacggtctcatgtatcccaggctggcctggaacccatttaatcttcctgcctctacttcctaactgctggattataagtgtgagccaccaggtttgccccccaatctcctttcaggatccagactggttttgagtttccaatcctgacccagccttccaggtactgctattacagaagtacaccactgcacctctgctccttatagtttaaaggatataattatatcatggataggactaagtattctgtatcatttcaattttgcagcaatatttcatctatattatctattaaataggtttttgtcaacacagacaggagtccgtcttctgcttgtcatagacagagcagtcatttgcctcaggttgagaaaaggaatagtgattagtgggaacaagggactcactatggggttaaaaagatctagtattttggactgtgttcaaagatatgtcttacctggatgtggtggtttgtgcctgtaatcccagcacttgaaaggctgagacaggaagactgctgttagtttgaggccagcctgagttatgtagtcaacaacaaaaatatcagggtatagtggcagatacatacttttagtcctagcactcaggaggatctttgtggatggtacctagtgtgacactaccaaaaaaaaaaaaaagagaaggcctattctgcaccttgtgctcaaaatgcctccttttgtggtatttatagcttaaggatagaataagttgtgtatgttagatacacgttgtattgaaatagatgctagtcatatactaggtgctcaaatatttttgctaaaaaaggattctgtgaggacaaggttatcttttatgtttatagatttaaacagtggtatgtttttagttctggagtttccttgactggaagatcttcctagtattaaactttaccatcaccccctaaccccctctgaagatgcagttttaactctaaccctaaccctcatttgaaataacagatttagaggcattattaaaaaattatagagacattgtgtgtatatttgaacttataaaaacaaaacattatagcacgaaacatagacgttttaaatgatgctcactgttttatttgtataaaggttgaaaccaaaccttaggggctcttcaaaacagaatggaaattttatttttttcagacaatgtcttgctatataacatagagctggccttaaactagctatgtagcccaggctttcctggaaatttatggtttttccaactttctgagtgtggcaattatcagcttgtaccttgcccagctgggaatctaattatcttatgtgttatttattataaagccaccatttggtgtggaaattaccaaaacagttgctatatatttcagattttagaatttgtccacaataagttttatcttctttttgcctgattcctggtttggtacatatggaggtgcagtactgatatttggcttgaacctaaagggactgattcatttaggacttattggatatttacattgtacccatagactcataggttcctgctcctaaggagtcagtggcctaggagaggaccacagattggttcaaatggcaaaaggatcattgtttctcacacttcccttccccaaattgagaaatagttttcttagcttgttttcaggcaatcatggcagaaggaaaacaacatgctttatgtgtgggtgtcatgaagatgtctgcagaagatatgtaagtttcactttaggctcctttactgacatatgaatggttcatatgtatctgttcaggaagattctgttgcaggtggagtttgatgtcattcatactacatcttacaaaaacctaagccaatagctcatttcttctttttttttctagcacttacgaagtcctttgtcttcaaagttacattcttaagcattttgaaaggaaacatactaaaacaagtattttataactatctgatattttaggattttctctttagtatttagatttaaattggtaatagagggctgtgtattttactgctagggtttttttttggggggggttggtttggtttattatttattttttggttttttcgagacagggtttctctgtgtagccctggctgtcctggaactcactctgtagaccaggctggcctcgaactcagaaatctgcctgcctctgcctcccgagtgctgggattaaaggcatgcgccaccactgcccggcttactgctagtttttaaaacacactagggtatgctggtatagcagcacatgactataatcctagcacttgggaggtggaggcagggagattgtgagttggaggttgcctgagactgtttcaaaaataaataatgatatagttcaggaccgtatactatttcacattctgatctggtgatagaagaaatgtagcatgtttccaacatatataaccaaaattttattttgtttcaagatttactatgttaatatttgcctaacctgttggcattattctgtttgcttgctagactgctaaaattggtattttaatttaatttggtttgtttggcttttcaaaatgggtttctttgtgtaaccttggctatcatggagctagttcaatagagcaggctggtcctgaactcagagacctgcctgcttctgctttccaagtgctggaattaaaagaatttgctatcatcgcctggctagtttttgggtttttgagatagggtctcttgtagcccaggttgaccttgaattcctgatctgtctccagtgttgggattatagatgtgtgctgcacaccagctttagaatcactgtaacatgaatttcagaggtggttatgtggcttagtagtgaagggcttgtgtagcatgtgtgaggccctgggtttgactctgtagcaccagaagaaacaaatagccactaaaaggtatcagatcaagcaaacttacaaatcccacaaactgccacagagtctgtagtttaggcaataacataatgacagtaaatttcctacatgttactcaatgattatgaagtatcaagatactttcaattgtgtttatcatgaatgcataaaaattcataaagcatgtttctgtgtttttttttccttctgcagtgagaaagtaaacaaaggaattggcattgaaaatatccattatctaaatgatggtctgtggcatatgaagacatataaatgagcctcaaaaggaatgtgcatgggctaactatggatactgtgctgtatctgtgtctgtgtctgtgtgacagcatgaagacaaagcctctatgattatgctgaataaaaattccgcggatgcttaa

SEQ ID NO: 787 - DNA, 212073 bp, mus musculus
ctattattattttgacgactcccgagttgcgcccatgctcttgtcagcttcgttttaggcgtagcacagccaggcagaagaaaatggggcaaagcgtgctccgggcggtcttctttttagtcctggggcttttgggtcattctcacggaggattccccaacaccatcagcataggtaagctccccagagccagccagagggggccaggctcttctgcatttgaaacccactaccctagtggggctgggggtatcgcaacatgagtccctgtcctgcatggtttggggacggtgtctagggatgggggactgagctgagatattggagacctgagctgcaaagaactgacgagtatggggagcatccaagatgagggaaggggtctcccggggctaatgcgggtggacggccaggttttctgaccgaggagcaagggagtcaagctggaggttgggatgctgcaagaggctaagagtcgcggcttttcagctcgctattctggactttgccagggcatgcttgcagccactggaagttgtcccagggtgatactgcctgtctggccgcgccaggacgcataacctgggcccaggtcgccccgtcccgcgtctcaggcttcagtgagacaggacagtgttagaagaaaaggaacccactttgaaacccccagaccaaggaagtagctgtgtggatggaggatggggtgggaagtgggggtgatacaaggagtcgggcaagcagggaagtcacgcagaccaagcattcatgaattgcggctgtgtctgtctggagaccagctccagtagccggaagggagttctccccgcctctgcctgtatttgcaagtagagaagttagaattgttgcttttactgaactgaccccctgtattgtcataggggatgattgggacagcaaggggaacgaaattgtttttcttcccaccctatcccctgtaccccaggagggaaaatgaaccagctgtgtggctaagggtgggggtggggttggagtcagggttcggggccagactcaagcttaagaaagaaccaagtcccacttttagctccttcatccttcccctacagcagcctcctctttctcccgtctttttagtttcctccgtgtacaaaacccaggtttttcacagtggaaagcagagtttccaagtcttgaaagacacacaggttgaaaaaaatcattcctcagttgagcttcccagaaacactgaggtagcctggtagctcctgtttgttactttctaactcctgctgaagtaggggggacacaagccgaatctccattgcctttgcttctaggtggacttttcatgagaaacacggtacaggagcacagtgctttccgctttgctgtgcagttatacaacaccaaccagaacaccactgagaagcccttccatttgaactaccacgtagaccacttggattcctccaatagtttttctgtgactaatgcttgtaagtagatctgcgttggctccctttgggaccttaggggacctcatttgcattttgtttgtgatgtatggggctttgcaaacgtgtgtgctgggggtgggggtgggtagtgattgcctcaataagcagactgaggcagttgtcaatcctgggttcatgttgcataaatcaaccttgaaggattctgctgcggggctgaaagcagtgggcaaaaactctgaggtgaattatgtttgatgcaaaacttccactttcctccctgctaaactggtggtgttctctcccccgcacccttttctgttgggggaaaagaaagaaagaaagaaaatagcatggttgttcagggaaatttcagatggaatttttaaaaaagaagcaacagcagctccttgattgagagaatgcggggcatgcaatacttgagtggtgaagctgtgtctgctggtcggaatgggctgagtttaatgatggcctgacacataggaacaaaatatgagaaccctgcaaacaagtgaccttgaagcatagatcaggctggattccctggcttctttctttctgtgctacccagagtgctctgataggaactgataagactacaaactgattgcaagtgataaatgcatgtcagcctaaaagcaagagggaagaccgtgcccaggtgactttttggaaagccaatcctgcctgtgctatcgtgcctgcgcacgcgtgcacgaacacacacacacacagccacacactcacacacacacacatgattgttaaggacaacacagttcttaatttagagcaagaggttggttgtgggaagaagcttgaagcaggaaaactgaatacttaaaaaggggagtttcatcagccccaaagccatttctggaatccacctttatacccatggttatctcttttcaaagggggaattttaacagtaaaaccacaggaactcaaatggttaataacttgttggacacaggtttttgttttgttgtgtttaacttgagagaacattttgtgagaaacactgaattcttcatcagagctttgtttcactaaaagtttctcccaaatgaagccacttaacacaaagtatgtcttgtttctctggaatggtgtgctttgaaatctgaagtttcaccacattttgggaaatggtatttatgtctgttggaatttaactttgtatatgactttcttcaaatccttccatctccaaaaatgtgcaatccctaacagtccttaaacaggacctcaagagcaaatttcattggatttaaagtcttggcttgaagagaagggggagtggaagaagtacttttcaaaaaatgtaacagttatccgcctgcagaaaaatttagctgaaggtgcagattcttttaagaacatgttctgagacactctgtatttgacattctttagttttccaacactgacaaaaaaaaagtgtgaaagttacaaaatgtctggctatacttcctgtcttccttttgtaatccccgacctctctccagcatttacaaggcacatctgattcttaatcctgctgcactgcgatctcctcaagaggctgaatctgaaaggcagtttcctaaatatcaattagaacagatttaaaaccaaatacatgaaaccaacggggtgcattatcattaacaagggataatacatatttcatctcccttccctgtctttccactgatgaactctgggctaagagggtcatttggtttctcaggaatgattgatttccaaagctttgggttttgttcttctgatcaaactgctctgacactcagcagcctgcctccagctagcagaacctgaacaacagtcaggaaatgatctctgtcatgagaaaaaatctcaggtttaggaacaggtaataaaccatccatattggacagtaagtggccagtgaggggactgggaaaccaactgatcagaatctctcaacttaaacccatagcactcttacttacaaagctgggttatagttgcacacttaacaatgtaagagaaggggttagattcactaagcagcaagaaaaacaagaccaaaaggaaacctcctccttagttatgtcaaatacacacaggcatacacacttccagggcacacgtgggagaacaatctagaaatcagtgatgtatgcctagctgcctgttgcacactcagacttgacagttagctcagaagacagcagagagaagctgccatcttctctggtccctggaacagtcatgtctgaaagtcacaattgtctgaatgggagtagatctcaaagctgtctcctggcagctgctgcttggtggcttagtgtgagaaagatacttagtccaactgtagcctctgaaaacaacaattcaagtgggcagagaaatgttggcgatgtctgttccatcctccctgcccccatggcctttattgtttttgtggaagtatgagtcaaacctgtcagatacaagcaaacaattttaacagtacttgaaccaagcaaatgactacagatgccagtccaccaagtgattattaccaatgccacagaggaaacaaataatatcaatgccctctagccttcctatctggggaactctggtgaaaacctcagacgagtccaaatctggttatgtagccctcctatctagttcagtgtggaactggactagcaacaatgaaataagcttccttgtcatgcagagttcccagtttcagctttctttggggctgaagctgatctcctctctggatctccgaccctggggcaagcatatactttctagggcataggtatgcaggaaaacggaaatgtgaggagtaatgccttctgtccccgcccctgccctctgcttcacctctgcactgtcacctttctccatgcaaagtattcagaagtcgttctcacaatgaatcctaggcaccagttatttaaagactttactagcaagcaagcaagctttttcttttcttttcttttctttttctgcacaagcctcaagaggtttgcttaagacagactctaacttcattctgtgccttaagaggccaataaaagcctccctggctttgaaaggtggttcagttgggatcttagctcagaagagaatggaagtttcgcagaaagactcacctgatttagagcacatgttcccatttcataggaattaatagagtccactgccttacttttaagtttagccgggtaaaggcagagagaatgacgttgtaactaaaacggtttcagcattcatgcctccgtaaacatagaaaggcacacacatgattagtgcataagagaaacaatgcacgcccattttgtaagttacagatctagcatttaggggaggagaaaaaaagaaccaaaccaatgtgataattctctggcttacaagggtagggaaatatcaggagattgctcagtcccgtggtttgactttgctgtcccgtttcctcgggaagccccgttgattcccttgaagtcccctcctgtgtcatgccgctgtgcacttgtagtgcactccacactacaccgccccagcctctgcagtgtcagctcattagcacacagatctcatattccctctccgcactgtcattgcaaaaattgctgttgtacacctttacagccaacaaatgtgctcgtggattacgtactgaagcaggggaaaggcaaatgcaacctaaaaggttattcactgcagaattgtcctctaaatgcattggcttaaataaaaatctgttgatggaagaagctcagtgtggatgctgagactgacagtggatgggggactacttacaggagtaccaactctgatggagccctgggcaaaattccttttgtcagctaaacctaacctatcaacagcaaggttttcttctactaatgtttacaagtgacttgaaatctacctgcaaactgagaacttcccccttttataactgagcctgttttgctaccaagtgtacttagctgagacaggcttctatctcctacccacagagtcacaatctaattatctaattactctaattgccaggaaggagccacttaaccatttaggtccatttggaaaagaaatgtctctcttgatcacaagctctgcaataccatgggctttgttttggctttgtttgactgtttgccttcctcatataagcttagaaacgaagatgaataccctgagattaaggctcttgtcctgctataggttgtcaagtcctaaccattatccgctctgaccccacctcccccatgactgaaggatatttgcacttttgctgccctgcctcctctaccctgtctcctgactagtcctcaagaagctcactggcttagttttttggtccttttggccagctggcttagcctactgaagcacgaaggggacacctcagtggtgccagtcaaagatttaagtcaccttctcacaaggtttatcatcattttttttccttaatctatgctttgtaatggaagagggaggatggcgaggctgttcattttggccataaaaatagatggcaatcagcaggctgtaaaggtgagcttcctgcaaagtgtattaccactcatacaagacagcttcctattgatcttataagtgaaggcaatggagaaaggagggtttgcagaaaaataaaagaggaaagagaattactccgttattctatctgtgtttactgaaaagtggggccgttgtttttctctctctctacaatttaaacttgtttttcttctaaataaaactagtgttccatatgccccatcttctacctcaatagagattgttttcttaattgtatgtttccctccatggtccctcaaattgaatgagtagtgggagatgctttaatggttttggtccctgagatatctgtaacttccacggctacggggattcagagatgattggctgcttctgttttgacagcttgagaaaataaatgaaggtgttgaggtgttgttgtttgtcttcctttctgcataggagatttgtcatttttatacaattgatttaaggattaaaagacaacaaatattttttaagagatgaccagaaatttaggagctagaattcattactttggaacaggagaataaaagtccttatccaaatgatttgcctttggatttcttagatgggggaccactgatacattttaaaagaacttttgtaaaactttgtatctcctataaagatcaagaaaatcatattaaaccaaattttgactcgattcctttgcatgttggtagtttaggcctaattagaagggatgtccaggagacctcaccattaaagcaaccaatggaggcaatagttatgctttgaaaaggaaaggaggtgtccatgcacaaaagcagctccctccctctgaaagctgctcaggggccatccaagccccagacacagagttttaaatatgctcagcctaaagtctagaatcaacacaaagttagggatactgtctccccaaggagttaatgcttagcaaactgataatgtgggcaaaatttgtatttttcatatttctactctttttatcattatgatttcctttcttactctggctgtccagctcatgccgttgcctggtctccaaatgcctactcattggcccatccacactaactttacatagggactatttcctacactgagagtcttggtctttcttttttcttattagactgtccttgctcttagttaatgctccttaaggactatacactactttggggataccagcttttccctgaacacaacaatataacctaaagtggtagaagagaggattgaaatgcataacaggagattattaactttaaaacctgggagtataagaggcatcatgtctcaatttcaaaggaagatactcaaatgggggggtggttcttaggatataatattcatattggctttttacccaaatcaaagtcagcaggctttggatatggaagtgttttttcagggaaaaggtagctattcatagtaggatgggtatgagtacagctaaaccacaggctcagtttcaagtgaaaaacttgaaagtctttgggacaattttgggaatcggcccaaatacatagggtttcattttattgaagtagctgttgtaagagctgtaactatatgtgggcagtggcaggagatacattgtaccaaacgaaagtcattcaggagaggagaggagggtggtagggaagctgagtctcatgcagaaggtttctatcctttggaatggcatgtggaattgcatgccagtggtggtaacactggatgcactcagtacctagccaagaagcagctccctctcatttcctctagctttctcttaccttggctcagtcatatattgtggtccctctgcctatggaaggatccatcctactctcttctggactcacactacacatgagtgagggaaatgaatggtggccctcctccctgtttcccaattgtcacttgctttttaagcattgaccctcaatgcaacactgttttagcttgtttgcaaaagtcaaaggaccatagataagacgggaaacagtgctggtgatggtctcttaccatatgctgcacaattcaatacaaaatagcatttatcaacctttcatgcatgcaccatatgcatgaaaggcatgattaggatttaaaagtttactatgagcccaagacttttcatttctagcaagttcctggtccttaaatcacattttgaacaacaacaaccaaaaggccaaagttaagagactgtatttaccaaagtaaaggttctttgggtcacacttttatcattaagatttgtctaatgaaacaaagttctgcacaagatacatttgctttattctgagtctcatattcccaacaatctcatgtccatttcatccaggtaggtgtcattattagatgcccactgaaaacatttgcttaaagttggttcttgtaagagtgtggaatggtgagctacagggcaggctgagagagaatgtagcccatgagtcagaatgacagtgtcttggctccttgccacgtcccaaagtgccctgtttagaaactatatatgcaagagatctaaggttgctttgtagttccaactctttttccactttgcttctctgggtcaagacatgccagaggaggcatgtaacaactgcttttcagctgcccagcttctcttaaacagggttggaaacaagaagcacaacagaattctttcttttttcaagaagagactgaaaaatcaactcaattttcaggtactcagagtgaaggaagaagtgtagtgttgcttctgaacatatcttagctaaggactgatccaaggaagacattaaaagaattgccaatgacatttgaagactgaatctgatgcaatcccaccccacccccacccccaaatactgtcactctaatggtctgcctttagtctttactttaacaaatttacttatgtgcattattgcattagaagcatatgctaaaatctgagtatgtaatctggaagtgaatgagctaaatactttttactcacatttaaacagaattatttattccggctaacacctattacctttcagagtcctcagaaggagatatccagaacaggtaagtaacgtagaataagacagctacctgccaaagaaagttgagcaaaaaaaatggatggtggaaattaagaaggttgttgatagaaaaaaatggtcaagaaaatacacactatctctttcttcacattggttctcagttgtaaactttgcgcctttattcactatgctcttatctctgtttgactatttcaatggcatttgacccatgaagttgctctcttctgatgcagtgagcctgctgcctgctttctgcatgactgttcgttgccatggataatggtgaagttgggattttctgtagttaatgtgggaaacttgcagaagtaaaatcagtttgtaagcaaaggcagtgagcaatttttttaagttttaaaaattgttatgataaacctccttcccccttcagttatccatggttggctgattggttaccaataaaacaggtagagatcagcactcaacccacagaaaggtaagtatatggacaaaggtgttaatatggtgttctctgcatgggtgaattgtaaatttaagacagaactgggatcggacatttgcaggcagacagaacctgttatagaaccttgaatatcctttaatttcactgcaatctccaaagatgctcgttgattagtttaagtcttggattggaccatttacatcaaaatcaccaaagattttgctttaaatatgaattcctagtttataccccaaatgtatgaatcagaaaatacatgctttaggcctatctagcaagttttgtgggtgataataataacataaatctaatttgagattcatgtcgttaataaatcctgatgctataatgtgagatatgcagattcagactgcaaactattgaatacccactaagcagcaagtatcgtgcctctatgcattttcatacatgttgcctttttgggtaattgaactacaattgatccatgtaagcagtaacaaatttggctgccaacctgaaaatttaggctaggacttgagaaaactaagcctcatagtctctgggacaaataaagtaacaactctgagatggcaaatagaaacagggacatggttttcatttttactgtgtatcttcctatcttggcttgttagccaatgatggttctttaaatatgctatgaactagatatgctatgaactagatgtcatggtaaatgtcagttcatttattaaaatggatgcattgcaacgatttactgtagcattcattgtggtcttcctccccatgattgttataaacaaatttaaaacaaaagctgatataataactaccactccactgtaccacatggaaaacattgtccaaggaattttatatgttatttcccaaggaatcattacatttccagaagtgaggcactttcaccccaaatttatacaaaatagaaatcataagtggttcaaaattcataagcagctagctcaaggttacacagctggctctgtggtggcgccaagagaatttcctgcctctagagtcttactcaatttcaaacggagctgaaatcttaaatgattataagagctagacacatcacatatgtggtgcatgaggcaggtatgtttaataaggaagagtgaagtgtttgacaatctctatgttccaaagccctcaacatatacaagtcctatttttaacccaccatgaaagaaacaggataccttcagtagtccctaagatggctgaatatggaaagtgcatgtctctgacatctataccacaatatatggtatactctatttagcagctaattattggtttggagaaaactgttaactggtcattataactagtgagaaaaaaaaagagagaaaagagcaaagctttattggggggggagggaggaaagacaaaatccatttgtcttcttaacaaaacattaagatgtaccagcctaatagaactctctatctcttatgcacatatcacatatgtaatcttacatacacaacactttatacagttgttttacttatgtaaatgtcacctcgactctaactttccatcagacaacggtgaggtgtatagcaaggatagaatgctaacatggggtcattaatatatatttggcagatcaaaagaggtcttctcagggggcttgctttggagaaattacttaggttctcatatatactccccacaaattggagacactatataagttaagaatctctgaagaatcacctagggtaagatctcctatattttaagagacaggcttagatctttaagccaatgtccaaaagaaacttgtatttttatttgcttgatgttgcagacagacataagcttgatgttacatgccatcgtgaggcactacttgtagcttatcaatagcttgccatagtaagagtgagagcagcatgtcttctcatcataacaccccatttccagaaataagagcacaacacaaataaaatcttgattctcattaaaatagtaagcaaggaaacaatttggtatcctattttcagactcagtcacattctgtcccctgtcactttaagtgttctaacagtaagtagtctgtttcttagttcccttgaggcagagaagacagcatcttgtggcagaattttgctaaccaagaatccttatcagtcagtagcttcaatctcttaggttgaaagtaaaaatcattgacatgtgtagccagtccataaatattggacactacctattcacaaataagaaatttatttaatgaataagtttttatgttaattggagataaatgtctgaagtgcctatagaacctgttcgtgattaaaattttatgaatgctagataactactccaggatgatatgtttctcagtaaaggcatgcctagaatgtcaattaagaccaaccccctacatacatcatcatacaatttactttgaagtcataaagtaagttacagaaaagtgagcagtttagatcccatgtttctatggctttgggaaacaataaaagggaaacagagatttatgagagtgagtaatagaccaggagttaagacaggtacccagttaaagtcccagatctgacatcaactgcctctatcactatagaccggcctctatatctctgcttctagtttctatcatttttaaaatagagaggtctttctggatgctatctgagactttgatcattgagaacctatcactaggtcttactagcttactttatttctagttgaggaaatactatgcaaatggaatccccccaactctttctgtatctagaaagttctattcctgtttattgttctagctcacactgataagtcctgggatcaaactattaaatcataaatctgatggatagtgtttctacctagtcatcacttacccttcccaatcccaacctctttcacttattatgcaacgctgagcaagttacttgatttcatcctgcctcatagtccccaataatgataacccttattgggtggctgagagtttgaaatgaaatcacaaattcatataaaacattcacaatagtgtccagtacctactgcttatcattattgatatcatcattaatttaaaatattttgagctttttgtcctaaaaacagaaacctagtttcctttgaaaattgaaatcacttgtcacttcagaaaccagatttccttcctgaacagctgttcactgagcctttacagttctaagttcttcttcaaactacagatcattttttttctgccaagaaacccatcacaacaccccctcatatttccagcccaccaacctaacctcagacatctctcacccatgcatccaactttgcacatcccctttaactcttggcagcaataactactcaggtacctccatcaagaaactctgtgagttgcatatctctgcatgacctaaggcaaaatttcaaaggaagacctatggtttcccctcccaaagaaactatatattttttcttattcaatatactattaatctcaaactgactcatcttcacagtgtgtgtgtgtgagagagagagagagagagagagagacagagacagagacagagacagagacagagacagagacagagacagagacagaaagaggttactcagtttatgtgcaactccaccaacttcccaaaggcccaggatgcatccatttctcctatgaaaatgattgaaaagaaaacacactggccaagtactcagtgggcttgctctgcagccaggaactaggacttctctagaaatgggtctgcccactgagtaatatcagaaaaagcagcaaaaataaattgtttaggggtctgctagctagttcattcctatggacaatgcattagtgaatgggctttttggtttttttttttttgtttttttgttttttttttttgtttttttttttgttgttgttgttgttgttgttgttgttttcctgagcccgaggaactgagaaaaaaaatgctccatgcattttcctccctggtaggcactgctgtgcacacaagcatttctcatacatcttctctcagccctttccacctcttggtatcactaagcccttgataattctcttaatgcttctccctaaagatggtgaaagccagatacaaccccacttctggtatatttatgagtctaggcaactgctccagtatacaagagttcaagtctactttctgtaattctggatgtcctttggcctcctggtttctgccagaatcaacccactgtccttgattcttccttctacagcctatagacatataggaacacaaggacataaaaaaaccaatgaggaaaacaaagcaacacttccccctggctaaaagtgccatggaactgcccaggtttttatgtcattcattactggttcttgtgtcttctcccttacattttctgtggcaaaagattgttgtttacaaattccttagtagaaagctatttctcctattccatttgggaacacttaacagacaaattgtagctctaaaatggactacaagaatttgaatctcgactctcttattagcagtggcctgaccttgataaatgacttaacacctctgcgaaataaagacgaataaaagaataaatatgctacacagatgctgtgaatattaaataggaagatcatttatgcaaaacatttaccatgatgtgtggcacatagtaagagccaagtgtaatggtagctactattaatactgaatggtgaggtgcttaaaaatacagatctcaaattttaactgatcaagggatgcttttccggtttccaagccctagaaagcaactcaggttccctgtgattgtatagcctagaacaagatggatgggacaatctttgaatactgagaaggctattgagtataagagactaggtttggtggtaaaatatgtagagggagaatttctgtgatacatcataaagccaggttatatatacttctaggcctcaaccatgccacaattaagtgcaattccttaggctataatcctttcttatttactgtcttagaaatgaggatgattttcttactgcccatgttgctttggataaaggatcaaggcgctttggataaagcagcacagagggtggcgtgataacattggcatttgctggattaaaggaaagaacaaactttcttcagatataaatggttttttttttaatgttttagaagtggcagagtagaaaagtgaacccagacatcttcacacaatcaaggagaaaaatgtagtttgagctttctcatcaggcgcagtttatgtggactctttaccttcaggtgatacaggcagcacggatgcttggagcgcttccttttgactggatgccttttccccctttggatggatgatactgtctgagtcaggctggaaagagcaaatgaaggcaatatgggaaaggttaacagaaattttcctaacgtgactttttcctcatttcagtctcctgtctctccagagcaaaggttaagcatctaatttcataaatttgctagggagaatgctgcttaggacccccagacaatgcaggcagctttttccccctgtcttcctgtcacctggccttgctctatgtgcagcctgtctctgacaggctgaaatctgggtgatgaccaaaagcagcgtgtttttttttttcatatcccaagatattcatgctccaccagcttcatctcctctctcattattatacaaggccactgctgcttttcttatagattaaaaaaaaaaagacatggttctcagcaaagggaactgaggaatccaggggctaagtgactgcactaaggtcccacaactggtagcagaactgggttggcagtctggctcccaactcttggcacttcgctaagatgtcttcttaacctgcttctaaggctctttgctacacagtgatactctgtaaaaaaatgacaaccttgtcagttttaaataggtgctagaaaggaaaaccaaagtcacagcaagtcaattagggaagcagcaaagctagagtttcaggggccatgggtaatgataatgtgtatttagtggccccagagctaacttgtcaacattttaccaccctttgatttatcatgaggagtgggcaaaacaaaggctaaaggtgtagagcccacttatgcgtcacataatttttgaactacatcaagtacttctaatccaactacctcattttgtagatggggcaagtgaggacaaaaggaagggattcatcaaagatgatgcaagatgagaatttggacttctcagtgtggtccctcccatcatcttttcaaccttcccaccagaaagctatactaaagcaataccgttgaatctattacttttatttttatttttggtgtctctttctcttgaattatgtcacatttataagttatagtatcccaaaccaattttcaaatgtaatccatcttttagtgagtatagaagttaaaatgtcaacttcaatcatgatcagtgttttaaaaaatacttcaaaaatatatatgaataaaatcagctacattgagcagaaatgaaggctgaggagacagcatcgagatatagtgcttgcctagcaagtgcaaagccctggtataacccctgtcctggaggaaaaacaaaggaagaaaagagaggggaaaacaattagagaacaaggaaaaaaatggaagaaaataaccatggactttaccacattttcaggaccatatcctgtgcttttattatatccttttattatcttggggagactttctaagtctccaaaaattttaaaaatgatcaattttatttatatttattatatcacatagttgtttattacatacttgtgatacataaacaactatactctctatagttatacattgatatgtatacatataacactactgccaaatttggtacattcagggattttgattctcatttcacagatgtttacaattatgtaccaacttgctgtaacatcaatattctaggtcaggtttgagaacatagtgaacaaataataaataggaacttatcctttctgcaatgttcactgttcctccactggacacagcaaagaataaaaatggagtagcacatgcctataaccctagcacttagacagccgaggcagaagggtcatgagttcaaagtcagcttagggtatacaacaaaaccttacttcagaaaaaggagagagatgctattcccatgatacctctactatatggctacataaacagtatctaaacaatgttgacacccataggaatgctgtcatagaaagtaccaatcttacagggccccagtactgatgagacaggaagaatcagtctatcccagaaatgaatcattttattggttaatcaataccaagtgctcagtcctgaaattgtatatatactgtcttagttgaggtttctattgctgtgatgaaacaccatgaccaaaaagcaagttggggaggaaagggtttatttggcttacacttagacatcacaagttcatcattgaaagaagttgggacaggaactcaaacagggcaggaacccagtgtcaggagctgttgcagaagccaggtgttgcttagttacttactcaatatagcatgttcaacctgctttctatagaagctagtacttccagcttagggatggcaccacccaccacgggctgggtcttctcctgtcaatcactaataaagaaaatgccttccaggaatgcctacagcctgttttatagagacattttcttaattgagattactcctctcagatgactttagtttgtgtcaggttaatatgaaactatccagcacacatacaaataacgttatatggactaagcacattgtgcttataggtttatgaatgtgcgtgtgtgtgtgtgtctgtgtctaacaataataactacagagaaataggtgatgaatttgagaggatacagaggccctaagggggcgttggagagaaagaaaaatgatataattatattttaattaaaaataagaaagaacaaaaaagtgacaagggagatatatgttataaaacttaggcagactatatagaaagtgtggttatgatctgaagccaaattcctaagtttaaatcctatatataacatctaactttatatacatctcagtttcaaaaacacttttctatagttttctaatttgatctttataatgctcatttaagacatacatctcagtgtctctagttgcatatgtaacagaggatggcctagtctatcatcattgggaggagagacccttggtcctgtgaaggttctatgccccagtacaggggaatgccagggccaggaagcgggagtgggtgggtttgggagcagggttgggggagggtataggggactttcgggatagcatttgaaatgtaaatgaagaaaatatctaataaaaaaagagatacagctcaggtgtaattgtccccactttgtagataaagaaactaaggcctaaatatgtaaaacaagcaatgccaagttaaagattatgtagtaaaaaaggaaaaatgacccagggttaccaacttcaagtactttggaaattgtaaagtgtataaagttagatgtagtatgcagctgtcataaagtgggattacagtcacaaatgatgctagagactgggctgagtattaagagcctcaaaaacattttgtaaggaaaacaataagctgttatggaccaaaaattttgatcatgtaaaccaacatctttgtattatatatgagagacagacagacagacagacagagacacacacagaggcagacatacagagagacagacagagggagagggagagggaaagagagagagagcagcacacatcaaagtaggactagaactcacttctctcacatttgcagagtccccaaataatcatgactgcattttcttagttgacctttgttgaaaaagaaagagtaaggaaacaatttagttatttgtagaatccacgtaggctggaactacttaattgggatctcatgcaaggaaaaggaaaatatcctataactactatgttttaaaacacactatttgcattccaggtgtgggagagtaaggagccaggaaggtgacagacaagtcaggcaggagagagagctcctcggattcttcaacaatactctcttcaacaatgaccaacacagcaaataacctctctttgattattaacaatcattgtcatagttgttcctctgctatgagttttttgggaaaaaaaaacattggtaaaatggataaaattgccagtttcttgaaaatagagaggactatttattttcttgtagcatccatgatgtctacagcagcaaaggactccatcaccaagagcacctcagctctcactaagccctttggagtttataggtctaggtgctgagcaaatatgtgttgggcactttgatctttccattagttgtttcagctgaggcaagagcaaataaacacttgtgtcttgacaaccttttcaagttcggtgggacagaaagttataaaagggaaaaagaaaacaagaaaagatttttttcaatagcaggctatcaaggttactataaatgccatctaacaaggcagcccattaaaaaatgtagtccaaaatgtactaatatgataaacccaaatgaggtctcgttattcttagctctaaagttctgactgtccttacaaactgcctctgcagcctagatagtggccatcatgatctgtcttctgctaaaatactcctttcttcctccttttgaacaggaccgtagtcccagagggcagctcttgctttccttctctctctctctctctctctctctctctctctctctctctctctctctctcttatttaattatattcatttgtcctgaaagctattgcagagagagactatctgtatctgtcagccttggcttagggtctttggagaaagtgggtagagagagctctatcatgctgcctagataacacctcttgcaccagttgtttttcagctaaagtgcagctaaaatcagggctcctgaatctgaagtgggtggtgaaactctaagataaccatgataaaagagaaagggaagtgaccttttctgctggtgctgttacactatgataggggctcctttatggacccttaaaagggagaaattcctggcaagtcaaagtcagggcaactttacactgtgggaagtaaatatatggatcttcttagcccaggaaatgtaaatactgccagagaaggatcaatacatttgtgactgttaaggcaatgataggttactaaggagaactaggctgtttggggatccatttaatctctgagttcaaaattagtgaggacaaccagagcctctgacagcctcaatgaaatgagtcctgaaagcatgcatactctctgaactgtgtctgtattttccaattaatgagggagggagatatgctgtttatttctgttgtttcaaactgagatgctaaaatctccagtttgctttaaataaaatccttgcatccaggggaacaatatttatatttcaaaggaaaagaaagagagaatgagagaaaagaagagagagagagagggggggagaaagaaagaaagaaagaaagaaagaaagaaagaaagaaagaaagaaagaaagaaagaaagaaagaaagaaagaaagaaaggaaggaaggaaggaaggaaggaaggaaggaagaagggcaagcagaggcaggcaggcaggcaggcaggcctggaccccatcccccttattctgctactacaaactatctgtggtaccaaccatgtcctccataggcttcgccttttcccatttgtgaaataaggccattagagtaagtgagcccccagagtcctttctaacttccataacatttactacttcaaacggctccacaagcttcctctggactgctgaggatgattccttactcaaggctttccaggagctcagaagatgttcccaactccgcccaatgtgtcactcaagcctagcttccacgatacacggacctgctctaaagtttgtatttcatgaacttttgccccactgtctgaggcccctactcattttaaacagagctccatatattagaggcaacatttggtagactttaacaccagagatggccaggcttgctgatgcatactagcaatctcagcacttgggagactgatacagccacatcttcaagaatagactgggatgcaaagctacttcaaagaactcataggctatgtagtgaggccctgtcttgaaagcgctggaaaagaacaacaacaacaaaatttaaactaaccaagatgtaaatctgccttgagtgaggattcctgttctgttattggcagccaagcgatttcaaaaatttgtctaaataagctttgcgttagtttcctcctctgtggattaacagcataatacttcttctgttgtagtggaattatcaggattaaatgaggaaatttataccagttctcagcatgacacctaacacacagtttattctgtcatcaatgcgaaattattctccactaagtaaatatcaagctaaaacttaagattgataaattaataaatattgaggtaataactggttgttgttgtcatccttgttgttgttgttgagacagagtctcactgtacagccctggttggcaggacctcctaatatagaccacactggccttgaacccacaaagatctgcctacctctcactcccaagtgctgggattaaagtggtgtgccaccatgcctggcaataccataaccttgaagcagtggctaatcacttagcttcttgggctgtgtatgttctgcttcctataaggacatgtatatactcatcagaaccattttggaaactggacagacaaacacgagaacattttcagatgagcctggcatttgggtacagaagtactacttacttaaatattactttcacctcccatggagccagttgagtccatgggagtcctaaagggtggcagatacacagggaacttccctaaaatgactccttgatatggctcacgtgttaatcacactaagcagtattttactcttcctgttgaaggtgtaatgtgaaactgtgaaatgagaataagtcgaggtaggttgccactgtctcctggcttgttgggttcttactgtattactaccatgggccagggggaggaggacaaagaaagcagcttagcttggtaagacaaggctaaatattatcagagtgagcccacctcacttttgagacaggagaatctgttctctgggggcaacatgaaatgaggagggtgagatcaaagtcaacaacattgtaagacagattaataaagaagcattaattattcctcaagttttgcatgcgcgcgcgcgcgcgcgcgcgcgcgtgtgtgtgtgtgtgtgtgtgtgtgtgtgtatttgggaactaaaatggaggaatgacaacaaatataaagcatcagttttgacacggaaactccattggtcaccttcaacccacggtttattggtcccttccctttcttcttaggaaagcttagtataaaaactgttcagttcgtggcaagttggaagcaaaggaagaggcaaaaagagaccaaggacccaaaatccacttcaaaggcatgaccctagtaatacaacctcttctgcttctctgagtaagaagctctcaatattgggtggcaagatcccattaattagctggcatctagcagtgaacttagactctaaaaattaatatctaattttgttgtctttgctcaccttatgtttaggcagtgatgttggtgagactttgtgggtttagcttctgccatttctaggagactcaacctcacagtaattttcctcttcctctggtgggttcagtcttttccaaccccctattctacagtgtatcctgagccttaggtatgaggcttataatatagatgagaacaagatcagaaataaagatgatctcaaagctgtatgtcagggtcatgatagaggaaaatatgaaagaacatggccttcgttgataactgacactttgcagaaagaagacctatggattagatcccttttgtattgctataacaaaatacctaagataatcaagttataagaaagaaaggtttgagggggttggaaggtgaaggggctctgatgttgggatgtaaactgaataaataaatcaactaataactaattttttggatgattattttagtagcttcaatccatggttgcttggtcccttccctttgttcttatatcagctaggtacataactctggagcataaagtgaaggaaagttcttcatctcatgacagccataaaacaaaaaaagagacaaaaagagaccaaggttcccaaatcaacctcaaatgcatgcccctggtgcccctttttaaggatgctacaacttcccccacgccacagtcaggtgactagaggtgcaactcatagaacattcggagccatttgcggtctaaatgtaatattccaggaatgaagcctgattttaaaaaaaaaaatctattacacaagaagttggcaagggaagtattaatagtatctacgttttatggttaaaggaataggttaagaaacttaaagcgtcactcccagtaaaatgccagtctggcatgcaaacctaagtctaaccctctgttcttcccattcgccatgctctttcctttttaactagacctatgagggaatgagtagttccatctaagctaattttccagataattgaagcagtcatcttttgggagtgaaagtgctatttttatttgaaccatttttttaaggtctacaatgcgttccatacctctgtgccttgttctgcagaatgaacagatcactgcacttttaatcctccttctacagtcacagccatctacctctttactctctgtggctgacaatgctgactaccttgtaggttcctgaagctagcatatttgaaatggggttcatcaaaaagcaggctactaaaatgtggcaggtgtcagtgagagaagagtacacagaatgaccaactacaaaaattcatcagactgggtctagttcatgtaggtacagatagctctaaggggctaaataactttgaagacaacaaaattgaccctcgaattgaaattcccagtaaaaagtcagaaacatcaataggagcttgaattgtgttcgttctacttcactgatccaccatgggaaagaggtccatcacaggtgggagaaatatttcttccactgatactgttcagaaatccccgcacatagtgagaatgaaaggcatacctgcagcatttaaattctgtacacacaatctaccctttcattgtttgctccagggcagacaactcctcccacctcaccactgcacctccatgtttcaaacgccacgagaggtctatttcagaaagatttctgtttcaagtggtgtgtctaaaaaggtgaatcttcactgatctggaaaccaagtcccttgtgtgacgcatagcaaattattgtgtgcttagcctgtcacttttcctttccttgtcccacctataatttcaaaggggggtggtggaagaagcatcctatacgaaagccctctttaagtttgccaacctattggcctgctgcaagtacttggatcttttcaaattccaatcagaatgggctctgctttgccttctccatctccggcttctctgacccggcaaagtttcccatctttcatcctgtcacttagctaatggtgtgtgtcctccttgcatacatcccatactcactgcttcctttcactagtggagtcgtcagcgagctgctcggcagatggcttactggctgctgctcttgtcccctcgctgcagcaatctgttgttctaaatcaaaatgttaatgaaaaataaaagaactcactgccaatgtctgtctgatttaaattaatatagagtcataccttttgaggcaggtttttctggcacaaggttctccatacaggctaggcatactatgcaggtttttttttctccctctctctctaattaaaattaagcgctttcatttccccgagtctcttgtggcacccccaacctgttctttttaataataacaaaggcctaacaaacattcgatttcagtgttccagggaatggcatctcacctggtgaacataattttgagagatattatatgtgatgtctaattataaacatactttgattagatgctgttttcaatactgaaatgacacgtttactaaatgcttcaagtgcagctctaagttaggctgtagttattgaaatctctttcaatccatttgttttaaaactgctggcaaaatcattgctaatttgctactttatttacaagggcccttcactttctatgcactcagcacagtattcatttctgcagcaccaggactgcgcctctctttagggaaaatgtatgtgtgtgcaggaacatcatcgatgtgaggcaaatttttcagcatcaatttacagaagggaacatgatgatgctaacatacctgaaggaggggggaagaatcaccttgtctcaacttgacaaaaagtgtagaaacccaaagcatgacagcttcaaccaattgtggaagacaaccctgtccatttgtttcccccatgacttctttctagacactcttaggaagagttaccaagaagctcaacagcgaactatgcttgctatagagtgcacaatgctataagtgatttaactttaacttcatcaaaacaccgtctgtttcaaaaataaagaagctagtacatagttaactcttttgcccgaagtcatgcaactagtaagtcacagaagcagagaacacccagctcagctctaagaccttcacttttaaccataataccattctatagtgtaggaaggaccacaaatgtcagcatctttggaaattactgttttcattttgacccctaggatgttttatttgctcaaacttctgtgtaagcaggcatcaacaccaatggggcttacaccatgctaaatgctgagtgtcactgccgccaaatataaggtgaatcaggcatatcaagcgtacaaggcagggcaggaggaagaaaggcctgtgtttgagggtaagaagtactttactaatcactaggtccatcctctcagccctatacactgggtctgtgcaatagcatggacaacagatcaaaagaagcaaggcctggaaaacttatgtgtgaagcagacaaccgatcaggggctccctgctggaacactccaggtcaggtcacccagatacaaactcagtgtttcttatactggaagaggagctgccacacaaaggaaataccccggaagcctagccttcctcctgctgctcagaaaacatacaatcttctcagaaagcagacaagagaaaatggtatgcctagggattcactggattttgggagttgtttgtttctttgttctccgggtttgttttgacacagggtctcagctagtagcccatactggcctcttgattacatagtcaaagacaaccactatctcccctagagctgggagtttaactcagtttgcctaaggccctagatttggtgcaaagcactacaaatttaaaaaagaagaagaagaagaagaagaagaagaagaagaagaagaagaagaagaagaagaagaagaagaagaagaagaagaagaagaagaagaagaagaagagaaaaaaaacccttaaatggaaaggaatggcaaagaaaggcagaatttcccttcttaaaccttactttggcagttatattttttgtccttcccagagactaaaggaaataggaatttggaaaggcatgcaggagatgttaaatagtacccagtgtaagagccaggtttcctgggtttcataacccaccttgtttcttaggtatcccagcccctctggaactcacacaggctttttgtaaactgaaaaggtcctatggaggtctttccaacatcaaatctttaatgattttagccctcactacatgttaataataaatcttgcctttcccactatttaaacaaggaaacacgaggaataatttgaccaaaagaagcaaaaatttgatctgttttgtagtcttacagctcaggccactggagccggtcccagcccgacgtgctagataattattcacccctctgagtcatcaaatcatagactctttgaaaccctgaaataaaagagccctaaaggtcatcttttcctaacctgctgagctctcctttgcctaaacaaagctgatgtaagtagtggagctaaatccaaatttatagcacacctggatatatgttgccggtgctgggttgagcctgtaacctttgcccccaaacaggttctcccttcctgagagttctctttactagtgtttattgattccagaatgcctttaacaagggcctggatttttgttctgccctgaatacaaacaggatagaaattctcctggaagatgtgataacatctaaatgcacataccatccatgatacatgtgactgtagagcagatcatataataagagcaaaatcaaagagatgagaacctgaaagcataaaatacttagaaaagaatgaaatggactacattgagaaggaaggcaaggaaggatggagacactaatgtggtcaacttactagatgtgtttaaagtcaaatctgggtttacaacccaatcacattatacaactagttatctcacctttacagttctcttaacaactccaagccttagtcatttacatactgtagtatgggataatatctattaaacatgaatgttgagggtaaaataggatacatgttctaagctataattacagtatgcttaagtacattcttggcttgtaacgtacagtgttgtactttgatagcattgaaggtgtgtgcccttgactgtgaccctgcagcactcataggaagaaattatgttgatgttcggatcttcagccatttgtaatatgtctaactattgtaaccgcccctagaggtaaccaaaaaattgattataaagaactaatcagaatatcagttattctgatcattgaaagcaatgttcaaacttgcttctttgaaaacttatcatttcatttagcttctttcctccatcctcctccttctgcttttcctttgggattcgtgtgagttgcctccatttcctaccacacattctctttctagcattacgatatatatcttttccactaatctaccaatatttctcttttatgtccaacaataatctctccctcaccaaatcaaggttattttttaaatgtgttgtcctcctaaatctcttcaggatatgcaacatattggtttccccattttttattttattaatttaaaagaatattatgtacaataatggattccattaagaagtttctataacataggatcaatgtactttagctgtccttacttcttaccaccgcttctcaccaccctcctccatataactcatctcctcagtcccatgtttgccttcaggtcatgtgtgtgtgtttaaatctagattccacacaaaagaaagcacacactatttcttaactgctgagccatctctgcagcccaagcacgcactatttcaatgttctcttctttactcctctcccatggtgctctattttttccctcctctctattctcattgttgaggcgctttcctccttagcttctgctgacattacattttaactcttctctaattttcaacctgctccttttttgcctgtgatgtcatgcaagtgccttcattctaggcttggaccatcttcatcaataaaacaaaggtttaaaaacgggatgatatctaatgacatttccatagccattcagtgtctgggagtgaatgagatatccctgtgtttcttgagttgactctagcaggctattacattttaaatattttatagccactcttgtctatgttagcagttgatgtacgtgtacatactacataaggctggggttttgctgctttattcatatttaatctacattttcttcccctctatatttgcatatgcacatatgaaatacctgtatattgcatggcatctttcttaaaaatagatgtaaggtactttctaaagtaatattttgttgtttatgcaacatattagtactttaaatgtatattgcagatattcttctccataatccatttaatttggctattcagaaaagagaacaacatttatttagccaagtgaaggcatgaaaaagtgtaagagccaggactcaccaatgtcattaacaaatagcccgcaaagaacgtatttgagagtttcatactgacatatgttatacagaaatacactgcagtagtataatgagccctcctgtcatttgtccatgtaatatctcttgaaaatactcaaatggatacattataaaatgtttactgatttttattcttttactcacaattcaagtgctatacatgatggtttcaaagggagcttgagactacaaaggaaaagatcggctacctttgtcttaatatctacaccctcccccaaatcctctgaatcagtttttcttgtttcaactgaaaggcaataataatgtatttcctaaatctaaggggtactcagtaaatatatcttagtaatgataagatggaaaaaaagcaaccttcaagtgtacaaagtagagaatgcttgtctctgctaaggaaggtggttgagaggagataagggtccttaagctgctcccaaagcaagtcatgttgtaagaaaagcagcggaggttttgttggtttcttgctattttgccactgaagaatatatgaatttgaaagatcttgcacactaaggagctctcttgatccatggaccataaatgtgtcagtaactcagcaaaacttgatatactgccttctcacacacagcaggagaaactcagtggctgagtcaacaggccctcagatctctgtcaaaaattcaaaatgtatgaatttatataaacatgacacacccttgaggtcagccctctccctgcttttccctctcttctctcctctcaacagtaagccacctaccactaaaacacctctcaaaatctaacagataggctgatttttattgtattgtaaagttttattggtgagcactctccagggccagaatattcaaattaatagacttggctagtcaagttaccagagaagcaccaaatatgtggtgtaaggtttaccaatttttaagagtcagaataaaataaaattttgttcctgactaaaaggtacacttcatgaagttatctttcatatatgattcagcaacactctggaagatcttcacatttgtaagtcaaaattgaagtctttgaaacattgcaccattagtgactgttggaagaaaagacaaacaaacaaaacaaagcaaaacaacaacaacttaccctaacatctctaggaaaagaaataccctggagaataaatgttgctggaatggtcacaaaatactaacacagtaagggtctggagagatggaatggcagtttaagagcatttgctattcttacagaggtcccaaattcagttcctagcactcacatggaagctcacccatctctctatctgccactgcagctccaggggattggatgccctcttctgtcttccacctgctttgcatgcatatggttcacaaatgtatatgaagacttgcagttgtcaattcaaatattctcgacatcttatgttttatttttatataaaaaatcttaattttatggttttaaaaaatggtggtgttttattttgaagtcatatttacttttctctaaacttctttaaggcaattatgatgttacccttagaggtcaattttactatattgcattgccacaactttagattttaaaaggttccacaaaaagccaatttatccatctagagctccaggtgggttagtgccaatgacaaagtgtttgttgctatgcgccaagcgttatatttaagtttctggcatgaattactaattacttataacttttgtgaaaaaaacaagaacctcaacattctctcattcaaagcaacactatttgttcaattagtttcagggattttattgtattttttaggtaaattgatgatgatgatgatgatgataataataataataataataataatatctatccttagtaacagccattaaacattggttcatgctatgtcaggcacttgctaaatgctttcacaggtataatgttgtttaaatccaattctactgttggctccattttataaaaagagacattgaacctacaaaaatgagagtatacacaagtcttcagaattctttattcagacagaataacctcagtgtataattgttttaattgtttattatgaagaaaagatatttagtaagcatgtaccatgtgccaggaactgggccaagtactttatgtaagttggttcacttaatgttctcatcagccttctggggctgctatttttagatatattttatagatgaaagaaagaaggggactggaagttaagttttctcaaggtcttatggctagtgagggcagaactaaggggttagtttagataagttttagactgaagtcccaacatgttctattacaaagacactagaaatgtgtacaaatagacttatgaatgtattttgattgtccattattctcataatcatgaagtcaccctaaagacattgccaacagtaaactatatacagagcttcctttagttccatggcacacaggtctttagcattctgatcacctttacttttcagagaagagagcaggaacagtttgaagccattctcaagaaagctccatcaaggtagcttttgggggagatgaattaacacttctagggcattaggttctctgccgtaatgcaagaatccagtccctctcttctccactgcctgaaagctttaacagcttgctcaaaccaaaacatcatgtcagcatttctcattggaatgccttgaaacgattggtaaaaatagcagattctcaagcccaacctctgaaagcacaacttcgacatctgcattctaacaagtgctccagatcacttgtaacactggaaagtttgagcaccacatacagtgataaagcactcaggccccgtgttctgaatttgggatgctctaacataaataagattaacttgttttcgtgctatgcaaggatgcaatcatgcatgacattaatagaccccatgaaatgattttgcatagtacagtctcctcttaacaatcacaatatacacaaaaatattgaaggctccaagaagtccttgaaagaatgtaagcaagttctttctcaactcataggtaataaacgatatttgcttatctgcttctgcgaagaagaaaaggaaaactcaatgtgtacttggacaatgtgctataatgcacctgtgtttctcaaactacttttagtggcctaggaaagggacatcaggagccccaccttagatttctagtatctattatgtctagagtgctcctcaaatctagtttcctgcataatctaggtacacggctataaggcactctgaaataagcatcagttgtcccaaaggtgatggtggttgagggacatcattatagttgctctagcaaggctaatagaaactaaacaaattctgaatatgaaaactacctggagacaacattatgatacttgctatttaaccatatgactggtcaaaaaatgatgacaacaacaacaataacaaaaagagcggcttgtttatacagtgtgaactgtttgctgttatataaccagagcccagaaattataaacagaacaagttcccaattctgcagccacctcaatgtagtggggatgataggtgggcagattccgtctcccagttgctctatggtaagaaagccacttcaccactctgacttagtcttttctcagaaagccatgtttagaactaaatgaggcatccacactaacctcttatctcaaaaatgaaataaaatatgtgccttcctatttccctctcctctcttttcctggcagagcactgtgatgctagatttgttagggcagcaagtaggcaggaaatgttgctgttgggtttggagcagctattctcttatgagggctgtgtcctttaatgaactccaatgtcagtaactcaagggcacataaagggtactgagatagctcttcagttccactaacaaggaaacaacatggattggggtccacagaggtgaaaggacaagtcctgccctcaagttgctctgagaatagtaacaaaactgagtgtgcctagtggtggcaggtaacaggcagttggtaggggctcaaggaagggatgtagctggtcacagaggtcatctaaagcagtggaaactgtgttaaagctaagaaaaatcactgaggccaaagacacccaatgtcttctttctctacccagaaaaagaaaatagacagtagtctaacctagggatgcagttccaaggctcagttccagcagccagcacagagccaatcacaggctgctttgtgcttttgtgcctggcgttgtactacatatagcacaaaaccagtaccacagaggtgatctctgccctctaggaaggaaagcaatgatgaagacaaacctccagagcacatgaaagtaatcaaaaagccagcactgaacagataaatacctcactcacttccaccattcgggttcctgtccatttttctctcctatggaaaatcttagataaatcaaaactaagtgatcaccaagtccccaaccacccttacctctccatgctttgtccagagatttggggatgcttgtcttagtattaacgcattgatttcatcagattgtatgactgtcggtggtcagatagagctttcctaacatttattcctcctttcagccattatttgttctgtgcttggagtaaggttggtggagaaaggatggagggtcatttccagatacttgcatgaacagtcccatcctgtaaaattttccatttgagtcttaagcatcttcaaccgtggaacaaactcacagaagctgctgcagtccccttcccacttggcatttcttcttatatccagcagagctctggaaagcaacaaggttgggattcctcaggtagagggatggggaacagtggttgagaggcaggactagactcttgcacttccctttaatggtgtgctaagactccaccaccactgaggaaaagccataccatgtttaaagagggctctatatgaatggtacagggttgtttcttaagtgagaaaaaggaatggcagacaaggggattatattaagcaaacaatgtttcccctgattttctttcagaattgtgtctagggagatactacagtgaagaactataacagaataaacacttaggattaaactatgtaagccatctccaagcaaaagcgaggtgtgaagcttggtcaaatcccagccactcagcttagaatccacaggacaactgtgcttcctaactgattcttatctaagtcctcaaatagattttttgtactatctgatgctgtcaaagggcaaaaggtgctgatagaaccacagacaattctgcaatgccaccccccatcagaacaaagagtgttcaaatcttgcaaagccaacaaaactgcagcataggtcagctgcaaagtcccccctcatcaaagacctccctgagccagcaaagtcaaggccatgagctcagggccctcagaaggtcgctggagaggacagtgagtctgcaggatgagtcaggagaattgaaaaagcccagccagtaccaaaagccagacctctagcacagcagccaaggcaaaaaaaaaaaaaaaaaaaaaaaaaaaaaaaaaaaaaaaaaaaaaaaaaaaactctgtaagaacctggagcatcctgataatgggggtggggagagagaagaagaagcaacagaaaagataaactacctttccttcgaaatggcaaaagagggaagcagatgctctttatccttcatatgtcccactttcagtgcccccctcaaggatgccattgatgatgacaactaagcaagcatctcctacatcatactctggtaaccaccaacccctaacaaattcacttctctcaaagcttcccactatctttgaaatggcttccttccttagcatagctctgtcatttcattgtaactgatctggaccactttagcagttcatgagtcagtatagttcccaccggggtcaaatattggcagttaaacaactgtctcttagcaactgagtaattctactccaaagagtatatacagtggaaggatttcagatgaagaggagtactgagagagagaaagatcctgcagaaacctacattcaattctacatgtagcaatccatccattcctccctccttgtttgagcataagctagccatgcgactggcaacctggacaaaagccttaatgcaaaggtgcaacaaaacaccttcttatattagcctcaagacataagaacttcttctgaatcattaccagcagaaacgtgctatgggagaagtacatacaggaattaagggctgtatttcaaactgtggagaagaaactcataataacaatccactctttaaaattattttatttatttacattccaaatattgcctccctctcagtcccctcttccagagttcttcccccttccccctccccctttgcctctgagaggatgcctcccaggcattcccccatgcctggggcatcatgtgtctataggaacaatccattttaaacagtttaaaaacaaactctgtcccataggtgctagataagagagtatataacctgaaaagtctagccatggccccagcttgtgaatctgctatttggacatgagtagagggcatggctttgctaaaggccacaggtaatgactgacaatggaggctttttcttgatgattggggatgagttataaagctaacacttgcattatctcatatattagaagctattgactattgagaaaagcatttgacttgtgaccagtctgatttcctaacatactatgcctcttcacaattgagttttcaaagaaaggcatctagtcaaaagttttaaattctagaacaagcaagcatttgatgatcctgattatttttaatgagacttctctggacaaagaatgctgtgaactctgtgactagaagtagacttgcctgagtagaatcatacttgtctctggttttctccctgtatgtattctatatctcagcgtccccattttttgtccttgagtctcatttctctgaggagtttaggggtcccacttgcatttttcagtccaggtggctgaggatgtcttcactcttcagttcttgtctctctattccatcccatggtaagatgcctcctgtaagaatcctgtttccttcttacacacctacccccccccaaaaaaaaaacagcttggagacttaagagctattgttatgtattaaatttgtcatggcaaataatgacttaaattcctggtccttcaaattagagcagcctgcttaacaagaaatacatttcctgatagccttttaaggcaattttagcttgtggcaataatagtaatgaaaagggggattagtggtgcatctttcatcacatggcagaaatggctgactatttttccctaaatatagggtgggaggggctttggttcatttcagcttacaaaggatgtttaaatcaaagagaatctattcctgctgcccagcatccgtcactaaatagtgctatgcagttttgctttgtcttttgtacttttgtgcttttctgaactgatatatctatccaaggcaaaggaggttgctaaattggtatttcatttttccttactaacgtcctgaaatgtgcctacttataacttctagccctcatttcatgtgtgtgtgtgtgtgtgtgtgtgtgtgtgtgtgtaagagagagagagatttatttttaattaataaagatcagtgagcaaaggtcttaccaagcaagcctgatgcctagggctcaaactctgtcatgtaaatgttggctggatatggcagtcctccttaattccagagttccaaaggcaaagacatgggatcccggatcagcctgggtagctaccctagccaaactggtgagtgtgggggtcagctgaagaacctgccttaatgaataatgcagagagtaatcaagaaagacctttgacattagcctcagttctccactatatgctcacatatatgtgtatgcaaccatacatatacaagctctcacgtgcataaacacatgtatgtacaccacacacacaccgcatatgacagaaaaagaaactcaaagaagttgatctcattttatccaacaactgcattattaaaatatggtatgggtgggaagaatattatcatagctacccccaccgattcaatctgtaatgaaacacatcacaagtaatagtaatctgatatatccatttcaccaataagcaaaatactgatcttacaccaaaatgaccagtaaggaacagcaattcttaaaatattaactcctcctgtaagagctgataaatagtcactggatgcttcagactctccttcagacctccacaagatccagtgactaatagggtaatgcctaagacagtctttaaggctattcctggaattttttctgatttgcttccagtgtcttcccatgtgaacatcacccacaatgccatccaccaagtagcaagtactgtgttcatgaatgtggaccaccatcacttgattaaggctgtagtgatgacactgaagtttctcttagtacagtctgttccatgcatttctatgaagcagaacatccacgaccttcaaaagatggacgactcaagccttgtttccaaaatagcacttggcaagcagcctagactcagatggggacaggagacacaggctgtgggcattatgggccagccccctgtcacatcacctcaggggatcctcaacctcatgggactcactagaaaaaaaaatcttttaaatttgaaaagcagaaattatctagtccacctgagcaccctgggagcaggtccgtattcttagcttcatgcttcaagtaccgagtttagaacaaaagcttccgttcaaggtcatttgatgagtcagtctactgagtggggaaggaagagaactggagaacaaacagcccacatcagggtcaaattgagctgttgagctacctcaatctaccagaaaggtctaagcaaaccatttgcattcttcccttgtagagaacttgagaaattgtcttggacggatgttagtgaacaaaagggaggaagagtaatgttagtggggcatcctttgccaatcagcagtctagaaatgcaaacttgtgatgacctcgtgatataggtgaatacatatgtggacagatgctatgtctgctgtccttatctgagtttcagcaaattcattctttctcaggaagagtctcattctccaaatggaccttttctcctgtcaactttgtactaatgtatcaggattctccatgacaaacagaatcaatgcctatgtgtgaatttcgaaagtctgaatttaacctttaaaaaagatttattttatttacctgtatgtgtgtggacatgctctatgtacatccagacccagacaaagaccacaggagtgtgcaggatcccctggaactgaagtcatggatagttttgagcatctcagtatgtgtgtactaggaactgaactcaagacctctgcaagagcaatgactgctgttatccactgagcctcctcttcaggcccaaattcaccttttggcccttcgagctctcttggtaacattaagagagacaaatacttgtgttttaattttcccctttatgaaataatttgacatagtcacctgcgttatgggttggaataagaagaaaatatttttatagataagaaaaacatttgaacactccaatacactctaaatgcacgaaaatatattgcctgtctttacaaatactcagagggaacatgaaaaatcagttttttttattaagtatctattatgtgtccagcatttctatagtcattagtttccttaatcctgacaataatcctatgaagttgatattacttactataagtaaaataagggataaaattatgataaaatacattcctatgtccaaagtctgatttttatcttacaaatacgtaaattttatcctaaagaaaagcaacagtagtatccaaattacaaatgactatgtcacagcaggtcagtatagcatcaatatgtacctataatgtaaaatatgtgcaaaaaatgtaaagtgtacaaaatatggcacctaatattatttatattacagcagcataacatttggaaaatattcaagataatgatagtcacataaaagaaatgagtatatccttaaaaggtgtcaaataacaaaactccctatgttcaaatgatacatatggaaatatagaactttgttgagataaaagaagtagccctctaggaaaagaatcttcagggcactacagatccaaactttcttccctggccaatggtaagctactgctgtagtggaatgcctgttccttatagccttgacaaaagataggatgagagccctgagagaagggggactcacagaaacagtgtcatctgttttatctgcacattagacaagaaggattggactaaaaaaaaagatttttttctgtacacagaaagctgaaaatagggaaaactggaattcactccaaaatatacatgattttcctatacccatgactcttgactcatgacccatgacgacatttgcagatgaatgtggttctcagcccccattgaggaaacttcttttgtgattagtagaggctactacagagaattgcaactattcaaactgcagaggctaagtggctatagggtattcaacctcagttgataaatctgcaccacaagccctgcatataagggtcaggaaacatcaaataagacgggcaagatagaatgtaagacccagagccaggatgcctgctgctaagtagtagcttctctcttgagaacataacatggaaatacatggtcatcagcaattgaaatgaagtgtccaatcctaactaagacttttgctatgcaaaaccctacatctaaggcttggaaaagagggcagaaggattgattttaagagctagaagaacagaatgcctgttgttacagagtgtactctagatatgagagggggaatatatatccatgaactctcaacaatatagttgccaaaataagaccagcataatgacaccagttgacaaagcaacatgaacaggggtaattttatgatggcttacccttggatgaagaggtcaatggctgctgagtggagaatcaatttcctccagggatgagaccccacaaaggtgttctaataccaagtggtaagccgtgtgtatgtgtgtgtgtgtgtgtgtgtgtgtgtgtgtgtgcacgcatgtgtgcgtgtttctatcaatactaattaaagaagaagagataatgaattgggaagagggcacagaaggagtttagggtgaagaatggatgatgtagatgcactactcatgtatatacttctaaatcacatttcctctctccagtatcataccttgactgatagtgacacagcactcccagccctttgttactgaagtacacctcattatgaccaccactcttgtcatatgtaccaaacttctgcaaatactttgatgcatgctaaatatttctctttaataatgatagacttgtgaccaagaaacagtattccctgctaacacagctaagtgactttccggggacatcaaattcattcatgggctcatcttgccatcattttctctgttaggttatttaaaatataagcattcttgaaagctaaaacctttcatataggaaagattttatacaatggcctccatagcatccagcatgtagcttaaggtatcagacacataaaagaaatgatgaatgaaaagcattcttttgcatgtacaatggtaaaagtatatcttcagtcttgtaatgttgttggaattatagataaatttaattaaacattacaatacaaacaagataaaacaatagattaaaactaatggttagctgctgctaggaaactctcttctttcccaatcactaacttagcaaaatttgctataatgtctcatctaatagcatcaatcaaagaaagtagaagacacctcctgtcattatgcctcagtttccctactttaaacctagcagtattgctctagagtagtggttttcatccttgattcacataagaatcaacttgagagatttttaaaatatggatgccaaattccagcctcaaggtttcagatttaattgacagtagcaaggcctgagctttgatatcattttaaaattccccagtgactctaatatgctgccagggttgagaagcagtgggctagatgatccctaaggtttcttcttactctggaaatcaatatgctgactatagttggatctcttctggtatcacagctaccctgcctgcctgtttcctactctcccctctaatactacacaccacttgatctatcctagctcgtcattgcagcccatttacctattgacttaaaattttatttgctcttgggacttccaagcagtgctatttaaatctgatttctaatgctatgtgggtcattttgccaccagagaagatcccctgatattaggatatgttaggaaagcatgagctgccctgtcctgcttccaggttgggaaaagccaagtagtaagtgtaagcaacccaggcgactactagtggtctgtaagcacaatccccagctttctgtttctctggattctttcatggcaatcagcctgcccattccattcggccctttgtcaagaatgtccttgacactaaaggaattgatttgttctccctttgctttaaataataagccaaccattatgcaggagttttataggatattgatttaacatacaaactgcattatggcccttgaatgctacagaaagaaccaatacctcatcagccaggaacaccaatgtagtgacatcttagcattttctttacttgtcaaaacacccatgagctgtgggcttgctgtaagggagacatgtcaaggatttagaaatgtcagattaaaatattctgggctattttcaaaaagacatgagcatttttaaccagtagcattctatcaacaatgccttatcagaatgtagggctgctaaagaatggtatgaatattatatgggcaacagaaagtacctcaaggtcataagatcatttatttctagaagcaatctgccacaaacatttgcttgatctgtatatacataataagagctgaaacagtatccgcataagaatggaagggagcctagagaggaatctgaataaagaaaatctctctcctcccaagatcctaaaatacaaacctaaaaaacttagaatttggaatggtcatttagctatatgtaattcagaagtcctccacagctggataagaacagtggtgctttgttgtaggcctttggtcaaattgccaacaggacataagtttgttttttgccttcactaccaagttctttgaaagagtagtaatatatccaccttgaatatgttttctttacacttgccccataatgtgaattataaaagctggtcacattaagatactaatggttccttaatagtcacaacctgctgttagctcccagtctcaattctaattgacatgactataactatttgctactgtcaaccacctccccacttcctttgttttgacaagatctctttccagattctcctatatctctagtttttatttccagtcaatggcttacacaaacctttctttatccaccctttatataatgaacatttatcttgatattcacttttaatttttttaatttttaatttatttttatgtgtagaggtgctttacctgcatgtatgtcagtgggtcacatgcatacattgcctgtggaggccaaaagaggctgccagatcccctggaactgcagttatggatggctgtgagctatcatgtggttgctaggaatcaaaccagggttttctgcaagagttgccagtactcttaatcaccaagacattgctccagccctgccccattctcacttttataagttcagacattctatgacttacagaagtgtcaaagctctcattatttctctctctctctccttccttttcactcactctgctcctccccatgcctcttctgcaacaaaatcttcaagacatcaagctcatattgtcacatccctttggagtacctttactacacagtccagtgaacccttatcctcattctaagcccagtacctctcttgtactatttcggttgctataatcattttctaacttgactcccatctctgtctcttctgaatttccttcattttcctggagtcttttctagaaaacacacacacacacacacacacacacacaatatatatatatatatatatatatatatatatatatatatatatatataaagctgagcttccttctgcctgtagaataaatctatgcatcacctctagatacctaataagctgtgtccattttttctttccagttttacttctgttatgtgccctaccatctttcccactcacaaacaactcatccccacttgtcttatgctatattacttcttaaatatgccatgcaagctcaaatcacagtgttttggtttatgctatttccagtatctagaagaagctcccccttcctatttccaaggagtatgttatttaaatatcaccttgtccaattaaaatgtcaattcctgtgtaaaatctttagaattaattatggtcttctctgatctccgaactttctatagatcataattctagcactcatccccattcttcttataattaacaatgtgagagctctttatttaaggcctggaattctgcctctgtcgtgatgtttaatatcatagatgctgaaatcagataaacaaagaactgagcatttgggttcatagttactgggtgcatggtttcaggcaagttcactggtatctcctggtttggagttcctctgttctagatattggcaaacataatgctgcaggaagaataaatgagataatctccataaagccattataataccctgcacacaataaacactccacacatgtcacctgtgactatttttcttctagtgttggcatatagccttgcaaagaatgagcactcaataaatggttactgaataaattaacaatagcaaggaagctctgagaatacttgctaaatgggtactttcttcctttattgatttagcattcctatcagcatccccaaaattggattatgtattgaatttcttttctctgacgtcaacacactgcattcataattgtgataaccaaaagcagttcacatgctctttatcactgaatcttgaacctgtctcatcattattcccaacatgtgtatgttttgaagtatacatttcaaacttttcccccagaaaaatccaaaggctttttccctactctgatgttgggcaaagaggatgatctaattaatgtgatagctattcatatggcaagcattaacttttcaggtacaatggtaattgaaatcagggtgtttaaaactatcattattgcagcgatattcagctgtgtcaagttgggattttggatatttaattcattcttaaacccttcaaccaataaaaatgggttgagtaatgacatttctaatttttactccctttcaccataatccattttgatctcttgacctccattttagttgtgaatttctgaaaggttacctttaatatccaactcacagtaatcagtttaatatcccttgacaaagaatattcttttaaaaagtcagatcctagggctgagaagatggttcagtggatgaaaatgatattgtataagtctgagaacctgaattcaaattcccaaagtctatacaaagcacagtttggtagctcatatctgtaaacccaatattacagtaaaaccaggagaatttctggaagcttgcaggccagctagcctggccttttcagggtgagcagcatggcttgctgcctcaaacaaggtggaatacaaggaccaaaactcaaggttgtcctctgattttcacttatggacacatgcacacacacgcacaaacacacacacacacacacaaatacacatgcacatatatacaacatgtttgtgagtacacacagaaataaagaaaatcaaattctaatatgctctaaaacacttgttatttgagaaaaataatcaggcttcttttgtaatttagtgccataaaaggtccagaggaacatagaaaactcatgtcacttatgagaggtgaatataaaaatcagacacttgaaacattattttcatcaacatcatcactggtgtagtaatcaccatcatcgtcatcgtagtcgtcattgtcattattaaaaccaatacaactctggtttaacaagctctggaaaaatatattagttcatccaaacacaattagaattatttggtgatatttttccattcttacatatttgacagttctgtttcaaatcttgcctcctgagcatccccacctacattggaaggattttaagactttcagggaaaaaatgtaattctcattatatctgtctacaaggcttcttgtggtttcaatttttcagagaaatacactataggagtatagatattctaccacaactctagagaaaattttatatctgtacatattatccatttgaatatgcacatttaaaattagctgacaaacatgtgtattgaatgttagctgataaatagatctttagtgtccatctgaaaccaaccatgcctattacctaccctgaacaaagattggcactagcactttttatttcaatttatattgtaaaaaaaaaaacattgggataaatagaaatggtggttccttaatgataataaccttaatcttctcaatattaaaaatatgtattaaatgcaaagaatactgaaaaattcaattagatacaaaaaaacccaactcagaatgcaaataatcattcttatgtggatttgtcattgattagccacgagaatggaaaggacctgatgttttgatatatgccaaatcatagttgtctgcaacttttagcttcccatgccaccttctgtctgcccctctgcatacacacagctcagaaactaggtaatattttagcacactatatttttcattcttatacatgtatacaatgtatgtcgatcatattcatttcccactctccccccccccgcaaacttttcttagatccatatctctacccaacttcatgtcctttctctcgttatttttagtaactgacaaagtcaaatttttgttgctcatgtagtcacatgtgtgaagtcatctactagaacatggttaaactgcctcaaacttaaagaacatatttattttatattattttttttacgtttatgaaaacctgataggggtgttattaaaagcttggagttggggctttcttgccttttttccctcaaatttatcttcctttactgtcttttgtttcctctatagcctatattcctcctttgttgattccccttctcacttaattgtctagctaactgatttattactagatttcaagattgtgttgtcttgtccttaaatcatttaaggcattttaaagcttctgtccttgacaagaccgtgaagtttttgacagctcatacctattattcccttcctcgctgctcgggtacttgtcatgcagactgtgagctacttcaggaaagcatcacgccatttccatctttgcctctctagcagttattgcagaatctgtcagtggagatagtcactacagtaatcattggatgagtggatgagtggatggatggatagatggaaaaatagtgtgttcaagaaaagttatccagctgattaatggatttcattgcactatccaacaaggaataactagcaagtattaataaatcagttacgaatggtccttgaacacttacctattatactcagctattctgggagtagttgggggtaagaaactatgggtctagaattgaacattgattgtgtgtataagccccaaatgaaacataattatcccattatttgggtttgtgtcaatatctgtgtgccaactcaggtaaatatttttttctagcacaaggggtgaaagaaattggaggcaaagcattgctattttttatgaagcacttgttctaggtttatggaatagcccatgtattagaacttgtcatcagttgtatagtatcttctttcttctcttacccatacttttcatccaataggaaaggagtttgagagacatcatgtcttctagtgaaatttttgaaaccaattggtggaagactagtggggaaagattagcatatgaagcatgagtaatagtcaagtctttttgtcctttccttgttagtctcttcttccattttaaggtctgtagccttccaaattctagtgatattcccctggtacctcttaggggaaaaattctgcttcaataacaataacagagcagcaaaaatgaaagatggaaatgatcataatagcatgggcttgttgccccaacactgtcagcctctcaacagccaaccccacagagttgccctatgcttgtcaatgagaagataaaagggatatggaggagacattttatgggaccatttcagctgctcattttaaatacacccttcatcaaatatagtgagctgggacttagagatcacagacagctgggctgcttgaaaaggaaaaccatattatggcaaattgtattattgtacatttactgagttccagggtgtctggaagggactctaaggtccaagggaacatttcaaagcagtgttttgaaacattgccaagctgaggataagcccaagggcagctaatgggttcagtaacatgaaactttggtggctgggaatttggttaggggctagaatagatatttttttaagatatgcaatacttggcaagcgacacaaaatgcatattttttatgaaaagatttggaaacaccactgagtagactgtctggcttcagtgaagctttctagtattgaagatccattcaaaagcagatgtctaaatctgtagttttatgggagcacatcatatgtccagcatcattcactcagtacttgtggtagcaccattcataagttcaaaggctgagaccaagaaattgccctaacaaggctcaggaaactgggttttatataggagacctgggaaaagcatgatgctactgatggaaggaatttagggttgccagaggaagagggcagatcaacataaagctccataaagcagatcatttaattatgtaatgcatgttaacaaaatggggcacatgctttattgaagctagattgccataggcaacctacttgcttaattgaaaaggaggaatgtctcactgggggtgaaatgttagaaattctgttcaacccactaggaccctgcttatctccatgttaagtagggagagcttgcagtgggaaatttaagagatggaagattgattagataccagagactgacctctcctcatctttacacacacacacacacacacacacacacacacacacacacaaactaaggttgtatcctcaagactaagaccaaagtcactttgaccccctaaatatatagtcttctcattcttttatgtatgatgcttatgatacattcatcatgatgtccttgaagctatagattaccctgaaaatcccaattactacatataaccatagcctgcttctactattaccaccatgctttgattctcatgccattccttgcttgcttgcactcttgtgtctataagaactcactactaactaaaatcctaaattaatctagatggcagtccctaccctgcccagtttgcattttctgttaggaatttctcatcagttgatcacagagccccacagttggtcatgctctcttggagtagaaaagagggtcatgggcttagtaaaatgaacacatgtggcttagcaaaaagatcatatatttgatccaagttgtgaaaacataatatgtagggggctagcatggtctctggcaaagtgttcaagtggtagtcattattatgattaaaatgaaggaaaaatgtgtgccaaaaggactaaacctgtctagatagtctggatcactaatcaaatatcaagagggacataggaatgctaaaataacagggtcagacatcatccatggtggtatatatctgtattcccagcacccaggagacagacaagaagatagtgagttcaagggcagccttgactaaatagtaatgttaaggtcaatctgggctagataaacaccaaagagaacaggaatgtttactaaatgattgaactgggggaataggaaataatgaaagttcctacacttcagtactgtagaagttaggcctgggtctgccttccagccccatgctcccagagataagactcagactcaaatatgtttacaaatacgttgaccatatagctagactctcctatgactatatataacttaaaatatcttaccaattctagtctacattttgctatatagttgcttacctgtgctcaggtaccatgcatcttcacatcctcctagcccatctcctgcctgcctctgtcctataattctttctcctctgggaagtaccaactcccagttcctgcctaagccattggtcataggctttttaactgataagtgatgcatccatatactacacaagatattctttctacaaagcacaacttctcagtgtttttatttgaattgtgcaagacctcttgcctctctgtgtaggagccctagatggttttcagtgccttactgggtttctgggacacttccaacttcaggaaaacagtgcttcatgttgaacactattaaaagggagcttattgggatattgtctgattctcctgaatagtctatgatcttcctaatttacccccaactccttaaaccaaactcatccatgttaaatcagttgttatagtgcatggctgtaagtgagccccagcactgaagttgccaaagtaggaagaaagcctaggaagaatgcaagaccaggaaggactgcatgacaatatcctgttcaaaagccagacaagaacaactaacccatcttatgttccatacccttaggaccgtggccttacataatgcaaaacctagttcatttttaggtagtaatgatcactaatcctagagcatctagatgtaatattttcatttaatgagccctctgtgccaacataattcagtttcatagaaatttctggaacctgagtaggctggcatgggagctattcatggtcatataggagcattttagtagtccttaaaccataccatgtgggcagttttgcttcagatcattctagcaagttaactgggtataaattataaaaataacaaaaatatgagaaaattgcctactcaacctatgtgcagggcctcccagctgtcactttatttaattatgtagacattttgaacacctactctgaacctggcactgagttggctgctgtggatacaaagatgactatgacacattctgcagctcccagttctatggtccagctggggcccaaacaaaactttgagctgctgatttgattggcaaagaaaataaaacagcaggaaaaaaggctagcagctgttcacttatagtcactttccatcagagacttcccttctaggtttaaacacttctttttgtttcacgcacaaaggcaatgaagttcttcctgtgaaagcacctaatcttagaggtaaaagctaaacacagaggagtgaattctgcacagcacaaattgacattctttcctctaagcaaatcgacattacattagatttggaataggaacccactaataagacatgtttatagcatggtcatacaaaatattagcacagtggaaagccctaggaagaacactgaccacagacaccaggtagtatttaattgaaaatgtttctgccatagggaagaactattaacttaactttaatggaatttttaaatgtccacaacaggaaaaaaaaagcaaacaaaaaccttagaaacaaatggcatacctttggccacatatccataaaatgaaaaggggatctgagctgaatgagcttgaataggtattagtaatttctttactcaatcaaatttcttgagcccctctgtttcacatattgtactgtctagattatgataggaatatagtggtggtccttactctcatccttattgacagacactaaacaaataaatttattactagcaatatgctccacactctgaaagtcaagtacaggcaactatgagatcaatctggccttgttgaaggaaataggagagatcatggtttaggctaagaaataaaaaacaaagagccgatctgaaaactgggtacaaagtgccatgtggctgtggatggaggcccatggggagagcattctagacactatgtagaagcccaggcagtctaaagctatcccagctctctcatgcttctcctctccagcatgtacattctttacagtagcaagatctccactgtgcttgtttcatcttgattttcagaatcatgagttacagtcatctaagattaacattaaccattcattagaaagtagaaagatgtttgccagggattggagttaagggaatggatgaggaatgtttaatgcatgcacagctttagttttcaaacaaatgagtagtgacaatagtgttgatgagtacgtattaatgtatttaatatcatagaactatacacttaaaatgattatggtggtaaattccaggatctctgtattttaccacaataaaattttaactatgaatttttaaactacgatccctcacgaatgctatgatcataaccaaagcagctctgtaacagccattatttctattctatgcattgtgacttttattttctcacagatttatttgcataagaacatgaactctggggaggtaatgactgtgtttgttttgctcactcgcctagcctcaacatagagaattcttattggcatggaaaaaatgctagggaaatagttggtagagttggaatccaactaaagcagtcttattctagatcagccaatgggaaaaatgcctccaatatctctgtcttgtaggccccatccacttaggtctttattatctcttatctagaagccacagtatattcctaatttcttatcttcactagcaccattcataatcatctcgaggttgcatgactcttcctggcataagatttaaacataaggataagctttgggcacagcgttccaaatgtcacaggatcaatttagtttacatcctactctaacatttgctttctagccatgatgaaattcatgaagtcatggaacttctgggcctcaatttcctcatctgtgaaatggggagccacttggaaaatgacttcttgtcaccgagcttcagtttctggcttgtcttccaggtctcttcaaatgatcttcatggataacaggctgtaaccccagatctccagttcttaacagcttacctcctgtgaaaggagtcccttacaaaaaaaaaatatcttgaaaataggtctgatagcatgagaatttgctagattttcagcttctaagagatctgttagcatgcaccaaatatgcagaaatcattgatgtcgcacctattttgaaaatccattcctactataggtgcctttgtgtctaccaacatcctttttatgcttaagatctagaaatgaagatgagtgaagtgccttctgccagggagttagtgagcacaggttgaggccatgaatagtaagtaattgttggagaagcgttagctttatagagctgttacctgcttggtaagggctataagagcttgtacgaaaagttcaaagatactcttctcccatgtttacttttgcagaaaagcaatgccacaccaaaattaggtagacagtagaccctgtttcatagtcaaatatattccactcatcttcttgttttcttccatttccaaaagtaatacatagggtgctagaattgtgtcagatagtctcttttgcaatccttcctccttgtgagctatcacctacccaaatgctagcacctaggttctggctagctgtcccataatagaactctaacattcctttgcaagctggctttgtgacctcagcaggacagccaatttctagccacttcattatctctgtgctcattgctgtttcacggagcaacattcttcgacatgacaaatgccttcctcaagccactccccatagtttccgctttgacaggatttgtaccctctcttctggaatcgagctcacaaatattactaactctgaagttctgatggtattattataagctgggtggaaaactgacatgtagaaggaataactctccctgggatgggccagttcagagtgagcttcttagaggaagctgcattctaagcaggcagtcagcacagccatcctggctctttgaaattgaataggtggcaatccaattacagcatgtatctgatcatttcatacattgtggaaacacattgagatcaaaagagccttcatttcacaggcatgaaacattcccttccacacttggcctgctccagatgggaccttagcacataaataagacaacatcatctagtaaaataactctgttcattaagagctaaggtatccactggtaaatggcttatgccatcaaaacagtataccaggggataaggtaagtggatgcaaaatgacaaaatcccttctaaagaggcctaactgcattgcaaactcaaatagcaaatatgcattgaaggccaggataattggtcctttatcttctccttataaaaacaaaggtttatttgccctttaaatggtccaataaaattaaattggcaccctgtagtgtgtgctgaatacataatcagaaataggaagcaataaaaaaaaaagagtgagaaagcaactgcatggaaaaccaaaagttggaacacttagagaaaaacaatgtaggaatggaacattgtttgtactaagaccttgttgttccataaagaatcccagagcagccacttgtgaaagctagacattcccaattgtatccatgatacctccaaggcaaaaagctgcctgggtttgaagcacccacaaaaaagaaaaaaaaatgagatggaggcaaggcagggctagaaaagaagtgagtgtctaagaaggggaaatttataacatgctaaaagtaaatgaaatgttcataaaacaggactgcttccttgtattcagaatgtcttttaaaggatattccctgtaatctttccagagctgcttgtgttaagatcttgagagaaaagcacaacaaaaaagcctcctagtacctaagtatgcagcaatccaacctccagcgaaacagacggggcttgctaactgatgaacagaaaacacaggcaataatagtcatcatcataaaccaattgctttctgatttctaattttgatggccagccacgtaaagatttatttaatgagcatcagcgaggtgacaatacacttaggtattaacagaatggatgggagagatggggaattgtgtcattgttcaattatttcttttttggcatcaaatatattcattcatatattcagagaagtaatcatgcctgaaggatttgacttggaaattgcagaaggctttccagaacttgattttgtacagtggctgaggaggtcagagaatgcttcctttaaaatatgtttgctagagcttcatggtgaatggagagagatctagaagtcatctccctacctccacacttgggatacagaggagttctcctgaatatattaagctcgtgtgctgcttgacagacagtttctccaaattttataggggattctttcatcgctaaagttttattttctctataattttccaagacagccaccaaaggactctgcccttagagtgccagcctcaaatgccattattgctgcctggctgggagtacatccagtgctcccatgccactcgggaacttaactccttcctagagatagaggagaaggggctttgggccaaagtggaaacctcaaggataaagatgacagcattgtttcactgtttgaaggagcctaagcactataagaaaacggatttttaatatcaacttttccatgtaaaagctcaagagacaactagacccaaacagtgtacagaaccaaaaaccacaaaggaataaaagaaatatactcataattgcctaatcgctggcacagaactttgaaccctccccctgaaagggcgttttccatatgacttctggagcatttaactaagtacaactataattactactattcctataataatgggtttcccatagatctttatattttatattcattatggataatacacaaaatatctctttagggtatatctctttagtgtccttgtcagcatgctgacaagaagctggagctcagaaaagggtaaaatggtcatagattgagtcagcaaggacttaggaaatagaactggagaattgtgcctctcagtaccaatttatgtcatcagctctttaagtgcctaaagtatgaagccaagtattcaaaacctgactcgaaatgaacagagcccatttcctcactcgccaaagacatcttgatcaccagtagaagcaagcaaacctcagctaggttcaggcatgtgactatcaaacgtgggcatggggacaagggcttctgtcactcagcaaaagcatggatctcttagaagctgagggaactgagggagcctaacagagaagaggtttcagccgggtttctgaagatgagagaaagtgatggtggcagagacttgtgaaatgccacttcatgcttagtatgcagcaggagcagatggagaaggttggatcagctgatggatcagctgaacctcaaagcacatgaggaagaactttgggagataaatttcaatagtccctaagttttaataatggggagccacataatatgaatcaaacacatactactttctcaatacttattacatgctattgcgtgtaacgtgcttcacactcttagcatgaattttaagatgaaaggttttttacacgacatataataacaaacaatatggaacataggacccaggttcagagtcccaatatctaaaacaagatgcactgtgctcagacgtctgccttgaatgttcttagacaacctccgaggactaacctgagtgtattctttatgactgaatatgcagtttctctagggaaatgccattgttatctgaaaatctgaaacttttatttttccccccatggcaattctcaaggaaatttcagaaccctgattctccttcatcttagagcaaatggacagtactggtatggtcagatatatccttagatagcacacaaaatttacaagttcatacatgactgggcagccaagcactagaggggctacttcttttgtctgcagaagaaactacatgctacaaatttcatgtgcttacttaatgctagctatttctagctatttttagtcagttgcttccccatggagcaagttaggtgcttcctacgatacacacttcctttaaagccgctgaaggagattcagctgttctgtactgcagcaggaggttagagtgggaatccatttaaatgatgttctgcaccagtgctttctcttctcgcttcaccaatggattgagttctaaaacaagatgtataacttggcagacacacatgtggcctgagtaccagagatgctagttaaagccatatagctaggctagaactgaaggatattgccacaaggaacctaaccccatcgcatgcaaatgtgggaatatgtgctcaccttctcaactccacacttccctaattatccctaactgagccaaaagcagaagaaagccctttagctctcatcatcgggtaccagttcgatgagattctaaggctgtgaggagggacgcattcagatggtgctcatagggtctaaggaagcgtgaggaactgcgagaaccgaaaaaggaataagatgtcacctctcccaggccataagcagtgaagatataaatcctatagaggaaagcagtgttcagcttgggacagagtgtggtgagacaatggtgcaagaagataaagaaaagcatttaacagatgtgttcgataagcagcacttcagtttcagaaaacagtatttacttttgccatatagatagtctttagcatttttcgttctacttcatttattttttaaatgttaggtcatgactcactataatgatttcataagccactaatgggtagtatcctgcagtttgcaaaaacattactgtagggagagggaaagaggattagttttcattcgttgttgccattctccctgaactatccaactttggcctgaaacaaaccaaaagtgtggatgatgaatacaatatacacatgcacacacacacacacacacacacacagagagagagagagagagagacagagacagatacagagacagaaagaggcagagagacagacagagaaagagaaagagagacagagggagattaagataaacacagagaagagaaagatgaaagtaagtgtgaggtggggggtcatgactataagttccattcaggaggtcttttcaaggggaatttatgtaaatattcccagcagcttgatactgctcaataaacatatagtttacaaagtctgctgcatgttcatgcttaaggcacataggctacttgaatttacatatctgatctaaccatgaagaagatcagaacctacctggtggatggcagtggttgttgctagctgctttacccttctcctttgtctctaccacaatagcattcagcattgttttctcaggcaaaatgctcctctactgagatatccctaaccagagagacattcttctaggaggcaacctacagtctcagatattttctgattcccctatgtgaactatgttctatttattctcttaatgtctggtctgtcagaagttggctgcaagccaatcatactgtaaaagtcctatgtaattcagacttaaatgttcatctcccaccccacatttacagctttatggaggccttcaccatcctagccaccaaaaatggtattttcaaccttatagtaattgatagagaagacaataaaagacagaaagtattttccatggactctcataatagactacaaggctcctaagttactaactgcctacatattggcagctgtcatccatccttagaaactatccctgtcctcaacaaagaaaaatatgaaagcagccagtacaatgcctaaaacagagtaatggttatgtacatagtaaattagggtgtaaacattgatataagtagggttaggggacaactttaataggatctattagtctagtactatctatgatgatggaaatgtttcattgcccactccactagctgttaaccacctgcagttatggaacacatggaatgtgtctaatgtgaccaacaaagagaatctgactgtatttactttaaactcatttaacattaatattttaaagtgtgtgtgtgtaagagagagagagagagagagagagagagagagagaaagagagagggagagagagagagagagaatgtgatgtgagatagaccacagagcacttatggaggtgaaagggtaacttactggagtcagttttatctctttcaccttcacattggttccagggattaccctcagaccttcaagctgtgtgtccaagcacaagcttgtgtagtacatgcctctacctgatgagccagcttttcaacactaaatatttgagacaaggtctcactttgtagttcaggctagcctgaatcccacaatctatatcaggctgaccttgaaatcttattgactctcttacctaaacttctcatgttcagggactgcaggcccatgcccctacaacacctaaataattatattcatttaagccttaaatagtcacatatgatgagtggctaccagactggacaaaatacatctagtcactcgttataagaaaaacattttgagtaacagccactctttcactggtaggtagcattttacaaaagctagagctttttctaaatgatctccaagagccaaaagttctgtcttctaaggaatgtctttctcccattagtcaaaaggctagagaggatatacgacagccaattttagagaacttagttctcagattaaacctaaagtgactgctcccaatgaagatagttttcaaacagatagcaggaaggcctgctgaggctgctgcctgaatgtaaggcctaaagtaacaatgcttctgcctagacttttgaggtacacaattctgcacagaccccgatggtcaagatagtgaaaaatagcttgcagtccagtgaaaaacaacctcttcacattgatgcaagcaatcatagttacattcagtgggccatgcacaaaaaataaacatgaaagttgcagggactcgtttccttcggaagaaaaagtgtttcatacaaacaggaagggggtgagagtataatggaggtgcaaattactgagacacattacatgtatttaagaaattgctaacaagtaaataagtttttgaaaaatctcgggagtctaattaaagtgatcaaaagtgcctttaatttaaactcactttttcatatacatggaaattttttgggttttgttttgtttgctcccttgcttcaggctgttggactacttttaaattatggagattttatagaattctattgaaataataagttgaatggatttttataaccaccaagcctgggaattgtgaaaagcctaacgacttttcaagcgtaatgttccatcaggcctgcatttgttaaatattacaaggctgctaacttaaaaaaaaaaaaaaagtcttctggaaaccagaaatgttgaggactgtggattttaggagttggtcatgtagcagtaattttacctgaaaaatgagcctacaatttgattcctaacaataaagtgtaatgagtcaacttttgatcttaggcaatgacgccaaaaggcatgtctttcctctcagtatcctctttgttttcctctttttttctgcttcctctgcataaaactccatgaaaaacagtaaagatacatggtcagagttggtaagaaattaattccatctccatacctaggaacaggttgaaagaaccaaagtcagttttaatcattcatactaccaaactgcacatgttagaagaatacatttgcaggactaagaagcactagccagagtatttatcaactaatcttccacatcctgggaagtgttggggtgaagaaagaagtagctttcagaacaaaatggcccttagttctttttttttttttttttttttttttttttttggtttttggtttttcgagacagggtttctctgtatagccctggctgtcctagaactcactttgtagaccaggctggcctcgaactcagaaatccgcctgcctctgcctcccgagtgctgggattaaaggcgtgcgccaccacgcccagcatgacccttagttctgttatcttcagcattttgtctataacttagataacactacccaaaatgatcttatcaaattttcagatgacagagagcaaaactgatttttatttattaaccaaatcacacttttaaattacccccatgaaggtgggtcaaaaccatgaggatatcttaaagaaattgaagtattttaaggacaaaaataaaagaccttgtatatccatatttgtggggcaccagtcatggcagaaatcctttatatgtatgtaagtgtaggagaccatggaggccagaagagggcattggagtccctagagttggagctacgggtggctgttaactgcccatcatgggtgctgggaacctaaatgagatcctctgaaaaagcagtatgtactcacaaccactgaaccatatccagcccccagaaattcctattaacgcataggcttatacattcaagacctcaaagtaggagtatattttatagaaccacattgggggcttgtcaaaaaaaatatcattagcattctaggtggcactgacaaatatgtcttgtgtataccaaaatggaggtgaaacatcattttattcatttacttgtttgctttttgataggttcaatctcactagcacttgtaccccattttggctacaaacataaggttttgacaaaccgtaacatattcagaggaagatgcttagagtgatgatgtgcctggacctagacccatgttatacatcaaaagaacagctggtactaggggtaattagcttgaagaaaaggtgttctactcaaatctatagatgtttggtggtctactattagaatatgaagtaaatacttgacctttggcccctgtctctagaaaagatcaacagttagtggaagttacaaggaggcagatttatgctcaataagatgaggatatttctaatagaatcatctaaaggtagaattctgaatgacatattttatgacagggtgagtttataataatcagcagtatttaagaggatatggtatgaacagaatttcaaggcctacatggatagcttaagtacaggaaaattctgtctcaaagactgtgtgaaagaattcaaacagaatgggaagtatacatgcaaattcctaaccggtaattggactaagtattttattactttatatcatttctaaattgtgaaattttcaaacctatagaaaatgacataacaaaataactatggtttaatttttaagaattgcttttatttggagacctgcctcactttctctccaacagtatgagctaccaagtgaaataaatgcttttcgaatcatttatggcatgttaccaagtttgaagctcttatctgtccatgacaaattctagggtttattctaagacactacgaaagcatcctttttccatctagctatagaaattatttcatttactatgaatggatcactggctcaattggtttttcaattaggagtattgatagctcccattttaaaagagtttcaagtcaagatggacccttactatgtatgaggattgacagtgatatgtgctagatggcagagaccaaagctgaaaagaatgaaatcctgtggagttattcataaagaagttgatgattcctgggaactcggtaccaatatggcctactcactgacactcagtaagcaatctcggtcatttttttctaaaggaatttaagttactttcacttattctcttcacaccccaatgaagaaggcaggtcacatgttacaaatgacagatctggaagttcaatgaagtaactggcccaacgaaagtcacccaaagtattcagggttgtcataatagaaatgtttatcatgcagtgggaattcaaaggtcattagatgaatgactaaattaatgaataggcaaacaaaatttaagttcatatcttatgactgggcttcaaatcttgaaccacattatcttaacataaaggggttgatccatttcaatacattcctggacatttctgacattgctaaagaaaggtggtttacagttaaaggtgtaaaatgaattttccagaatacatgcatttgtatattagcactgtatttataagccattatagtgaagtaggataaaatgttgataatgagtgttttctttgttggcagttagatacatgctatgtaattgcagaaataactagttagactgtcagaaggcagtgcactcctgagagtagaacaaaatgcacagaggaattaaccccaagacagtcattaaaccttagaatcatcatctggagaatggaactgacaccttgttctgactcaaaattacatatacccactagggttatggagctccaaggccaaaggccttcaaggctggtgggaactgatctgtataaacccagggatgctataagctaacttccattccatataagctctacctcatccggttccccttctcctccatccccagattaaatttttagacaataaaaatgcaaggccagaaatgtaagtactcatttggtgggctttgacgtgtccaaaataaatacttttgctaagtttttaccataaaatgactctttggggattttgtagaaatctatgtattatcattagatttttttttccctcctactcaggatggaagtcgtcagctaaatttatgattttcagtgtggggagcagataaaagtcttctgcagatgggaaacagattttgaggcattttgagttatcatcactgtgctgaaatggtactcatggaacccaatgaatggagtccacagatgctactaaacatctgattagtgcccaagacaacttgcacgatgatattccaaacaaaatataaatagtgtcaaggttgagcaaacttgagatgagtcatttgtaaagttgcattcattggtccattaacaactcatacacaggaataatcctcacagaaatggatattgagatgcttataatttgactaatcaacccaaacaaaaaggagaagaggaatctaacaaaggagaaagtactgcaagcctgtgcccagttaaaaacactgttgtcatactataagaaagactgagatcatgaactgaaggtgaacagaggataaacatactttatatactttacagcactggttctcaacctgtgggtcacaatcgaccctctcacaggggtcacctaagacaatcgaaaaacacacattgcaattcataacagtagcaaaattatagttatgaagtaggaatgaaaataatcttatgattaagggtcaccacaacatgaggaaatgtattaaagggtaacgacattagaaagggtgagaaccactgttttagaggccgagtagatggagcattacaaaacagcagaacaaagaaataggagagaaagaagaggcaaatatatgctctcttgggctctgtcttgagtgactgggtgagggtaacatgttagaagaaacatggagaagaagagccgattaataggttgggaatgcaaataagaaaacaatatgctcagtctgcgatgccttagggctgtttaatggggagttggaaatgcagatctagagctcctaagtatctacttaaaattcatccacatggaagtaaaaagaggtgaaatgagctgcctagcacacagcaggacctttgtaaatgtctgttgaaagaccattatgctcggtgtaagaagcaggtcagcagcaatgtctttgaaaacatcttcattgaattgttgggacaagaggaaactgagaaggaggattaagggaggtcaagtgaagagcatttctttttaatttatttaatgtgtgcagatatctggcctgcagaatgtctgtgtaccacgtgcatgcttggtgcccacagaagtcagaaaaggccatcagatcacctggcactgtagttacagactgttgtgagctgccatgtgggtgctggaaatcaaacccaggtcctgtggaagagcagccagtgctcttaacctctgagccatctggagaggttccaagtggccagaagttaatgctatggaaatggaaaggagaattttaagaggcagaacttcatcaacaatatcaaatggtgttcaatagtcaagatccatgacatccattaataaagctgaatgcttcagtaggcatatgggagcagagtataggagaggttgtgcaaactgaggattacaaggtttccatcattacttcaataggcagaatgagagacgagttagaaaaacagtttatggtggtattagggatttgggataattggaatctttcagctgatggtcatcctgacaagacaaagacagtttgtagattaaagatacacatttgcacatcataaacattatgccttttctcagtgtattgctgcattattgaatatcaggttaaaaagaaaatcattgaggacttgtagaattgaagtgatatgtgttgtgtggcacttgagaaacctaaaaggtaaaagtaggctcaatcagaggtagtttccaggtaagacagtgcgctcccttcatactgagaggattgatccagagttaccaacctcatttcactgtttggcttattagcttaatatttgctaccaaaaatcattacatccaattcacagttctaaaacaacatacatttgttactgtccaggtctggaggtcagagtctaatataggtcttgtcatattaacattgaggtgttagcaggactgcattgagctccagatgccatgaaaaggagctcattagaatgccttttctgatgtttagagggccctcacattccttagaccatgcactctttctgattccaaagctagcaatggacacttaagtctttctcatatcactcctttaagaaatcactagtctatatgatctcttcaagtctctccaagtgttgtgcttcattgagctgctagaattcaatatactctggcattacataaagaaacttcccatgatccatctggatcagttccttcatcgctatattgttctgcttcatgcttgtttcccatgttaaatcagcaagagacttcagtttccttttttctgcttgattcaaaggggtatgaaaagtattctgtaaatggtccacaatattgttatttggatctttggaataattaagttgcttggcacttttaattatgctttttgaactacgggtggtgtaattagatgctaggctgtacattaacagtacctgtcccaacctttcagatttgggagactataaataaaagtatgacagctgggtccagcttttcttgtcactcaccactgaagggagcacagctggagaactacaacatagtccctaggaaaacaggatgcagtcagaaacaacatcctcaatgagaagaatttgatttttctactaggggagaggtggagacaggtattcctaagagaaagacaagcaaacaatttcatatcataaaggttcagaggccataggccagagatagcgttttaggaagagttagaggcagaggacagtagctcattcgtgagccaaatcaccgggattccttttgtaatctatgattacccaggaatgagactgggaaaagcagagaaggaatggatcagacaggcaaaagagaaaacaagctgtgctacctagagatgcagtgtgagactgagggcaacaacagtggggaagggtataaaagaacctgcggcattaaagggagcaaagcatgccaagggaagaaaagctgactatttgaaattgatatattcatattttatttacttatatcatctattggattttcctgtcaatgatatataagatgtaagaggacagtttctcctccctctaacagtgcccatctagcatatcgtagaagctcaataaacagtttttgagtaaataaagagctagtgtcaatggagtatctctctatacttccatactagacacctcctataaattagcccagttaaattttcacaacttttctgacataggcaccattgctatcttgattctattaaaaagaaacaagctcagaggcacagaagtaagtagcaagtaacttacttaacaagtgatagatgtcagcatctaggcttctattagctactttccccattgctgggaagaaacttctggcaaaaacaacttaaggggagtttgttttgactcactgttcaagggtatgtctataatggtggggaattcattgggccaggagcatgatgtggctggtcacattatatccatagtcacgaaacagagagatggatgctggtgctctttttactttctcctttttattgagtccagggaatggtgccaccaatagttagggtggctcttcccatcttaatagtccaacttctgaatctgcgtatatagcaatggtctacccaaggctcacagaaactaattattctacattaaatcatgcagccaagaactgaaatcaaaatctgcctgctttgaaagatagtgcccttttctctttatgaatgactttagaacattgccaagacaaatatttctcccatcagtgttttaccaagaacagccttctgaaatgtaaacaaaaaagtgggtacaatagaccaaggattcaacaaaggaaacatattccttcaaaaagcaccaatatcaaaactatcaccaatctgccaccggctctcttttctgggtgttagaaggggaaggtagctgagatctatctatgtgcctggactgaaaattaaaagttgaaggtatgttactttctgctaggcaaatacttatccacactgccctagacagctctggattggggatattgaggaaatgctgagaaggcatccctaagagcctggttcataattcattgtatgaccttctacagatacttttttatattgcagattctttatgataggtagtgtcagaccagtagaaatctgctcaataacatgagctccaattttctcttttatatacttatctttctatatagatattagacttttgtacataaaatttcaattctagcagggctggtgatatatgtctttaatggcagtgtttgggaagcagcgatctatgagacagatctatgagaacttgaggctagcttggtctacacagcaagtcccagaacagtcatgcatacatggtgagactctaatctttaaattttttcatttcaatgatttccaacaccaaatactgtgctttgaaaggcaacaaataatgaaaaagctagagtgagctgtgaggaacctaatgagctttttcattttatacaagggaatttgcatcatttctacccctctctctcccgttccaactccctttcagttttatgacctcttctttttaatattgatgttacatattgtacttaaattaaatgaatattaatattgttgtatatacacttatacagtgtgtgtgtgtgtgtgtgtgtgtgtgtgtgtgtgtgtgtgtgtgtgtgtaaaacagattattctatgagaaagttcagtgttacattcaactgtattctctgcaaccaaggatgattgtaagaatctgctctgagaggcgctgctaaggatccctatgtcccagctgttttcagaagctacttttgtgcctgctgattgtctggtctctgggccttctgttcatgctacctacacttattgccgtgaatgaaacaaagaaaatcctctacaagtgtcagtatttgctgaacctttgctttatatgaagacagtagaacatggagtgaaattctcttaacacttgttgatgtccatcatcatgtgtgtgacttttggacttgaggaaaggttgtcctaacatgtgaaatagtagagaaacatacgacacaaagttattcgttatgttacatttcttggattgactgatgagtttctgggtctttattgtattccaaataaataagcaaatttaatgaagtataaaagctctataaattactcccaagtctcaaaatcatagatataagagcaacacagcacttctttttctattagccagattctcatcgctataatttcttttcacttatttgacaaaaacaaattagtcagaatggggttctccatgctgaaaatatgctgcatctcttcaaagcctgttttatgcagggtaccaaggtcttccttttgtgattactagttgggatggagctgagaactaccagttattctctgaatcattttagttgaaagaccatgatcacttgttcaagccttttggttccatgaccattaatagggacagcttcttccttgaattttaagtaaaataagcattttccgtatttccttaaattttaagtaaaataaggatgaatttgaatttcagataaaccacaaataagtttttaatttgaaacatgcatatgttaaagctgatttattttctgtatgaaatacaaatttaattggatatgtatcattatctgctaaaaatgaaagcagataaatagatatctcatacaagcagatatttattagtgacactgttggatttggactacaaggactataagttttagagtgttcatgtcactacttactaactgaaacatttttgatgtccaaatgagcaattaaatagtaaaggtatcagtatttcttggggtccattcagaaattaaatgagactagttttatattacttaacaccgtgcctaattaagactagttatcactactattgattcttgttattttcaataacttctatttcacttactttaacgtttactgttgtctgtttgtcatcattatttttcagtatttgaccttatatcaaagttctccatttacatgattcaacatagaatagatttttccttagtatctcctttcatgctaacagaagggttgtttgtttgtttgtttgtttgtttgtaagtgttccctgttactttcacctttcatcaactagctgctattctatttttttaaatttttttattcggtatttttctcatttacatttccaatgctatcgcaaaagtccccgacacgctccccccccccacccggactctcctacccacccactcccacttcttggccctggcattcccctgtactgaggcatataaagtttgcacgaccaatgggcctctctttccagtgatggccaactaggccatcttctgctacatttgcagcaagagacacgagctccaaggagtactggttagttcatattgttgttccacctatagggttgcaggtgtccctttagctccttggatactttctctagctcctccattgggggccctgtgatccatccaatacctgattgtgagcatccacttctatgtttgctaggccccggcatagtctcacaagagacaggtatatcagggtcctttcagcaagatcttgctagtatatgcaatcgtgtctgcatttggcagctgattataagatggatccccggatatggtcgtctctagatggtccatccttttgtctcagctccaaactttgtctctgtaactccttccataagtgttttgttcccaattctaagaaggggcaaagtgtccacactttggtcttcgttattcttgagtttcatgtgctttgtatcttggggattctaagtttctgggctaatatccacttatcagtgagtacatgtcatgtgagttcttttgtgatgattgggttacctcactcaggatgaagccatccaggacaacccatttgcctaggaatttcataaattcattttttaatagctgagtagtactccattgtgtaaatgtaccacattttctgtatccattcctgtgttgaggggcatctgggtattttccagcttctgcctattataaataaggctgctatgaacatagtggagcatgtgtctttcttaccagttggaacatcttctggatatatgcccaaagaggtattgcggaatcatccagtagtactatgtccaattttctgaggaaccgccagactgatttccagagtggttgtacaagcttgcaatcccaccagaaatggaggagtgttcctctttctccacatcctcgccagcatctactgtcacctaaatttttgatcttagacataatgactggtttgagatgaaatctcagggctgttttgatttgcatttccctgatgattaaggatactgaacattttttcatgtgcttctcagccattcggtattcctcaggtgagaattctttatttagctctgagccccatttttaatggggttatctgatttttctggagtccaccttcttcggttctttatatatattagatattagtcccctatctgatttaggataggtaaatatcctttcccagtctgttggtggcctttttgtcttattgacagtgtccttagccttacagaagctttgcaattttatgaggtcccatttgtcaattcttgatcttacagcacaagccattgctgatctattcaggaatttttcccctgtgcccatatctatgaggcttttccccactttctcctctataagtttcactgtttctggttttatgtggagttccttaatccacttagatttgaccttagtacaaggagataggaatggatcaattcgcattcttctacatgatatgcaccagttgtgccagcagcatttgttgaaaatgctgtctttttttccactggatggttttagctcccttgtcgaagttcaagtgaccataggtgtgtgggttcatttctgggtcttcaattctattccactggtctacttgtctgttgctataccagtaccatgcagtttttatcacaattgctctgtagtaaagctttaggtcaggcatggtgattccaccagaggttcttttatccttgagaagagtttttgttactctaggttttttgttattccagatgattttgcagattgctctttctaatttgttgaagaattgagttggaattttgatggggattgcattgaatctgtagattgcttttggaaaaatagccatttttactatattgatccttccaatccatgagcatgggagatctttccatcttctgagatcttctttaattctcttttcagagacttgaagttcttatcatacagatctttcacttctttagttagagtcattccaaggtattttatattatttgtgactattaagaagggtgttgtttccctaatttctttctcagcctctttattctttgtatacagaaaggccattgacttgtttgagttaattttatatccagccacttcactgaagctgtttatcaggtttaggagttctctggtggaatttttagggtcacttatatatactatcatatcacctgcaaaaagtgatattttgacttcctcttttccaatttgtatccccttgatctccttttgttgtcgaattgctctggctaggacttcaagtacaatgttgaatagggattgcttccagcttctcaccatttactttgatgttggctactggtttgctgtagattgcttttatcatgtttagttatgggccttgaattcctgatctttctgagacttttatcatgaatgggtgtttgattttgtcaaatgcttcctccacatctaacaagataatcattggtttttgtctttgagtttgtttatataatggaataccttgatggatttctgtatattaaaccatccctgcatccctggaataaaacctacttggtcaggatggatgattgttttaatgtgttcttggattcggttattttattgagtatttttgcatcgatattcataagggaaattggtctaaagttctctatctttgttggatctttctgtggtttaggtatcagagtaattgtggcttcatagaatgagttgtgtagagtaccttctgcttctattttgtggaatagtttgtgcagaactggaattagatcttctttgaaggtctgatagaactctgcactaaacccgtctggtcccgggccttttttggctgggagactattgataactgcttctatttctttaggggatatgggtctatttagatcattaacttgatcctgatttaactttggtacttggtatctgtctagaaatttgtccattttgtccaggttttccagttttgttgagtatagccttttgtagaaggatctgatggcgttttggatttcttcaggatctgttgttatgtctcccttttcatttctgattttgttaattaggatgctgtccctgtgccctctagtgagtctggctaagggtttatctatcttgttgattttctcaaagaaccagatcctcatttggttgattctttgaatagttcttcttgttcccacttggttgatttcacccctgagtttgattatttcctgctgtctactcctcttgagtgaattttcttcctttttttctagagcttttagatgtgttgtcaagctgctagtgtgtgctctctctagtttctttttggaggcactcagagctgtgagtttccctcttagaaatgctttcattatgtcccataagttcgggtatgttgtgtcttcattttcatcaaactctaaaaagtctttaatttctttctttattccttccttgtccaaggtatcattgagaagagtgttgttcagtttccacgtgaatgttggctttgtattatttatggtgttattgaagatcagccttagtccagggtattctgataggatacatgggacaatttcaatattttgtatctgttgaggcctgttttgtgaccaattatatggtcaattttggagaaggtactatgaggtgctgagaagaaggtatatccttttgttttaggataaaatgttctgtagatatctgtcaggtccatttgtttcataacttctgttagtttcactgtgtccctgtttagtttctgtttccacgatctgtccattaatgaaagtgatgtgttgaagtctcccactattattgtgtgaggtgcaatgtgtgctttgagctttactaaagtgtctttaatgaatgtggccgcccttgcatttggagcgtagatattcagaattgtgagttcctcttggaggattttacctttgatgagtatgaagtgtccctccttgtcttttttgataactttgggttggaagtcgattttattagatattagaatggctactccatcttgtttcttcagaccatttgcttggaaaattattttccagcctttcactctgaggtagtgtctgtctttttccctgagatgggtttcctgtaagcagcaaaatgttgggtcctgtttgtgtagccagtctgttagtctatgtctttttattggggagttgagtccattgatattaagagatattaaggaaaagtaattgttgcttcctgttatttttgttgttagagttggcattctgtcattgtggctgtgttctttttggtttgttgaaggattactttcttgttttttctagggcttggtttctgtccttgtattgtttttttttttctgttattatcccttgaaggactggattcatggaaagataatgtgtgaatttggttttgtcgtggaatactttggtttctccatctatggtaattgagagtttggcccagtatagtagcctgggcaggcatttgtgttctcttagtgtctgtataacatctgtccaggatcttctggctttcatagtctctgctgaaaagtctggtgtaattctgataggcctgcctttatatgttacttgacctttttcccttactgcttttaatattctacctttatttagtgcatttgttgttctgattattatgtgtctggaggaatttcttttctggtccagtctatttggagttctgtaggcttcttgtatgttcatgggcatctctttctttaagtttgggaagttttcttctatcattttgttggcaatatttgctggccctttaagttgaaactcttcattctagtctactcctattatccgtaggtttggtcttctcattatgtcctggatttcctggatgttttgagttaggatctttttgcatttttttgattgttgtgccgatgttctctatggaatgttctgcacctgagattctctcttccatctcttgtattctgttgctgatgcttgcatctatggttccagatttctttcctagggtttctatctctagtgttgcctcattttgggttttctttattgtgtctacttcactttttaggtctagtatggttttgttcatttccatcacctgtttggatgtgttttcctgtttttctttaaggacttctacctgtttggttgtgttttcgtgtttttctttaaggacttgtaactttttagcagtgttctcctgtatttctttaagtgagttattaaagtccttcttgatgtcctctaccatcatcatgagacatgcttttaaatccgggtctagcttttcgggtgtgttggggtgcccaggactgggtgagttgggagtgctgcgttctgatgatggtgagtggtcttggcttctgttagtaagattcttaagtttgcctctcgacatctgataatctctggaatctgttgttacagttgtctctggttagaacttgttcctcttgtgattctgttagtctctatcagcagacctgggagactagatctctcctgagtttcagtgatcagagcactctctgcaggcaagctctcctcttgcagggaaggtgcccagatatctggtgttcaaacttgcctcctggcagaagttgtgttccactcacctgaggtcctaagatcccgtggattgtgctctggggaccttgggggtatctgcagactcagtgcccaaggtgacccagtgctagggccgactggaagggacttgtgaccctggtcagtccaagttttctgcttccccaattaatgctgtctcaggccctcacgattggattggaacagaagttgtgttccactcaccagaggtcctaagatcccatggacagtgctctggggaccttgggggtgtctgccaactctgcacccaaggtgacccggtgctggggccggccagaagggccattctttaattaatataaagagctttactatctatatgttttaaggccacttttaattcttgaaatcaaaagctctggtcttttatgctggagatggtgctagagatggtagagtaaatgaaaatctttgaaaagcctccctcaagttaatggctgattaggttactcaatgaatggctctaatcaacatcaatttaaataacatgtatagaaagcaagatattggagatatcaagaactcacgttctcataatgtggtgacaaaatgaactagattggtctctacttgccttcctcctacttttcatgttttctttcctcatgttgtatagtgactttactgtttgtcctctcaggggaggatcctaggttctagagttctcttctctaacctgcttattcccatcaccacatatccttctgtctccctacaactaattggacacattcatttgtcttaacataataatggctttaatgattgcacttcatccctctcccaaactgcagacttttaatttaatggcataaaactaaagaaatgagcctaacactggaatgtatggtttcatagcagatatgggagaccatgcaggacctcttaaatcacattgcattatgcccattaatgtctgcttcgcatgaatggaaggaggcactggtgcagataatcgaaagatcatttccacttggtttgggaatgcaccacacagtgttgttgtagctgatttgctttgctaattatgttctactgaagctaatgttgaaattggttcacattttttaagctcctctgggccagaaaagagatggggtagcagcatggcccactttgaaatgaaggaaaactgacaacaatgaggaggaggtcatgaaatgtctctatgtaggctaatgagtccactagatcaatggaataggatcaaagtagaacttggtcaattacacctgggcacaggaagtaaccaattgcctcctgtggttcaatggccactgaaaggtcagccattcccacagcctgttgacagtctgaaaccctctaaattagcagtctagatgaagagtctttgttatagtacaactgtgattgtaccattcttggacatagcaagaacaacacatttcctggtagatacattagcagttagtctgactcaatttgcatccactgcattggctgagggggaaatgaactgaagatatggaaagacaagtttgccttggtggtggcatggctacactaaggggtcactaggtaaccattgtgggaagataaaagagccttaagtgccttagaggtgagcaggaacacatgtacacgataagacaactatcacctcgtcccttcctcagtttctcggcctctgtaaacacagataatatataactaatgccaatgaagatttttcttaattattttcctgttggtcaactagactatggtaggattctatatatttttctagagtcttgactccttgtttctttgttgttctcatttgtttgtttgcttgcttacttgctagctttttgacatggcaaattcagagattaattatgcattgactttctaaccttacaagttgccacaggggacaactgacctattgaaatgtgtttctttctttctcgttgcagtctgctcccagttctccagaggggtgtatgctatctttggattctatgaccagatgtcaatgaacacactgacctccttctgtggggccctgcatacatctttcgtcacacctagctttcccactgatgccgatgtgcagtttgtcatccagatgcgcccagccttaaagggtgccattctgagtcttctgggttactacaagtgggagaagtttgtgtacctctatgacacagaacgaggtaagaagaaacatctatttttctctgtgggtattcatgtgatgatgattttcacactttatcacacatgcatccatttcttctaatagacaaagtataattctcttttaaatttgtttttagtacttagtataaatcaaacattaataactatatcaatggtaattttagaacctaattttccaaatcatatacatatatccccctaaagagtgacttaggttaaacccgcagacattatttttgcaaaagagcaagcccagcaaaactttatttgatctaaaatatataaaacatagaatattattagataattttttatctaaaaatactaaaatttccatgactgctatgtgtgtacatatgtgatctactatgtcacttagtaatgaaagtccaatctggaaagttttagaaaatgaatctagtgagattattattgccttttcaacatacagtaattaatttgttaaaagatacacatcatgctccaactaaatgtattcccaagtccagttgtctatgaggattttctcaatgaaactgagggacgttatcatcatgacattccatcaaacactgttcttatattagtcatttgcctggagactaaatgaggatggtttgggtctttctgactccaggtttcagatttagggaaggaagatacacatgaaaggtctgtcttctcagtcctgaccatacctacagggaagctctttctcctcaacataatttgaaaagttcatttgtccttggaaccccttggttttctttacattcctcttatttagctacagcaccagatcatgtcagggaacacataaacctgtgtgtgcctaagatatataccagcaaaggggattgaacttcaccaatctggatcaagatttgagtgttataattcaagatctgatactagctagctttctgatcttgaccaagtcatcaaggctcacttgaccttggtctcctcacctaaggtgaaccccttttaatgcagaattccatgcctctgtgatttttttgaaagtatgccagacacaagaaactttgtatcttggaacaaattgtaacttgtctattgccagtgagttaatctagtgattctgaaagctgctatctaccctttgtggtgtattccacccctgggacagattcatataaaatatagttccaataggagagagcaaaaagaaaaccattcatgcaacaattcatgaacaacccagaacaatgtttaattgaatgttatactagcttctggttgctttaaagactgtaaaaatgtatcattctagaaatgagagatttcagagacaactacttgtctctatggtaggaatcattgaggaaagaaaaacaggaacaccatgaagtctcaactttaaacaaagaacaacaggtaattggagaaccctgaaaatgggaaaaataatcttctccaaagaagactcccacctatccaatatcaaggagtcagcactgagatcatatgcataatattatattgactgagcaggttgtattcatgtatttaggaatatttttatatatgtcacaacaattaaagaaaaagagactgtatttgagaaacagcagtggataagagtacatgcgaggggctggagggagagaagggaaggaagggaggtaattatagtttcaaagctaaaaaattgtgtgtgtgtttgtgtgtgtatatatgagcaaagggcaatgtaagaaagaggctccatgtatctaagcaaagcaatgttgtttaagtattatttaaaatttctaaatttactcaaggaattttctctggttcaaaacacagagagtgaattagctcatttccatatattgaatatagttcaatatggatcattgtaatttagttttcagaactgaaggttgaaatcagcagcttctctctcgaaactgtaaaaattaacgattatttctgctaatgctataactgcatgcattccaaagaagacccagctcatgcattctctcatcatcatctatctatctatctatcaccatctctgctcattaggtctccaatgtgaaaaagaaggctaacatatatctatgtctgcttcttatctcattaagtagtatgggcaactgttttgtctggcagtgaaaagaaatctccctgactgatataaatctgtttctctcctctgtagctacttaacaggaaggactaacctaatatgtttttgagaaattcattacataaactttaacattaattttcatgttggaaagtcttctcaaggtattattccaaaatctatcacaaaactttaagaattttctattgcccatatgggaaatgaatacagtttgttctttaagattcagtatccttataactcagacaactaaccatccttttctccctatgcaaccttatgagactctcatactactcatttttcattgttgtcaaaacgatccagatccaggactctgatttatcaacttcctttcctctagtactgcttgaaatactctcctttattttgataatgaaaatcatttcagtttttctaaacctatagcaaattgtacctccctcttcattcatttaatagttgtttaagtttacagtgataagcaagacacatatggttcctactgtcataaagactactttctatgagctagtgtgatggctcaatggttaagagcactggctgctcttccagaggtcctgagtttaattgccagtaaccacatggtggctcacaaccatctataaggggatctaaggtcctcttctgacctgtggatgtatatgcagcagagcacttatatattaaatgaataaaatttgtttaaaagattgctttctaataagagagacagacaaaatcaagtaaataacaaattataattatacatttagataatgcactataaaaaaggattataatgtttagacctaatttataaaggatgccaagtgacagccttaatgaggagtggcattataatctgcaactaaaagaattgaaggatacaggctaatgtggaaatagtctgtgaaaaccatctgtagaaattaatgaaagtcaagtgtgggtaacaattagtgagaagaggggtggatggttggaggatggatgtagttggaagaacagagataagaggagagctgtattttagccaatacaaccagggtaaggaaagtagattctacagtgagaaggcattacaagattataagcagaggggtcaaatgacctgatttaagcttctacaattaatggaatggttaactaaggaaaattaacaaagaaaaagagccattgtggtcctgcaggtcagaatgataacaacttgaccaaggctggaggtaaagaaaagtccgagaagtagaaatggtgatgttttaactataccagttttgaggagcagaaatcttgcccacctctaaacacccaaaacccacttttgtccacactattcatttggtgcttaacataacatatttgatctggtatatagcaccccaacccctcatctccaatgtaatagtaaacagttctttaaattacaccgtacagtatttgttatgcttgcttttatacatcaatgatcacctcttgctttggtggtaaaatggtggggagatattataagatcaaaaacaattgtagatcttggtccgggacccgccgaacttaggaaattagtctgaacaggtgagagggtgcgccagagaacctgacagcttctggaacaggcggaagcacagaggcactgaggcagcaccctttgtgggccggggacagccagccaccgtccggaccggaggacaggtgcccgcccggctggggaggcggcctaagccatagcagcagcggtcgccatcttggtccgggacccgccgaatttaggaaattagtctgaacaggtgagagggtgcgccagagaacctgacagcctctggaacaggcagaagcacagaggggctgaggcagcaccctgtgtgggccggggacagccggccaccttccggaccggaggacgggtgcccgcccggctggggaggcgacctaagccacagcagcagcggtcgccatcttggtccgggacccgccgaacttaggaaattagtctgaacaggtgagagggtgcgccagagaacctgacagcttctggaacaggcggaagcacagaggcgctgaggcagcaccctttgtgggccggggacagccagccaccgtccggaccggaggacaggtgcccgcccggctggggaggcggcctaagccacagcagcagcggtcgccatcttggtccgagacctgccgaacttaggaaattagtctgaacaggtgagagggtgcgccagagaacctgacagcttctggaacaggcagaagcacagaggcgctgaggcagcaccctgtgtgggccggggacagccggccaccttccggaccggaggacaggtgcccacccggctggggaggcggcctaagccacagcagcagcggtcgccatcttggtccgggacccgccgaacttaggaaattagtctgaacaggtgagagggtgcgccagagaacctgacagcctctggaacaggcagaagcacagaggggctgaggcagcaccctgtgtgggccggggacagccggccaccttccggatcggaggacaggtgcccgcccggctggggaggcgacctaagccacagcagcagcggtcgccatcttggtcccgggactccaaggaacttaggaatttagtctgcttaggtgagagtctgtaccacctgggaactgccaaagcaacacactgtctgagaaaggtcctgttttgggccttcttcttcggccaggaggaggtccaaatacaagatatctgcgcaccttccctgtaagagagcttgccagcagagagtgctctgagcactgaaactcagaggagagaatctgtctcccaggtctgctgatagacggtaacagaatcaccagaagaacaatctctaaacagagtcaactataactactaactccagagattaccagatggcgaaaggtaaacggaggaatcttactaacaggaaccaagaccactcaccatcaccagaacccagcacacccacttcgcccagtccagggaaccccaacacacctgagaacctagacctagatttaaaagcatatctcatgatgatggtagaggacatcaagaaggactttaataaatcacttaaagaaatacaggagaacactgctaaagagttacaagtccttaaagaaaaacaggaaaacacaatcaaacaggtagaagtccttacagaaaaagaggaaaaaacatacaaacaggtgatggaaatgaacaaaaccatactagacctaaaaagggaagtagacacaataaagaaaactcaaagcgaggcaacactagagatagaaaccctaggaaagaaatctggaaccatagatttgagcatcagcaacagaatacaagagatggaagagagaatctcaggtgcagaagattccatagagaacatcggcacaacaatcaaagaaaatggaaaatgcaaaaagatcctaactcaatatatccaggaaatccaggacacaataagaagaccaaacgtacggataataggagtggatgagaatgaagattttcaactcaaaggtccagcaaacatcttcaacaaaattattgaagaaaacttcccaaatctaaagaatgagatgcatatgaacatacaagaagcctacagaactccaaatagactggaccagaaaagaaattcctcccgacacataataatcagaacatcaaatgcactaaataaagatagaatactaaaagcagtaagggaaaaaggtcaagtaacatataaaggcaagcctatcagaattacaccagatttttcaccagagactatgaaagccagaagagcctggacagatgttatacagacactaagagaacacaaattccagcccaggctactatacccagccaaactctcaattatcatagagggagaaaccaaagtattccacgacaaaaccaaattcacgcattatctctccacgaatccagcccttcaaaggataataacagaaaaaaaccaatacaagaacgggaacaacgccctagaaaaaacaagaaggtaatccctcaacaaacctaaaagaagacagccacaagaacagaatgccacctttaacaactaaaataacaggaagcaacaattacttttccttaatatctcttaacatcaatggtctcaactcgccaataaaaagacatagactaacaaactggctacacaaacaagacccaacattttgctgcttacaggaaactcatctcagagaaaaagatagacactacctcagaatgaaaggctggaaaacaattttccaagcaaatggtatgaagaaacaagcaggagtagccatcctaatatctgataagattgacttccaacccaaagtcatcaaaaaagacaaggagggacacttcattctcatcaaaggtaaaatcctccaagaggaactctcaattctgaatatctatgctccaaatacaagagcagccacattcactaaagaaactttagtaaagctcaaagcacacattgcgcctcacacaataatagtgggagacttcaacacaccactttcaccaatggacagatcatggaaacagaaactaaacagggacacactgaaactaacagaagtgatgaaacaaatggatctgacagatatctacagaacattttatcctaaaacaaaaggatataccttcttctcagcacctcatggtaccttctccaaaattgaccacataataggtcacaaatcaggcctcaacagattcaaaaatattgaaattgtcccatgtatcctatcagatcaccatgcactaaggctgatcttcaataacaaaataaataacagaaagccaacattcacatggaaactgaacaacactcttctcaatgataccttggtcaaggaaggaataaagaaagaaattaaagactttttagagtttaatgaaaatgaagccacaacgtacccaaacctttgggacacaatgaaagcatttctaagagggaaactcatagctatgagtgccttcaagaaaaaacgggagagagcacatactagcagcttgacaacacatctaaaagctctagaaaaaaaggaagcaaattcacccaagaggagtagacggcaggaaataatcaaactcaggggtgaaatcaaccaagtggaaacaagaagaactattcaaagaattaaccaaacgaggagttggttctttgagaaaatcaacaagatagataaacccttagctagactcactaaagggcacagggacaaaatcctaattaacaaaatcagaaatgaaaagggagacataacaacagatcctgaagaaatccaaaacacaatcagatccttctacaaaaggctatactcaacaaaactggaaaacctggacgaaatggacaaatttctggacagataccaggtaccaaagttgaatcaggatcaagttgaccttctaaacagtcccatatcccctaaagaaatagaagcagttattaatagtctcccagccaaaaaaagcccaggaccagacgggtttagtgcagagttctatcagaccttcaaagaagatctaattccagttctgcacaaactttttcacaagatagaagtagaaggtattctacccaactcattttatgaagccactattactctgatacctaaaccacagaaagatccaacaaagatagagaacttcagaccaatttctcttatgaacatcgatgcaaaaattcttaataaaattctcgctaaccgaatccaagaacacattaaagcaatcatccatcctgaccaagtaggttttattccagggatgcagggatggtttaatatacgaaaatccatcaatgtaatccattatataaacaaactcaaagacaaaaaccacatgatcatctcgttagatgcagaaaaagcatttgacaagatccaacacccattcatgataaaagttctggaaagatcaggaattcaaggccaatacctaaacatgataaaagcaatctacagcaaaccagtagccaacatcaaagtaaatggagagaagctggaagcaatcccactaaaatcagggactagacaaggctgcccactttctccctaccttttcaacatagtacttgaagtattagccagagcaattcgacaacaaaaggagatcaaggggatacaaattggaaaagaggaagtcaaaatatcacttttttgcagatgatatgatagtatatataagtgaccctaaaaattccaacagagaactcctaaacctgataaacagcttcggtgaagtagctggatataaaattaactcaaacaagtcaatggcctttctctacacaaagaataaacaggctgagaaagaaattagggaaacaacacccttctcaatagccacaaataatataaaatatctcggcgtgactctaacaaaggaagtgaaagatctgtatgataaaaacttcaagtccctgaagaaagaaattaaagaagatctcagaagatggaaagatctcccatgctcatggattggcaggaccaacattgtaaaaatggctatcttgccaaaagcaatctacagattcaatgcaatccccattaaaattccaactcaattcttcaacgaattagaaggagcaatttgcaaattcatctggaataacaaaaaaccgaggatagcaaaaactcttctcaaggataaaagaacctctggtggaatcaccatgcctgacctaaagctttactacagagcaattgtgataaaaactgcatggtactggtatagagacagacaagtggaccaatggaatagaattgaagacccagaaatgaacccacacacctatggtcacttgatcttcgacaagggagccaaaaccatccagtggaagaaagacagcattttcaacaattggtgctggcacaactggttgttatcatgtagaagaatgcgaatcgatccatacttatctccttgtactaaggtcaaatctaagtggatcaaggaacttcacataaaaccagagacactgaaacttatagaggagaaagtggggaaaagccttgaagatatgggcacaggggaaaaattcctgaacagaacagcaatggcttgtgctgtaagatcgagaattgacaaatgggacctaatgaaactccaaagtttctgcaaggcaaaagacactgtctataagacaaaaagaccaccaacagactgggaaaggatctttacctatcctaaatcagataggggactaatatccaacatatataaagaactcaagaaggtggacctcagaaaatcaaataacccccttaaaaaatggggctcagaactgaacaaagaattctcacctgaggaataccgaatggcagagaagcacctgaaaaaatgttcaacatccttaatcatcagggaaatgcaaatcaaaacaaccctgagattccacctcacaccagtgagaatggctaagatcaaaaattcaggtgacagcagatgctggcgaggatgtggagaaagaggaacactcctccattgttggtgggattgcaggcttgtacaaccactctggaaatcagtctggcggttcctcagaaaattggacatagtactaccggaggatccagcaatacctctcctgggcatatatccagaagaagccccaactggtaagaaggacacatgctccactatgttcatagcagccttatttataatagccagaaactggaaagaacccagatgcccctcaacagaggaatggatacagaaaatgtggtacatctacacaatggagtactactcagctattaaaaagaatgaatttatgaaattcctagccaaatggatggacctggagagcatcatcctgagtgaggtaacacaatcacaaaggaactcacacaatatgtactcactgataagtggatactagcccaaaacctaggatacccacgatataagatacaatttcctaaacacatgaaactcaagaaaaatgaagactgaagtgtggacaccatgcccctccttagaagtgggaacaaaacacccatggaaggagttacagaaacaaagtatggagctgagatgaaaggatggaccatgtagagactgccatatccagggatccaccccataatcagcttacaaatgctgacaccattgcatacactagcaagattttactgaaaggacccagatgtagctgtctcttgtgagactatgccggggcctagcaaacacagaagtggatgctcacagtcagctaatggatggatcacagggctcccaatggaggagctagagaaagtacccaaggagctaaagggatcttcaaccctataggtggaacaacattatgaactaaccagtacccctgagctcttgactctagctgcatatgtatcaaaagatggcctagtcggccatcactggaaagagaggcccattggacacgcagactttgtgtgccccggtacaggggaacgccagggccaaagggggggagtgggtgggtaggggagtgggggtgggtgggtaagggggacttttggtatagcattggaaatgtaaatgagctaaatacctaataaaaaaaatgaaaaaaaaaaaaaaaaaaaaaaaaagaagcacaaggaattctgtagggtcatctggtggtgcgtgacttctgtgttcttcagatgactaaagctacacatctcaaatgaataaatttcattctttgtactttaaaaaaaaaaaacaattgtagaatttttaaattatatgagatgaggaagataaagagagatagaaaggaaccctgataatcactttcaaataagctaaatataccacaccatgactgttctgtttaggtccagggatgaataagaaggcaagcaatgggttaagcttcagaggtcatttaaaagatatgttgcacaaacatggccaattttctctctggcgttatcaaacactgaataaattggtggaatatactgactctgctctaatttccgcctacagacaaatgtctgattcaggatttgcaagtcactgcttcacttagttaataaaatgacatcttgcttcattaatatcaagttagaaaaatatgcatttggttctacatacataaaaggtcagtgcttaagaaaattatgaggttaactaactgtgttacctaccccctctataacctttccttttatcgacttctctgttacttgtttacctagtctttcccacagtacagcatctctatgcctgccctccctgtcgggaataaaaccacatctttgcctacccttcctccacaccttcacaaatcttcatgtcctgcattttgttcccgttgattaatagtctttctctgctaatgacaacacctcagctcaccaatttattcatgccaatttatatggttactaatgacttcgtgtatccaggagaagagaaatttctattcaggcaaggaacttctatagaaatagaaccttaatccaaaaatggttttctttttattattatcgcctttaattggcacacattagttatacatattcatgagatacaatgtgatattttgatacatgtatacattgcgtagtgatcaaaatcagggtaattagcatatgggtcacatcatctatttatcatttctttatagcaaacacactcacaaaatccccttgtggttattttttgaagcatgcagaatgctgttaactatactcatgtttctgggcaacaggatactaaagcccatttcttccttctaaatataactgtacccattgaccaacttctatccatcttttgtccctcagtctctggtaaccaccattctactctccacttttataagtcaactttaatctccagctctcgggtaccaggaatccaattcgggaggttacgtacatacactgattcctctgcatagaagattctaaaaccattccaagaaaatggccacatctttcagttattacacacatggggggggtatatgtgaaagtgttctaaatagtaacacaatctcctccacaatagtgacttacctgagaactgaagccaggctttcttgagtacatgaagccactccttggcttcaatgagcagaccccatggagatgaaagaacctggcctagctgtgagcttagataatgagataatagtctgggtggcctttgagacaactagtggaaaccttctttccagcattcaataaactcctgctgtctccccttctgaatttgaaactccctacccggttctcaagtaagtctctgaaagtcaatagccctttaagagacattgttatcttctttgaaaggttgtgatagaaacagagaaacctataggaattattcttttggtcaacatcaaactgttgagatttctctagcattagaagctagctcagttgtcctagctcagttttaaaagaagcacagttggtctctgactttgacaaattgacaatcctattgtggaaaaaaaaattgaaaccaactgttgccatccctactggtgacatttgcattcatttcagcatggaccatgaaggaaaaaaaaatagagtttctcagagagctgcggtgttggggaactttgagcaggtccttgaggtcttaaggagtaaggagatcccccaagttaaggagggagggagggagggagggagggagggagggggctttcctggggggattatgaatgcttccagcttggttgggttttaattctcctgagatgggcagaagcttcctgttctcacacctgtcagcatgctgacttccacactgtctacaagtcttaacttcatagtgctcttttaccaaataaagcccagattctctctcttccacatctttactgcatttctcttatttttcttcttcttcttcttcttcttcttcttcttcttcttcttcttcttcttcttcttcttcttcttcttcttcttcttcttctcctccttcttcttctcctcctcctcctccttctcctcctcctcctctttctccttcttatttcttcctcttcacaaacatacacacagacttacacagagacagacatacaaagagataaatctgtaattctcatgttagtgtgtgtgtgtgtgtgtgtgtgtgtgtgtgtgtgcgctcgcgcgtgcgcgtgcacgcatgaatgcagtgcaaaagaatttatgctaggcaaacttctaccacttaggtctgtgcccatatctcgaaaatgttttgtttaggaaaggtcacattaagttgtccaggctggttttcaattttctctgtagcagctcagatagaccctgaacttgcaatcctgctccatcgtcttcagtagctgggattactgacctgtgcactcatgctggggtatatcatattttaaaaataagagcagctgctatttcttaagtatttaacatatatactaggtcttgagtttatagattatcacattttatcatggtagcatttatatacttctacacctgatggaaccaaggcagaaaaaaaaatcaaataatggttcttagacttatacaacatcaaagtaaggagagaaaaagtcacgtatcaccctaggtctgccacattttacagactatatgctttgctctggctagcatactgcttcccactgtctaaacatttaaaggcagcaagtaccccttccttcaattttctatagcagttcttcaaaggacactgtacttagacctccatacttcaattgtatctgtgtagatgcaatccagttctcaatttacttcttatattatagtgatcacaaataagtacaatatcttttttggcacaagaataccagggatcaacataaacagatggtcatagacccaagttcaagggcagatgagtcaaaacgatggaagcagagaaaggacaatattgttgatgcaggcagaatgcaggtttggaatgaacagctgtggtgaggcatgcatttaaagcaaagagaactcacacatccctctctgtggctaagatagtttctggaactcagaaaaacaagaatctaaaagttcatactgccaaggggctatatgcctagttgtgtcaaaaagcaaggaatgaccaacggtggattataccaaagattatctttccagccaagtgctgtgagtagcaggtgcctccatcaaaacaaatgctgttgctttgttttgctttgtcttgtctttttctcacccacttcaagatttaatgaaaggatatacgaaggtgacagatggctccaattctagtcatgtccatttgccttctgggaaaagtgaagtcaagagtgtttttattgaaatttaagttacttttttatatttgaataaattaggaaggcctggagagtacattatcctgtgagagacagatactaaattcccctgtttgagcagcagtaatcagggttgacaggacctaagacagttggtagtttttgcagcctgcttaatctattgtgatgagtcttcaactatgagagcatctcgagagcctgtacaataataccagtgaatgaatatttggactgggttgtgaataaaagactgtgcatatgtctataatgagggtttcattgaaaatgaaaatactgaagctgtcatatttttaatacttcgatttgcacatccttgactgctttggggcataaaaagagaaagtgccgagcaatttgttgtcagctcttgaaataaattatcatttaaacacttcctctccacagaggttattagcttagtagctccttcattcctggggttggactatcagtagggggagaataaaaaaaatcataagacattaaagtatcctttcaaaagctggatattagttactgtggaaattgttctcttagtagcttaacatacttttgctgtagctctccaatgctgcagattaggctgcagcaactattaataaatactgtcatattttacagctgtcatgcaaagctgaaaaaaggcttcgctgtgattagatcctgtttactgtaatatttccagctcagactcagaaaggcagttttcccataaaggtatttccataagtagaatatttttccattaaatgacacgactaattttaatatagtgttaactccttgatcacagtgaatttgaggtcaaattgatttcacagccagaggaacgttcatctccaaagacacattaaaccaaaccatcgaattttctctcttgggttgtccttcctgtgtggagatggtactcctgtcacaaatgtgctttgaatagccccctccctcttagaaggagaagtctatagagccctgcttgatttcttttcctctgccttcctgtgcccgactgaactgtttgcaagacagctattcagggtttaggataggggtgccttcagtaggctaactagaattgtgttttctgtccgagaatgtcattattgcagcaaaagaaatcaatcttttttttttctcaccacaccaccatcatgctttagcatgatgtttagaactgtatttgcatctttagggaaagaaggtgacagctggcagagttgctcttttgctctgaccttccattgctttcattaagttccttgaggaattaaccctcagtgagctgaatatctggttcttaataaataaatgttcctcatagtattaggggctagctgcaatttgctactatttctaggtttgagcctgattgattgttgaaaaggagacagattgtgtagtaatcttgcaactgtgactttaaggtttgtctcttggaaccctatagacatcaattcaagtgagggtaaagtatgtgaattgcaaaatacagtgtatatagtctttagtatcaagctaaacagagtaacatgtccaattaattttagttcttgtgattttattatactttcaaaacgttacccctcattggagggagaaacaaattctgatccctcaggggacatatgacaatatatatacaaattttagtagtatggaaaaggaatactgttaaacatcctgaagcgtacaaagacagcatcctctcccccagcatggaagtatctgctacaaaacgttggttgtaggaagacactattgagtcaatggactggtttctggaactcttcaagagaccggttatgaaccaatataccagtaattgagagtttcattttatctatgttgtcattaacaacaaagttcaatatccactagtctttaattatgaatagtttacatcattgacaaagagatgagttaggagtaatgcacatgaaacaagtatgaactagcacaaggcaagagctatattgtgtggaatgaatttcaagccccaagggatactaaagaagagagagttgctgatggacaggctagagctatcagggaaggcttcatggaagaagctatatttctgagccctcaatggaactgcttcacctagaaccaaaacaacatggtgtttccatcaatgctctccaacatcagagatcaggacaagatgtacaattaaaaaaatgaaaagagagcacagtgccttttacaaaacagaaaacaattacagagctgttgaaaatgggcaataaacaaagaacgggagggcgctactggcaaaattccattttctcaactaatgctccagcaagagtgcaatttccagcaaaatcaacagagctctctccccttgtctatcagtcaaatgcattgtttgctagcaccatggctgcacaggatgcctcaactgaaaaaaaaatttaaagagcaatacagaatatgatatgccaaggaatgggggcagtgggggcacgttagcatggagcccagcttgtccattccgaaaattgtctgtggagcagacaaagaagaagaagaagggactcaaatagtaaaaagtaaagactactttacttccccattttcagggatccattccaatcaataagttgccagtgtcagttttgtcgactccacaaaggatctgatgaattctctggtgctaactgcctcagcgggctttctcagcagtagaagggaggctaattaagatcatgtcaggcaagaaggctgacaggttaggttcctgggccacattgaacttttagaaggtgttgtttcaacttcactgccgacaggcagcatttggctaggcactgatttcatagtaggtctccagttcacttccacaggtccttgcatcaacaggcctccgttttgttaaggacttacatccttctccttggggtaattaagcgccagtgtgtttgctttcaattgcattactctggctctctttcatttgaatttttaatatgcttgtaaacaaagacaacaattaatagtctggtcattttccctactaaatcatgtgtttgtgtgctgagtgtcttaccaacatacagcatctagaggtgagcttaggacaaataaaggtagctccgcatctcacagaaggtagaaaatgggagaggcatatggaactcattataccaagttgtagcttagactgaaaatataaatagcttcccctcccccaaataaaggtttccattatttcacagataacggatctacagtgagttattaagaacaagagagatatttggagggttttttgaactaaggatttcacaaattacatagtagattgttttttgagcccatatttatattctcataggcatacaatcatatgcaatgctggcactataacccctaagatttaacgttaggagtatatcattcatctcggctgtataaaggaaaggaaaggctcagaaatagatacatgttatccaggaacattctgtctcctctcacataatcagggtttctaaccactgtcaaaagataaacacagctggacacccgacacttgagcagattttagtcagtaacatagtattgcaataagggaaggattcagcataaactgaagtcatcttcaattcttacaaaagttcctgggtacttgagagaaaacgtgagtaactgggagaatgtgagtagctgtcctcaattaccgtgtatgtgaaagatccaaataactaagaaagcttgctccacagcaaacccatgcagttttgttaagcagtacctactgaactcagcctccggctatctaatagagactgggccacataggcattatacttaggtattgactagatcaaatactaaattcatttttcaaccttgaatttctcaaacagacattttagaatgggctatgatcaccatggaatgtggccttgaactgttggaaaatatgtctgagttttgctcaagttctactaggccaagcttgagacctcctcaagtagaggtcttagaggagcctgagcagagtttaattaaggacagaatctttgtagccacacaccaagaacaccctgttctaagggatgagtggtccagttagaggcatggagagaatgactcatcaaaccggaactctggttcgaagcccatctctgtcttaaaatatcaaattcaagttgcatgtccttttgagcccccagtttctacatctgtagaatgaaggatgaattctgacattctgcaattaaaattgtccatcagtgcagggttatataagtgaaggaaacagggtgcctcttcataataaactcacagtttagaaagacatcccagatatgtaaaccaatagaatctaacacaaatgttaagtgatgtaaaattctggaagctattatagcatgtcttttcaaatgactattcttcctgggggttgaatacgcaaataactatctacattgactcctttaactagtcagagactacttaaggcatccaaatgtttcctatttggtcatctcttagtggtcttaaaacatagtctcacagtcattttcaatatctatgtttcctgtatatgaaagaaatatctcttagtagaaattatacaagaatttctataataagaggtgaagaagctttgttgcttgaacatatcatttcccaaagattcaaatgcctcactaagcagaagagttaaaaattcatctgagttttacagaggctatgacccattctcagttctggatctctgcatttaatttcccctcaaccatttatcttgatgctctatctagacttctttttccccagaaaacccttctgttccatgtactttttttcagaaatcctatctttgagtcttttagattcattttaggcatttgaatgtttttgactagatgcatatatgtgtactatgcgcctagtgtctaaggatctcagagccctttgaactagagttatggatgattgtgggacaccctgtgggtgctgatactcaacctgtgtcctctgagagaatgactgctcttaattactgagtcatttctacagccttgaaatctcgtctttgaatgttccactagcatccttcacattccaccaccatgaactctacactagtactctataattgtgagcgtttcaatgtgccacatggaagacaccctttatggctttagtctcttgcatgtagcatttgctttctgtcatttatattccttactcgatttccatccaaaacacacacacacacacacgcacacacacacacacacacacacacacacatgtatgcacacatgcacataatgaacatatacacatctatataaaaatctggaaaatatcttatccttcaaagtcctgctcaaatagtagtccctgcttactgccctctgccctcctagttatttgcctatacttctagcacagcattaaacataaaaaggtattattattaatattagtagtatttatttgtttacgtgcttatcttctgaacaataccaccagcttattgaggatggggttgctgacttgttcatctctgcaagtgctatattaactgctgagtaaatcatagtgattgattgttactattcagcaaatgaatgagggaatgaaataaccttagctataaacaagatgcagaattacataggctttggagatataatgaaggtcattgacatgtgcttaccatacagtttgaatagaacatgttctcagatcatgcgttggatagttgtgtgcctcctgtatactagcctaaacatgattttgagtcttcctgtgacccaacctccgtaccaaatatatcacattcctacaccaactgagaagcaacacagatatttgaatgctagcgatcatagttagaggctctaggtaatggacagattttcaaaactcttcatggttcctgaacctcagccaagccaatacaatccattcattgaggactctcaagggctaggatgtagctgttgcactacttcattacaaacttcatgaattctctgaatatgggagtaaaatgatattaatctccacagatccaactataaaactaaagaaagaaaattactttaaaatgtttgtgtaggtaatgctacaaacacaaaatagtgacgtgagagccaatatagtccattcttggttatccacacaagaggcaagccagacgatgatcatctaaagggcattttttgtcagaataaaagagtgtcttgtaaaaacagatattccctttggattccaacatagtttgattttcctgagtatggaaagtaaaaaagatagtccaacaaaagggattttttaggatgtctctttgattataaattccccatgtatagaaaataccatcctgattgagtaacaggatgtataggatacaaaatcatggtctatgaaaccagaattaggagaagtaaacacaaaaatgaggtagtatcaaaatctcaaaagaaagagaaaaaaaaaaaacacaaagaaatgctgcacagtactgtacctgaaagcatattggctaaggaatacaaataaggaacaaagataacgagcaataaacacttgtaagcttgataatttttgcagagaagatttgatataagacattctactccctaagaaatttgaattctgtcaactgtaaacttcccagttcccccaagcagagggccgacatattccacagatgcactttatgctactgaaaggctgagccaaggctcgcaaagattaatcaggttgctttcttggaaagctctcagcaggagcatgtacttcctgaatatccgaagaagtgttgcttgtttccactggacacagatcatagaggggaacaggatagtactatttactaaggctacccattctttcatagttttttatgcctttcaatagcaaaaaggagtcatgatttatcgacaagcgggaaattttcaaaagaaggaactacagctttattaagtgactttttatccacctagcacagagtgaaatagtaacattaaaaattttattagacccattaagctggaaaggctttgaaagttcttaggtctgaagtttgggattctaaaaaatgaatcagctccatattttgtcatgttcacgagtctcttaatctgtaattctacttaaaaagtattattcttttaaaaaatctaaaggctattcccagatctatcacattgagccttttgatcctgtttcaactattttatctgcataatgatagttatatatgtgcagtgtatgtatatatatatatatatatatatatatatatatcttatatatataagaatgacatgatgtaagctaaaatcaaatgctgagtataagcaggccatttcctaagctaaaataacagctctgtagatgagtggttagggtctgagaaaggctcatccttttgtgtccccagaatctaaaatcctctttgtaaggttctacctaatcaaattgaaagagttagcaagtgcaccttcccgtgttcttcaagcattcacctacactggtaatccaactagttctattcatctcttctgttgattagcaagtcaacaagatagtgcatcaaatagaaaaaaacctacaaatgattaccaagcaagtcattcctatagtaaacatctcgggccacatcatggctgctaagaaaagccacagacactaggccatacattgcatgtgtgcttactcaccttcaaaatggatgccataattgtccctaactcataggattgctacactggttacacatataaaagatacctaggtcagttcctggcccaaagcatctgtaattgttagccattgttatgaagggcttaacagggctataggcaagtgatgctgccctagtcttggattatagtgccatgatgcccatcctttcattgtgctaattttgattctactctatcagaatcagaacgtgttcccatgaaaagaggttggaaacacacagtaaatggaagaaatggctaatagacaatgggctcagacatgacatttctgtaagtgcagagagcctcagccccccccaaaaggaagccctgtttgggggatggctagactggtgatcaggaagtaaggcttgttttcttcctgttgtcctgacttcatagccaaccttccatctgttcctcatatgactaattgtaaatctattgattaaaaaataatattgttagaaaagcttggaacaaagcttttttgagggtttactcagtatatatttaatagaataatagagtagaaatggcattctcttcatttatatccaatagaaatgtttaaaggtaacttaacctgagcagataacttctttacaaagtactaaagtcactgacacgatccaaaatatacatatgcattccttcttaactaagctgtcacagctcagtgtgtgtgttttctgattttttatatttacttattcactttacatcactatcatggccccctgcccctcctcttctcccagtcccaaccttacaagtccctcctcccataaccctctacctttctcctcagagaaaggggatcccaccccccttgagtaccactccaccctaagacatccagttgctgcaggactaagtgcatcctctcccactgaagcccaaccaggcagtctaggaaggggaataggatcgaatagcaggcagcagagtcagaggcagcctccactccagttgttaaggggccagcatgaggaccaagctgcacatccgctatgaatgtgtaggggccctaggttcagcccctgcatgctcgttggtcgatagttcggtctctgtgagctcccatgggcccagactagttgactttgtaagtcttcttgtgttatccttgacccctctggcttgttcaattctatcccccactttttcataaaatgcaccacatgatgtttagctgtgggtctgtgcatctgtttccatcaatagctggatgaagcctctcaggagacaattatgctagactcttgtttgcaagcagagcaaaatatcattaatagttttggggattggttcccttacatgggctgtgtctcaaattgggccagtcattggttggccattccctcaatctctgctctatctttatctcagtatcttgtaggtaggacaaattttgggttgaagttttctgacatatttttaaatcttcctagactatagtacataataaaccctagaaattagaagcaaagctcagtttgcagtcttgcatttgtttggcttaagctgctgcatttaaattagaaagatagacaggtgtggtggtatttaatcccagcactcagcaccagaggcaagcatatttctgtgagtttgaggccagcctagattacagaaagagatccaagacatccagggctgttacacacagaaactctgtatccaaaaaaaaaaaaaaaaaaaaaaaatcaattaaaagaaaattaggaggaaataaattagaatgtagttccaagttcccttccggattctccctgtgactacagatcaaaccctgaagtcattgccaaacagctgcatggacacagtcatccggctgtattaacctgaggggggaatataatttgaaatcaaagaacagatattagagaacatgtaggatatcattttgtagaagataaaaagtggattattttgtggtttaaagtgaacagatacaaagatgtgttattgcataccttcattaataaccctcaaagatctgaagccagtgtcctccagactatagcttctctcacttgtttttattttattctgtttatctgagcctgggttcttgctctgcagaccagggtcattttctattcacaatctttctgcctcagcctcctgagtgctaggattacaagtgactaccattatgcctggactattcctaccaagcagattttctgaaatctacagtctactagccatcttttcttaatgccgagatgagacaatgggtctggtaatagcttctttttttctctaaggcaaatcttacaattcggttttcgtggtggcatacatcagctagctatatgatattgagctacaaacctctttgtgtatctgtaaaattgaaatgtttattagtatctacttcattgagctgctataaaaattaaataagatactatgaacatgattagcagagtatctgattaaaagaaatatgctcaataagtggtagctatattgcttatgataatgcttaaacttctttaaaggcaccaatattaaactactattactataatcaccaaccatattcataaataaaaagaaggaagacacacaaaattggggctgtcactgaacattctaggtgttttatcactatatctatatgtgcaacttcctctcagtttaacaaacgaagaaatggggaaaatataaaaataggaaacaaaggcaacattcttcaccctataattccccatagcctctaataaactacttgaagctttggggatctgatttctattcttagcatgtatatattttgctctctgtgtgttccaacacagaattagcaaaatatttccatacatatttactctcataacctcacccaatatgtaactttgataccaagaaatggtttaatgtgagtctactgaaagggaagaacattcagttattctaattaatactgttcaaaagaaaacctaccgttctaaatacttcaaggtactgtccccatgtattgttggtttggaaatgaaataaatctatgttcccaaagaagagaatggtttgcccaaggttatacagctaataaaaaagtaaaagcaagctggactagagcccaaactttcagacatcctttcgagaaatcgttcttctccatcagactgctacatacctttaaggcaagggcttattttcttaaggactatgaaagattccagctttaggggaaagtctgagtgctaatgaataactagttcctcagactagtatctaccctggatggaacactttttatgtgccaggctctgcagtaagcctccaaaatgtatcacctccttcgatcttcagagtagttttagcagagactgactgccatggtccttcttttacagatgagacagtagaggcacggaaaggttaagcgatttgctctcccatcactcttggaggaagtggtggagctagcggtgtgcattctgcctcctcttctgtttaaaatgttcttcctagcactccacactgacagccaccttcagctctcctattcacaaggaagaggtgttatttttaaagctgctttgaggcagaaagataagtggtactctctcagttcctcatactgatagaagagagaggtacacaaagaaagcacatcttgcctaatatgaaaggcagaaatttgcaactctgaaggagatgtggagtctagtagagaggacttggtaggggaacattctctctcctcactctccggtcggtcgctagtcacagctggttcttaaccaaattgaaatgtgaaatcacagttgccaatttttagctttttcccactcctaagattctagccacattcctacttaacccacatccatcacccaaactgccctgtttccttttatcaagaactctatcagacagctggagccacatccaatgcttatagctaaggagcacaatggcccccattttagtgttattgcctttctttttttttaattagatattttctttatttacgtttcaaatgttatcccctttcttaagaagtacctggctgctcttccagaaaattcaagtttggttcctatgatccctatggtggctaacaatccactgtaactcctgtgtgtggtactctgatataaatgcaggtaaaacacccacatacataaaatatcaaaaaaaattgtaaaagaagtcccttctaggctgttacctttaagcatctgaagaagaagcagggccagttagacgagaaccagccagggaagtgttgtcatagctaactcactaattattgaagtcgaccattttcattttcttgccttcatatatcttccccctgaggatacaaatcggtgcaaatcatcctaaagacaggaaaggtgaagctctaagtgaacacttagactgggaaagggaaaaatcagtccattattttaagatctcttgagatgctgtaaatacacaggcaactcagaacaaagatcccttttttcccccttacattatttatgggccatctaaaaattacattcccgttctctttccagcactgagagagaaacatgcatattcatgatctgataaatatttaagtgggatttatttaaatgagagagaccatttacaaacattccctggctctcagatcttatcctgggcacacagagggaggataaatcccactggtagattcaaaacctccgctggccacctgtccccccaaacttggagcttttccttgagaactggtgaatgccacccgcaatattttaagggagccttgtgcaccagctccctccagtcctgccttccttcctgttgtgagtcctgcttccatgtcttagcatccatcattagcaaaattctgtggctggaagtttatatgggggcagcaagtctggtcacagctttctttgcctgtacttttccttatacaatcctcaagtcctacagcaacacccaccactaatagtcactctgcctatggatgtatctcttcatactccaggaagatagttataagacatacctggtaacttagactagttgtctattaagcaagcattttgacattttggaagcatttcagaggtagactagcaaaatggatcagcaggtaaacacgcttgctgtcaaactcgatgacctgggatctatccctatcacccatggtggaggagagaactgacacctgagtgttgtcctctgccctccacacatgtgtcatggtatggaaacacctgaaattatacatacacatacacaataacacatgtgcacacaaataatacatttttaagaattatttatttaaaatttattaaatattaattatataacatttaaatatttttaaataaagcaaagaaaaatacatgttttgttattaccctgtttcccaaggattttatacataccatgctttcatgacctcctcacaactgagttaccaagcatgttgacatacctcacatatcattactaggcagggtctcaagtggagggattgaggcaccaacccagacacaaaacctttgatctacagagtgttctaggactggaatctgacagaattgtcatcagagggaccagagaggcttcatccaacaacagatgggagcagatgcagagtcctacagccaaacattaggcagagctcagggagtcctgcagagaggaaagttcagaggaaccagaggggtcagggacaccaggaaaacacaaaatcaactgactgggattcatggggtttcacagagatcaggggtccttagctgtctgacctaggttttccacatatatgttatggctaaatagcttagtgttcttatgggactcctaacactgggagcaggggccatctctgacttttttgcctgcttgtgggcccttttgctcctgctgccttgcctcatccactgtgaatgtgatagtatgtgcctggtcttactgtagctcattgtgccctgttgggctgatgtccctgggaggcatgctgttgttaaagaggaggcaaagaggattgtatatgggggacagaggaggtggagaagatagattggaaagaaaaggatgggaaactgcagtctggatgtaatacatgagaggtgaataaaatttttaaaaagtagtacatgaaacaataaaaaaatgagtcatttttccagtctgaaagattaaaacaaacaaaaaaaaatatcaggaagatgttgtttgcccaaaataaattttacagtttgtaagttgcagactagagacttgaacacgtgtctgactctaagatctgggatctcagactacctttgagagtgctgggagataaagcaatgataaccaaatggaaagccaatgctgatgtatggacagtttaaccacaggggtggagaagctattgtaaaagagatattctttgtatgagacaaggtctggattctccattccaatatccattcttaggtaccacctagatattgttgtagcacacagttccttctttcccaaaagaaaatttcatctattttgtgtctcatttccacagtttatccaataatcattgaactgacctactaaattagtctgggtagggaactgcttgcttgttaatatctcaagatgcaactcatcccaggtaatatatgtgttttgagagaagtttctaattgcctgatagagggacactgtacatagctaggactgcatgtaaggagccaggccagtgagagataaaactctgagtttctcaggttaactagtttgtactacctaagtgactatctaaactacctaatttagacttgccagattaaaatgtaggtgatccgtcaaaattttattttcagataaacaaaaaggcccattcttatgagtacaacctaaacagaaaggtcatacttaaactagaataccatcattttaagttcaaatttacttagctttgtctgttttgctactatatctggcaacccaaatttaattcaaagtcttattctaaggagaatcaccatccagaagtgactttgggtatctgtttgcttgggacacttgccagtgactaattccaaagcacagggctgagtgactgaaggctgtgagggaggaagagagaaaggacagaggaaaagatcacatggtaagagtggcccttatcgcctctataggacagaaaaggtaatgtcattaaagcattttacacaatagccttatctgcttcttaccaccaaccttcctgttggtgtgctgttttcctctaccatttgctgcccactgatagatgaaaaggcatgcagagtgccattgccaggctctgtgttctcagggagtgaactgggcctcagaagacacatcacaagcaagcagcaagacaggctgcaggctgcagccaaagcactgcacagacatcagagctgccaaaatgtaattaagcgccaagcacagaccccaagggtgatggtgggaagtgtttcatgaccaaaatacagagagagagagagggagagagggagagacagagacagagatagagaaagagaaagaagtacaagcatagatagatagatagatagatagatagatagatagatagatagatagatagaaagaaagaaatggagtgaagaatgcttataagcctaattaacaatttttacaacatcaaaatttaacatgttgccaatatcagattcatactacagaagccaagctgcacccaagggaagggagtattcaaaattcttcctacttgggctagtgcagtggatgaggcacctaccaagacgatgaaattgagaaaatgaccaaattagaatagcaaaagggggctggatcacatgcaagacaattaattacggaggctgaggagtttgaactccagaaatgaagccattgaatggtaatcataacggtgatgatcatgacggaaatagcagaccttactgagagctttgtatgtgcccggaactgcactctgtactttacacggcttgactcactttatcctgacaacaaccctgtgaggcttgtcaccaacattttatgaggtgcagaaagattacataacttgcctagagtcacgcatttattgaatgatgaatcagaaaattcaaatctaagcagtcaggcaccaaaggccatgtgcttaactactaggctctaccagtgctctaatctgatcttgtttgttcacttgcttctttgtcttttttgtctcagacagggttttgctaaactagcccctagctagctctgtagaccacgctaaccttgatctcaaggcagttctctgctttccaggtgctagaatctatctgttcttgaatagactttcccaaaatagttacaaagtcctttcaaacacttaagccttcttagcacaaggatacccacttgtcaaatgggcaaatgtacttttatgggcctagaacagaaggaggctttgggggccttctcagcctcaccatgctctcaatggattaacaaccactggtctcttgtcagtatagcagaattaagtttttattttcggctttgactttggtccttgtagagcaaactggagcatacatgtctggtggttctttgaatttcttgaagaatccttgagatcatgtgagtcttctgataccttagtctataacctctgagactcatagtaaatagcatcccatgtctatgaggctgttttcatttgtcctggtggaatcatttgttccttttagaccccaactctgcctttccaccattctatccaaaacatatctgtctcttccacaacaatataagaaagttggggctgaagataatttacatgtgtatgtatatgtatgtgtgtgtgtatgtatgtatgtatgtatgtatatatgtatacatacatacaaatacacacatatatggtggatagtttcataagatacacacaaatacttatcaaatgagtgaaggtattccaacttgtcatttttacacatgagaagacaaagtactcatcctaaagtcccacagtagttcattggctatggcttcacactcagcccggtgttccatctactctcagagaatgtatttctggagactctaaacgagtcttttccagtctttcatattccttttcttctaatacatatgcttttactccaagaacctcctggtcccatgcattcatggtttatttggaaaatgctgattcctcttcccacaatgtattcccttcccttgagatcacatgttttagaaattagacagcacaggaatggattattgctattcttgtagcaacttccattgggcaatgtttctgtagagacagaaatttcaacttctatgtctagtttgtcaagtccattgtgacatggtaactactagcttttcagcacaaagacaaaaaacagggaggaaaaaagtgtaactggagaaaggtgtgggagtctgaggatggaggccctgccatgctacagcaaaggagtctaaatcctattgtatacaatggattctgccccgaaatagagcctggtgcacattgataccaggcttaaacgtgcctttataagaaagcctgagagaaagattttaacatcacactagtgactgagtgctctccagaagtgacaagaaagattctggtgtgtacagaaaagacctgacctttgaaatggactcacagaatacatagtcacatccccactctgctaattatcagtcacaactttgctaattattagaaatgtaatgttcacactgctgcttagcgttattgagtttgcttgtctgtttgacaacaaagtcagtaatgctttttcttctgagttttgtgataagtatgataatgaggcaggtgagagaattgtctcagcataagcttgaacacacactcgaagtgattgcacagagcatatatagttcaaattctttgaaccgggtgacctctgaaggacctctaagctttgaagttcaagctttgacccacactaagtaaggtcagtggtcagtttcaaatacttaggaaggtccttacagcatgctgcaggtttcataactaagcagtgttttggtcatcatgaatagctctaatttctacaaaaagctgcctttgaaagatcccttcccaccaaacaatggatgctcccagaatcccatgcaacgatggatatttatttgtcttgtgaatatttattagtactccccctaaggtcccacaatagttcatgggctatggcttcacactcagctcggtgttccatctactatcagagaatgtatttctggagactctaaatgagtcttttccagtcttccatgttccttttcctctaatacatatgtaagtaatcatttaaaagaaccaaaggatttagggcttgggtattggctccaatgttgttcctctccacgtaattgctttacttcagggaaaaagaagatataaaacagctttcagattgaagttcagagatgtgggagatgaagaggacagagaggggctggtaaagggaaagagagatgggaggagaatattctgattcactcagatagcatcttgccaagccccggtagagtacagcaacctcttgtccttcccagtactttaatcctccaaagatttctctaagacccaggttttcttctacatcaacaatacatggagacctggcattccacctcatggctcaagaatttttcaaggccctgaagtatgtccttatattactgaaagggatacaattttgctcagcccggtgcaatattattatttatgttttgcttcatatttactccacggaaatcacaaagttctgtcaaaagcatactggtgtgctatttaatggatcaaggcactctatatcccactgggcccaaaactaaaactttgcaagactgcaggtgcatgtaactccatctttcaactgaaggaaaaacatcacccaggagatgaggagtttttcactttcacaaacaagtgtcataattccaaataataaagctccccgagcaaagcaatcatcgccagcttgattcccaaccagagtgcactcctgagttcatcttgaaaaaacaggccacggttgcggatgcccaaacccaagcaggtcttacagccctttcttctttgcactatgctttcactttatttcttgtgtaactgttgcccctacactgtacagaggatgctccatcctttctgtgaattttcagtcaagctgttgaatcaattccatggctaaaagccaaattaaaaacgcacacttctttttattaaaaagaaggcagctgaggattagtccatcaaaattctcaaggaatgaactgttctaattaagagtcttctaaaaaatgcttcagctgaaacaagaaggatgctgaaataattcagtaagttgggactaattttgacaattttttttctgttgtatcttgttctgtgatctgcacacaaaatactactgactcttgcatgggccttgagttactattttgaaaatgtgtatttccaaggttcaggattacaagtgaagggaggtatagctaaaacttgaactaaactcaggacacagcttggaaaaagtgtctaatttctgaagtttatagtttgttacttattttaataagccaatggcatggtgtgctagtcacttttctattactgtgataaaacaccatggcaagggcaatttcagaaggaagggtttatttggcttatgtttataggagcataagagtccatcatagcaggaaagggcagcaagcagcaagcatgagcaacatgaacagctgagagctcacatctctaaccaccagcaggaaactgaaaatagcctgggattgccatgatgcttgaaacctcaaaagtctacctcccttgacattatttctccagcaagatcacaactccacaacctacacaaacagcaccaacaactcagaaccaagtatttgacatctgagctatgggaaacaatctcattcaaaccaccacacatgaaaagggaacaatattgttaataaaggttctgattacataaaatgcaatacctctcacttcttcatacattttcatgactgatttcttgggagataaatttctgatttataaactgaggcagaaagatgccaaggaaattatccagtgatgatattagtcaagcttctgaaactccagtctactgattattctgtccaccacactgtgatatctatgtcacttcttcatttactagatttctattgacttcctctcaagcaggccatactggctaggctcagttaatctcaccacagtaggaattacatctgaatatgtactcagcgttagtagcactaagaatagcttaggtgaaagtcatgggtttgataataatggttgccataataatgtccttatgcaccccagttgagagccatttattttgcataatatgatctttgcatactaaatgctcgtttgcatcttttgaggacacttgtctatggcataattttttcagaaaggttctaatgtcttgcaacaatatactgatagacttctaaagaatattactttaaaaacagttgaatgtgtgttctgagattgtgtggcctttagataattaaaaagtagtaatcaccactgttttttatttgtttgtttatttatttattcactttacatcccattccttgaccccttcctcctgaccctccctcacacagtcctttcccccacatcttcctccccttctcctgtgagagggtggaggttccccctaggtatcacacacacacacacacacacacacacacacacacacacacacataccttggcacattaagtctctgcttggctaggcacatcttttcctactaagaccagacagggtagccttgtagaatgagctatacatctgctatatatgtgctgtggtattggtccagcccatctttggttgatggttcagactttgagagctaccaaaggtccattttagttgattctgttggtcttcttgtgaggttcctatccccaccagggcccttgatccttcccccaattcttccatgaggcttcacaaattcagtccaatgtatggattccactgtctttttgtttgtttgtttgtttgcttgcttgattgattgattgttttgggggggggtgataagctcctaaggtatttttattaggtatgtatttcatttacatttccaatgctatctcaaaagtctcccacatgctcctccacccactcctacttcttggccctggcgttcccctgtactgaggcatataaacttcgtcaggtgacagaagatgctggcgaggatgtggagaaagaggaacactcctccattgttggtgggattgcaagcttgtacaaccactctggaaatcagactggcagttcctcagtaaattgcacatagtactaccggaggatcccgcaatacctctcctgggcatatatccactattttttaaattactcttttaagttgataaagccaggaccctctttcagaaaaatgggtcctaaagttcccttatatcaccagggcaccttagcaggggccacacagtcctgttccctatggtatttaagaaagctcactcattgccagtatgccctagaagctctttacaaacctgctttcccaaattgatctttaacatactgaaaattgcccaccctgtcaaatttaaatgatcactataaagatcaactcgtacaattttatttctgggactgagggcattaagatctcagagactggaagctgcttcaatcaacaatttcatattcacctgctctgtagatagcagcatatccttggttagaagttgagttggcatagagacataaaaggtgcagaagacttcaattttggtaattttataaggtaatcacttatatagataagtatgtcttaaactctaacatacattagaaacatctggacaattggcttaaactcaaactctgcttcaataggtctagaggaagttccccaacaatctatattttcacaagtttccaggtagtgccaatgataattgtccaagtagtgtactttgaggcacagatattactgagaatctgtgactatctaaagatttaaaagaaagattgcagactgtgtacgggaggaaatcaaacaaaaggagctggatagtgttatctgtcctcctccccttctcctcccccccttccccttcattgcccacacagggtcatatgtccatgcttcgcagtcacagaagaaatctccctgatgcacggaaaacactcacattttcttaccacaattgcatatgctggagccatttcaaatggaaacatctgcttccttcctttctctagaactaaaaggggttctgttttggagtcagccagggacatcaaaaggggcccctctcttaccactttaaaaaatagtgtttctcagagtcacattcccagtggaacagtggttgaatcacttggtatattatgaggagtggacatgaaacggtcacacacacacacacacacacacacacacacacacacacacacacaatcagtttcctgaagtgacacctaagaatttaatttgaggtatgcccaattagataactcctcatataaggaaaaacaccttgagcaaggactctaaagatgatctcacttctctcatctgacctgtagttgccctttcctgcatttacatatcattaagcctcctgagactaggatagggaagcaggtttttccatccttcagtttcccacaggattcctcacctcaaccccaccccacgggaatctctgcctgggatatatctcaggtggttaaatcacatgattctaagtgcttaacaagttttacccaatagggaaaagatttgtatttaaaggatgcttttaatctagtttctctcggtgggttttgtttttgttttctggttggttggttggttggttggtttggtttggtttggtctttggtttgtttggggtttttttgttctgtttgtttcttgtttctttgttttatgactaatgcttctttacggcacagtggaggtacttcaaagccttcgaagctgttgatattctctagttctccatatcgatttttttatttaattttatttgtaattcattttttacactccatattccattccatgcccctccccatcctccctccgactgctccacatcccacacctcctccccaccccaccctgtctccacgtggatgcctccataccctatgccacctgacctctaaactccctggggcctccagtctcttgaggattaggtgcatcatctctgaatgaacacagacccaggagtcttgttctgtactgtatgtgtgttgggggcttcatatcagctggtgtatgctgtctgtttggtggtccggtgtttgtaagaccccaaagtttttatctttttaatattctaagagttccatggtgtgtgtgtgtgtgtgtgtgtgtgtgtgtgtgtgtgtgtgtgtgtattgaggcagagtattgctctgtagcccaattcactataaaaataactaaatagcccagattagctaagatatcatggcaacccatcagtcttaatcttgtaattgtggtgatattataatttatattgaaataatgagagagaattcaaaaatatggtgaggaaagtaattgaaagtgacattaattagaaagatggctagataccaagtttggaactccccccgcccccgcccatagcactaaacactgtctgttccattctcttcctgtatttctagagttggggaaagacttccagcttggagatgaaatgcagccttttcatgggttgacagctatgtctgcctgtattttcactttttcttttgttgtcaacttatggcaaatacatatattgtgtcccctgagatagtgactgcatatcatgtatgttctcattatgggcttctcagaataattctgcatatattgagtgcacaaagtaaacagaatttattgtgacacttctatatatgtagatcatatactccaatcatatcatcctcctctcttttcttcttccaaatctgttagcagccttccttttataacttgcatcagttagtgtaaatcatttctgtttttgtttgtctgtacctcatatgaaacccaatctggcactgcaataggtaagagtcattggactctgtagctggaaagagtgataagagatcacagtgcgcatggaaggtacggagggagagtaggaaaacaaactagttgagggttaaaggtaataggcagagaaacgagaagaagcaaaagaaaaacctacaaagaagacattggatattaaagtaattaaaactaacactaacaataaataacatttatataacatcacatgccttataaactgtgctggaagcacttcccacacataaattcatttaaatctttgcaataactttatgaattagatgcatcatcattattattgtactttatacacttcagacagtgaaggcccaggattgtttatattaacatacagagtaataggtttcctgatgacatacagcattcttactgatcttccccttccacttccctctctcatcctcttgtccctcccttgatccctaaagaaacacatagatttaagtcaaaattttgtatttgtaaagcagagccaatggaagaagaaagtgtgatcaccagacgtttactttacgtaagtcaataatccttttttttttccaagtcagtttaagccgggtttctgtctcctataaccaaaggagttctaagttaagtgaaatgttcaagttcacgtaatcttgacaactcaatgcattaggcactgctattattattcctggtttgaaaatgaagaaactggggcacggagaggttaagtaacttaccctgagtcatgcagctgataagtagcaaaattgtgagctgaactcctgcagcctgacttgagactctgtatatgtacagcaagtgtactaagtgtatttagtgaaaaaaaaatagagcatgccaccagtgaatagtggaaagcaaaggtaacttcattctaagaccatgctttaatgagtaacctggcaagcatatagctaccctttcatattttaaaggaatcaggaactacacaggttgagcgtttacttagaggttcctcttcaatgggaaaccagaatttctggttgtatgcagcttagactttccagcaaggaaccctctactgaaaccaaagctcgtgccaggacctcctgtatcctatggcactctcttccaggatggtggtgtaacacagtggtggatagtttgcctagattatacaaagcctgaagcttaatgttcatcacacacacacaatttttaaaggaagaaagtccctttgagacaggaaaaagaaattaagatgaagacgtctctgtcactagaactggaaatatttcttagaacagcaaaacagcagcatgagaccctgggaagtaccttactaagatgcacaaagccagcatcaattgagcaaagcctacttttgatccttacatgtctgcagcctctccccacagaggcccatagcatccttggaggctttcagacaatccctgtgagctctgtttcttccacaagtgtcctaccgttctaactgcagtagattcactgcagaaaaatgtgagaatgtttgtaatgtttttgttgttgttgttttaatgtgcagaaagcctgtctgctggggataaatgttggccaaagagtgatcatttatccatcagaaatcaagtggttaaagattacaaataagctttcattgattttaaaactattaagtggctcccctgataattctcagctgatttatattagtcagtcacaatttgtggatagataacattaaaaaatgttatgttaagtaattttatattaaaacaaaatcaggatgtacttcacttaagaagcaaagagtaatttttgtcagtctttgtgaatggctcttgtttcccattcattaaatgcttaacaattcttagagcttaaataattaaaagtataggagagatgtggagatttttaaaaaatcaatctttgcttgtagtgccattccaaaatatgtcctgcatggcatagtagatcttctctatacgactacttaataacaagcattctgcattttttataattatgtgtgctgccaacagtgtgtagttggatttattgtgcactgaagcccccagattgagagttatgtcttacacactctattataatgaatggcatggaagggttctttgtgtcacgggatgctgagttggatatttaaatagcatgccccagaaacgttctacattatggtgatgctgagagagggacattgtctaaagtacactgtgatttaagttgtgtggcccatagttgtaactgcagctcattgacaggggattaggatctataaaataggaagaaagaattgttccaataaaaccccagttgattagaaggacatttgggagaaatattaactggttctgattttttttttacatgcaggaagcaaatcatagtaaaacataattctcatagtattattttgttgtttttttagatgaaaagatctttatttcttagatgaagtcttatttaaacagcattataggatattaaatatgaactatgattaaagcacaatacatttaaagcatctatatccaatcatttctattttttcttttgttgtattcaaagttagtcatgacatatgccttgtgacaaaatctaaataaagaaataaagtgtatgtgtgcctgcatgtgtgtgtggtgtgtatatgtgtgtggtgtgtttgtgtgtagtgtattgagatgtgggggtgtgtatgtgatgtgtagggtatgtggtgtgtgtgaaaaaacaatacattcatttcctccaattcatttttaaagaaaactagtaaccaagaaaaaataatgcacactctggaattcatcttgttttaaaaaacctacacaaagaatatgactgacagaatttgaagaaaacgatctaatttcctgtgcctctattttgtctccatcctttatgatgttggaatgtatcactaagataagccatatgtgagtagaataaaacgtgtcctttctgtgacacacacaaaaaatattcaacaagcggagcaacatattgtattaaataaattatgatctcaacaaaaatcctaaaaatgtcaagataggattaattattattgggcacacatttaaatactttttccaactccctatatgtatgctggaaaacaaatgtcttctccctccattccaaggtgagagggaaatactaaaggtgtttaccaacatgcctagctcagatctttaattgttgagattataattgcaatatttctccctacccttttcaaaacaaccctggcctcttttttcactgttattgtatgcctatctctctctgtctctctgtctctgtctctgtctctgtctctgtctctctgtctctctgtctctctgtctctctgtctctctgtctctctctctctctctctctctctctgtgtgtgtgtgtgtgcgtgtgtgtgtgtggtgtgagtgtgtacctaaatataacctgttgagttcatataaatgtagttgtctatatgtctctaggggtgatgatttaatgctgtgtatgtgttctccctgggaaagcgcgcctcccctgctaccttagacaaagtctttggatctgaactttaacaactggtatgagtactttgtcaggcatagtggggtgagacaactctcccataatctcccaaccagatgaatgtaccagatgtatgtagaggacaatgtaagttgtatgttatctgatttctggcccaatgtccttgttactcaattgtgctatctatttcttgtgctcctctggttaatttactttgagaaaagcatatatttcttggatattgttctcttatagtatatgcattaatcttttttctttttctctctcctattcccgctactgccttatccaccccctacacacagatttgtatatatgttctggtctctggacactatgcaacacattcaaactctcagattatctaaacaggaggagaaacgtcatggtgtataccctctgaaattactttggcacaattatgccaatagtatgcaatagaaaagacagtgttaactacaaccagcaaaactaaataggcataattggcattactaatttgtgtacacaaataataattacaccactttccatccaaagttcaattaggacatgcaaagttctcatagtttactggatcagaaagtggaaaacttcaccaaagctaacaataaccacagtaatgtacagcctgcacctcagacatatctttacatcgttcgcagagactgtaagcacacagccatgcacgggatagtgtgcttaaggatagcttgctaaattagtgattgttttccagtagtccctcatttacatattattcctcacacaaataaaatgctggatttcactccacgcagcaatacataatcactgcttatcaaatgtagtcagtcacacgtctccaaaccataccagctataaagaagattctgatgttactagaatatatagcctggctactatggagtccataagacagaagcattgccaccatctggatacttttcagatgtagaactctaggccaacagaagtagagtccacatatacaaaattctcatgtgattcatgtataccctacaggagtatctgttcatcccatcgcacaatagcagcagtcacactgtatgctccagttcaaaaacatctcctatgcccctctgactctatagaaaatataagggaagaggcataatgatcgcctaggataatctataatctaatcccaaattgtgttatttctattgcaaataatgtaatcatagagaagatttgtaacttactgtgttattgatagaagactattgggacaagggatcattaataagctactagtcagtatttttggaatataggaaaaccagtaataataactaatatttatcaagtacttattgtttgccagtgcttgttacttggctttttttttttttttgcacataatccagtttagtttttcatgccaagtcaatgtgctaggtattatatagttgctaaatatggcagatggtctggctttaaatcttgtatttaatatttgctggctctgtgatcatagacaagatgttttagttgcatgtgccttagtttcttcacttataaaatagcatctcacaagcagtcacgagaactaaaggaattaatatgcataaaacagttatatgtagaattaatacacataaaacaggaacagtatatagtaagcatccaataaatgtctgaggttactatctacatgctattaatgaatacatttatacacagaagttgaaaaacttttccaaagtcacatagccagtgagtgggtagagacagaacacaaaatcttcttggtaagatacagaactcatgctattcaactctgaatttcatgatagaaaatctttctcctcactcatgccttatgtgatagaaatttgaactagacatatccttagagttttgtccttgtctatagcaccatacctctctatgggtttcaatttcctcctacatacaataatatcctcacccacaatcctcagactatagaaatgtggaagttagatgtaattgaaggcatttgacttactggtgtagatcactccttactttctgaggaccattacatgtctctgttactctagctgctctgagacactcttgtatgtctcaagagatgctaaggtcaacacaggcccatgccctctcttaacactgatatcattccttataaaccagaaagttccactgaaggtctttaatctcttgacaaggttaagaaaaaagctgtgaaaatagcttctgcaaaggtcatggctttcccttggctgttccaccctctgtctaaaccttaaaggaccagtgttcaatattagacacctacaataggatttcttttctatggcctaggtttctaaggattatttcatatccaggtttggaaccaaaaaaatttccctagtaacccttttacaatttttcactttcaagagtagcctattacttccaaggagtcatgaaaaattttatagataaaattaattttaatgcattcatattttattgtgctgtatcttataagactcttttgaaaaaaagaggcaggctgaaggaccaagaaagggtgttttctaagttcctgggcaagcacattaaatgtaagaattatttagattcacttttgatcaaccaaattataaaatcattcacttgtgttctgagcagtgttttggtccaggtaagatagctttttttctctaccaaggatcattcaaataaataaaagaccatgtccaggaaatatggtacctaggtttgaatgacagcatagtgtgcataggaaattatattaagaatgtataatttattcacaggacatctactgttagcaataaattctcagccattgatataaatcacattatttgtcacttaaacatccaaggaaacatgtacctagagaaatactatgatttcaaaactttcatcccttccctgaaatctccttgatgattcaagctttatattggcactcattgtaaataggttcaccctgcaacaaaatagcatttattggctgcaaggtcactactgtaatttctgacttccatacaccaagaatatactttaatttctttccctggcagggcttgctcactagtcccaaagacctagttttagcacaaaacccacggaaatgttactgaacttctgtgatgtgtcttcctagttttaagttcccaaataatgcttgtctgtttttatccattaatgtttttcatataatatattttgatcaagttcttacccatttcccaacatcttaccccaactatatttcatgttctctctctctctctctctctctctctctctctctctctctctctctctctcctccccctcctcctcctcctcctcctcctcctccttccctccctccttccctccctccctccctccctccctccctctcttcctccctctctgaaacaaaagtactgggcaggccccatgcctaatagtagttggccaacacaaaacaggcaccttgactttctggctttcgtttgttcttaagtttaaataaaccagaatctaatgagtcaaatgaccagaatgtctgttcatagtccaaaaagaaaaaaaaaagcatttactatgatccagcaacatcacagatttagtagaagtgagagtttccttggattgttccagggtcagtgtacacttggctgattgcctccaattttgacttctccagacctgatatattaatatctatgttgaaatgataatcctaagacactcaaagcttctcaggcaacaaaacaattatgtgctatttatctgatcatacttacgatgaaagaaaattggaggtatatgatttagagacacagtagcatttcaagaacaataaaataactacaaagagatttccatttagtaccgaagtgctcagcaaatggtctagatgttaccgtaagatctgtttctctgcctccctactcacatgcaatttcctgggtatgtcatatatcccatgcaaaataaaaatattagactaaactagatgatatctaaagtcttttataattctgatgtccaataattgtattgtctttgtaattccttgattgacatctgaatctataacactaaaactaatttgaacatagaatgcctcaaaggaaccataattcagtcactgtccttctatcatcgaaggatagggagcagttttagggttatctcaaaggctagggagcagtctcgggactattagcagaagttgactaagatgtttttcttaacctacctatgaaaggctacagaaaggcagtgaagtacatctttgagatgatgaggacttctcccatagaagatcaggatgcatttgacaagcatggggaagtggcttagagaatttaataaaggagtttggcagttgcttccaaagactacattgctctcaagatactttgaaattaaatttgtattaattgaaaagcaagaagagaactttagaatatatcagagagaaattacacagatgagtttacttgctgagaggtacaccacaggcagccctggcacttggcagcagtcttgacaagtaccttcatatttcctttgccagtaggttcaaatgtatttctataccctctctctccaaaatgtatctataactaaaatgccaaaaacaatctctaaaagctctataagtgttaaatatctctaaagactcaatttgttccccaagtagaggtagcccctggatgcttcctcccacaataaaagaaattttccagcatcttacctgaacctcatctattaaatgtaggacttagtgtggaaaaaaattactttcaaatcaattggatatcacctgacctgatttttgaacccacaccaacccaaacgcaaaggaaaactctgttactgattctgcctagtgaacagtgacatatctgttctggttacagaaaagaataatgtcaaaactagcaaaacaatagcagtgaacaaagcagccaagatatttttaaaaatctatagccaccttacagtgtctatatcacttctctatcccaacatatgaatctctacagatctaaaaaatacttcatattccaaaaataaataccaagatgttgtaagccttgtcttctgtatcatacttgcctggttatgtgcagtttcttcaatgtagtaccaatatgactgtgatgcatcgcctatttttcatgtccttatttttaaattaaggcctatttcgcatggcttgcttatatttaagcataatataaatacaggcggcagtataaaacaaatgcttaagtaaatgaattataaaatatccctaaaactactatcagtgaaaaagaatcttgctagttacctcagaagtcctttgtacattgtcaagcacagtttctttgtttattttggtgaagatatgtataacttaaaagcttcatcggttgtttgtgagcatggtatgtgagagagagagagagagagagagagagagagagagagagatttccaatttgtatgaaataagatctctcttgttcactgtaactgcacataccagcccaactggccagtgtggatatgaagattgtactgtctctgtccaccatctctccattggagtgcaggaatttaaggtgtatgcaatactatattggatttttatatgggttctggagatttgaatttaggtcatcaggcttgtgagacaaatgagccatctcccccacacatcaaatgctattatgaggccacaacatttctgtttatttcttacttctaaaatttgcattcacagttttggttgattgattgcttcatttttgtggtattaggggttgaactgacagccctgtggatgctaaacaagcactttgacactgacttataccccagcccttcccaatcagtgctaaagctgacaacaatcctgtctgccccagagaggattggaaggaagcaattgcacatgggcaagtattttgtataagcttaagagatggagatgaagagtgttgagagtcaaaggcaaaacatgcatgaaagttaagtgtaagaagctgggatcatctccgacttcctctagaaccttttcagctaaattaacatccccacatcatgtagatacattcaaatacaaaatataaaaagcttgtaaaatgaaatataagagaatttaaatgtatgcattattcagtactgtccataccctgaatttcctatccttcctgcaaataatcaaaagtaaatctcaagactgaatagataaaatggatagagaaggaaaggcaggaggaagcagggtttgatagtctgtctagtgaaacttcaactttctccagctttctgccaagaggcattgatgttaatgttcttggactattctgtatgaattaggcaaactgtcatagacccacagattaatcactcaacaatctaaggtctattttgaaagatggattttaagttctttccttattcatcccatggtatgtggataatttaaaagcataactgtctgactaattggccaatttgatcttcaatactgaaaaatcagtactttatcattacctaagactttatgtttccctatatcaccagaacacaaattgaacagatagcatgtataaaaatatcagccaggaagcagaacatgttattcttttgtcttgatcacattcttatccagtaggaagggagggggtaaatcagcatgagcaagcacctactgtatgacagagatatctcatctaaaacatgttttaaaaagagagctgggttgatctattctaggaataaatgtctcattggagaccacaaaggtgttgcctctgtggatcaagaaatgcagcaacaaaatattgagccagaaaatcccagtattccctatcaggaggagcatgctttgtaaaaaatataccatcacagccttagcaacctgaattaaaaaaaaatgtcgagaaactgtgagaatgctacacattttttgaaatgctcacaacagtagtagttccccaagctatgttgagccttcttggcatccaaaacaaaataggaaggtttggggttggaccaacccagttatcctgattgagctatgccccctgcctgctacttccagataaccctctgtctggctctggggtacagactgatcatacaccgtttcctgaaaaagaattcccctctgtcatgctccagggactttggcagaggactggagaggatgctttgtgattcctctggcattcaagtaactctctaatgcccaaagtgcagagcagagggaggtttgtccaaatgtctgacctaaaaggaccatggttttacttcttttctaattaggataattaacctcctctgtgcattcattttattccaatccaaatggctcaaattaaagtggcacaggggactttcaagctctggggacaggaaatactttataaatacctttaatattcatttcagccacaattatggcaaagccagaacaaagttggcatagcaacttcatccttgacacaatctggagcagtttgaaggccgctttcagaatattattgatgcaaatgtctcatcagctataaaactgtgtccttaccccataccattccctgactaaactggagtggaggttcggcagggaggatgcttgtaaaagatattatttctctttgtattttcatatgagtttttgtactttgtctaagaaagccaaaaaagttatatggcttataagtcggtagaaattgatataagattgacagaattttttctttcaaaataaccatggaagcccaaactttggaaggattctaaaaattggagtccagcagtatttcacataggacagaggtatgttgctggagttttttccctaggtggctttagttactcattctccacctctgagcaagtttgaaggatccctagcaggtatctacctccttcatgccacctatgaagagacaaataaatgaatacactccctctagattgtttgcctgttctacaagatgcaatctgcagatttgtctgcatacagcccttctacttgtacaggaagctgctatagtcaccagtctaactacagaccttgtgagtctccataaatgataaagacaacagaatagacaaaattaggatgtctgcttaaagtgcatacagaagtatctattttattctagcgatgctggaatttcctctgatatgccttggttgtagccttggactatccccagaagatgtgctacttggtatgctacaagttcaactgcatacatttctcaacatgctgttaaaaggctttttgtggacatattcaacaagctggccattctcaaaactttgccaatatatgacctggtttcctcttaacccatccttctgtaaacctttcatgcacctgaattacccatctatgttaactagctaacctgttgatttgagtaattatacagtagtgacaagaccattactactcaagttatggtgtgctaatgtaccacacgggaagattattttaaaatgtattctagttcattaagtgcagagaggaactaaagggtctgcatttctaacaaatggccttgataatgccaatgttgcttatccatatggcacttataaagttgcaaatggacagcatatatcttatttatgaatgagttaagcctaactagtgtatctagaataagagactggcacaccaaccttttaactaacaatagctgcctttcctattaaggctaaaagaaacatagccagatctgccagaggtatggcaaagtaaaccctggcatagactacccttctttggatttgggtcattagcataagccatcctaagtaccttctctgctttctgaagccaactctgcaaaccaaattcattctgcatgcagacactccattcatcgcatccactttcacagtggctcagaatggctgctgtcaccatatcactcatgctgtgatctgcatcagtggttaagacagaagaagcagcgagatcatccaagtcacaagccatttatttcatactaagaaataagtcttctatccaagtggggccagctaagctgggcagttgtcatggttctaaggttgcaggaaatgttcggtttacactattgagttcctcagtagagagcaaagtaatccttgacaatggcccaggtgtcattaatcctaccaataaaatactagacaaggaaaatctatttctcttctaaggtgtgaattgcaaaaacgtgtgcttaattttttcaataggaatcaactgccttgtttctctcctaaaccaaacccccaaatcactgtctcatgcattgttcttcagtcaaaatagctcttaaggaacatttcaataacattatatggttcagcttattcaaacattggtacaatatgtatatacattgagaagtagttaaagttaaataataaatacatagtcattgtgtggtgagaatatttaatattcattctatagttttcaagaatgtattgttattagctgtagttgcttttatatagatttcttgaaactaattccttctaattgtactacatgtcctgtcaccaatagtaccttatacccatcttagctcctagtcacaactattccactctctacttccatgggatgaacatttttagaatccatatgtgaatgagatggtacgatatattttttttctataccttgctcatttcaattaagataataccctccagattcatccaagttgtttcaagtaacaagatgctcccttgttgatatttggagagttaaacactacagattggaaggtttccctaagaagattccagagcagtatgattatccggcttcaatccaaaatataaacatgttttatggcctaagggagttgtcaaacagttttaaaacacactggcaaattgaacacagatttaaaagtaggccagcttgaagaaacagaacagctccacactttcatatcccagtggcttggtgggaacaagtgtttgcctgcagatccattactgctcctggtggggtctccacactaaggaaatgaacatttcccattaactgattcaccgtgttctttagctcttttgtctctgggtaaatactgaactcttcatcagatcaacacttccatgtacctatgatattacaactctatctctcactcaaaatcatacagaagagctaaaatagtggctagcaaagtcaaacttctagctaagaattcagcctgagtgagcacaaacctttgaagtcatggctgactagtctctcaactaatcctccactgtgatgactaacgttatcatttctaagtgcatttcattcaagtaaatctctagcccgtaagctttctcaacaatccaataacagatatggaaccttaattgctagtggccatggattccccctctgtaaagcccctatatagtctagttgactggagcacttctaaattcagtcacagccatgtgcttgttgatcctttgcaagaaatgttagcccagctggatatatcctctgactaagtgaagtcaaagccagatctggtattgtcagttagcttctccctgtcaagtctatgagtctagacactttcctccagatcggctggccaaattataaactggcttaaactttcactgatttaaatcctaatagctctagtcaatggaccaatttccaagtgagacagtaagcaggaagtgaaagggaaaatgaacagaaatatttaaagaggtaatagattagcaatcttccttattttcccctcctgcatctctaacttatggcctccatttatctcttagtacagttgcattctcttcatctaccctagaaatagattatcattttacacttaagaagaaactgctttctataataggaaggtaacacacatttttaatacctgcaaagaaatacttgtgtgttttttttttaagaatgaacttggctgtaacataatcagaagaacaagaatcttggatgggagggggaggattattgcaatgaccgaagcatatactaataatagcttcaagggagctagctgtactggggatttaaagtaaaacgcagacaaacgaaacatgaattaactttccttcacatatgcttagggcaaagaagtccaaggtaacactcagaatttctaactaggaaattaacaaaaaataaggaagtcagaagaaatagctggattggaagcagggaaggctctgacataccaaaaagatgtcaaaactcacctagtctaaaaaagaaaatgacagcctaatggcttcaagtcagttctgtaagtgatgagaaagatatcactatgcaaagaaatgtatgttagggatatgtacaaagtcattttaaattgattgcatcatatgtgttctattaggcccaaatacccaaaggggttttcaggtagtcacaaaactctgcattctagaactcttcctgagtaagagaaatgtacagtgtaaatacataatttcctgtgctacatctactaaaagcacactgaaatattccaaggtcaccctattttaactcttcattttatttcaattaggtttgtctagaaggggggaagtgcatttagaactgtgaatgaagataacaaactaatgtttcatcttcttcacatcttggcctccagacaaaattattgaattgtacctaagttgcaagaagtcaggctctcagaggtagacaaaagtcttccacgtctgttacaattttcaaatataagaaccagaataaatgataacctgttctcttcattgtacatatgagaaactgtaaagcagaggaaaattctagtcaacaatagatcctatactcatgtattttgcctgttatttttaactttccatattgatataaaatgacatttctgctattttctggatagtgataaatttcgataaacagtaaaaaaaaaaaagcttacattcaacagaagtgttctgacagatacattccttttagctttgcctgtaagtctttcatgacatccttgaagaatcacttcccctttcatttaatacccttatatggagaagccatagagtccacagcaagcctgaacattaaaaactatcttccttctcttacacactgggactcttaatcagtaccaaggcccactgtaatctacacacgtggtagagtttatgacttgcttcatcattcttagttgcacaaattcttgagcactacctatagtctgcacatatctatccaccaatttttttttccctgctgtcctcttagtagggctttacctttcatccaatcgtcttctgttcattaagactcaggtcataatatttatcaacgaaaatatctgcttgagatagtttttctgggctctcacatctgtcctgtagacaatgttagtttgaccatcatctctaaagggctgtggtcaaatgccatgtttaaattattgcttgtatgaaatattttctttacatattgtgataaataaagttttagctttactccttaggtatttttaattttctatttttaagatttgtttttgcatatgtgtgttttcgtgcaagtattatgtatatgcaccatatatatatatatatatatatggcatttcctctgctatcatccaacttcaactgtcaagaacatttcctgattgagttctatggcattcctcctctgcaggtacccatgaaatgttagtccacttaccagttttttgtaaaagagactacttgatcacagactcaaagttggaaattactacttccaaccgggctaagaaactaagtgagaaagtataagtgaacaaagtgatatattgaatgctatctacattttctcattactataggcaaatccctgttcaaaagcaacataagggaagaaggggattgtgttgtctttggcttatgggtacagtccagcataatgaagaaaacagagcacagaagtgtgagtctgcttgctctcatctgagcagacaatgaaacaggaacaggaacaagatttcctccaggcactctgtctctagctagtctccctctcctaaaggttagagaacctctcaaaacagcaccaccagctggagaccaaagtgttccaaacacaagaatctgtggggaacattgcacattcaagccatgacaacatctattaagtgttcaacagtccacagtacagcttgtagttgactcttgctcttggtgaatttgcattgcaagtgatcccagaacaattatctaagtagcatacataaatataaaagaattatacatagcactgtaggagctccttttaacccaaagcccagttgcttttatatttttattttagacctagagtggctggctgacaatcagaggcttgcctattctgattttcccagacgttgaacacatctactccagatggtcttctaaattcccttgcagctgataatgcgaagcaagtgtacattcactcagtgaaactgacatatctctttgggcatattttctcagcatagggtgaggaaagtgaactacataattcaccagcagggagacaaggttcataatgaagaacagaatgaatgagaaaaatggaaaatgtaggattatatgcactgccagcttcagagccaccctcaaacctgacaagtagcagttgcctcccttggtgagatattagggtaattgcaatacctgaagttgacaaacagtaccccaccaattattgttgtctacaaattctcaattaaaacttaattctttaagacattttattcccagtttgtaaaatataaattctccatggacgtgggggcggggatatatttgtaaaatataaattctccatgctctagcacaagagcatgctctgagttgaaggaaatatatttaaggaaaaggtaaaggacacagagccagtgagcccctcacatttattggttccacaaattagccaagggccatcctaataatgcagctttaaggaagagaagatttgaaaaaggtcagttcttaattaaagaatgacttaaacaaacacagttatgaagaacagaggctccagagaaatcttaatttgctatgggtaaattggattgggtgtgaatgagtgtttgtttttatcatgttccataaaattcgcagattgtcattcatatgaaaatagagaggggttttcaatcaaagcttccaatcgaaagcttttcacatactgaacattttctgtattaacatcttaagtttatacattcactctattgctttttatgagaccaaactttaaatgaagctaaagcaaatactagcaacagcagaccaaccaagcatgggtccaaatgtgctatgggttatttttaagggagtacattgtgtgaaatgaataatcatactcttgagttattggctctgaggtcagatttttatacatatggcccccgagacatggcaagttgcaacacaaaatgagtgggcttgccatcatctcctgcctctgcttctatgttttcccttttcacctctgtctctgaaaccacctttgtattctatcttaagcttgtctgtgtccttattttgcttcagcatttaagataaatgtatttcaaaaatccatgctgatgaaagatggttaagaaaaagagagtatgaggttgtataaggttggagtttgcagcccgggcaaccacaaacataagaatagaagagcaactttcatttggctagtttcatctgagtgaacaagaataccaatttcataaaaatgctagacacatgctcatcaaaatgtaatagaaacaacactaaaagtacaataagctgttaaactagacattgcatatgttatagatgcaataaagacattaacattattagaaatattaaaaaagaaaaagccatactcaaggaataagcttgaatcttaaaattaaaagacaggggtgctggagagatggctcagcggttaagagctctgactgttcttccagaggtcctcagttcaattcccagcaaccacatggtggctcacaaccttctgtaatgggacccgatgccctcttctcgtgtacccatatatatatatatatatatatatatacacacacacacatatatatatataataaatctttaaaaataaatttaaaaagacagaaaggaaagaaggaaggaacagaataagagcaatattgccagataagatcttctatgcctgtacttctagtatttgttgatttctgttcagcatgaagtagttttacattttgttggaagagtggggagaaaagaagaaacctggccttgttttcctgggaacatgatttcgacagtataggtctgagagctttttgtatctgttgtcataccttttgtggggtcaaactaatagtcatggattgagtactcctaagaacagatgttgaaatgtcaattcatatgccaaaaggctcttggtgagtcttcattggcagcacttgtgcagagaaatgggaagttggctaagtaaagttgtggtacacccatgccaaggtattaaagctctgaagctgaggttgcccattagttatcccactggaagtttggaatgatcatgtttttatacttggctgctaccagacgttggatacaggatgccctggagaggaggcccacccaaccttaagtcaggtatctctcttctaccaacaactctcccatcagcagaagtaagctctttggtaccaaagaatgatctagctgcacaaagcagcatccctgcacagcctctaaccaagatggttggcttgtttgccaagtgatgctcaataaacagtgcactagaatttaactggtcctgactacgatccagttccttatacctaactgccatgtccctcctttattgctatcctcccatgttactttggtcagatgcagagggtaagctcccaatcagccagttatctatatggtaactcccaccatttaaaatgaggagcagtgagggcaagaacagcattggtggtttggaatccagttgacataatttgctactcaaatcaaagtagctttgagacttacaaagctgggcatgtgaaaactcacacagggcagatgacaatcctgaagctgctaaaacagcaggctttatttttacaaacccaggactttgttgcaaacctcacctcctacaaacactagcacctggttttgctctgccaagtcaaacatttctttctttctccctcaagcttctatttatgctttggtcagctggaactgagtcagtgaaacgatgataaatcgggtatgaaaacaaataaaaagctcgacttggatcgctcactgacatctactgaactgagttgaccattcccctcaagttctagattgcagcagtcccatgctcaagcagacactgggaaactgaacggaaaagaaatgtaaagctaagccacagttgtgacttgctcagaccaaaaaaaaaaaaaaaaaaaaaaaaaaaactgtaagaaagactcataaccaacacactcatcaaaaatcagtgtgctgcttctgctgagtttttgattaggtaacacatccccatggttcaaagaacagaagtataaaaatatctaggaaaatcattgcttattaagaggaagcacatagcagagtgttgatctgtcatctgaatattccagcaccttacactctgagaggacaccatgaaccggacttttaaggtcttaacagttttatccttgcagaaaataatacctgcctctttttaaagaactaaacattatataaccaagtgggatgtgggatgtcttcataattctgtgtctctgagaaaacactaatagttcttggagattttccccccagcatatacaagcatgggctttttagcaaaagtaaataaaatatgatataataataatgccatattatacatgttaatttgttagttctgtagtggaaatctttccttgttagtgtatgcacattgttgacaactaaactttagcatagcatcctgtgtgatatacttaatacactgtattttgcatttttataatatatgtgatacagttattcaaaatgccttttcgttgcttttgattgatttatcttgaatacaaaataaggcatatctgggaaaattaatgagaagacattaaaggaacctttatgggaagaacagaaacacccagaaatgtctacaagtagcagggtatgcttggtaaagggggagatgtgcagttacactaaataggtaacaaagtactaagtgagtagatgataccatttttcgggtttgaaagaacatgaaaacaaatgataagtaaggaccagtccaggaagagggattaaagaaagaaagacaaaagcagggtagaaggcaatggccattaacacgtacacagagagctgttaaagctttatcagaactaaaaagtttctgcagaatccaacctaaatacaaattaatagaatttgactatttaaatatataatcaatccagactagggatacatctcagtgatatggtgttagtttaacatttatatggccctggatttcccccacccccaccccagaaactctatgatgctaaaataacttacatcaaaataaacagtaaccctatagccatttacacttactgttcagataatatctcaaatattaagaccaataaaatattgacaagtcaacaccctgttacgaatagagaaagtccatgaagatccacccctccccaagggcttataggcatataatagtatccagcatggagagacttgtgaagctacatccttccctgaatatctacagtcaattaatcattactgaatgtgagagagacatttttttcagtagcatagccactggtaagagtgttatgctcttataaataatcccttacccatgtccctgtaagcaactgtaataaagctcacagatcatttttaaaaaatcctgaaaatagaaggaagactacttaagaagaaagagatagtaggaataggaggggcacaaaacaggataatggaagatgaatataataaaaatgctttgtattcatgtacaaacgtgtcatcatgaaacctgttattatgcaaaattaacatatacttagaaacattgaaaattatccatttaaaaaaagatagaactgaaaggaaaatagttatcatcacataaaaggaattgttgaggattgggacatctttaacctggagaagaaaaggttaaagagagccatgttaacagcccttaaaaatgtggaagattgtcccatggaaaagagattaatcttcctccctgtcatcttaaattgtggacaaggtccattaggcagagatgacaagaatttggattttctactaaaggtgtgaacacttgtgttttgttaaaaagcccttttaaaaagaaagtttactttaaatatatcaaagaatccctatgtaatttctttactgttattattaagccaatattttcttcataaatagcccaaaaataaaattcaacacagtccttactgaattttcataaattcttaattagtggcattcaaaataatgaggccttattatacactgcttaagaaagctttccacatgctttaatctctttcttcctatgtttatttcttaatcccatgccttggcccactatgtgccctcaactcccactgaagcagagagtacatctaaaacccacatgaaaatgtaaatctgagaaataaatatgcacggttggttttataagagtaagaattaacatttaaagcaatggtaatttgctctgatctgtaattttgagctcctgtgctgaaattgctcatttggaaattaccaagtgcttgggtctcgtttgtgatcttcttcctgcacacacccagcacacaaaggagttataatgaccggctgagtcactactgccatctccctgaagcatgttctccaaatgccaataccattttctatggtacagtggaggacgacactgagccacagcctgcttacaccacagcagacagagaacccaggagtgtgttcaaaaggcatcgccacctcctccatcctctgcttctgtggccattgaactattacatcacagataattgggatttgcaaatcatatctatcactcctatagggagaagggagattgttttgataatatcccaataaagttgtctattcttgatgagattatactcattgtaaattcatacaggaaacacaagtggagatatgatatattattagaaatgtgactactctaaaagaagtgatgcataaaaagtttgtgccattgtactttgtactttgtatttgggaggttgcttgcttgcttatttgtctgtttggtttggtttgggggttttggtggtggtgatggtttggttgggttgggttggttttgttctattttgtttttgttttttgagacaaggcttctcattttaacactggttgtcctcgaactcactccttagagcaggctggccttgaactcacagagatccacattattctgcttcccaagtgctggaattaatggcctgtgccacctctggctggttgatttgggattttcaaaatagaatctctttgtctacctcagggtggtcttggacttttggaatcctcctgcatcagtctctcaaattctgacattagaattatgagctgcctataactccaagtagctctttcttttctttgaacagagctccaggaggttagttgctaatgtttgtcggatctaaattacctaatgcaggaccaggaactcctggtaaatttggttaggaaaaggaaatacttcaccaaaaaaaaaattctattgaatatttcgtagagtctctatataaccaaaaaaataacagtctatattgaaggctgtcattcacaaaatcatagtgactttatctgtgagacacaatttatcttgttcaatagtcacatccacatgtggttcagcttgttttaataaggctctagcatgagtagttgtttataatgttttgctgtgggtttcttttaacctgtaattctgaagaattaagtgatagatgaaagaaaggaacttcaaatgcaacagagaaaattacagccagacctaagaggttcttggcattcgttccaaagatattttgataatgcatgtcaagacaaaagggactcgacaaacacctctccccatggtgctcacaaatgagagaatctccttccctttaaaacaaacaccaagatggaggtgccaaccatctggagagttgaggttggagctgtgagggtcacttggtctctccagtgaatacagtatgaagagacccaatgggctgttaatagaaactcagtggaatcttcaacacctacagaaataattttccaagaaaaaaaaattagtatagctgtttttccttccttcagggttttccatcctgcaagcaattatggaagcagcagtgcaaaacaactggcaagtgacagcaaggtctgtgggaaacataaaggacatccaggaattcagacgcatcattgaagaaatggacagaaggcaggaaaaacgatacttgattgactgtgaagtcgaaaggattaacacaattttggaacaggtatgtctgagacttagcgctctcccagtctgcatgttaaatcattatcccgaggcagttcccgtatctgctaataaattaagtagccaacagaataagcatgccaacagttttcatagtctctctaatccctttttcctcctgagtggctgcaggggggaaaaaaaggaatgaaaagaaaagaaaattctaagcttataaaaaaaattgcatcgcatgattaatttgaatgtctctgcaatttgatgctacatatcagataaatctatggctccactcctgtttaatagatagctggttatttcaaagtaatccctgtcctttcctatatcttctggcccaacagggaacagacaatagattaggcagggctgacaggtaggatttttgtttctcattactggaatatgtactgccctggacccttctaggaaacaccagctatagttgatgaatgtggggagatactacttgccaaggtcaaattgtctatatcattctaaattatccttttgggttagtaggggtaagagaatacattaagatatttttaatttcataaactttattataaaacaaccctgggaataaaaatattacacaccaaaattcaccagacccaaaggctatacagatcaatgaacttctatactagaactggcatttggaacagaaactgtgaagctttacattaaaatttacactttggtatcaaacattttatacatttacacaccaccaaaattaaaaagattcaatggcagatttagaattagaaaaacgattagctttaggttctgtcctactcatgtccattacctgcatcccgtccttcctcgtccccttaaatttagcctttcttgttctaatttttggatgttatactaaactttttatactatatatttaaaaacataaggtgatatattaaaatattttggttttaaaagtgtgaacaatttttaaaaagcaggccaaaattacgtaagacatgcacaaacaaaccagacaaaaccccagtgctcagaaggggaagtgaacacaaaatcccacccttaaccaaggagctatttgctatagatacctgctgggagaggaagtaagttttcttccatggagagacactgggtgtatcagcctccctaaggggcaggccctatacccaggaatagttggtcaatactaattggattccatgtgtatttgtggttgtttatttccctttggttgattgttttgttttctttgaggtggatagggaggtgggagagcatctgggaggaggtgaagaagggaaaagggtgggagcagaaaacattgtatgtaattctcaaagaataaaaacgtttttaaaagtggaaacaaaccctccaacaaaagaaacaagataaagaagaaaacataatccaatgtgccaccatgttttcattatcaagcatcaatatgtaaactttagaacaaaattaccaggaatattgatcctaagctagatggacactgtgtatgggatagaaggccaaattgaaccttgaaagtttactgtttccttacaagtctcattttgccacttaataacaaagttcctgtctctaccattgaaggaaactataagggaaatcttctaatttaaccccaatgtgcctagataagccaaaagagcagaaaataaaatcatggtgagcagccactgcttatgggaggctttatataggaaatgaaatattaaaaatttgttagatctatccctataaaaagaaaagacaaaaaaaagagagaagaatgagagggttggggagacagggactgcaggtgctacaggttagaaatacaaagctactcccttgttaagctcagcattgcttttaatggatgatgattcatagaaaatctagagcgaaagcctggttagttcctcaactaacattcacccgagcaacacaaatggtccatgctctccctcactgaaaaactttcctttgattttttcagatcttaaaaatgaagaatcaggtcagtgatgcggctctatgtactacatgccctccaaaatgtttagactgaaatagccttttagtgggtgacctacttagtagccccaaacagaagaacatctctcttgtcacacttttttggttttcttctgtttcattagggactttggcttctcaaataaccaatattcttttaaaggtctggggatttgcaggaacttagacttggactgagaggtttttcagttctgggtaatggaaaaagtggtgggtaacgctttgacttctatatagttctgaaaccgcgggcacttaactttctttaccccagtttcctcatctacatgatggaaaaaatattttgctctacaacccctcaaaaagccataaaattttggagagaaaaatcaatatcacaggaggaaaatcaagctgtttaccaaaatccacatttctggtttattttatgtcttacttttctgtcttcctttctcctagatgtactttgaaaatatccctcagaagtagcttttatgcaattttattcatttatcatctttcagaaaatcataaaaaaaaactctcaacacatatttgctttctctgccattgagtagctcctgtaagacatatgttctacaaagtaggggctagaatgagctacaaactttatggtacatactaatctaggtcagatgggcattgataaagtacactttagtaagttgaactgagctttggctacagctccatccaaaacagtgcttctcaacctccctgctactgtaaccctttaataaagttcctaatggaatgataaccccccaaccataaaattattttcggtgctactttataactggaatttttgcttatgttagggaattataatgtaaatatctgatgtgtagggtatgtgatatgcaattgctaagaagttggaacctacaggttaagaactactgacccaaagatgaaaaagtacttctagcaacataatgtgattgctaaaatatacatttttaaatttttaaaaatgattctgtttatttctattctaacaataataaaattgctcttatttatcatttcgttttttaaattttttaaattaggtatttatttcatttacatttccaatgctatcccaaaagttccccacaccctcccccacccactcccccactcccccactcccacttcttggccctggcgttcccctatattgaggcatataaagttttcacgaccagtgggcctctctttccactgatggcctactaggccatcgtctgatacatatgcagctagcgacacgagctccagggggtactggttagttcatattgttgttccacctatagggttgcagatcctctcagctccttgggtactttctctagctcctccattgggggccctgtgatccatccaatagctgactgtgagcatccacttctgtgtttgctaggccctggcatagtctcacaagcaacagctatatcagggtcctttcagcaaaatcttgctagtgtatgcaatggtgtcagcgtttggtggctgattatgggatggattcccgggtatggcagtctctagatagtccatcctttcgtctctgctccaaactttgtcactgtaactccttccatgggtgttttgtcatttcttatataaaataaatgtcttattaaacaaattgcttaagtaaccaattttaacatgatatttttttaaaaaaatactttctaaaagaaagtgaatgctttttatcagagtttattcttctgaaaaacatcctgatatactatacagattttagttccatgataacattcataattcaaggagtattaagttcttctaaaagacagcctcattgtttgttttcaatattatttagggattttttttcctagtaaatcttctataatcttacaaaatcatgttccattcgactgcctgagataaaagagcctgtgatagcattataacactatcattaacaccattgtcaatagatcagatttaagcataaagttcatactgtagtctatatccaccaggtattaatgaaaataggtagtgtagtacaattgcccaaatataatcagattttcagtagagtattatataacataatgtccacactatgttatatacagtcttttttgctgtgaatattcaaatagttatataattaataaaaattcttctactattccttccaaagatcttttttaatttatttttatttttatgtgcattggtgttttgcctgcatggatgtctgtgtgtgagggtgttggattcactgaaactgatacagatagctgtgagctgccatgtgagtgctgtgtattaaacccagatcctctggaagaacagtcagtgctcttaactgctaaaccatctctctggctccccaaagttcttttttaactcttgaggccttcatatgttactggagaagaaaatcagttagaagttgaccttcctttagtatccctgtataccaatcaatttacaagaaatgtatgatagatgtatttacaagtgtgagaactaccatagaaattaacagagggtcaaatgagaccatgataacttcttagggctcagagacgatttacaaactgtagatcctaagcccaagatttagagcactacctgtttcatttcttccaatttcaatagttatttctttttctcttatctgggaattacaatataatagaacatgtctcccttccctttcctactttcagcctttcccatatatccttcccacttttcaaattcatggccttcttttttcattatttgctattgcatctgttatgcatatgcatgtacatgtgtgtgagctcgtgtgtgtgtgcacatgtgtgtgcatgtacattgtgtgaatgtatgtagagacccaaagttgatatcttgtttcatcctccatcattctccactttatttatcatggtaggttctgtccttgaacctaaagctcactcactctcgaggcaatctagctagttcctttgtccaggaatccagtctgaatggattttgtcacttactagctttctgacaaggggtaatatatgtgtttgcctgtatttccatttttctcaaaagaaaccacaaatgaaacctttacgtagatgagttaatatgtacaaatcatttggaaaggtccctgatctatagtgttggtataccactttgatgtccaaaaaagcactgtcatacaaatgatctcatgtgaacttcacaataagatgcctgcaggaaagatatgtttataccgaatttatacatgaacattgaagattgaagacttctagatgacttgtcaaaattttacttccagttcaattatcagtacgtaacagaggaagtgtgaaacagaagcgggtctgctgacccctagtctagtgttcttgctttaaacagcaccatttgctttaatttctacactactcattaaataactcatcaaacccaaatgtggtctactcatcagactctatcttaaaatgatggccaagcaattagagatgatccaaagaagaatggcaagaaaatgattaaagcattaggaaacagtaccttcgaggaaaggctataaatgagttaaggttgtttatcctagggaaagagagccaagaggcagtttaatcaccatgctcaagtataaagagttgtcataaagagggcactgaccaactgttctgcgtgcctaaggacagcactggagcaaatgagcttaactggaccagagagacagtcagcactaggaaggactcattataaaggaaagaggaaagtagaagaaagggcaatcactccagttcacactgtacgaaggcaagactctgttgaattaggaaaaggttatgattaacacatttttcaatatttgtttttcaaaaatgcacaaaattgcaagtttacactatgtgctagcaagtaaaaatctttaatgaatagaaaaataaagtatactattcctgggaatctgtggttctaggactcactacaggtagaaaactccacaaatggtccttttataaagtgatatcgcatatgtatgtatggtctccttgtggatttttcaaggtgcctttcatttgaggtcatattgctttttgatctcactgaattcttcatgttcaaacacctccgcttttctcgttactgtaaccttaggtagtacatgtggatcaatcaactccctttgaggagcaactagattttcagcatcatgtaaaataattacatagaaattcataacctattcataaccacctatatagtataattcatatctaaactattgataatagtggatagaatataagtgctacacgtgggattatccgtgggataatggcaagcagaggctctgtatgcatttagtaaagatgtgggtttttgaaagtatttttgatcccatgttgggtgaatttgtaggtacaaaaccagaagttacagaaggctaactgcaattcttaacgtccctgtctatcatctatccagaaagttatccccttaaatagatttacatgatctccacttgttcttcaccatattttctctttttctaaacattattattagtatattctctgcctgagttataacatgaactaaatgggatgaagcaatatgtttaagttttctacccagcaaaatgctaaaatgtatggatttctcccagtactctctcatgccaacttatctcttcatgggtgatctaatagagtcccttgggaaaacagtctaggagcagatcaacccctagcctttcctctcaatgctcccagcagaacagcacattgacttactaccacataagacaatctgagttagcctctactcttagaatagctttgtgcatggttcagttgaataaacataagtttgagaagcataaacacgtgagttcaaatcctagctctctcacttctctattggatgatattgaggaaaatggctgtttatttaaggcttaatttcacaagtatcttactagcttttctttgctcaggaaaagaagctatttaagaattgttactcaaaaatggtctccatgtggatttttcaaggtgcctttcatttgaggtcatattgcatttggatctcactgaattcttcatgttcaaacacctctgcttttctctttaatgtaaccttaggtaatacatgtggatcaatcaactcacatactctttgaggagcaactagattttcaacatcatgtaaaataattaaaggcaaaaatcttgagccatatatagcaattagtacttttaataacagatatgtactaagtgcttatagccatctcgtgtgtgtgtgtgtgtgtgtgtgtgtgagagagagagagagagagagagagagagagagagagagagagagagaaggtaacctagaagtcatacagctaatagttgatgaagctagaatttgaacccagggaatatagatgcagatgctattaatcacagcattaattggccctgcatctgactgaatttttcagttggagtttattcaaccaaaatttataagataagcatcctgatgaggcctgaagtggctttgtttacacaacaggcatttcacagatattttctccacttgatgaggagtcatatcccattaacacagagaattgaaaatacaccctcaaatcgacgctttcgtgaagtgctcctttgtaacaaacaggttcatttacttacagtaccaaaataacccagctttgaaatgagatccacaaaggcatatgtcgtgaaaagaacttccccaaagtgatctgtatataaatctagcatagctaacgaatacctaaagaagtgtggcctccattgtcttaccatagtcttctggtgatatccgatcagcaatgccccactcccaccctacctcacccccaccttaatatctagaaaaccaagcatgaacgagaaatgtaaatatttatagcagatggatttcagatgggtgcttagacttgagagtattgcaagggccatagttatcctttctcccactattaccaccagactctaatgggaggaaatgttgcctttaagcatcaaccttcagcggactccttatagtacaaactctgaaacacaaggatcttttctttccttgtggccttaagagcatttgaaagattagtactgagcttcaggaacaaggtaagggggaaacagacacaaaaaccaaactgggcaagccaaatcaaagcacacactatgattcttaggtaacaaagggagtccttgaaaacaaatcagaatgcaattagaaataaacttgttccctaacatgtaaagatgtttgtcctgggaattggtaacaggcagcactattctacattgagggactttagctttggttataaaaaagaaaagaaagaaaagaaaggaagagaggaagagaggaagagaggaagaaggaagaaagaaagaaagaaagaaagaagaaagaaagaaagaaagaaagaaagaaagaaagaaagaaagaaaggaaggaaggaaggaaggaaggaaggaaggaagaaaggaagaaacaaagaaagaaacaaagaaacaaagaaagaaaagatggcttgattatctggtcatacctcccagtagacaggcctggtaaatatttagaagcaaatcctctctgggaaaatataaaaagaaaaactcattcaagatcattactttgaaacagaaagactcttttatgtttcaggtagtaaaaatgttgatctcaaaaaggaaatgttcctattagaccaacagtttcctcttcttattttttaaaaatccattcacttgattatttcctaggaggcttggaaggatatttttaaaaatcaacaaaaattcaaattacttttcattaactaactttagagttccttctgaaaattctcaaggattgagacacttggagatgaaggaaaatatccaagagttttataaagcagaatacagaagcttgaggcagaagatctggattttagccccaagccataggacttcacaatgtatcaacatttcctaatccctaaagcaaccgtgttatatgttccaagagacttctagttccaagagacgatgatacctggtgctttaaaaaacaagatagagcgtttgattcaggagatactggttgagaggataggggtagtgtgcctcagtggtaaacgtgcatgatacaacaggttaatctccagcactgcgatgaatggaacagaagaaagagggtgaactgtggcagggcagattgggagaagggaggaagggagggagggagggagggagggagggagggaggaaggaaggaaggaaggaaggaaggaaggaaggaaggaaggaaggaaggaaggaaggaaggaaggaaggaaggaaggagaaaggggaagggaaaaatagagaaaaggttcattttgtcttacctagttctatacaaggtaagtggaaaatagtaaagcgtccttactgaagaaatgtacagtctagcaggctgataagaaaacacaataattctggaaggcagaatatgacaactatctccgatgtgtgccgaccttcttgctttctctgactgccagctagtgaccatcattaaatgttttttgctgactgaggtgcttgaaagcctgaacatcggggagcttttctgagacctgggaagatgggggataaagagaatgagataatatgcccttaaggccacaacaccactaggaaattcatttacctctatccttagagcacagaacaacaaacattcctggtaataggagtttatgtttgatcaaagctagtaccacatatgtatatacataaatataacatcagcccttccagaaaatgcctagggaattattctattaattaaaggtttctgatagttggattctgattaaatgagatttgtttgttcattacaaacctatgctaagtccctcgctgtatccacatcagctactctcctccttcctgcttgcatgccctttgcatatacaaacatcaaggagaaaacaggaaaaaaaaaacagttttactgaatcaagacagactcactccttgtcttaacatcagaatcttaggactaagcctggtactttatacccagatcttcaatatgtgaagcaatacaagtgcaacaataaaactgatgtaaatatcacctttgtttttagttaaccctgttacaaatcaaaaggaaattcagaataactacatttaaaaacaaaaatagaataaaaccgtaaacaattatagctttgttatccctctgcaggaaatgcatgtattttctgctggcacagaaagaaagccccccagacacgccaagcatgagtttgtgcggcttccttggtgaacatcttacttaagtctttgcaggcactgagggcttgaccgagtcctgtggattttgattactggcttgtaaacactaagtcttttttaaatcaccattgggctttattaggaaattgtctcagattaagaacaacaaacatgtagtaattagaaagtttgtcatgcagctgcatgattacaggagcccgtctctagattctaacagatgttaccaaaacctctttcaagaaagctgggagaaccacagttcgtgagagcaacacaaaagctacttattgttcaaacccacaatgccacagatcccttatatttaaaatgacaaggctcccctacagagaggtaccaagcaaatacaaaaaaagaacagtaacaaaaaattaaaataaaacatgtagattcaacttcttcaccatgctaacaacgaaaggcaaatgcaaacaatagtgccatgcaaatatcttgactttttttttttaaaatttttattagatattttcttcatttacatttcaaatgctattccctttcctagtttcctctcggaaagtcccctataccctccccccaccctgctccccaacccacccactcctgcttcccggccctagcactcccctgtactgggtcttcacaagactggctcctttcattgatggccagctaggccatcctctgctatatatgcaagtagagacacgagctctggaaggggaatactggttagtttagctccttgggtactttctctagctccctcattgggagccctgtgttctatccaatagatgactgtgagcatccactcctgtatttgtcaggcactggcatagcctcacaagagacagctatatcagggtcctgtcagcataatcttgctggcatatgcaatagtgtctaagtttggtggttgtttatggcatggatgctgactttgatgccactgaacatggcaaatagcctgaacacacatgatacgattatcgtgaaatgttcacttggcccttccagttgaaggaatcttctttgtgggaacagtttcgcctcagtccagataaaagtaaccatgtaatggtctatagcaagggattaagtagattggtgacaactcttatcacatcactaggagcagagctaaaatagaagatagtaagtagccaagcaccactagtttattatcaatcttttttttttttttttttttgaggtagggtcttactgtgtacctctggctggcctgcaactagctttgtaaaccaggcttgcctcagactcatagatatctgcctgcctctggctcacaaggataccgctatgcccagcttacctacttataataaacttatagctaccaaatagcctccccagtacacaaatacaaccccctacaacccctatttcactctgaaaatgaatatcaatctgattaagtgtcttttcaaggagcacagcttgaggttaaaggttaagactctacctaagttctttttcaaaaatcatgtctgcccttgcacagcaaaccccgccccatctttttttgttactttagtgacagtcagccataaaatgtaaaaagaaaaccatcctaccagtacaactttaggatgaatcagacagattctctaaggcattccaagatgctcagaggacaagtctacaatccaaggcattataattagaattgtgcaccttactttatgatgaggaattaatgagtgggggaaggaacttgagatcatgcagcctgaaaattcaaacaggaagtatgcacctaaaggagcccagccaggctgcagtagaagcacatgtgtgagaactgcaaggcatgttcccagcccatgactttactgtttgccttagccagagttgtgtacatcaccatggtcatcgttaagtattagatttgtgagtggcaccggaagagcagcaattatttcactgttttttattggactgtggttcagtaggcaaaacccaccttgcctactatagtgagatgaactgatcatacatagtaaggggcatgaactgaaattgttttcatgtcttcagttgaatctcttgtagaaggcttagctgtaactatacctaaactgtgttttgtaagaactggagaaggctaaacatagtggtggatgcctttcatcctagcactaggaaggcagagtcacttggaactctgagtcccaggcccgtctgttctacatggcaagtcgcaggctagccagggatacataatgagacactgtctttagaaggttggaccaagaatgtgagacctctaacaaaattcactattagtagtgatatgcttgccaattttaagaccatgaacactaggaagggggaaagtgagtaagtgatttccacgttggaacctgcataagagcttaaaggacacctacccctttagaggcaaataacagaaaatagtcacaatatggtgtgacctcagcactaccgtatctttgaccaagagatgaaatccagacacattgaaggaatggactagacagtcaaagaggatactcacagcaagcttcttaatgggccctcctaagtgacttgcctttgactgatatcacttcaacacttctgagagtcctttgcacttctcttgacctatttcagactactgcttgtgcttaacttgagaacctgtgacacaataaattgctcctcctccctctttcttagccaatataaaattaattgttgcttaatagactgctttgctgcagttttctcaaatgtgcaaagcaaacacatccattttttccacatacattaacttaatttctgtctcacccactcaagcacaacgcaatccttccaatgctgaactaaacaccttacccacttggtatccatggcaaccaccaccaagctgctcagagagagctgcaagtagtggcaggaaagtacacctcccagtggagctattagctcttctgctttagccacatcgataagaggtggcgctaggtcagcccctgaatcctcgggaattttctttcttcagaaaggagtgttgttcacacccttgtctcaaggagggagagttgggatcagctttcagttttccattctcaacctgttgaaaataaagcagtcagtgtccatgttggaagaacaagacactttgcataaagaggagcagctcaggctcattaattgatggtaaggaatcatcacgtaagcatcctcttcctaaattctctacaaataaggatacgttaagaagtgggaggaactaatacatagctttagcttcttaactgcatcaaaggaaggaaacgggaggccactattctcgatgctttccagtcgatctgctgaaacataaggagatgcttcaacaaggcaacattccttttcatattgcttctctctgaagttcttaggaaaggactagccatacatttacagaaagggtggggaaaaaaaccaagtatctctcatccttcaaaagtagagatgtaacccagtgaacagatcattgcaatccatcctgataagtgcattgataaaggaacacacagcttgtaacaggaaggcaaaaagaaacataattaactcagcctgactcagccaatcaagaatcctgacacctcatgattgtgctaagtggggaaacaagaacccagtgaaattcatatggtgttgtggaaggggacatatacttctatttacctatgtatgacgatgttcacttaattgtcagaatgagtgccaataaggagcaaatgaaaacctaaggctggttaggatgtcataaagtagagtagtagaaaaatactactaatatcatgtactgtggaggctggagagataacacagcagttaagagcatgtaccgctctttcagaatataccagttcagctcccagaacccacatatttgcaaccccagctctaaagcatctgagaccattctctggtcttcataggcataggcataggcatgtgcacgtgtacacacacacacacacacacacacacctcaaaaaataataacatgggcccaattggtcagaacacaacttgcccctttaccaggacctttgaatcctctagaaacaaagttttttttccacctgccaatagtgtagcatgctatcagaaaggacaaaattctacttaggcattcaactaccctttaattttaattgaggtgttgaggggtgggggactagcatgtgtaatggtatcacgactagagaataaaagaaccaggatttaagaatttggttccagggcccatatttttatagctaccaaacacaccagtacaaggaccctatgcatgggttcccttgactaggccatatgtcttctccattccattctgcccactttccacccaaacacaagaaaccagtgctaagtttaagataggactagtcacatgaaagcataccacactagaaaacaacatgtcaagagagtcccagaacccatccttctcctcctttctgtatcctcttcattttttttttttttgtccataaacattcattgaatacctacgtatagagcactacactgaaaaacactcacaatccgaagtagaaaaaacgggcttctcccctcaaggcaaagtagaatggcaggacccctatctgtactgggtaaacatttagtagactggaaaagatgagaatatgagaccatataggaaccgacaaaacacaacaagaagtgatccttagaaaactgaagcagaagataggattaatggagacatgtttttgtgctttgtttaagccgaggaacaacttggtgaatactaggtattgataaacttctggggttggtaggttaattggttggttggccttttctctttatgtagccctgactgtcctagaattagggatgtagaccaggctggcctcaaactcaccgaaagcttcttccaccaaaatgcagggattaagtataggtaaccccattttcagcagtcaacagttgttgaattaaataaactcgcatcctgatatttgttctaaggatggaaggagcatcatttgaggaacatccaggcttataagcattgcatgcacagtgtatgtagcttttggttttggtgcacaacaggagccttctagatgtgtagaaattgtgatcactgtacttatgacttaaacctttgcaaatttccaccaacgcgttaatatggatacaggcatgatccttagaaatgtctttcaaaaaacaagtcttgctactagctttgctcatctgatgaggctggacttgaatgataatattaaaaataagacttttaagtatattttagttagaactgaaggagaaatagttatgatttctgtcagtaggcataggttgtaactctctgttttaggtgcttatggtctactaggagtagagggagctcagcttgtatatgcttcagaaaatcaatttatttgatgaaaacgtaagatcaggaaagaaagatatttccaaataaccattttgtacctccctaagtagtccaattactgttcttctaaaactttctactacagtacaatttcttttttcacttatttcactgtgagcattccactaattctctagtgaattttggcttccaaggcttttgaagataaagacaatttgatgacattgggcttgtttaggatagtatggccatagacataagacatgcaataagaatctatgggaacactcaagggagacctaagcattcatacacaaaaagtgagaaccactgtaactgtgacctggtaacctcaggaaccagactgctgtgccagcatgcagcaccaagtacaatatatttcaaatatatacttaatatactagttaatatttgatgaagttaacgtgtacattattttaattagtatgttagttaatgtgcaatatattcaatactctctatattaaatgaattgggtctgacttcacaatgttagggtaaaaagcttaaacatgtgtgcactctgctttgacttcttccaaagcctccaaagtcattttcagctctacggatatacggtctaagcattagaaaagtccaactcaccacactaaatggtactgaatatattgtccactgtggcctggttaccatcttccaggtgtagttccgaaggcaccttcttctttgtggcagagtctaaggaaatggtttgaaagctcatgcctagggtagccttatatcctaaagcccagaatctttgattgagtaacttttctgtaataccttcctgagttttccatgtttaaaagatttccacaagatgattttgaccctccaacgtaggtaagactcgtagtgagtttattttctccattgcaacaagaaagtggcacacagaagttaaataacttgccaaagatcacacatttcagattgcttcattcttctccttatttcctcaaaagctcatttttttggtaccacatcataagaatgtatttgggaaagcagcaatgggactcttgctatacaacattaactgtgtcctgccagagtcagttcccttgctttccaaagctatgggtaagaacgtttactttgggcttagtcatttctctccccaccccttcctctgtttcctgaaagaacaattaagatccatctgggactaattataatgattcttgaatttgaacttgcaaccattacccaattgaggtcacttattttaaattaacttgcctggtcagaacacaggtttggttatcttcagaacacagtgcagagaggccctggctcactcagacttttaattaactagctaaataacatgcactgtgacaagctgcctaagatttgatggagttgtacatttgcattcagacaaggatcaaaatacactgttcagcgcttcggggactaagtcccagaaactttcgcactgtatcttgttcaaggctgtgtgcttcttccctttggttacctctaattattttcctgtgcttttgttctgattatccaacattcatcacaagtgcagcttgtgattcaacaatgacaattcatgtcctatgctgatagggaattgaaaattggaggcatgtgcatatgagccaagcacaaagcttcgtgaaataattagggaaaccaaaaggagattcccgggatgccccggggtgaaaaacacagactttctaaagagtcagacctcaactgctccccacttaggtaatcagacataataacactaggtaatctttgttgcatagaatttgtgatgggagctaatcacagtgtaataataatgacagcaatgccagttcttatcaacagtgattactagtagtaatatggctgctaacagtgactaggctttggagttagtaaaacctaattttgacctctttctccaaccccatattctttttttttttaattttctcatacatttaatttgaatgaacgagcacagcaatcctcaaagtggacatgggatcatttcccatgtatgtgagaaaaacaaggctccaaggaacaggcaggggcaattcagaacaaagccagaacctaatctcaaataatgagagctggtagcagacaatttgagttggattttgactctagcacttaaagatatgtgactttgaatatatactatctcaaagcccaaatattctcacttgatgtgaggctaagggtaatacctaattagcagaatagctctttagttagaaagaacttgaattaaaaactactaatcagaaaattatattacagagatgtagtaaacagtacagtaaggacaaaagcagacttaaagcagtaggctagagcccagaatttagccccgacatacatatttgtttgatgtgcagtaagagccccaggaagacataacatgcaaagaatatttttccatatgcaaaacaagcatgtgttcctttaccttaggccacactaacatctattcaaactgatctttatgagttttaagtgcaggatgataaaatgaaaagggagatcgtcttcaacaaatagcgcttgtctaattggatgtcccacaaagccatcctctgttacatatgcagttggagccatgagtcccaccatgtgtgctcttttccaaccctatattcttacaacttcaaaccaagttgctaaacctttctgagctacagtttcttagcctgaaaggattcacaatagggcctaccttaaaggattgtgctgtggattcagagaaataaagccaatgacacagtaaagtgcccactgagttcagatcccccaaagtcttgtttaaataaagtcatgctctacaatatgtacctttaatcccagtactaggaagatggagacaggaggatctctgagacttgatggccaatcaatttagctgagtcagtgcattcccagggttcactaagaaaccatatctcacaagaataaaatggaatagtaattgaggaagattcttacctgtagcctacggacacacacacacacacacacacacacacacacacacacacacaccatggaaagagagggagggaaggaggagggaaggaagagagagagagagagagagagagagagagagagagagattttaactggtagaggtggtatactcctttaagcccaccatttgagtgtctgaaataggagaattgctgtgagtgcagggccagcatgaactactgggagatttttaagccaacctatactacatagtgccattctacttcaaatgaataaatatatgatagatggggaggcatttagacagatggatgggtagagatagatagatagatagatagatagatagatagatagatagatagatagatagatagatgatagatggatagagatagatgatacatagatacatagatagattcatagatagatacataaatacacagccagacagagaaatgatacataaatttaagacagtacttggttgtattagtcacttttttgttgtggatagaacaccatgaccaaagcagtgtataaaaggaagagcttttgtgattgggttacctcactcaggatgatgccctccaggtccatccatttggctaggaatttcataaattcattctttttaatagctgagtagtactccattgtgtaaatgtaccacagggaatgcaagggccaaaaagggagagtgggtgggtaggggattgggggggtgggtatgggggacttttgggatagcattggacatgtaaacgaggaaaatacctaattaaaaaaaaagaaaaaatttttaaaaaaaagaaaatcttaaaaaaaaaaaaaaaggaagagcttatttgtgtttccagttttagggaggtaagactccatcatggtggggagacatggcaactatagcaggatgctgagagtttatatcctttaccaggaggatgatacagaggaagcactgagactagtatgaggctttgaagcttcctagcctgcttccaatgatgtacttccgaacccagcaagaccccacctcctaaaactctccaaacactgccacatacctggatcccaagtgttaaaatgctagaacctaagggggatattttcattcaaactacaacacttctgtacaagtcatcttttatataccaccgaaatgccttttgtccaacttttccctatctgggatttttttttttttgcccttttccctgaggaaggggaaactagaagggtcattattttgtggttgatttactaccgtcttctcatcattttgcatctgcatctctaacacccaacttccatttgaaaacctcagctggttctctcatcttcccagtgctatcctaataatcagcaccagcattcctctgtatccaagcactaagttatcttcccattattctcacccaatagctgcaggttgtttgtttttaagttggggacatgaaatcaaggaaggctttatgcaggaggctgcctcaacttggtctttaagaatagataggagttttccagggaaagatgaagacatagccaatacaaggcaagcactagacaatgtcttaagaattgaagacacatggtttcacacatttctttcttcagttttgtgaaatagctattagtgatagatgtcttttccatgtaggctactcagacctagaaagcctaagttaattgaccaaagttatgatgaaaagtagtctctaatctatcaatctagccttcattgttaagtacactactttatttttcccatgattatatcccctatatttattattttacaaatgaaaaactaaggctggtatgtaatgtaacttgtctgggattataaagctaataaatatcatgggaggtaggtttgagggtagaaagggagaaggaaacaaaataattgtaatttaattttgaaaactacaaaaacatagatttatgtgttgatacatgcctataagcctagcactagggaggctgagatatgatcatgagttcgaggctattctagactatagagaccttgcttcaaaataaataaataaatatttttaattaaaaaaaaacctctcctttagcatttaagcactataaaacagcaagactcttgaaatcaggagaaatagccttctagaatatgtctctcttcattttcaaaatagcattctatttaagttacctgtttgtcaggttcccatttataaaagccaaaggaaaaaattttttaaatttctggttggagacaaagtactttctatctatagcaggttgagttaatcattctctccttggttgtactttgttcatatttctgttctcgcacttctcccactgggctataatcatctgttaacttggctgtctttcccattcaagtgtgacatcctccagactagggcccagattcttgtgacctctgtctccccatgctctatccccatgattggcaccgattgagcactcaacaaacattcattaagagaaggaaaaataaaaggtggttggtagaggcagctttccatatttaaagggccttcaatccacattcttcctgattccggtggtgtgccagaaagtgggctattgttaaaaggcaaaagtgttgatttgtagtaccttgatttctgggttaataattctaacattgctggtttgaagcgacccaggattttattaactggctcagaagattctgaatagttaacacgtggctttcagaagctctctgtgcttggctggaaatcagcagttcttcctggggtacttgaaccatttgctcgccagtgtgatcatgaaggtggatgagctggccaggagggcaagatgatgccagatccaaatagcaagagtgaagggccaaaggaaacatttctgagtttagagaattgtatgctttgccccccatgaactaagcctcagtcatttgtcatccatttgcaaattgagatccacttaaatgacatggctcccagaagaggaacaaagctgccaactaagcaattatcctgaaaatcacatagagttcctgagagacagttatttttatttgaaaatataaacatggtcattcactccaactatcaaatatttttactgattagggtgtcagatactgaaaacactgcacaaatggaaaattattaagaaaggcacaactaagaacttgaaaaagagaccattctattctctgtagccataccagctgctttctttccactctccgcctgaaagcttcatcagctcgagctacacgagggtctctaatattatgccctactatttacatttcaattttgcatataataatgaagctaataactaaatggcaaaatttgaattgaaaaataccacacatcagggttcatgtttcttggttttttttttctaatacatcaaatttaatgcttatcaggcaattccttataaaatgacgctatttattgtcaagcactgaaccttttcttgaagttcctagtttagaagacatgttatagtatctgatttatggggagatatcttacacttatttcatcaaaggaccggtggatattcctccttttttattcaaatgacaaggccactcccattgaaatgcctgctactcatcacctatacagtctcttcagaatgtcaatgagcatgaaaatatataaacagaaagcaaagccttggttgaacttttagaatacattatgcatattaaaacaaaactctctgtgaatgtagctatgaggattgccacaagctaaggccagcctaaactacatagtcaattcctaggccatcgatgattacatagtgaaacacagtattttaaaagtaaaaacagggaaactaattaattatttaggtctattttaaaatgtgtgtgtgtgtacatgtacatataaatatgaagatcagaggacaacttaaaagagtcagttctctccttccacaatgtcggttccagggattgaattcaagtcttcaggcctattttcctaacctactaagccatcttgatgaccctctcttgtgatttgttattaaatcttccacatattgcattaagctacaataaattgaatatgaaagtcttggaagtaaagctaccttcaaaggataatctctggtaaaattcttaccctctaatcctctcatcttagaattgtatttcttgccttattcatttcctttctttccacgtaagcttccctacagtcagcataagcattgacaagattcctttattgtatgaccgtttgtcttgctgacaaaaagcttcagtcactctccgtgtccgcaacaccccaccccccatcccaacacacacactgccataggactgactttggtatatgtcattgttctttcttaccacactattccagcacactcctttgggtaagatgactgcaatttaaagccctgccattcagacatatgagaacaaatatgtgcaccttgaatttactaggaaattatgccagtggaattggcttgtgttatgtttactaagactcagacaaattcattggggtcttcactaaggaaggcaaacacctacaattggattgaaaatctcttctggaaggtatggcacgataacaggctggtttctgcagcacaccatgcattcggctccccacactgctgaaattacatacagtgccataagaaaacaatgtcttttttttttttttactaagagaaaggggaaggcagatgtgagcctaaaaaatcttttctttgaacagaaaaatgtgatctaataggtttttttttccttacaaaattcaaccaaaaatcctccccacaaattcaacctttttttccccagactcccttgcccaaaattttacatgatacttaaatcaaagagaaacaaattagggtgaacatcaaggcctgttctgtactcaaagcaagatcaatctttctccatagatccttttctggcgctgatgtagaaaatccaaacatggagatacttaggtctgcaaataacctaatctgcataccagatggatctaaggggggaaaacatacacacttcttcacacacatttttttttctaaaatgtgagcatagaaaagcagatgcttttgcctcccaaaggatacgtgggcctctctcaagtagtcttgtggaacaatttcatttcaaatttctaaaatgatgaaaatatctagattaaacatgaaattgggaaaggacgggtctccttgagagacaatgaactgaatgtcttataaatcctttttaactgcttggagatattcggcctgcagtttcatagaaagatgcgatgaggggctgtttagaaagggaaaatgacccccaaatgagtaaacttttattccatgacttctttgacggaaagtttgacactgtctacatgtccaagtgttagtatatatgagatctttcttatgcaaaaaaaaaaccctctgctcagtgaatgagatttgtagctagttttttttcactttgagatgctatatgtgaagataaaaataattttccctaaaaaaatgaatttcatctatacttgatacattttccccttattacatttatcgtgtctgccatcatagcaggccatttatcatccctagcaaatcttacaaaggcaaaatgactgcagaacatggatgtgggaacttggtatttcttccttaaatgtcacatctgagtgtaaaaacagctttttatctgtgaagttctaaaactaattcagaaagatctattataattactataaaagcaaagttgaatattctcttggataccagagttattaagtaagtgagggtagaatttatgtctctttcatctgtaacagattgaaagaatggaggttgagtattaactgaacaagaactttcctattaactatccagttctctggtgctccatattatattcagtatccccagcccttccctgttttcacaagcttttcctagggaaaaaaaaagttaaagggaaggcgaagagaaaaaaatatagcacatttctcactgaagcctcagttagctcccatcagtaggatgatagcagccccacagcagatctcaagacaacagatactttctctctaacaacctggagatcatttctgatggaagccttccttgaaacatattacatggccctgatattttcatcagaagtttctgatcaaagtaaactattgtctgatgactcaggcactcacagcaaacatccctgattatactgtgcagtagtgcattgttgcctgcttttctgttgtttcttccttctcctttaagccagactgtcacttcctctagtactaatgcacctctcccaaatatcactcccagcctccccacacaccccttctagcttgaagtgtttaatttactgggaactggaaaaaccaagattggtaagaactgtatgctaaatcagagttaagaaggcactgaaagcaagcatgaggaattaattatgggcttcaaggcagcagctctgtgacacctaaatgctcctatctttagataactttcccatctcctccaacttaaggctaactctagaaagggtgatgagagaactaccttccagtatgtctatttgttctgagcacaccatctgggcatggaccaaaacagttattctaacagcttcatcttttcctgaagctgaagatgcaatgtcttaatgaacaccccatccctggaaggaagtaatgtggcatacttcatcattctgatctcaaccatgtttggagatgttctctcgtttaatcaacgcaaccttgttaggagacctagggccaaatggtggatacgtgaatggaaactcagaaagttgagtgatttgtccacagccaagcagtgagtgcatgaccaaatcctacctctggattgtcattcaggactcagctaatggcactaccattgtgtattgttccttctggactttcttatgtgaaaaaagcacaataaatatggtctccactgaaacagccttccttatttttctccgagtttgtcatgtgttcatttttcatgaagtattcaaaaccctctagttttattatgtgagggttgtccgtgaattaaaaattcaacaaatgtatggtcccaacttgccaccaaaagttaacaaatgtcaccagcaaagatgtttctcatgagcagacactgaagaatacatcccagaagacacctaacagcttattttgtgtcatggcaacatgagaaatcacctcctcaagatattcattaacctttcttttccttcatacacaatcagtctgaaatgtggctcatattttaaattaattgaaaacatctctctgtactctctcttatacacacaaatacacacacacacacacacacacacacacacacatacactggcttgagtctctataaaagcaagaaagtaaacatgatactcaaaggtacaattccatttctatgggccaacctaacatgtaccctctatggcgccttccctttctgcttcatgcctttaatcatctcgccttgctcctctgcaaaaattgagaacaatcatcatcacttagcataaataaaatgattggaaattgaaaatgtattaagtcatattactcttaacctacctcaaatcctagcttagcctaatctactttaaacatgctcagagcacgtgcattagcctttagtcaagtgaaatcatctaacacaacgcccattttataaggaaccactgaatgggtcctgtcatctattgagttctttgttgaaaggagaaaagaactaacatggtaaaagacctgaggatgggagtgtgcagtaaagtacttccctgcaatgcatacatccctggcttccatcactatcacttcacagaaataaagttcaatctctcctgcatgtccataatttagataccaccataaagttgaaaactcaggaggcaaattgaaacatgtcatacagtcataccaaggggactggttctaaagcagtactccaactcggatatttgccaatatagaggtgtgtgtcctttatacaaaacagcacactattcatgtctttctatataccttgaataatatgtacattatttatattaactaatactacataaatattaaacaaatagttcttgtactgcactgcttggagaaacagagacaagaaaatagtctgcacacactctatttgaaatgatttttcaggtgttttcgatgtgagcttgtttaaacatatggatgcagaaaccacagatatggaggatctaattgtacctccagtccttccccaggaagaaagacccagcttctaatcccagctatgtgaccttggagaaattatttaaactacctttgggctgtgattcttcatctgtaaaattagacttaaaattttatagaaattacttacacatacaacattgagtacaaggcctgcatattttagacataaaaataagggcagttgtaataactataacaattaacagactttcatatatgcctccagtttactatgtataaaatcctgagaccttgccagttgttttcaaacctctgacatctgcactcagctgtatccagaaggaattcctcatgaagcttaaccttccagcctctggctggcattgcttcctcctaaggcctgttccaatcattctactcaaagtttgcctttgctttacttaaagaaagatcatattagcttcacattgacataaaacttaaatacacatcaggctgttcctttcttctctatagtgttcacttccttgttcccatcacctgtacctagaacagtgtcagcaccttggtgtttgacaaaatgcttaaccagaaagtttggcgtacttagttacaataaaataaactttatgtatttagaaaaaaaaaacccagccagtacatttgggtggaaaatatttagcccactgacataagagacaataaaaggcactttgtaaactcaaggccaagtacttaacacagcattactgatgaaaataatgataattatgatgactccgaggaaatgtttcttaccctcactatcgctgacatttgggaccagatgattatggttgtagggactgtcctaagcattggaagatatcttgtggcatccctgacctttactcactggatgctaatagccaaatacgttgtctgacattgccaaatgtccctggaaggaaaactcctctgaatgccctagggcattgccttcagcatcaaaagacattcagatggccacacatctttcacattaagacattaaggcaagaaagagaaggcaagcgtgtagaaaagttttcaataagcaaatgtaacctcagttaacctgaaaattccattaaccccattctttgagtgctctattccctaagctttctagataacaaaaaaaaatgtacagtacattctattttctaatttgtatgctaagttcagctcattttccatctcaacagctaagcatagaaatccagttcatgagtgagggatcatcagcctctcttttgccatctattttaagtgacctggaagttccaatgttttttttaatccccttgttttgatattttaactttgatattgacaatgattcctgttttatctgactacaagtgaaatgtgacaaaaaatgaacccggtctaattagcagcaattctaccatatactaaaatcccaccatattgctgatgatttaaaagcattcgttccagccatcccactgattgtataagtgaaaaaaatgcccttaaataaacaatatttctcatttcttctttctgcaggttgtgatcctggggaaacattcaagaggttatcactacatgcttgctaacctggtaagaacaaaaatgtagttcaagcatccctgagcaatatagtccatttagttcatgtcatctctaatcagctgtaaaggaaatccaggaagcacctaatgtgttctctagatgcttggagaaacaaattcagtaactacccaaactggcctttcgtagctctggatactataatgttgtctttttcagctacaaagctatctccttttcttatttaaaagataatttgagtcaggtcttctggaactagcctgcaatcccagctacttgggaggttgaggcatggtcagaattcaaaattttcctgtgctgccaagcaacttcaaggtcgtcctggtaaacacagtaagatcctgtctcaaaataaaaataataaaataaaacccttccaaaactgactgaagaaacagctctgtggtagagttcttgcctgggaaaaagcagatattagcttcaacctccaacagcaaataataacaatgatagcaatagtaatcaggcatagttccccattattcttagattcagtttggatgttggctatttcaattaggtttgaaatgtaaaccaagagacagaggacacagggagatgactcccaatatatccaaggacacttgcatgccaatatttgatttgtgctctcagaggctaacaaatctcttccaatcaggcacaacaggatataccttcctacctacacaaaacccaacctggctttttacattcaaatgcctcatacctttaaagtccataacatctgagaagacagtgtgccaccaaggtcaccccatacctctttttattctgaaaaaacaacttgcttagtgattaacaaaatggcttataaattagaaatgccctttagataaaggttctgcagagcattgtctctatggaatgaaaaagggatgtgaaattatcactatactactaagaatctattaagttatcacaggagttcaagccaaaattttgtttcattagcacaacaaaatcacaatcgttataaagctcttaaaccaaaagaataatagtgatggtagatgattaatgtaattgtgctcttagatttctagaattaagggaaatatcttgttttgcttacaaatgtttctaaatgataaaagaagtgctattcaagtatctttctcagaaagcatccaaacactactgacttctgatgtagtatgcatcttgaatatgctgcacaaagtggatgaggccttccatccaatttaagcataaatgattgattcttctaggagaaaaaaacagtcctcaattcacatataaaaatactcagcttaggttttggacaacagatgagtaaggaatattttgagtcaatggaggttagactagggtgtagtagaaaataatagatgtttcaccaagatacctgaaacagttttgttgagtttttcagtttctttcttaccaataatctgctttccttctttcattttcctacttccatccctctcattttatcttcccctcagccttatatgttctagaaggcagtaagatatacaacacagtgtttaaaatatggggcattatgtatttactggcaatgtatgaggtgacttttggtagtgctcatacaagtatttacttactaaaaactcttgtccttaataaacattaagaaaatatatgactaggacatcaaaaacaaagtttttcagatcttaactcacatggagcaaaaacagatctaacaaaagtgaaataatgtttgatcttcaagtaaacaatatattatgctttctttatacatctgcaaacaactgtgctcatgcatgttgactgcagattgaaaaataatattgagttggagtttagaatgttttggtcttgcttgagtaaccatagatacctcagttgccttgtggtggatgtggaggtgggaatagaggaattcttccatatgttgggacccttggaattagatgttaaaacataattagaaaggcaagacatttcttgagagggataactgtgaaaaacaaggaagagagacagaagtaggaagggaaggtttcagaccacaatatacatctgataccactgaagaagggcaagaaggaagatagacagtcaagaagagcacagactgtggtgtatttctgaggaagtcttagtcagaacaactaagaattcctttgcaaagtctgtgaataacaaaccttttcagtctcactttgatcaaccattatctgataaatgccaaggaagaaacgttcttctcttgaaagctaaagtagattctgatggcacctgaagtgggagcctggtccgctcactggacaccttgagtcaagttctgcctgagaaaatttgagctcattcacatcagtaattgtctcagctggcataagatgatctaaggagaccctctctatcctagatttccagctaggccagattatgcctaataacaatctttcaaatatattttcctttcaacgttgagatctagatctgtttccatcaccaccacaccccccaaaaaagcctgcagagtgatggaacagcaaaaaagaattgccacctatggtggtggtgcgcttcagtaaacacaacaattgaaagatacaaggccatcctaggctacatagcaagaccatgttgggggaacagtgagtaaggatgtagctcagtttcatggtgtttagctaacatccacaaggacaagagtgcttgaacttgatcaaaagagaaagaaagataaacagacagacaaagaccgacacagagacaaagtgagaaagaacaaactaagagcaagagaaagctagagcaagggacacagagagacagtgaggaaagagatcactacagtgttctggaaatgaatggtgaactgaatccagagcacacaattcaggataatgagaccttagagagatgcctcctacaagaacaagcaaaatctgttccttctaaaagaaagtaatgtgtagtatcatgtcagtgtgagtcatgaaaacatgaactcattcattgtgctttgagctgccactttttcctctagtgaccttctttcctttgaactcagccacacagtttccataagtccctgaactctatattattaaagcagtggatagaaaaactactactcagttgataataataatgaaacatcatctctatcctccacaaaatttaaagcacaaaaaaaaaatactccaaacacctctagcaatgacatacacatacagagtaaagcaaaactatttagaagtcatttggatggtcaaaaaaggaagtggagctaagaagatgcttccttccaagatgagccatctggcctttcaagatgagccagctgggtaaaaactgaggatgtgtatatactcgggggaacaaactctagtcagccttggtgttacaacagcacagaagaactcctttcttctacaaatgcaaattcaagaacactcaccctgactgagcttcctatactctaagtgtcttctttgattctcagctccacatatctgtcaaagacacctgtatgcttttacataaacctccttaaatgcagttctaaaacgaggaggaagcaatcccataaatgcttcaatagaggccgtcaacaggtcagtgtgtacactattagtgaaaaataagctttggaaaagttcatcttgctaaaaatctcagatataaaaaaaaaaaagcaaagattctaccaagaacacaaaccagagatgtgacatgatcaagctagaagtggacattcctgttaagcaagtaagtctccaacaaattccatatccatatccatatgcatatccattggtgatatcttttcttgctagaggttgttccataattgtttcctcttctagaagaatgctgttacttggtctgcttgagtccccagcagtaactagtatgtgcatgcaacctgtcagttacgcagcacctttttcccatatggctgggtcctataacagtacctcttatattgcattgcaaagcatatcctgtatcatgatttaattttttcatatatgttgacaatagtagtagattgatgtgaagcatggaggtggtatgacatgatacaaaccaaggcactagcatatgagctaagagtcaagcttaaatgcttggaattccttcaactagacatatctctgtaactgtttattcatttgcaagctggggaagaaagacccgatcactatttcccagaataggttatttgcatgagctagtcttaaggagtacatggcagaacctttttaaagcgtattggttttgaatttatattaaatacatattagaaaaaataactactgcatcaattctatgatttcacaaacattctttagaacaaggcagaattgctgtttaagtctcataagtaccatcaatataaaaaaataagtaaattttggttcagatacagatttaaaaagaaaactataaaaggtggcatatttaagactaaaatgttaaaacactccaaggtcacttgcagttctgtacttcttcctccttagatatcacccaggtcgactgtgaaggaaagtgtcaacatagcaactgggtgaatgctaagcacacaggtaggggagcaaaaaccagaggcctactgtttttaaggcagactgaagcattaaaatcagtccagatgggcaaatgctgagagaactgtgagtgtccttagccaagttccaaacagagataaggatccaaagaactattcaacgtagccaagcagttgatacaaggcaaattacatccgcgttgagatggtccaatagcagatgttcaggataccttaaaaatcagaccaaataatccaaacacttgaggtgcccaggggaagacaggagccatagcagaccatattcagtgctatagtgtttaaccactaccttggaagacctgacagttccccagtgttcgaggcagctacagatgctgaaagtggaggtggggtaatgtcagctgtcagtggtaaagaatgtggaggacaggcaatcaagctgagcattgtaccagggagaaaggggataagagttaatggacctctgcctgccccctgctgtgctcgctattttcttgggacttctttaagcatcttaaaacatctaggagtagagacttctcaccaccacctcctcaaatcttttttaaaaatcaggaaatggactcagaaaagagacccaacttgcccaaagtagacaatcagcttataaagtgacttgtttttcctgctcagcccacccatgtgtctcagcaagacaggtcagctctgaaaaggtcacagaagagtttgtgcaaagagggactggtgggatggctcaataggtggaggcaattgccagcaaacctgacaacctaagtaccatccccaggacccacatggtagagaaaacagactcctaagaattgccctttgaccttcatgcatatgcagagatataaggatatgaagcacacacagtagtattatgagaattaagtgatcaaagacaattttaaaaacagggacagcatactgagcatggtatggtaggcatgtaatgtgagctcttgagagatggatgggataggattagggattcaaggtcatcctcagcttcacacagaattccttgaagggcctagaaggaaaggttgattcaaagaataacaaacaaaactttgtgattctgtactttaaagctgtccaaaaaaaatgcatctaaagacacatattgcatcccactatgtccactccctaattcattcttgctctctccctcttggtttttcattcttctgtagctcccccgccccctcccatttccctcttgctgtctcttttccctatatctccctcattcatagcatattacaagaaatggggagagacacctctttttattttactaagacagaaatgatcactcataaagtagtatgcaaaatcacatccagcagtaaactaggtttgaagaactgacctctgtgcttaccagatcttggaatgaaccaaaaacaaaaaagaacctgctttgtttcaagggaaagcagataagattgagtcatgctgttggcatatcaataccaactagtcccttatgctcccttccccttccagggcttcctgttctgttctctgcttccccttcctttgttcttccaattgtaatgttctatataaaaattcaaatgctcaaagccacgtgttgtgatgccctcagcagatggcatgtaaacacagaggtcattgggttggagcctagttttataggcaagggaagtgggcttgaggcaaaaagctgccactggtcccaagtgccaggaaacacagtccacttcccctggatatacaacctctctaatggctcaggattcagtttcttcttaaaacagagatataatagagcagaataccaagagacagaagactggggattggtctgaagtctaaacccctatcatgttattgagggtcacaagcattagtcagcttaaagtagacaacttcagatactcattcctttttctccaaaatgcttccctgtgtgtctctccttccttttccctccttcccctccttcctgactgaaatttacaaggaaagatcactacctagccaatgttttaacgaggtgacttcatagaaatatatcttctctttcaggcttctcaatgctgcctctaaaacagggctacttagtagatttatgtactagtgtttcatgattttatgggattatttcttagattgaaaatatcaaaacttgataatgtgcttagtagcctaaactactggatatcatagctgaacaacacaggacactgcagagatacatcattctggcagctacatggctaagaaggagcaactcactgcctctgtccaggatcaccatacaagatcttagcactaagtaccatatatatcaaaacttaaagtattgcctttaatgatgcatagtagttttcacataattcaaaagcaaataaaaatattaattcagaccatcataagctgagaactgtctgtacttggactgtggtccctcggtcatccacaagcaacctctcttatagttgtcaagtgaaaaatgctagtaactgaaagcaacttatcagctcctccaccacttttcattttattctggccacagtaccatccattatatatcttcccaatattttaatgttagctcttttttccccttctcttcccttcttcccttgttcacaaatcccaggcctcacctctattgtgtggaacattcagatctttaggtcttacccatggtctcttcaaagttcactttatagtatccagaagaaccaaaagtctatttacttaacacagtctaccttttcctgaagaattatagattgaaaatggcactacattatgtatattaaacattacgtagagtttctactcaaccagtgtttatttctgcttgtttcacttctgttttatacatgttcttcttaggtcaaacatgaaatgcttcggcaagtctggttttttgttttgttttgttttgttttaaaaaaaaaaaaaagagcttcttaactacttacagaggtgaacccatttattcccaaacctttatagaccaataaaagtgcaacaaaaataaattaaatgaaatagtcaaaggcagacacatcaaatataagtctaatatttaatattttacatttagcatttaatatattagttcagtagccataagccaagtgtaacagctacagatattgatagcaattattctgattcctctctcctatcatctgactggtgacactcaacagtcaatgaaccagcactaagccacacacaactagggtattagaaccctaaaagtatacaccgtccctttttatttttatttcctttttgctgtgtaggagtagggtacacacatagtactctccatagtacacacatggaggtcaaatgacaatgtggaagaattggtcctttcctactatcatgacggttccagggtttgaattcagatcatcaggctgggtggcaagtgcttttatctactgaggcaaagcaccagtcccaggaaaggttttttcctatatcatttgaatgccccaaattgcattcacttcactacaaagaagacaggacatcatgttctggagaaacttataatcatagtgatgagaacagtcttgcctaacttatagtaactggcctgaagacagacaaagaatgaagaaagccacaatgtacaaaatcagtactgtactgcacgtactgcagacagagaaaaactttgtaaaagggcgacttcaaaggatgctctaaacagtaagaaggatccatttacatgataaatcaggaaaagttcacctaaacagaacatcacatgtcaaagttccgggcaccatgctttttctacattgtcaaaatgtaattttatctagaccagagcaaggctttactaggccagttaaaagaacaatagaaagtaattgatatggttcaagtaagagaaggacatgatatgatttatgcctcagatgaattcactacagacaaattttacaaaaactaaatcatacctcagaaaagctgttagtctaaaacaaaaggctatcagaggctagttcctcaccagtggcaattataatgtcacagttgctttttttaatccttacaaatagctccaaatagactgaagtgtcattagggtggtggccaggtacgatatatggctcacaattctatccacttaggtttcagagaatatttggtgattggattagagaatagaccatttagtaagcaaggcaagtaacctgtaaccaagtgctaattcatatggtgtaatctttccctctgcccatttcctccgcccccaccacatctggaggaaggatctgctttccaggggggggggaagacttgtgtctttcattaggacacaattactttgcatttctaggttgaagcatcactccgatgaacaattcaaatagcactaaagacagaggaggcttcatgcaaatgctaagataaattgttgtccttggcagtcttccaaatccacagtctactgcttttatctcccctctagcaggccacttgcccatttctcacccgtgatctattatcaacgcaggaaaagtcacccaacttactttgtacttgctctcctctatggacaaaatgtgccgtaagaacaattctatgtgcaagaaatctctgtgtagtatcctgaaaataaatgctctaaaagtaaaccttgaatgcatttatttccagcttctaagttatccacactatctgaaggaaaatgatctgcttaaatgtcaatcaatggagagcgcataataccaaagccattcgaaacttttgaagttagaattttatcagaggcagtttgtgtttgaatgccaattgttcaaaccccagttttataaatgatggacttcgagaattcaccaaggactgtttacagtactttgcataaacttcttaggcacaaagttatggttcatcttatatagccgactgcagatatgagcaacagtgttagaaaggtgaaatacaactgataaaatctagcctagcttacaaatctaaatgagtatcttcagtgctcatgttcccagtgaatactgccattgtcacagaggtaaataagccagatgcacagatatttaatacctagaaaaggagaaaacattttaacttaccctgtatgtcagcagtaggattccttccaatctatctctctctgctttccctcatatcttctaatcgcttccctgtgcaaagttcaccgacacaaccaaaggaaaagataccactgtggcaattaggcaagtagcactgatttggatgtttagtgtaaacccacacaagtaattgagtatctaatcatgagctgtaattgttaaaatccccatgaaataataaaatgggcttaacagaaattccacttagtacaacagggaacttgggaccttgaagtaacttagcaatgacattgcagagtgactatacaaatgctcttattctacagaagggaatgggataataaagaagacaaaggtccataagcagtcatcaaatgtacaacagcccttgtaatcattagagaaagaggaaaagaaaagaaaaaaaagcacacattttagtacaaaatacagccaaaattgatgtagcactttcttagtcattgtgttgctaatcaaaaacattggtaaagatgtagagaaagtataattcttaaatatgatggatggaggtggaaattagctcagccattttggtaagtgatagggaatttcctcaaaaacttctaaaagtaaaactactatgtaacccagaattgccatttctgggtatacaggtgctcctagatctggtggatttcataattcaaaagtacagtaaatcaaaactacacctcgatcaagccagggcagtggcaaggactctataatcataggtaccaaggagacagagccaggttgattgtgagttcaaagtcatcacagtcaacaaagaaagcatttcagagcaagtgatgcatttaacatatttaactcacccaacactatagcttggctccatagcccatcaaaagttatggttgtttactcttaatgtagtcgctgactggagtcacagctcactgcagctgctcagcatcctagcactatctgcatactgatagcccattcactcgtataatttcacatgaactgaatttttgttggtcagcccagttgaatctgcgttttgttgaggctttgaaggaagtcaggccacagtgagcaaaatgcaatgaggtttgtgactatagttatatctaggactttttgaaagaacttaaacttaatctcaaatgatagagatgagtggagagctaagaatcaggcacattctactctcagccaactactttcactggcatccttctttatcacatttctcttccccattttatttatttacctatttcagctgttacctttttatcatataagaagttttacggacggttttagaggtatttgacatttattgtgctttgagtaagagtagtggcccagataggctcatatatttggaagcctagtcatcagggagtggcactatttcaaaaggattaagaggtgtggccttggagaacatgtgtcactggttgggttttgaggtttcaaaagcccatatcaagcccagtaattcccattggcctgcatattaagatgtaactcttagttaattctctagcaccatgtctgcctactacccatgatccctgacatgacaataatggactaaatctctgaaactgtaaaccagttcccaattaaatgctttcctttaaatgagttgccatggtctcgtctcagcaatagcaacccaaggtaagacaacaacgtttatatccaaactttgagattggtttgttaacaactccaaaagaaaaatccaacaacacgctggaataaacaaattgccttaaacacagtgaagctcagaacctgcagccaaacaaactcttcctcagagacatgagccctaacttctatcgccaatctttcctttatatactttaggtgctcagtggacatttccacagtgtcatcattttacagaggtttaagtgagacttgaacaatacacccacacaatgtttttaagtggccagcttacataatgaaatgttttgaaaagttatgatagaacggatagcaggaccaaggacctgtaagtgtcttctcctattaagtagtcacccagttgtcccctttgaacatactctacactactgaatgcagcaacgtgtaacagaaatgccagcatgatttggatggtgttagaaggcaagctggagtctgccgagtgctgtctcacagcaggcaccactctctcaccttcttcactctacccatgaccttcacataacagtgcttcatgatttgcttctcactagtgttgtcctttctgctacatggttttatttgtagagatttcagtggaactggggaaacagtcccacctctttagataatgaggagacatcaaacccagggaatatttgtgagcaagtaatttaggagctccaactgatttgataaaaagaaaagtgcagtgagatccggtcagctgcagtgtattataaaaattgatcccacttcgattattctacaccttagaacaaaccttgccctttaaaaaaaatccctattatattttgaatgtacattggtgacctctttgctaaagttgcctgtataatctcagctttctgtatctgtgggttgtatttgtacatgcataaagtctagctactgatggtaaagtaactcacaatataagatagctttaggacatgttagaagagaaacagagagcccagcagtaattgtcccagtcctattgttacctatgaagcagttacagcatgacactctgtctctaccaataaccttcacacaactattttcatatttcaccttccaggtgtcctatggatgtttctcttgtataatttgatttatggtcttttcagtcaactcagcacatagtccctcccagttctgggtctacaggtggtcatctcaagaactgaaaattagccagagtttgtggaaaagttaaatgatctgaggtgatatataatgagtatgactttttaaaggctttgaaccatgtccagtgagaagaggtgaacctcgaatcaggcagtatccgtctcgtacccactgctgttctctgacctccatgctctattcaagagcttcccatcttcattttcatttctacctccatggaaccagtgaatgtttctgatatagttttcttttagagagaatgcactggtctcagtaagttttagccaaatattcttgtcagcacaagaaatgaaccttagttaaatctatagatactcaaaatacctcaccatgttgtgacaagatgcaaaggaaaactgaagcctttttatacctcccattaataaaaatattaatctctgatattctccccttgccacaagtacaacttccttctcttctaatagctccttatattaatgcctatgtataaattatccaaataatctagtctgttttctgtatctgtagactgtatacacacacacacacacacacacacaatatgatcagaagcacagtagtttaaatcatggcagaaagaaaacctgtcttatcgttccattgttctgttgtttcagtctcttccggtgcagataattttgggtcacctctttaataatgcttactttgttaaatttcttcagacaatgaagtctctttgttacgtgggattttaattgcaaatgtcagcagttcaatctagcagtatgtaatataaaaacaacatatttgagtacgtgttagaatgtaaacaggtaagccataaaaccagaccactttgcctttcagatatcagttataagttccgttttttttacaatgatatataccatttttatttacttcttttctcacatgggaattgttatcatctctatgaaattaatatctctccagagatttagaagcgactccctttttatttactcaccttttgctatgaggtcagacagacaaactcaagcagtaaactttagtaagcattctcggcaagtgaaattcctttaaatgatgaaataacgggaaattttaaattattaccattcagttcctgtctctacatcagacttcctcctaacttccctcatcctgccactttgtcctcccattaaaactcttccattgtcctactcacttactgtgggtgctgtctggattccagtctgacataactgtctttatattgcttttaaagattagcaccatttttttaaagatttatttattagtttttgtgaatacactgtaactgtcttcagacccaccagaagagggcatcagatcacattacagatggttgtgagccaccatgtggtttctgggattgaactcaggacctctggaagagcagtctgtgctcttaactgctgagtcatctctccagccccaaattcacaccttatacccagtagcagtgagcattttatagaatgaaaattatcaaatagtacaaaaatggatatttttcctgaatgttttgaatgttattcaaagagtttcaggagccagacatcaattgcctttagctgagatcctaaaccctaagaaaactggggtcctccttttcctccatcttgtcttcccatcattggtaagtgattcttagtcatctctcctctgtcaacattataggtaaacatgtggcaaagtcgggcttggttcaattctcaaagatgacaatgtctcataatataagacagcagtttgaaaagaaaaacagtgaccacattgccaagttgaatctgaatgatgttagtccaagatctagctgagtcctgcacctctctctgagctccccatgttccactactgatgttactctcttgattttcctctaagtaagcaatgttgatttttgcatttgtgaaaattttagatatatagggcctcgtttttctcaaattagtaccattttatggcaatgcttagaggtaaatttggtaagaactgtggttcattaaactccttacaagagtgagaaaatagatgaatacagaccaggactcagtcatccccttgacctattgggaatatgtaccccaaaacttagtattttaagtgtctttcatcatttgtctttattggtcaaagtattgaaggtctcttctattgtgctatgcttatacacagtctttagatagacttggtgtcaaaatcaacttcaaggtctctgtgtagtgaagcaaggagtgaattttgaagagttatataaataattacaatgcccaatgtcttaatcaaatgggtggataaagtgagctagttgccagccaaattcctttctccaacttaattatcttatcacaaccctccctgccaccatcatttgattctcctttttttgtacgttctatgtgtctatggttatccatcctgttctgtttagtgtctttacaatgaattttaagactataaaacactaggaagggttgtgtgtgttcgacccagtgacgtgcacaataatctaactacaaatgatgacagaacgtagtgcctgaaaatatgaggtaggagtctagcagtgcttgccttttagtctgtattcattacttctagtgttaccattctgtgtttatagactactgtgtttatgtctgctagtcagctttcttgtaatagttatttcactaactctgggtagtttgaggcctcctcaatttacaactttgtcaattctagctgtacacaacaataaactgtagtgactcattttagaaacagaacagttcttctaaagtgcaacaaattgagaaggcagagcaggagtcacccaaacatttcttggctgtcttctgccactgaccatctaccattttattgaaccattttgtcacccatgtgtttaatgatcatttgcttgattcatcttttgagagatttttaaagccttaccccaatttgactactgtgaacactcgttcacccacctaaggaagatatctaaaaccctaccctttacccatggcagcttttttgtgcagtatctgttactgcccagtgttttcacttggtaaaatggaagctattaattaaacccatattctctgtttaatatttttctttcttttggaagtggagagtgagttaataaactttcatagcaatgatagcctctgctatctgctagatttatacacaagcttgcttctctggtgattttagtgcgggggttagcaaattgtagaaaatattgtcttagtatctctcataaagggatcctttaggagaaaactcatcacaacaagttaatattaactttaaaatgccttgtggttattagaaaggaggaatgattctcagtatgcaaaccaaactaattggctccttgtccaatctccttaaattcatatctcacaatgaaaggaagatgataggggttctaactaattactgaaaaagtgtctcactaaaatcttttctaagaccattttctgattaattttaaagagctccaaaattaagaatgtaaagttggagttggtggttggagaagaacacatggggcacttctgaagactggatatatttgtggctcagtttatgaatattaatgaatattaataatattcacttaaaatatacgcatgcttttttgtgattatctcccatcaaggaagatgttctgaaagtgcaaaaaagaaaataaaagaacttataagaatatggataagataggcatgtgcatttatcaaaacacatcaagtatacttttaaaatttgtccatttcatcaaatataaattttccctcaaaaaagaaaagaaaaaagcctggaaagataacatgcacacatgtatgtacatttacttgtatgtacacatgtacatgcccacatgaatacatacttataccacaaatacaaaaaggatgggagaaaatactatataaacaggaaattatagctattgacattggggttaaacctttggggttaaagtatactaatatctgcacctacttaacacttttttttgaaatatattccaaaaattgaatgaactattggaccagagagcacaatagtaaaatatgaatatcaactataagggttttcactgcatgtttgctttcaaagtttccatatatttgaaattttcttacactaaagtgttagaggtgatagtaggccagaaaacggctcagttaaaaatgttctagacatggtcctgaatttgggtccctaaaactcatggagaaaaggtaggcatggtggtgagtgcctacaatccaagtgtgggggaagggaagcgggaagagacaggagaaccctggaactcactggctagccaacattgtcaagtcaatgagctccagttttatcgagagatttttgcctcaagagaaaaattgagaataatttaggaaagcattcaacacagaacactggtgtgcatacatatgcttcatgaattcatacacacaaacacaaacgtgaacccacacacacacacacaatcctgacaataatttaaacaagagagaagctctatccagtttccttttgattttcaatttaaatctgaaatgcctgttcccagaagagtttgatacataactactgcgtgtacactacttctaccccttccctcgcccccctttgctctttcaccttcctcttaaattcatgacctatccttttatatctcagaaaaatcaatatcttttccaatttttgtctcttgattttttttataactagtaaaattgccacagatacattgtgcaagttttttctccttgcaattttcccaagtggtaaataaatctattttcttttctaatgtctgtctcttgttttctttttatacacaagaacaataaggtacacagactattcatctgaattttggtagcagctatgttggaggaaaactcagaactagccaactcctaaatttgaaaaataaaggaaattcccagatgctagtgtcttcttccttcttgctgccacaaaagtttgatgtctctaagcatgttttttttttttcgtttactgaaaataggggtatttttcatacgatatattctgattatggtttcctctcccccaactcctctgagatttcccccaccttgcctcccattgatatagaaagctgccatccattcattaaggattctgacacatgcgcaacaaagcacatgagaccaatatccaacagaagtagaagcaattcctgggcaggggatcccagaagacagtaatactcaagggagttggcagtgcccatgtagaaaaggcttaggtgtgaaccctggggagagcacttggaaatacttgggtgacagagacaccagatggtaaccagagcaagtgaaggagcaaatggcggatgctatacagatgtcaagactcatttatggattcatgtgagacgcaccctggggtttatgccatcatatccaggcaagctgtcagcttcactcactggtatttctgtgaatcacaaatgtctaaatactcatcacaagaatctgaaacactttgctctgctcagcatgttaaggtgaagaaaagattttctatcgcacttcttaaggccaaacatcctcaacattctctagtcacatagtgttatatttgaagtctctgtaggaagactgaagaaaatacaggtaagtgaaatcaaatatttgcttaaaagcaaaacatgcattggtcacagacagaaaaatgaaagcatgtaccatttctccattttgtttgtactttcaaacacatggtggcctaagaattggtttcatatccaaggccttcttcattgcgaataaataatcctagggaaggaatctttcatttcatccttactctccaacagataaatgtaccagaaacgtatgtctctcacagtcatgatctttttcactgtctttccagggttttactgacattgtactggaaagagtcatgcatgggggagccaacattacaggtttccagattgtcaacaatgaaaacccaatggtccagcaattcatacagcgctgggtgagactggatgaaagggaattccctgaagccaagaatgcaccactaaaggtaatgctccaatatacacagacaatgaaggccagctttccaacgcttttcaatatggcctttatatacttacaaccatcctgtgatcaagtgctcttccctcaaatgtgattcaataactcttttaaaaagatcagctgtaactgactctatagtataacctaacccccaaacgaactatagagaatagatcttgtaaaaaaaaatctagtgtttgaaaataaattagtttaatgtttaaatgaatctcatttctaatattctcatagtaatttacactattacatgaacctgaatcaggcaaagggtagaggcagtaggaataggtaaagattgatagtctaaaacagtaaattggattttacattatttatgtgattgccccatgataataagttccatgaatctcagaacacccaaatgaattagtctctaatatagaatatgtattacctatatgtacagaaatattgaacagaaatagttacctgcctacaaaagtgtctttaaaaataattagatttcctaagttgctcattttcccaaaatcaagataagaatattaaaaacagaaagtcatatttagagtgcatattttcatatgtgttccctatggttagaaaactatttactcatgattttaaaaaagataaaataggtggaaattatttgtgctatacaaaggtttcctaatatattatatatattatcctaatatgtatatatgtgtgtatgtatatatatatatatatatatatatatatatatatatatatatatatatatatatcccattacctcagcacaccaatttttgctgctatagtaaaaattcatacaaagactgtgatgtaagaagagtcaaatatgttaaaaccttcccccttaaaaaaggaaactgaggaaggtcttctttctcatacttcccagctctcctttctttctaacaataatagagtagagaatactagggaagatagatgaaaaagatgtattctctactaccctgaacaggtcacatcagaacctgtaaagatctgatacaactagatacaagtaaagtttttaaacaattgaaatgctctaggaaaacttgtgaactaaacataacttcatagttcaataaagccacttactagttagaagctaaccatatgactataatgcagattatatgtgccagagctttctagggcatttccatcttaaatcatcctgccccttggtcagaccaagtgtcctaatttgtcttggtgaatattgtcacattcccaattaggaatcctttataatcaaatattatttaatgtactaaactggcatgatttctcatgctatagttaggcgagcttacaaaagtttatatttccatgaaactgcctaaccacactgctttgtggtgttttgatttagcaactttagaagacaaagatacatttattcattattttaagtgttctcaacaattttataaacacaatgttagccacaagaaaatgaacaaagataaaaggtataaagagaaatattgcagtaaagattatccttgctctgaagatatatagcttctaaaaaagataatgaaaaccatctcaggtactcattaatactgagtgtgtgcatgcaacatgctagtacttaccattaaaaaatgcttagtcttataagtaaaaccctacaaatggtttaagaaagtattgaaccttgcattaaatcaatcaaagatcctactttaatacttgacataggatatatagagttagaaagatcatttagaaattaaaatctagatgttgtttaatacatatttcataaataattcttttcattatttattttagattgactggacaatctcatgcatgggtacagaaactgaataaagtacaaaattaaacatttcttttaatatagctttagaagaattgcattaagactagtgacaatgcatgcagttggttgggaggaaaatcaccactctgttggctttaggtagtgctaggatgggcaaacacaaagatttttcttcatgaaagaaaatatgctctccttatagtcatacttgatgagctgcttctgaaaggaaagtaacaagagaaaagtaaattgatagttgtaaagacaacaatgtattcactctcaattgtatttggacagacttttatatagtgagaactccccttaggacattttgctacactttaaaaagtcaataagattccatattctacaagtattcatcacccttgcaaaacagaggccagcttattttaatcatgctttgttgattcatttaatggaaaagcctccaccatttccaactgcagataatcaaatcccttgtgttaagtgactagcagcatccctagtagaacatgtcactgtatacaaggaacagaaagtaaagtgttctcgcctgaaagaggtagcatcaggaagcattgcctacaaattgtcaacgttatcagatttaaaactcaataacaattgtaattttcgacacttgaaaagaatctttggtttttgctaccccctgggaaacaaaaactgatttattgctggccagaggtcctagcttgcttcaaacatggtccagacagaaatgattaatgtttccttccaaattaatttcaagctgtctaacttagctatttccattttcccctaagtaaacagcagatctgaattttctattacaaacagcaataactcagtcttgctttaggatatgctatttcctctctaatctatacatgccatcctttaacatcacatgcatttcttctcataaaatatccagccttttatactcactcactcaatatgaaacagtattgagagcaagaaagagactcccttgagccatttgatcttaataaccctaacatgtgcacacatggggtaaaaggcatcattgttgaatgcatcaaagtcagtcttgcccacagagaattttgaacttgaataattaggatgatatcattgtagggcaaaaggtggaagtgaatgaaaaacacaaggaacaaggcaagtttctaggatgtcatttgtcatgctatcttgtttttcatgtgtttattttagtatacatctgcactgacacacgacgcaatactggtcatagcagaagccttccgatacctgaggaggcagcgagtggatgtatcccgcagaggcagtgctggagactgcttagcaaatcctgctgtgccctggagtcaaggaattgatattgagagagctctgaaaatggtaaggacaatttcttgctggggaggacaggccttagaaagacacaaaaaggaagtcctcagtcccaaaggaggatggactaagaaacagcatctcaggctgtgcagaaaagatttgtgtggataatcacccaagtctataattccaccaatagaaaggtctgctgtgaagttagaaaaaaataaatttagcgcaaatacatctttggttctatgctgcactgtacctggtaaatgaaacttggtaccctgcaaaattatacactgaattaataagtagcttcaaaataacatatcttctgcaaatatgacatttcctaggaagatttgggattttttttttaatgaaatgatcctaaatccaagatgggcattaaaaaggacagcagcatcgttgggctcatcagacaaattaggagcctgaatggactgtggaaccgagccagtgtgatagtatttctgttgtcaaagagaacacttattctattcttcatggtagaatgcaggaacatggtgcatttctagacctacttaagaggctttgtccagtgccacaaagaaaaagcctaaagaaaagtacaaggaatcaatggatagatgatcaaataggtcacttgtttttagtatttactgggtaagagatcatttaaggcttcaagcagtgtcctttgaacagattccattatttacactaggagcaatatcacccattcattgcagctttccaagcaaagctctttcctgaatatttaactttatgcctgccacatgttcctgtatgcattaaaatgagcctccaagagtacaagaatctcttctttccaactaattatcttgatgtttgggacatccagatgagcaaaagagataggccatcctaagataattctgtgcacaactcagcaatgaagaatcaggaacaacctcataacgtacaccattttgtgtatttggctctcttactgctgccttaatttgccaagttggatgcattcagtccagagaggttagtggcccctgtgtctctctccaagaaagagatatgaaccattctcaaattgtgtagacttttatgtcattgtgtcaattccctaacagatgccccgagtgtagttttatggaagcagcggtgcatgattttgaagagcagctaattaaattccaccttcctagcagttacaagatttgtattgtcaggtggaacataatgatgagtgaaatataaaactgcctcagagtgaatcaaaatgagttttcatcaacaaaacctcatgggcaggagccagcatttctaattgattggccattcataacatcaaccaccactttccccaagtagaaacgtggccaccagaatagaaaataagaaaccaacttggatataaatcaataggaccaaccatcctgtcacaaagaaaaatttctggacgtttaactcactggtaagttcaaagggcaggccaaataagccatcctccttcctaggccttaatggccaatcacctaatctcagggatgcttcacattttgtttctattctagaaagcaatggactttccaaaagaatatggtccttcaaaatgactgaaaataagcctggttttattacattttttaaaaatccctttttactgacgttcattaaaaatgagattgcacgatgtacaggcacccttccttatgactaaggatcactgtttcttaataaatcattttcttcccctaaagaaatctagaaaccaaaccattgtttttagatagacgcgtgcgtggggtggggcctatttaaatgaatatatagacatgccatccattctgcacttagtaagcccctatgagtatgtactaggctccatattagtatgcaaatatgagacaagctaaggagagctcgtatttgaattacattaatgttaaaaacacagaaaatgaatgtcttttaccttgagatgctcccaatccagaagatatagattattaaaattataggtaaataatattaaaactatttagatcaaagagggattctggatgaggtagtgggaagctgtcactgacattcaatactagtctatatccctaaaaatagacttcactaagagtggtggtccagtcctatacctactccctgaagactttatatcatgagggctggcatctctaggacacctgttgacttcccagctcataaatcaagttcagataacctgggtcttttgaaatgtgtaattcttaatgagacttgaaggcctgagtatgcacagcaatgaaggatttctatgcaattgtctcagctctatcaaacatcacaacatgcatcaatttcatcctactgaataatgcatcaataaagggcccatttctttacctagagctgtcatctcacatggtctacaagcttagtgcttacgtttgcttggtcagatagaattgccatatcaaagcagtctcatggtctcttaccggcactcagaaatctacttcttttaaaaactattcccaaagccttgatatcaattttccccttggcagtatagacccattactgtccctgacttgtttgctagcttgttgtttttataaatgaagagaaagatattttgtcagcttatcctcaaacaaaacaacaacaacaaaaccagattatttttctttaaaatctctgacccttactcaggaagtgaaacatccagatagactgacagtctttatttgatatttctaaactttagggcagatgagaaaatctgtcagtagatgtggccttttgttttcctatgactaggaacccttagggcatatatagactctgaatttggcatcccaaaacaggaatggagctctaacacttctgtctctgttgtggagcactcaatgttcctgattccttgaggtccacaaattttcatcagtctttgaactatctctgcatggcagccctgatctctgccacctgtctgtaccttggcatatagttttaatagggaggaaatgctgcttctctcacagtagaagtccataaatgcacaaccctctcaaataaatagctaaagtcactttgcttggtaatgaattcagattggagatggaaagacttcctgggttaagatgcttgatgaccagaggtcaatcccaagatcccacaggggaaggaatgaatcaactcctgaaaattgccctctgacctccatatactctgtagcacacacatgcctgtgtttacatatactcatatcagagacacagaataataaacaaataattgtgaatgttaacctagtcagactgcactgtgacgcttactgcataccaggcataacttgcaactcatttaatcatctaaatagttctgagagattggtgcttctgggatttcccatgtcacagattaggattactgagtcatgctgtggaaaccaaatttttttcaaatattggaactatgaggattagaaacaatgctactccacaagaaacacataatgcagaataatgcattaacctatttcagcctaaagtacattcataagaagggactattataaatattcaagtctttgaaatactggttaaagtcatctcactacattatacaggtgaccacttctaatactcacctaaagtttcataacttaaaagcctactaagaacacattgttaagaaaataaggctctgtgaatacttgatcagcctcatagaattcaatgacctgaaatgaaaaccctcaaagatttcatcctagggacctagagtcaacaatgtaaaaactagtttaacttttttcacctcttgcctttttaccaggtgcaagtacaaggaatgactggaaacatccaatttgacacttatggacgtaggacaaattataccattgatgtatatgaaatgaaagtctcaggctctcgaaaagtaagtagccaaaacagtcaataagagaattgtctctccaaaggtgagagcatgctcacacaagatgtgtgagaaatatacaaagaaagccccacttggtgtttgtctttccatctgctaaggaacagagataagatacataaagttttgtaatcagaatgatccaaccatatcttattaaagaggatgacgctctaatgcttataaaagtaatagactcacaagttattaataatttttctaaacaaaggggaagaatgacaaactctatagcatgctattaaacagaatcttcctaggcacatgtggtttttcacaaacaaaaatgaaagtaggtcattgccaacccaccacccaaagtacttgagacaaaatgtctttcttcagagctgaattgtatatgcccagttagcgtctaactcactaacaattgagttagacataagggggattttgtagccgtgtgataaacctttagaatataaactatcttgcatcatatctaccagctattaacaggcttttgacttcaatgtatcagctttctgcaatcccaacattttctgctgtagaaagttaatagaaaaagtggtcattacacagcaggcacaagtatttggcagaattgtcggtaaaggtgaagtgaggaaaggaatcctcaagatcaaggaatagcaagcacgcctctggatgtatcctttttgtcctgagggcagtaaaaacatagatgggaccagggtatcaatccttataaatgtcaagcttcctaaaatccacttagtatttcttgagagaaaaatgggcatccagatgaaatgtctgttctttctaggctggttactggaatgagtatgaaaggtttgtgcccttctcagatcaacaaatcagcaatgacagctcatcctccgagaacaggaccatcgtagtgactaccattctggtaagtgtggacagacagcagggaggctttctgaatagttgcaggtattattcagttctaagtattccggacagttctaaaaatattagtcagctagtcttgagtttaagcatgcagaagttctaacacaacggctgctcaggaaccctcaagcacctcttcgtaatgaacaaaatgccactatacacaatggaattttattcatccataaagaaatattaaattatataatttccaggaaagttttcagaacttgaaaatattatactaagtagaataaccaaggctcagaaaagcaaatactacatgctctctctctctctcatattcagatgttaatttccagttgttaaatataggagtaagtatgagtaaagaccaagaaacttgatagcagacctatgagagcaaagagatattaatgggaggggttaatgaggtgggggatgttgatcatatgtgatatcaacatgaaagggaaaatactgtggacaaaatcatctagaggggttggggtaagtgtggagggaaaggaagaggtggataatcacccagaatgaagtatgtgtgaagattctacaaaacactcaaaaggaagaaaaggaaagaggagtagagggaatggctcagtgggtaaaggtgcttgccaccaagcctaatgatctgagtgaaggagagaactgacccctgcaagttgtccctttgccctctacccaagtaacatggtatggactcagctgcaatatactcagaaaggaaagacagagaacaagagagggaagagagtggatgaatgaatgaggaacaattttacatattactgtcctcttctacttccctcctaaaagaatggtgcttcaccagaatatagagtctaattcttcattgtgtagggttgtcgtgtgaaaaaaagaaaatcagttaatgttctaatattggatctaatattcctttgtataactgtgcaagtctctaatccttaggtttttatttttgcaatttgtaaaatggacataaataataataacctcttacctacgtcttaggaccatttcaaagttacagttagctatatagaagtattccacaaaatacaatacactatagacatatgatggggtagtgttgtttccaaatggttttccaaaagttgtctatttttttttaaatgaagtgtgtacctcaggtaaaaacaagtatggcatttaaaaagcactatcaaattctcttcttcactttatcctaagaactgtatggtggacctcagatggaaaaaagagccagccaaacacctcagcttcacaaggactgcagtatttccctatgccctgcctgagctggctggagcccctacctaatacatcctgagaaatcaaaggcaaatcctctttatgtaccaaaggagatagtactttccaattcaactacatcaaaagacttcactggtgaaaactagtcctgctttcaaattctaggggaaaaaaatcttaaatgtttctctacttcattaaatcatcagtttggggctccaaggaatacatggtcccatgaatagttgattgaggctcccttccttattaagtcaaaatttaaaaaaaaaaatcatttccatacaccgagcctcaataggaacagaaaggaaagtgtctccctattacatttactgcatcttagggaaaaaaaaatggataagagtaatcctttgttcttttgttctgttctctaaggaatcaccatatgtaatgtataaaaagaatcatgagcaactggaaggaaatgagcgctatgaaggctattgtgtcgatttagcctatgaaatagccaaacacgtaaggatcaaatacaaattgtccattgtcggtgatgggaaatatggcgcaagggatccagagactaaaatatggaatggcatggttggggaacttgtctatggagtaagtattttcaattccattgttatctatttctattcttttcagttaacaagaaaatgaggggctctaatgttcagtcttaagatttatcagatttcagggttttcatgagtctgtaaagacctagtttctcatgctgttgaggtcaggaaagcatcctttgagcaacaaggttattttacaaaaaggaaaataaaattgaggaaatgtatttggccacattaagcacagtcttccctctactgagagtcttttccttattccttctgtgtttcactgaattaggtaccagaaccacctacccatgcagtttcttagcagtatctccatctctcctcattggtcccctcatgtctaatgaaccagtctgcagtatgagtcctactaggtctttcaaatctaaaagcactctttctcccaaccatggacattatcttagttaaggtttttgccatctgtctatcatttagctggatccctacctctagttttacactagcaaatcagctctacattattgcaatcccccactttaaaaaacaggataaaacttgaagaagactatagtggtattgccacaggtccttggtgttttaaatggttttggtctcagggaagattaggtcttaagcagagcaatgaagtatatgaggataggtacaattggccaccagaactacccatttcataaaccaatctctaataaccaaagttcagatctaaatatcagaagatatttagttctactagacaataatcacttgctataattggtacctatttagacatcagatactgagaagataaatgaattggaggtatgtgtgctgagaaagtcacagttggtaagaagcaaacacctatgtatctattgggtggaggatcagaaaaattactccagtggtagccagcacaactagggcgtcactcaatcataaaacactactggggtcactcaatatgttttttagaataggcctttggaaaccagcataagagatggagctcatttctaaaaatgaggacacagaatgggaactaaggcttaaaatgaggctgggccccaggtatcaaaactgggacactgtcctcttgccagacaaacagcacagtaacttgaaacccctcctccatctgtggggcctgagccaatcaccacctgtcttaggtcaaggttggccttgggaactggggcaggactgagttgcagatgagacacaagtgaactaagaaatgaaaaagaggtttttcagttccagagagggacagacaacaactcagttgattttggaggaccctaagcagctctcaaccattttgacatagtactagcctctcactttccaggtgacaatgttttctctttcttgtcacttatctccccaacactcaaaacgtattgtcttgcctatagctcttcctgcactttagtaaattgcatagggaaaacccactctttgccctaatgaatcaatacctgtatacaataatggttgacaaagattcattaaagttagctcatggagggaaaaataaggcaatgtttttgttattattagctagcacttatagagtgttcactggctgctacctactgtgctaagtactttacacacattctgtaccttaatcttcacaacatgtgtttgaagaagttccattagtaacctcattgtatatgtaagactatttaagataagaatgaaaactacattccaaagaccaaacatcctgcagggccggtcttggttgttcaggctgctataagaaagtatattagacttgtggtttacaaacaacagatattgatttctcactattctggaggatgagaagttcatgatcaaagatttaattgtctagtaatgatgagctttctagctcacaaattgtacctacttgttgcatcctcacattagggaaagggtaattagtctctgaagcctcttatataaataacctatttatgagggttctgcttcatagagtaaccacttcctaataccccatttcctaataacattactttacagattacaatttgaccatataaagagaggcacaaacattctgaccgtaacaacaacacagtgccttggatctatgaggttcatgtgcttttaataagttcaccacactatcccatagtaaaagttgtttggggcccatttcatctggaataatatttgaaatttattataaaaatattttggtgccttggccattcttgagagaagttgtcgaggctttagtagcgtggaattctattgaggtataaattaatactgctccagttatctgttctagtccatcagttcaccagcccatccaaacagaatggtcagagccctgtagtgtctccaaagaaacctagcacagtctggaaatagatcagtgccctcctagcattgagcaagatgtcaggcatggtgatgtaggataagagattgcctgacattgttcagatgaagtgcagcactctcatggtgtttacgtttctcctctgggatgtgctctctgctacatgatttaatctctacacatccctttctctctctacttcatctatttgtaagtgggggaatttgagaaatacagagcgctttgtttagtaattcaagcggtttgtttagtaattcagacttcatctcctcaattttgaaaaggtgagatttctgaagtgacctttctctcattctcctgctgctctgggaagagctttcctttctgccggggaaggctcttaaaggcacatcctctcccctttcctgacctagaagaagtctctgatgttttctaagctgaataatacaaagtgattctggacaactgacagcaaaccaatccactgaagtagactgtcaaactacactttcctctaaaacctaggaataggaaaactagactttcctgtcatgctaggaggaagagcttgctgtcagagaggaggatagcagaagctaaatgtgttttaatcttttggcatcagaaacttttcaacatctctgtacatgatagaaatggtgggggcatgaaagcacaggcttgcatttctggcagtcctaacctcttatggtttgcaagttgcttcaaaaaaagagagaggaaaaaaactgatgatttttccagagtgcttaatggacaaaatatggagaacaggaaaattatgacttgcatttagcaggaaaactatacagaaaggcatgggttcgtcttcccagtactgcctcctataccttttgtatgtactgtggatcagagcaggaaaggaaggcagagcgggagaaagctttgccaaagacatttctgtatctgcgatgaagtctcaagaaaaagtcaaaaggaattgagtttggtaaagaataaagaagtcaattagtctcttttcagatgcttcttgaatttttttcctttaaagaaattcaaatcaaagttgatgttggggcaccttgtatctctaagaaggttatttttgaaacaaacgtcagcagcatacaatgttccccattacgtaagcccttcagaacattgtggtcttgaaactgtccacctgcttttagcaattttgattttgagctggatttctgtaacactgccacatagtaatcattccagctcaaatggctcacacaccaccagtttttactgctcccaaatagcaagtgttttaagagggcattttaaaagaacattttgtggctatcagaattcttaaatattctttagccaaacatctaattcattttcacagatgactaggagacccaccagggcccaaacattagcattgcccattgagtaaaccaagaaattgaagcctgctggagcacaagagtgacagcaatttctcagggaggaggggaggtggcaaattttgacaatagcacaaaaatcacagttcggcaacttgaataccagtatgcctggtctagtgctctgtccactggtttacattggctcagctcactaagcttctcaatgtatgagaatcttgatattactgcagtcagatatgtcacttcttcatggcttcagggtaaaccggcttgcattctagctggattatgagtgattccatctaagatactcattacatttctatgtaccctctagggcaatgcaatactaatctctagttatctcttgaaatatttaaaaatacaacataaatagctggaaggttctgtcctcaagagaagatatatgacctaacaaggttttttttttttaaggaaaaaaaaaggcaagaaataggctaggaggaaattggagccccagttatgaagaggacacctcccagtgggtcactgccacattgtttaggttcttagtacctagaactgagaataaagatgatgtgggattgcttttggaaaggctaggaacaatatcatacacattggttcttctgacttggaaaatagcagaaagctcaggaatgaagatgagattggcatgaagattccaagtcatggaccttgggtgtcccagactatttctccctcccaggagaaatggcaactcagcagatactacttacaatgacattgcattgcttgtaagaaattatcttagattgccactatcctaaaacagatttattttccattaacaaaggcagagagtcaatctgtcctcccagttaaagggggagaagcaaggacccagtatcagatactatgaattcactgctaatcttcaggtgattacactgggcgctggcagaaaggactgatggtttgataaaagtgctcttctactgaacggacacatagactccagggaagagcattaatgatacatgaaagtctgctattctgagcagagaggtgaggaaatattcccaaccatatttagcatcacacggccttcatccagctccccagatgcccgtttatcttcagtgggtctttaaatccctcagctccccaaggacaaggagtccaaatcaatagacccatactgggacatctgttctggataaagaaatgagaagatcctgttgtgaccctgcttgttgttgccctgatttaaatagtccccatccctttctccagatcttaaccgtagcagacaacaaacatctcagagagtaaagccaatagagcagtttaatccctgttccccaacacacagcaattgtattcctattgtccaccttacttctgccccactctttttttctaccgcatttcaggaggaaattcctgctgaaggccactagagtcttaggcttgacgcaaggagcagggagcagatcacgtctgcttcttatacggtctgcatggtacatctcttcctttttcttccttccccccttgctatcagaaaatgctttgaaacagtggctgacaagttcctgctcaaacataatcttcaaatgggttacaaattttagatgagctgatcagatgaaaatactttaaaatgtaacaagcctcccatctcaaacaatttgtaaaattacagttaaactaaatgtcatctctacttaaaatttgtcagcttcttaagttcatgatccccgtgcataggagtctgttgggagtttaggttttatatttacaactttggctgcccatctataaaaacgattataaatcccctcaagctaaatccccttcaacaacgcagttgcttgggtttgccactggttaagtgggaaaaaaaaatcaaacttaatttagtgtgtttgctgagcccacacagccattcttaagttgcttgattaaaatcctttaagtagtcaaaatgcaagttaaaaacactagtagagtctcaccctgagctcttaccatttgctggtttctgtctgtcacctggagcacactcataccaagcatttacccacctagtattctaaaagtgacttttctgctgctattagcagcacaggcttgatgacaaaaggctgctggagtggtttaggacaccaaaagagaaacacttgattattaagttagaagctcacctgctccatagttctagccataatccttcatgcttggctccagttacagctgacttgcatcaaatatcaagggaggactttcggagggtgggtggatttgatgcaaacgtgttatatgcgtatatgaatattaatttatttgggtggttgcttttttttttttttacattttcatcactcttaaatctttaattttcttttaaagtaaccctgttgtctgtatgccatggcagtcccaggaaaactaaggattcttggacacttattagtaatctgcttctccattttctcattggtaatcaagctgattatttcacaggcattgtagcaggcaggtcatacataagctctgaaataacctacaatcacacggataaatttcattttttattaaatttattatttattcactttacaacccagtgtcatcccttcctctgctcccaggacgcccccatgtaagtcttctccccattcccctgagaaaaggaagctcccttctggtcgtcaaatcccaccagaccacacatcaagttactgcagaagtaggcacatcttctcccactgaggacagacaaggctatccatttaggggtgcaggatccatatgcaggcaggcagtcaacaggctcatgggcagcccctgccccagttgttggggaacccacatgaagacaaagctgctcatctgctacatatgagcaggaggcccaggtccagaccatgtatgctcttcagttggtgattcagtctctaggagttcccaagggtccaggccagttgattctattgttcttcctttgaagtccctatcctctttgggaccctcaatctttcttccaactcttccataagactccccaagctccatctactgtttgggtgtctctgcacctcttcccattgactgttgggtggagcatctcagaggacagttatgttacgttcttccctgcaagcataacagagtgttattaatagtgccgaggattgtttcttgcccacaggatggatctcaatttggggcagtcattggttggccattccctcagactctgctctgtctttgtccctgcacatcttgtaggcaggactcagtttgggtcataggctttgtgggtgggttgctgtccttatccttccacagggagtcctgcctggctacaggaagtggccacttcaggatccatatcctccactgctaggaatcagctagagtctcccacttagaccctctgggatctctccccatcccaggtctctggcaaatcctagagattgcccccaaccccagcctatctcccttctctttcccctgctctccctacatatgatcttcccccctgcctctctcccctcctcatcgcctcttgcacccagtttcctcctttgatcgacctccaatgtctattttgtttcctcttcctcatacataggaagggatagtagcaggagagggcaagggctgcctctgagctgatgctccacttctgtgacttgtctctcacaaaggataaaagagatagaaaatgcaagctccagtctcccacacatcttactgtcctgagggctcaatcagcagctttcttagcttctattggttgagtcttcttctagttacttgactctatatttttgtccttttcaatctgcaggtctttattaagggcccttaagggtgcatggtaaattcttgttttggatccaggccacatcattgagctcaggtttaacatcacccttcatccacccctggggcagtacaaaaaaaaaagtatactttctttgaaaaagctcctgagatcccagcacttgcaagacagaggcagaaggatcaccaccaatttgaagccagcctgagccatgcagtaaattcaaggttaacctgggctgcatagtaacatgctgtctcataagatgaaaaatggcaggaaaagacttcccagaaagaaaaaattcagaaaattagaaatgctaggctaagggaaagaggcaagaacctgaggggaacagattagccctgttgttttttgtgattcaaaagtactttaaactcagtactttaaactcctttgggaatctgttctttagctaaatgttccttaaaactaaacaataagccattattccttctctgttagccacctcttgttagtgtttagtggtgcttaccatgtgatgggtatggcagttacagagttttcttttgtgggcttttttggtaagggtatttttgttttggttttgttttgctttgttttgcttttctatttcagccattgtctctttctttctttttgaaattatgatgtaattttaccattaccccctctctttccctccaccaaaccttgccatatatcaagtggcctatggttgtacatttaaaggggatcgggtgtctcgatcttccattctgtacccacttgaaaagagctcagttcccttaaattcagtccaaataaagtgaatttctcatgccaaatactcacttacttctaccttcaaagacagaaaagaattttttagtaatttctcctagaaagattaagacttacatgattaaagaaagaagaaaatgttaaattaagtaattaaattcaaatgagatcaaatggggactaatactagatgcatatttgtgtcctctgagcaggaggcagagacatgttggcactgagtggaggcccctttgtgtatgaagtctcttggcatgaaaatactctagctgattcaagctatctttgccaaaaacccccgctagctttctggccaagtccattcttatcaggagcctttgttcttatgaccaggtgtaggcctcaggcaaaggataaaacaggtaaaaatttgtcatagcctctcatcttatcatcagtgtggaactgaagattaaggagttcactggaatatgaagggagttgaagccatagatgatgatgttgaataaagaaaaaataaataaataaaggacaggaccttgaatgatctgtcttgttctacaaaccttcagtgattacctcctaaaaggtgcttctagaattacaaaatataccttggtggagaatggaagctatgaagaaaaaagcaggtaaagaataatattcataaaagtaataagagaacctgacatctttagtgtccaaaagccaaaggaaagagtatatactatggaaaagcccagtgatgtcacatgagcagttgatgtctgacaggaggtgtttgagtctggcagccaagtttacagttcaagaaataattttaacaaatcagagggactacagaattagatcttgaaggggaagttctgctttcattcagagacaatgaagttcgagtttcaagaacattgatatgatgtgtagaggcgcaatacgggtaggatgatggaagaattaaaaatgaaaggagtggtgtttggtaaacagaactgcctatgattttaactgaatatgtgttgtatgatttttcctttggaagacatgaacaaatggctactcacttccgcatagagccaatgacaggccagaacaacaattccaccaacactcatcttggcaaagcaatacgtttattggggttatttacagtagtatgagtaagcaggtatttacagatgcgtgaataactcatctgcattgcagatcaaagtattatagtatgtagtacatatatgcaagtgtcagctgaaagcaggttgctagataagccaatggatctgaatctcattaccagagctctaatctcggcctctttcccttataaatggtgagtataagtcatggttaatgccctgtctgttaccgcatacatcatttgaagaaagaatggtcattgtatcaacctcaaggttgctaggagagtgaattaaaacaatatatagaaagtgcttgacacagtgcctcgcacagagtaagcagtcaataaacgtgaggaagtcttcatcatctacatttccccttaaataaggaacacttattcatgtgaaaagcacagtaaaattagggaaatagactatggatggtaaaataagaaaacaagagttaggttaactatgtcataaggaagtacaagttgaggtaagaaagagatagcaaatggtttgagttgccctattaaatttaccaaaataaatttcttccttccttccttccttccttccttccttcctttctttctttctttctttctttctttctggtcaatatacgttctttctttctttctttctttctttctttctttctttctttttggtcaatatactttagttgaaacttcctccattttcctccacctgttcccacaggtagatactgaagcatagctatgcacatcagacacacacacacacaaacccctgagtgttcttggtaacttactacagatctgatataccatacttatttccctaggtacattttaaagactatttccacacaaaaacctactagcattgaattggaacaattgtagaaaaaaaaaataagtgcagaaattcctaatgccacattcctctaaaattaatataaaaaggtgacatgcctttacatgagttaattattcagtgtactgctaacatttatttatcagtctgacatgtgttgatgttgtgcttatatttatcaccagaaaagatagctgacttgagaaaataatataaattctaatagttgttttatccttgtatctctcttgcagaaatattgcattttttcatatactatgttcaacaattggcaactaattaaggcatatacatttttagaatgtactacaataatatatacaaaaccaaatactgtgtctctgtcttcaaatgatgcatattttaacagacaaggcagcagcctagacttacactgaatactacaagggaaaggcaggtcgttgtgcacagtatacaaaaattccagtaaaataagggagagagacataagagtatgaatattaaaataagaaaacaagagttagattagatatgtcataaggaaatacaagttgaggtatatgacatatcaaaagaaaatctggggaaaatagaatcagttcccctaagccaagatgtttcagaggacaaaagaccagggcatttcctttcttgaccaacaaaataaaacaatttagaacccactgaatgaccctgcttctctaatcatagcactgacaaatcagctggttacagtgatcgaatatactatatttccaccaaagacatttattaagtgaaaatgataaaggaaatgctgtctgttaaagtgttctgtgtctttgtttttcagagagctgatatagctgttgctccactcactataacattggtccgtgaagaagtcatagatttttcaaagccatttatgagcctggggatctccatcatgataaagaagcctcagaaatcaaagccaggcgtattttcattcctggatcctttagcttatgaaatctggatgtgcattgtcttcgcttacattggagtcagtgtagttctcttcctagtcagcagatttagcccttatgagtggcacttggaagacaacaatgaagaacctcgtgacccacaaagccctcctgatcctcccaatgaatttggaatatttaacagtctttggttttccttgggtgcttttatgcagcaaggatgtgatatttctccaaggtttgtttgtgtgtaatacagaatacctgcttgtattttgtggtcttactgccctcatgtccatctggtattcacctgcatcaacttcagagttctttcatttaacattccatccaatgacaaattgtcatcacagcattttgtgtgcttatgtctacgaggtgagtgtgtcactggcgatgcttgaatgcctaaggtttgctacaatgctcatagatacccagattctggatacagttaactgctgcataatattcctatgaaagtttcctcattaattgaactgaaatatcttcgcatttgccaaggggctaaatctgggcaaaatgtgaaagaagatagagcatttctttaaaccttcccaccttcccctattagtattgcccttctcattgtgctctcagtctgcctacgactatgcaagcgtctactcaagtttcttagctaaaactagaaaacttctcagaacataagtacaaaccttaatggtgttgtcatatttgaaaataatctggccatttgttataaagttaggccgagagtgaaaatgtgacaaaagaattttactgtcatttatacccccaaagcaaaatgtatgaatgtccatagtatctttagttgtaatagacaaaatatagaaacaaagcagttgttcagctagtaaattgataaagaacttgtagcatatccattcaatggaatactatttacttaagagaagagattactcatgcatcctaacagtacagatgaaccttgaaaacataatgtcaaagtgaaataattcaaacacaaaatgccaaaccccactccactctacttgttgaatataccattatagagcatcccatttgtccccagtagacaaatctatagagataaaaaggacaattactatggacatagtttgaaaggagaagaataaaaacacagataacaatagtgggattaaagtctggcaagtttgcttttgcagaacaagtccaagagtcagaaacaactctgatttaagttttttatgtcttgttcattacagaactttttctgcttgcatttttaaaaagaaatacaccaccaaagtgtcatttgttccaatgaatgagatgttgatacccacttatattagcatgtggggcaaatgccttacttgtctcatccttgccctaaacctgctggaattcattacaaatcctgatattttgatgaagggtgatataaaaccatttcaaaaaatggattgtgatgatggttacagagctctaaccttactatgcaagtatgagaacctgaggtcagttagccaaaaccacataaaaagccaggcatgactgtatttgcctgtaatgccagcattgtggggtagagagaagcaaatcatgagagctcactggccagtcagcatagactatgcttccagttcagcaagagagtccatgtcaagtcaataacatgcagagagacaaaggaagacaccaatgttgtgctttagcctttgcttatgaactcccatacatgcgccagacatatacaccatacacacacagaccaccacagcacccacaaaacaaacatgtacactaaaaatatgtttaaaacactgtaactgtggtcaaagtaagcattaatccaaatgctgactagggtcaatactataaatatacagggattttcactttgaaattaaatgacttggggctgggaagatataccaaccaatatagtggttccttttcaagcatgaggacttgatccaattcctagaatgcatatcaaagctaagcatgctggtgcttgcttataaaaccagtgctggacaggtagacataggtgacccatggtgctcattgggcagtcaagactaatttgtaaactgtacgtgaataatagaccctgtctcaaagcagagggtgggcagtatccctgaggatgatacccaaggtcttcctgtcttctctacatatactactacaaagacaaggtttcagaaagataataccagcatatctttgtgaggttagccattgggtgcacaaaacattcacaataaagctttgcagcataacttttgtagtatagcagactttgaagcatagctatcttcaccagcattttagaattgtgtgtatcaagcgtcatgcatccaaactactccttcccccaacttctgttaaaaagaattgccaccttcagtctgcttggttgggttcttcaaattatttcacgtcctgttccttttgtgttcagagtgtatcattttgtgatatcagggagttcacttgatttcctagtttctttggagggttgagaaatactcactttgagagtctatggcctctgaatgcatctatagctggaagatttctaacatgactagtaatctgtgctgaggccatgttgaagagccattaaggccagagattttcctggtttctgtaagtcaactttcaaaactacatttgtgatattccctactgtgatacatacttaaacaggtttcttcaaaggtcatttgtttttacaaatatttactcatgttacttaattaaataataactaaagctgatactaaaaacgacaagttagaccagctttgttttgttttgctttgctttgcttcaatttctggtggcagaatttaagctatgacttttctgtgatcctgaaatatagcaaatgccttttctttccaaggtatagattttattatgttgctcaagatgtcatcatatagttcaatggcttccaagtttttcaccatgacccacagtaagaaatcctttttccatcttgattcactatacataaatttaaaaaaaaacaaacttataccagacattattgttacagtattctgtgcacaccaagatggttctatcctgtttaatgttcttaaatctaatcatggttcaactcactaagaagccaatagcacacttgtttggtataacaactactatttttattgcactttcgagtgagaaatcattgcctccatgagctctatattttccaacctataagtgatcattcctctgatactatcttttgtgtcctacaaaagatgtatctataaatcttttattaaaatgttatgcttcctagaatttgtatgacattcctctaagaaagaaacatgtttctctttgtcttgagagttctattgactatatatgtgtgatcaactgtgtatcagtcctgcccactctaatatatttctctattgacctatttagaaagtcctgccaatagtatagtcgcactgtg

SEQ ID NO: 788 - DNA, 212073 bp, mus musculus; identical to SEQ ID NO: 787

SEQ ID NO: 789 - DNA, 304 bp, mus musculus
atccgggccactgttactagcgaggggaagatggcggccgcggctgtggtggttcccgcagagtggataaagaactgggagaaatcagggagaggcgaattgtgagtgtttctgaccgagggaaggcgccgggccgccctgaggtcggggcgctgggcgcagtcggaagtggggtacaggggccggggggcagcggcgccccctcccccacccgcacccgggcggcggatgaggatggttggttggtccggagtttccacttggctgaggagcggagccgggagccgccactatcgccgccgcc

SEQ ID NO: 790 - DNA, 18102 bp, mus musculus; identical to SEQ ID NO: 35

SEQ ID NO: 791 - DNA, 66692 bp, mus musculus
gggagcccagcggcctgatcccagcaccccccctcccgccacctccctcctactcccgcttcgcccgcttcccgggcggtgtggagaagagcaaagttgcgacagcagccggggggctctgcccaggtgaagggggcgctgtgacgggggcgggaacggcgtggccctgcggcgggggcggggggggggaggataaagaaacttgcttttcgcagcccccaccctgcgcgggttcggatcttgcgtgatccgagccctcgtggagacgctgcaccgccgccaggaccgaggccggcaccccgagccggactcagatagggaccgcgcgttccggcgggctgccgagggcaggcaggccggcacccgggcaagggcggggtgggtgaccgtgcaccggaccgaaccgcggactctggcggcgtgggcgcgggacgaaccgggaccgggccgagttgggtggcgaagtaggacgtggattcggggggcggggcgcagcgggaggggggagagcaggcccggcccggctggcctgggcgtgggggtggggggcgagttcggggcacttgctgggctctggaccgagcgctagggcggggcggcgctaggggctgggcccgaccgggaggagagggcgaggggagggagagcagggggtggagtaggggcgtggagttgcaagcggggtctggcctcggccgggggcgaaggtagatctgcggggccgaaagcggagggagggaggcccgaggcagcgcggcggcagcggcggcggcggcggcggcggcggcggcggcggtggcggcgaaggccagcttccgcggagtttgtgcccgggcttcccagctgggctccggtcgcctcccgcgcacaaatggggttaggggactgactggtaagcaactcccggtgttggacgggcttcccaggcgattcccggaaaaccgagggaagacgccgtctgcaatatgccgcaccccaccactccacctcttagcatctggattctgctcttcggggtcggtggacccttccccaccacaatccttccaatcttccagcaccccttccgtctccctcttatccttggccatctaaatctcctagtggtatgctttggaggggtggaaggcgtcgagggctgcactttccctcccttgggggcagcctagtttgtgtcttattcctgccaggtaatgttgcttggcatggtgtggacctggggtttagataatttaagccccggatccaagcttttttgatggcttttaaggaaagggacggatccctggattttcatgaccagaatggggtttgaggactggagttactctcagctcacttccagtaccaacctctttactatgaaccatttctgtgggggctcgaacgtggagggtgggatacgggagcattaatgtgctttgcttctctgtgtttccacagggtcagcgtggtgaaggacagctagtgtcagagggaaagtagacactagtccaactacggccgcccccactaatacttcggtaagggggacacgactaaggggatgctggtgggttggggcccagtataagagtagaggtgggtagtcgcccccaggactctttcctggcggggagagaaaggcgagcccctacttcggggagggttccggggaaggagatggagggtggcgactggggggggtgcgggaagaatggaagagtcacaccctgcttgcaaggggagcctcccttaggctcctgggaaaaggggactgaatacgtgtgctctgtggtaccagggcaggggagatctggggatggttcaaagagtgatttgcacactggttctggcactagtggcctgagaaagtcaggttggggcataaggtggagaatgttggaaggaaggcagacaaccaagcctctggccccagtgcccagatcatttcccttcctcaacctccctcctaaggggcatcggggtggggggcgtggagctcttggagccccgcggattgagtgcctccgcctttcttgggagtctatctttttgcccagcttgctacagctaccactgcctctctctctggaatctgctcggttctctctgcgatcccctcctcctcctcctcctctcccctcccctcccagtgtcaccggggctgcttggctctgcccccttcgccgccgcttgctcccagctttagtccctccttctcatgcttgctccctcccttcgcctcctcctccccatcccccccctcgccaaggccgcattctgggagttgtagtctcttgcagcgctggcaggcgccgcccgcgaacaaggctggactcgacttcccgtcgagccctgcgaccggcacccactccaccaggcttcgctcacacacacagacacacacacacacaccgctctccccctcactctttcgctcgccgcggcgctgccagtgtgtggctctgtctctcctccgctttgctgagccctcccttcttcctctcagttcctagagtccgaccgccgccgccgtgagaggagaaggaggtcggtagcgataaggggcggaggggggcatcggatgccggcagtgttaggcgggtggtggttcaaagagggtgagagggagctcgggtggcggcctgagcctccctgcggagccgacccgggaacaggtgcgtcttttttctctctcccccaacccctccaccccttttgactccctggctttttcgtattcccccacccgcttctttctatcctaagcctttccccaaccctgtccgttcctcttcccttagcttctcagcttgccccccgggggcgccgtcctcttcgtgtccccggacgtagagctctcgggagctctctctgtcctcgcccctcccttcgggacagctcccctccacttccaccttcgtaccccatccctgccctgccctatccccttctcgacctccttctcttttagccaggtgagacttgttcaccaggatccaagagagtcttcccctcggctgggcgggggtctccatggaaacgggggtctgtagatcctggggcggggggggtaaccataggaattaccccactgaacagaaaaggaggtggaggctatggtcttggaagtacctggccccaaaccctgatccatccaaggatccgacgatccgaagggaacctggccaacagggcagggcgaaaaagggcttgttattttttggggggggtggtggtgtccgtgatgaagtcttgaagagaccgggagaaaatgccctccaaccttagaggtggaggtgcgacgggagctctctcggggttgctttctcctcttttcaggggtgcaggaaccgtagggtaaggggtacccctaggtggcggcggggcctgggttcgggagtgggagtgctgtgatgggggcaggggcaattatccgagtccctggaaaaaaggcgggggatgacttcggagcgcccaagctccgctgccctcgctctaggggcgggggctaccgggccaggcgaggcggggagggtgctcaaattgaagaaggatgagatgggggcaattcatactggccccggcaagcctggtgggagacccagctggcttgcaagccctcaacccgcttcgcgccaggcctggaggctaggggtctgggaggaaagcagagggctggaaaggagggaggctccggttacggggccggatttcgggatcaggggcaatcccctggcccttggagagggagggagagggatggccgcgaaccccagggttcccccaccctgcttcataaggggcgtgaggaatggacagcaggcccagcggagctggattcaagcggatcgtggccagggagtgggggggcttagtggtggtcttcgggggggagtagtccggcggcggggcgggcgggcggggcgtggggctccggcgggcggcggggcggggcccgggcggcgctgctgccgctgccgccgccgccgccgctcctgctagggccgccgccgccgttgctgccgccgccgccgccgcttctgggcggggaaccgaggccaaagagagtcccgtgccggggcagagggcgcaggcggcgcgcggtggggaggggggctttctgcgggcgggggcaggctgggggtggagtccccgacggggggcggtacgagctaggacgacgacgaagaggagccccgggggcccggtgcgtggaggacgaggtgctgggagaaggaaggggggggggtgggtcccgcgacgggcctcgtgggcttggctcccggaggttcggcttcgggacggagccttgtgggggcgcccagaagccaggaaagggatagaggggtgaactggacggtggagggggccctcctcgccggggtcccgtggagaggaaggctgggccagagggacgtccgggcaaggctgggaggagccggcggcaccaaggctggggttttcgtgttatggaggtgcaggagattgttgtatcgaaagatgtggttgaggggaaaggcgggagggaagcacgctgcaaacccaggaggcccaacaccacaggccgttgggggtgcccttctgttccgctcaagcttcccctcctctccccattagaagcactgtgtttttgttgtattgttttgaaaatttcaaggttgcctgatcaaactgtcgacgtggtgatactttcttattcttgctggtttctagagtagacagtcaggacaggcttcagttggcgagcattcttccagcccagcgttttgggggctctttgcatgcccgtgggaagggggcttgtgaagcaaggcacagatgaatactctcaaggcgatttggaggtcgttcctatgacactgggtagagggcagctgcagatagctttggtcagacttctggggtacactcgaaggcttcaagtgttagtcccatgcgtctttcaacttagaagactatttctcggaatcacactgcagaaacgtttcatggggaaagaaatggggcatgaatttggagttgggagttgattaggctcataataaaattcaaaggatggctgggagttaccattttaatggtcatctagcgctgttctgtttagtgtgtcttgtccttgaatgttagcagtgaggggcctttcttattggggagactgcaggtggcatagtcaaagctaaatttgggcagagttttaggatactcgaatgtgatgtcacctggtggtactgaagatgacagtctgtaggaaagaaacttacaagattccactggggattaaagagataatcccgcaccaagaatcacccagaggctccaaaaggcagtaaaaggttgagaaggaacctgtaaaattttgacagaaacaaaagtagcaagccaaacagagggagcaacagggacatggtgagtcaagttaaaagaatccaaagttccattatgcacttgaggcttgccgtgggcatcttgagtagttcatgaggacctcggtggcaggtagtttttgcacctgaggagattattttgaggtggatctgggagatgggagcccccagggcttggcacaaaagctcgctaaaatggactttgttaatggattttcatgtacacttgagtgcaggcattagtgaaaagatagacactcggaaaaaatgaaatttattcttgtgggtatgaactaatcaagggaaagtcactcttaaactgacttttgaaagtctgactctttataggcacagacctttaatctcagtactcagtgggcagaggcaggtgagtctctggagttaaaaggccagcctggtctacagaataagttccaggatggccagggctacacagagaaaccctgtctagaaaccttctgaatctcttactagctttgcagaaacagtatgtaggttcctttccattctgacccagaggtgaagagagctagatacctagttgatacaggaaggggaagagatgcagaagtctggcttgaatagactagttctgtaaaacagtaataaggaagggacggctaattgttggaatagggcagggtaaagctaagtgagtcctagccagctttgctgttgtcaaagtagagggacgttgtatgagaaatggggccataccaaggcactcttctggatctagctttttttttttttttttttttttttgatttgccaggactggtagagaagatgtgtggcatcctggagattgcctttctttcttactggctttggggctcttgggaagcagaggaggtttctctgggggtgtgtatctgagccttattcatgatacagttccctaccctggcaaggaaatgcttggtgaaggtggcagaggatctcaagccttgattaatctgtgctgtgagctttagggaggagctttgctgagagaaacagaatcataggagcaaaagaggcttaccactagaaagaaggaaggcaaaagaagtcagggagaggggaccatagggcagggaatgggggaaggaagatgaagatgagcatcattgttcccatgtcaggtctaactaagaagaaagcagtaagttgaaacctccagggtaatgttttccaaagaaagttcgaagaacccttagggctctctacagtttagtactagaattgctaaggctggagtaagaaagaagatcttggataaaaataggctaggaagaaactggcatttagaaagaaatataaatatatttacccataaagaaggagaggtagtatccatattaagaatttaaaatgtacaatgtgggctgggcatgtaaaatgcttgcctagaatgtatgatggcctgagttcaagccttagcattgaaacggaaaaaaataaataaataaaacaaaaccctacaatgtgaaagaaaagcagatcattaaagagccaaaggagagaggcattcagatgctgttcaaagctgggattgaggagtgtaaagattaatttttgatagtcactactgtgggaggacccaggaaacagaatagctgggattaagctgaaacatttcttagcaaatccagatgaatgtcaagattctgaatgggaaaggggagtcttggtcccatcttgagtggagaataggagaaagtgggactacaccagtttttccagtctgtaagctggaggaatcctagatataaggaggtaagcaatagaaattccagagcaaaacaaacaggataaagaacagggacctgagagccttgggccagaattgaacagtagagttaagggcaccaaaaagagactttaatcaggatttgactggactatgtttacactggtttgtgaattctaggtggagctatctgggatggattgggttgaatatatagagctttcccagggtcagctagcctcttaagaagccatgcaagaattctgtgctgagtttggatgggaacatgaacactagaggggaatggagagactagagagtgaaacttgctactaattggacaggaagggggagaaaacacggaggatggctgtgtgaaggaagagggggcacttagatcagtgggagtttttagaaaggaaatttcttaatgttagcattggaagtcagtctgagtctgtgtctgctcgaatctttagtgccaggatagctaaagagggaggaaataagtaatctccctttgtgtcactaggggattcgagggcagtattttatatgatctcttatatgagccaggtattattcatgccagtctgtaaaatgtaggaaatcgtcctctttctaaatcatagcctttcctgctgttcataactttaaaatggtcttttatgttgaaaatgttcttttagcgaactaaagttgtgttctggtcaagagcaaaacgtaactctgtttctgtctccaaaattccagtaagctcttgtagtattttttttaaagcagtagcaactctttcctcataaaacatgtaaaaatttatcatttttagcatagtaagtgtagatttgttaaggaacaatgagaaaaactttggagtatgtgcatgggggtgggggggggcaggcagggaacaatactctgataggttgactattttatttatttatttattttgtcttttttttttttttttaatgagatatggcctatggagaccagactggccttgatctcacagagatttgcctgcttctgtctcagccttccaagtgcttggataagagtgggtgatactatgcttagtttcctccctaccaccccccactcccccccccacctttaaagaaaactgcaggtctagtgttgaggtggtgttttcctctttgttggtagataaattgtgatgagtttgaagatgtggcttgttctttgtaaaatgctgtgattttccgatttccccagtagagttaaataaataaggcaagatgtggcttcatttgtatttaaagattttaacttgggctaaagatttgggaaggcctgaattctatgtagcagcagttttggggttgagacatcgttactatctgctaagaaacaaaatttccttacctcattactaagatctatcttagtgttgattccatttaaagctacagtagaattttgccactgcagggctatgaggacaccaaggaggtctttctttttctgagttctgtgaaatgtataacacacagatatgatcccagggaggagatccactgaagacttggatctatgagaggattgaatatattttctcatgaagagtctttactcagttgaacttgggtcttctgccttgcccaggtggccttgcatcctaattaatctcctttggagacagagctgtgtctggtccttgttgttcaactttctaatagtatggcaggaaacaagtcactaactttcctgagcctcagtgttcttatctagacaagggagatgatactaaatatcataggatggttagaattctatcaaataaaatgtatataggcactgctaaggtacttaacaaatggaatatatttttagaactaaaatttcttgtgtcttatgacgttacttactacatacaaggcagaatgaaactaaaaattcattctgctatccacccctcatattagccctttgtcctttttctctgtaattctttttgattagtagacatccagggtttattgcatggtaggaagtaataccttaacacattgctgcatctgcctcagaggtggaggtggtagttgcttttacggttgtgccatgacaacatctactctttctggacaggaactgaagactgaatatcccattgaaactttaagggatcttttgcaccagagctatcaaattccctgaagctgcctgatgtaggtgctgggaacttaactagggttctctgcaagagcaatatatactcttaaccactgagccatgtctccagcccaaaatactgctttcagtaaaggactcttgtgttatattatggctggttaagtgttctaactatctctggaaatgctccgaaagctgatagaacccggagctgatgtgcttcgatgataaagatgctcaccagtgattgaatgggagagaataatactggagaaagctctgggttccccaaaccaaactttctgggcaaaggaaaaacagtggccttcaaagtagatctcctctctgcagctggagtggactttggtgtcaacaattgggtctctgttagttttgccaatacagggagagactgaggacaggccaattgaaaacggcagattggctgacaaattaacggtttttctgtttgacttagaaaatgcattgttattttctacctgtcctctagccctgagatttacctacctatttttcttctgtttaggcaaatattatggctgttccctgagcacacatctactggtagtccataagtctcctgggtttaaaaggtagctgtgggtgcagcacaccaagatagttggggagtcgattttattattttgcttggcacaattttagttgagttctgtgtttctctttattgtagaaataaagcaggaatagagttgaagtgagagcaaggcagtaaaagaaagacttgcatgcagtgctgttttgtttatttgatgtgtatgcccgcatgtgcacatgtgaacgaacatgtgtatgcacgtgcatgacagcttgcaggagttggctctctcctcccaccatgtgggtcccagggattaaattcaggtcatgaggcttggtggcaagtgcatctcactggccatgttttgttttgcttttgagacaaagtctcattgtattgctcaggctagtcttgaacttgtgcattcaagtgatcttcctgtctcggtctcctgagtagctgggactgcaggtatacaacgttgtgcttaaatatttctacctgggtacctggtctctctatgatatagtaaaagggtggttttccctagtagtttattttagcaagctattgagccatattgtgtgtcttatattatgctacaccctgttgggagggggctagtaaatctataggtgggtaggagagtgagtcatggagtttgcatactgtgtaataagagggataaaaataaaataatagcttctaatgaattatatacataatctatgtagtcatagcagagcctcatcttcagataaaagaacagaaaaagtaacctgataatggtgtctccaaatattcatgtacatttatggtctaggagaggtttacagaagcaaaccttaaatgaggaggaatcccctttacatgaaaaagtccatgtcatacctacagtacactaaatgttttcagagacccactgaagaccaagatggaggaaagccaactcttatttttggattaacagaaattagaagtctcacaaaatgtttctatttacgtagatgtcttgctgaagtagctttgctgattgattttataatgcagacttaagttttgtaggtatctgtgacgtgtagacgttacacaagaacttttaaaggatttatcctctctgtttctctctgtctctgtctctctctgcatgtgtctatatgagtgcaatggtgtgtgtgtgtgtgtacatgtatgcagtgcctacagaggacagaaacatcattggactcccttgagatgcagttcccaggcagttgtaagccacttgacataggtactgagaagcaaactctagtcctctggaagagcagggagaattcgaaactgctaagccatctttccagccccatctgtataaagtcttattagctggagcttgattttagtataaagttattaatacaatgatatgtttttcctaaatagagcaaataagtttcttttactacaggaaaagaaaacgaatagtgtttgaatagtaagagggaaaatcaaggcagagtgtagatgagctaacgcaatctgatggcatgaaaatggaagtaaaccatgaaaacttcgcttttggttcacatcatcctcaaaatatacctctggcccctgcaagtgcctctgtgttatgctcagttcttgactaataagatgaatatattatctggcatagtgagatggtcttgaggtggctgagaaatggagaaggggagtattttttaaggtttctaccatagtttaggctatgggtcctgtaatacatcactgttccaggtgatgggacactggtgctctaatactgttgctatctgattacattcatcttcttcctcttcctcctcctcctcctcctccctcctcttctttcttctcctctttatctttttgagacagggtctcactatgtgttacaggctgtctctgaaccaactgcatagcccaggctggcataaaagtaacctctctaagttctaggtttatacctccacacttatgtcatgaatggattatggctgttcctaaatatcgagtcatctctaaaagcatggggtttagcagctacagtagtgaagagatcgaaagggtgtatataatagttaggattccatgttagtgctctcaggagctctgtggaaaattgtaagccttggccgtctagtcactgaggtgactgcccagcctcccaaggtaactaaattcatcagaatgagtaagctctcatgtgtttaatagatagttaactttcctttgtatccagtctcataaatgtttataggcacatgttttaaacatggtggtacccaaggagtctatgaaggcatccaggctagaatcatatacaggtaatttcttaagtcttcttgttaaatacaagaattgtatcttggaagaaaatgcaatatcccctgagtctgctctcatatgatagacaccagtggacatattcagaataaaagaaagaaaaaccaaacttaagtgacccagaaaacgttagaatagatttagttagatcaaacggacagttttttttaatacgttttattaggtattttcctcatttacatttccaatgctatcccaaaagtcccccataccctcctccccactcccctacccacccactcccactttttggccctggtgttcccctgtactggggcataaaaagtttgcgtgtccaatgggcctctctttccagtgatacaaacggacagtttttttaaaaaggtgttatattcttgaggtgattgtttctggttgatccttgtgtgtgtgtgctattgcatggggctagaagggaagcacgggaaagcagttgggacatttctatgtcactcaagtttcagggatgatagctgattagtagctagaagagatgagggggatagaggtatgagggagggcaggtagcagaatagaagaccatttttccatgggaaatgactaaaacagagcactttcagggggagaaaacattctcattgggttaaagcttggggtatgtaattaaatggggaagcacaagtgttgttaatatcctgttcaatacacacagagggaggcagaacagtgctgctgctttccccaaagtgagctggtagggtaacctttcttttgcctttttaaagttttcttcttataagagtattgcccaaagttctgcatttctatcagaacagtaggacccaaagttagttttctttcattagtcaccaccggcccaaccctccttcttaaactgtctaccggccacagctataatctcaaggacagatttagggccaagcttcaagatgaatattttctgttttttttttttttttaagtcataattgcttccaggtcaaaggtcactaagcagtgtgggccaaaaggagtctgaaagagtactgccagagttgttttacctgagaccctgtcctgatgttgagctcagccacaaggaacagacaggtgtcacacatgggttagagagactgatgtgacctgtgtatctactgccacctttgctcatcactaattgagtctttggttgcaaagggaggaatgaagattttgacagattcgaggttataaactttaaaaacaccatctatggtggattatgtctgtaaccaaagcacatagaaaactaagaaatgaagattgcctcgtgtttaagaccagcctgggctacatagtatgggtaacaggccaaactggaatccatatcaaaatgctgtttccaaaatcaacaagcaagccaggcgaggtgacatatacctgcagtcctaacactcaggagacagaagcaggcagatcagtaattcaaggccagagtcagctctatagtaactttggggccagtctgagtgttgtggaagtccatctcaaaacaaaacaaaaaaactaatcccaagaccccaagttgataaacaaaaacccattatctacttccatgtaaaatatttgtcagattctttctctgatactttgctcttttgcttttttgtttgttttgtttttgaaacaaggtttctctatgtagccttggttgtcctgggacttacactgtagaccaggctggccttgaacttaaagatccctatctatcggtaccctccaaatgctgggattaaaagtgctggacaccatagcttagccatgcttggcttttaattgtcgtggaatcgacttttgtcatcttcctttcaaaacagattctgccctttggtaagatcttggtattttagggctgctcatttcctatttgtgatgcgcctaaccctgactgggggcataacttgttatatagaacctcttcttcctttttttgataacacattctctttaagcttttctaaaatgcttccgtgcttccccacagtatttcagtttggcttgtgatggtgaaatctttcaggttcccctatttcatttttcccgtttggttgccgtgtgtgtggcctcttctttccatgctctagcttctagcacattgtctttgcttttgcagttttttttctctctctctccctccctccctccctcctgctcttttcaccctgttaacattattgccctcccattactccattcctgccttggtgtcccctactctagtatggctgttatggcagatggtgtactttattcagccttcttcctaggcacatttcctaggatcccagtcagtctctgctgctagctacataggcatcctgaatggctaagttgtcttttttcaggcacacttgctgctttgagcgggtggaacttgtgttcttcattgtccttatcatgagttagataagactttttgagtgacttcgaccaaagtgaagatagtttacagtggtccctctcagtgctttgcaggcagtggcagcatttgagtcttgggtcatgcagcttattcctaacaatgacatagttgtgacacctgggaaaaccctttgaggtatttcatatccctgtgcctgtgatttctgggtcacttgggattaccgggtttcttctaagttccttttccgaactttgccttcacttgtgggcaaagaaagagagaaggaggaggaagcgagaatgcgactatccctgtgggtacagtgagtggaagcacgtggatcatgtgcgtttgtaaggtttttctttttctgctcacctccactgtgtacctatggtgagctttatagtgagtgattgctaacttgattagacaggatggaacaaaacgagatcctaggcttactgaatcagaatgtgtggagctgagacctaagatactatttggaagcagctcctcagggaccttggctggttgcattgactgttctggtcccgactactcctttgccagtggaagcctgtttcctagtgcagcatttgatgcttctattggctttttctcttgctacatgaatcttgccttcttatgtaggccacttagttcagtgtcctgcttgtgtgtctgctgttttccaccccttgagcacaaagactactgttaattagcaacagtgaacttcagatggtcaggagtactgctctgataaaatcaggagaaaagttacaaggccaagatttaagaagatgcccaattttcaagatttcatgggggccagagagaaggttcagtggtcaagaagaatgttactgctcttacagaagacagaatttgattcccagcacccaaatcaggtggcctatagtgacttctctaactccagcttcagggattcaacgccttctggtgtctgcactcataagtacatacacacacacacacacacacacacacacacacacgtttagaaatagtgaaagtcaattttaaaagagattttctgaaagcagaggtatccagagtcagttttgctctctaggttgttacacactacatcatgaacgtgtttgactttagcttccgttttgtttgttttgcctctacctttcctttcatgttttgttgggcctaaaagctctttatctaggggatgtttggtctattgctgtttccaaacactgagaatccccctttgacttctgtcctggacctgcaaacagcttatctcttcaacacagaacagaaataattctgagtgaaaaatcatgtggttggagccagtggtggtggtgcacacctttaaccccagcactagggaggtagaggcagtcggatctctgagaaggttttctgtgtagccctggctgtcctggaactccctttgcagaccaggctggcctcgaactcagagagatccacctgcctctgcctcctgagtgctgggattaaagtcatctgctgtctccttatgcagcccagtctggccttgaactctcagtccattttggattacatgtaccactaagcctagggaatagggtctttgttaaaaacgtttctaaaatcaccccagtgttagtaatgttaaaaggtaatcatcaggaaaaaggtaaggcattatgactccaaatactggaaagggaacacatggtacgggtctgatttttcttcctaattaatgagaaagctagacatgttatagctactgtaaagctagatgtgtaaagctagacatgttatagctactgtcaagaaaacgtcaagaatcacaaatttatgtggagtaaaggaattagatgtaaatggaggtgaaactgggttttccacagtgaggcagaggttggggcaggagatcaatccgaactttatggaaccatgacagagtttgtatatccatcagctacttgtaatttacagaggcgtaaagtagggcaaaaatggtgaactcagacagaatccagcaactgtgagcaaagtgcactatatagataatgcatggattttttttaatagtaagcaagtgtggtagacactttttcattttggttcattttgcttctagtgatttctcagaatcatcacctcagttctcatctagaattcagccccatataacatgtatttactgactccttactatgtgtgaagtattaagaagagccaaagaccagggggaaaaagaatgttgttccttaactgcagagctgatcctgtgctggagagacacacgttccaggttcccagctaactcacagcagaggagagccagagggaagaaggaagaaaagagaagaaagaggagaaaaaaggaagaggagagccagaaagggagagttaacggttcctgggctgaggctaggggagtgacacaatgacatttgagctaggctttgagggatggtagctggggaagaagaggcacagggggaggccatctcagagtgaagaaatagcagagtcctgaaactaggggggccaggagctggggtgccgaggatggcaggcaaagggccagatgcagcagaagaggagcacgcagaggtttgaggcaaggaaggctgtctgaagaattctgccttgggtgctgccttgattctgatggcttttgacgagagtagggaggtctgatcgaagcagcgattcagaagatgaattgattgtggaatcaagcgatgggaggctaagagagcagttaagaggccagtataatgttcctggggtgagatgatgaaggcctgtactagggcagtggcaagagggacagaaagagagaaggaattggctttatcaagacttgactcctgatttgatcagtgtgatggggagaggagttgaagaaatttcaaccaaggagacagaagtgccagtaacagaggaagcatgctgtggctgggcatggtggatgggctgcagagtacatttatggggacagataatgagtccactccgagatctcttggatttgagaggtttggtggacatccagttaactgcaagttgctggcatctggaattctgctctgggcctatggagagaggtcggggtttagagatgtccatatgagagtgaccagtccatctaggggtgaactgaatttgtgaaagctgagagagatagagggtaagggttgtttacacagcagggggagacacagaaagagacccagaagcaagaagaggagacgggcagaaagatgatggagggagacagaagtgagggtgggaaagactggaagggaggcaggtaatgagactgagagactaaagaggagccagggaagtgaggaggaggaagagacacaggaaggggaagcctgggaagagaggcaggaagggaaattggaagaggctgtgctcagagagttcctagaaaagggaagggagcacaagccgtctcaaagaaagattagagagagaatgaggagagtgaggaagagagcagggagagatcaggagagacgaataagaaaagacaagacagaggaggtagtaagagaaggaagattaaggtaaaggctcattttcagtgaacaccaaggtttttggggtagataacaggaggagcacatacagagaaaccaggcagcacgaagccaggaaaggctagcgaagggaagtataaagaaaagggtgagcagcagctgactgacatatgcagggacccacagctggacattagactaagctctggaagtcttgtgcaggagttgggggaaggattgtgagggtgggggtgggggaggggagtagggagccccagttctgttgtctgcctgtgaatcctatttccctaactgggctgctttgtctgacttcagtgggagaggatgcacctagtccttcagtgacttgatgtgccagggtgataccccaggggaacctccctcttctcagagacaaaggggaggggcaatgtgaagggggactgggaggaggggcatgcgcttgggatgtaaagtaaataaattaattattttaatggaaaaatacaaataattttaattaaaaaagaaaaactagaaaaggagggtaaggacaagagagcctgttggctgccacagagatggggttaggatgcagtcaaggaagagaatgggttggtccatttctgttgctcttcctttaccaccttccctgaatccagctacgatgacctcttggctctcccttgatctgagcaagcagcctcctcctgctttgagaacttttctttccctccacacatgtagatcactcattccttcacatcctgtaggttgttgaaatgattccatctgagggaggcctatgttgattgcctgattgtgactcatagcccctccactcactcccccgatactgtccccaggctccttagtgtgccttgtatagcttggaatgtactataacacggattactctaaatgtgcttattgtccttgtcactacctctagaatgcaagtgctgtgcaggtacacattttgtcaggttttgttagttcttgaatccctaggacctaggacaaatgtttgttgagtgagtaagtgaattatgttgagtatgaacaatctgtgaacattgaaaggctaaatggagcaaatctctgatgtaactgtactttactatgacatctttggaacacagagaacagcagacaagtctggtcactgtagggttctgttcagttgaaattggctgaatggtgattttagctaataggttaacacaacactggctcactggataaagctatttttcttgatctccctttttctatcaaaaatgaaatggctgcgtgatgattgtcagtagcaagaactaggctttggctcatgaaggggttagtaagccacggtggggattaataggaaaggacaaggacagaaatgtgtggttcctgatggaggcttgtttttgttcatttgcttgtggccggagtacaaagggtattgcacctaatttggcgggagctttctacaccttacatagatgtattgggacgaacttggaagcagagcagagcacttctgaaaggcttataaagaaagtgtgggcctcctctggagagcttaaattggccatgtaactcagatccttccctatccgtgcattcgcgagcaggagcagaagacgacccctagttgtctctcacttcacttgctgcttaggtctggacgcagcactctaactggatgtgcttaggctaaatggatgtagaaaatacactgtcccttaactgtatgcagcagattcaacttcctcaaacattcaagcatatgtgtctctgatgattgacagtgtcctcatctccatcctgagtgtgggttcctagaaagctgctgtgaagttggccttatttggaccttcatttcccatagcagactggcttgtgagagtgatcactttagcacttggaggccatgattgccttcattaagatgtttccgtgtaaaagatggctaaagcagctatacttgttctcagctttaactttttggtattcttttcccccagggggagtggccagagcagatcctatctggtggtgagtggctgtcatgatctctacagcaccgctctacagcggcgtgcacaactggaccagttctgaccggattcgcatgtgtggcatcaacgaggagaggtaaggttgctgtacctagtcccagggaggggttggacctggggacaagattctggtttgtttctgattttcctaaaacacaggggtcacctgctctaccacactgtcccggatccactgaagatgaagaaactatcagatgacatttgccacctagtattatctgtctagtgataaagaactctaacattgtggagtaaagaaaagctcggatgcctgtagtttctgattcttatgtcaaagtttggtgttcagaagttcatgtaagatattttcagttcttgtccagggcttagaagaaagttggtctcatcatgtagctttatggtggggagcaggtcatcaaaattctgggggccagtacttcttacctcaagaagctaccaaaatatgtcaggaagaccttatgacatatcaaaggaagatgaggttgctgaccataactttaatgtaaagttcagttagtgatacctgtctggtctgtgtgtccatgtttcagtttctgatatttggttgttcaagagaggcctttttaaaaattatgcatcataccaaggctagccaattgcctttcagagttgatatttcccttttatcctccttggccaagttgctctgtatggtggttatgaggtttcttcaaacttcaagagattgttctgtcatgcctgttggtgttttaatccattggctatctaaattcaaacatgccagaggattctgataggattctcccctccaatttaagattggcagtctttaaaaagaaaaagaaaatagatcctggtgtagatctgttaagatagttcactgggtaaaaatgcttgcctccaagcctgacaacccgagttaggtccccagaacccactaagtgtaagaggagaagtaagtcccacaagcagtcctctgatgtccacaatcacacatgactgtgccaccttacaccccaaaaaaccagagggaagtgaaagaaatagatccagagtttctcaagtaattctaaaaagtatttgtatgtcgggagaggtaatggtgatagttttagagggaaaaagagactatttttgtttttatattctatgggtgtgtgtgtgtgtgtgtgtgtgtgtgtgtgtgtgtgtgtgtgtgtatctagggatgggatactgggaatcctgagtgctgagtatgttctatacctctgagctacaccttcagcttcatgtttttatagaagtcattttttttcttttcctaactagagaagggtatatttgtctgagattagggttaggagaatagacttctattttcttaatccattcacacctgatagcttaatggtccctgttctgaggagtgtgttagaggtggacttcaaaaaggaatttaattttagaatacaaaaatcaaaagtaaggagaataaggcgaaattcttctgagagacaggagaaaagaagtatgtccctttgtgtgtgaggtctgctcttagaatattcaaagagatgctcctggcaaggcaggctgctgggtgctttgtgagcacgcactgacaggctgcattacagtcacaagtagttggggctgatgtagagctgtatgcctgagccttcaagaacttagtacacaagcaaggtgtgcttactcgcatctataatcccaggactcgggaggtaacggcaggaggacctggggtttgtcaatagcccgggctgcctattaacttttaggctagccttgtctaccaaagtgagaccctgtctctgtaaaacaaggctaacctgagaaattaaaaagcactggacaaattaccttgttccctccctgtctgtgctgtattccttgcaagaagggagtcagaggtagatgtgaaatctgattttctctttttacagacctttcttgggatgctaaattacccaatatgcccagtggttaagatgattttttttaaagcattgtcatttctgatcccatctaccctttgtcaccttcttaccactgtctaggctgtgttacagctgatttccaaatgtaatctcatcctatatgcttttagttcttcttttgagacagggtctctttctgtgtgttgcctgggctggcctggagcttactgttatagcttagggagacgtcagacttgtagcggccctcctgcttcagactgcgtgctagatgtcatgtgtgagctaccgtgcatatcataacatatataatacacatctcacacacacacaagatctatttctgtgtgtgcatgtttcacctccatgcatgtctctacaccatgtgcatgccttgggctcatagagatcaaaaagagggcatcagatcccccagaactggacttgcaggtggttgtgaggatctgggtgggtgttgggaattaagcccaggtccttttgaagagtaggaagtgctcataaatgctgaagcatctctccatcccccagcgccacccccattttaaagacaaggccttgctatgtagcacagaaagaaaatcttcctgccttagcctcccaagtactatgattacaagcatataccaccaagcccagctttatcctatgtaaaaaccatcttcctccatcctttccaacttgtagaccttacaaatttgaggtataaagctgtttttagggataaacttaaaattacattgtaggagtctgccaggtttatcaaatatggttggggcatatagaacagaaggcataaatcagcctttttgactgctctaggtggtctgtcagctttagtcaaaccttcggctaaatagtcttgcttgcctttagcattaattcattccttcattcaataagcatgtattcaatacaagagcaaactggtagttcgtcttcatacattgctgttgaatgtgtggactggtgtgaacaggtcctatggagtctagctggaagaatgatgtatttctttgggaatatcagaggacagtgtcacctgagcccaggctagacatgtgattaggagtttgaggtgagggccgatatccatgcatccttgattattaggggaaggccttggctggagtgaaggggggttctggtgaaaagtctcaggggttggtaggtaggtaaggtgcctcatgcattctgggttggatatttctcttagatattgttccaggcccaacaggaactgaaaaccgtccagtgtggcaggtcctgccgttaatctttaataattaggaaaatggccctgagagatggtggctggttttggttaagttcaacaaagccttgagcacaccagctgtcttctagtgagaagaaacagtggaactgatttctaatcctgcttggagcctcttttggcctatgtttcccccctcacctgtatccccataaccttgctcagttgacccagctccctcccctgcctttctgatcccaggctcctctctcagtggaacatttttttttttttttaatatttgcttagctttgcatccccttcagaggatttgaaacaccatcgcacacattttcctccctgagcttggggggctggtgctgcagcttaggcatggctggagtagccagaagtgctgcctttgctgccaccaccagcctctctgcctggctctaggcttcactgctaacctctggcttgtgagaatatagcttctgctttcttcttctgggcagaatttctgcccaaggaggagcccaccaagcaggagggagcgtggtcaggaggagaaagaatgtaaacaaatagggccttcccatgtggagttgtggaggggagaggtgcgccctccccctaaaccatccctggagagtctagttggaacatgcttctccagcccaaggctggctccatataggtcctgcttttctgctctctcaggagttgatgtgaaaagtgtgttttcccttctctgtagccctccatctctcctcttcctcaagacccctaactgcggtccaaagcccttgcctcacagtcctgtgttaccagcagtcatttccagtggtggaactgtcccacttctgccaccctagctgtttgttaaaggggacaagcctttcccccttgattagccccttctggagccggctccgatcctcattgccattcttgcttctcttgccccaggtacagttagaaagtctgtgtttcagtcggagggagggagttatttgcaggggtgctcctccttgctggagttgactgcaggcacccccaaataccctttagactagagtgtggtcgctaaggcagacgctgctgacttttcttcacgggctgtattggatctctggcagggctccaaagatggcaggcaaacccaaacaaagagcaggcagagcagccctgtgctttgcccacccagaaaacttgctgcagctttgttctttgaccccctacctcctctgcagccactcccacccaggcggctgccctattgatatggctcctgagcacaggggccgggttcctgctgcacttaaagcggccagcggccggtatggagccaccacttgtccttcgactttactttagcgtgtgatccttttatttgttcgttttgtcaaatggcacatgttttaggattcttacctgaagtttagagaattcttcttgagcagtttgggggagggggttacggttgaatttttctcctttgagatccagctttctggcctttagactttctttatggcacataccaatagaaatacagagttctgtggctttgaggcgctccctttgggaggagagaggatgtggtgatgcagagaggctgaaaggaaggtgcgcccatgtactgtgagaagagagcatgttgtgtggagccaggttgacttctagaaatgctcctttggagaaaaaaagaagtgtttgctttgttttgctggtttttcaagtaacacacggggtcttactcttactgtataggcttgctgagtctaagctggccttgacctcaaagagatccacctgcttctgcctcctgggtgccaggatttaaagacacacatcaccagtccactgcattttccttgttgtttgagacaggatcttctgtggcccaaatgactgaattccttaccttcctgtctctacttcctaagtactcacattacagacaggacacatgctcagctaaatgtcgtagttttaaagagcctctcggtgtcagtgaccagatggcctcacatcagtgctgtaaatgtgagtgtggttgggcttcaggcccgccttgcccgatagaggagcaaacgcttcagattttgactagattggaaagcactgtggaagtggagatttgcttacaaagaggtttaccctgaatggcacttcccatatagacttgaaacaagattggatttaaaataaaactaatttgtgtacccttgaggattctgggttacatctctctccttttgggcaatgccttgtatatcctggagtgaatggtcaacttgatggttaagctccaggcgaaaggagaaggtgctaaggtggggttcatctgcactttgggtgagaacactagaaagcacaataagtggcccccaaattctggtcagacaaggctcctcctcttcagcaacttgcaaagttgcgtgtggcggctccgctttgcctggttcagctcctagtcttctgccatcccctgaggtcaccatggaagtgagacaggagggtttggaaagctaggcaggcaagaccttctagaagtgtcagtgctctaagtccgggccttatctcccttttctgctgtgtcttccctgccagaagagcacctctttctgatgaggagtccacgacaggtggctgccagcactttggatctcaggagttttgtgtcagcagcagtttttccaaggtaaggagctatgtgctgtcacatgctacccatcaaagggtgagcttcttggaccatgtgcctagtttggccttcctgagactgggagcaagaagacacaagttgctgtaggtgagacagaaacggctctgcgcatgccctgtacattgcagttggttgagttgtcgagaggaccagcaggtacttcccaggggcctcagggtacctgcatcagttcccaggactttgctaagatggccatgctattctttcgtcgcaggtggagctcacggcagttggaagtggcagcaatgcccgggggacaaacccagatggcaataccacagaaaaacttgggcacaggtcagaagatcagtctgatgaccctcagccaaaaatggactatgttgggaatccagcagaggctgagggcctcctggtgccactgagcagcccgggagacgggctcaagctgcccactcctgacagcactgaggccagccacagcagagccaactgctcctggactcccttaagcacccaaatgagcaaacaggttgactgctcgccagccggggtaaaggctttggactctcggcacggtgttggggagaagaacactttcattttggcaactctgggaactggagtccctgtggagggtaccctgcctctagttaccactaacttcagtcagctgccggcacctatctgccctcctgcccctggatcggcctctgggaccccctcggttcccgatccattccaagttcccctttctgtcccagctccagtgccccactcaggactagttccagtccaagttgccacatcggcttcagctccttcccctcccctagccccagcagcgccctcggtgcctactctcatctctgattcaaaccctctctctgtgtcagcctctgtcttggtgccagtaccagtgtctgctccccactcggtccctgtgcccttgtcggctcctgctccgacccctctcacagtctctgtgtccgcacctcccttggctctgatccaggctcccgtgcctccctcggctcccaccttggtccttgcttctgtcccaactccagttctagctcccatgccagcatccacacctccagcagctcctgcccccccatctgtaccaatgcccactccgaccccttcctctggcccaccctctacccccacccttattcctgcctttgctcctacaccggtgcctgcgcccaccccagccccaatctttactccagcccccacgcccatgccggctgccacaccagctgctatccccacctcggcgcccattccagcctccttcagtttgagtcgagtgtgttttcctgcagctcaggcaccagctatgcaaaaagtccccctgtcttttcaaccagggacagtgctgacccctaaccagcctctggtatacatcccacctccgagttgtggccagcccctcagtgtggctacactgccaaccactctgggtgtgtcttccacactcacactcccggtcctgccatcttacctgcaggacaggtgtctcccaggtgtgttggcctctccagacctccgctcttatccatgtgcattttctgtggcccgacctttggcttcagattcaaagttggtctctttagaggtgaacaggctctcctgtacttccccatccagcagcactaacagccagcctgctcccgatggggtccctggacctttggcagatacctccctcaccactgcttctgccaaggtgcttccaacttcacagcttttgctgccagcccccagtgggagctcagtcccaccacacccttccaagatgccaggtggcaccgatcaacaaacagaagggacttctgtcaccttctctcctctcaagtcacctccacagctggagagagagatggcctctccacccgagtgcagtgagatgcctcttgacctctctgccaagtccaaccgccagaagcttccattgccgaaccagcgtaaaacacctcccatgcctgtgttgacccctgtgcacaccagcagcaaggccctcctttccacagtcctgtctaggtctcaacgcacaacccaggctgccggcagcaacgttacttcctgcctaggctccacctcttcaccttttgttatctttcctgagatggtgaggaatggagacccaagcacttgggtaaaaaactcaactgctctgatcagcaccattcctggcacatatgtgggagtggccaacccagtgcctgcatccctgctgttgaacaaggaccctaacctgggccttaaccgagatcctcgtcatctccccaagcaggagcccatctccatcattgatcaaggagagcctaagagcactagtgccacttgtggcaagaaaggcagccaggcgggtgctgaaggacagccaagcacagtgaaatcccgttataccccagcccgcattgcccctgggctgccagggtgccaaaccaaggaactgtctttatggaagcctacaggcctgacaaatatgtacccacggtgttccatcaatggaaagcccactagcacccaggttctacctgttggctggtcaccataccaccaagcatctctgctttctattggcatttctagtgccgggcaactaacccccagtcagggggtgcctatcaggcccaccagcattgtttctgagttttctggtgtgtcacctcttggttccagtgaaactgttcatggacttcctgaggggcagccacggcctgggggcccttttgctccagagcaggatgctgtcacaaagaacaaaaattgccgaattgcagccaagccttatgaagaacaagttaatcctgtcctcttgactctcagccctcagtcagggaccctggcactgtctgttcagcctagcagtggggacatgggagtaaatcagggatccgaggaatctgagagccacctctgctctgacagtacccctaagatggaaggcccccaggcagcctgtggcctgaagctggcaggagacacaaagcctaaaaaccaagtgctggctacctatatgtcccacgagctggtcctggccaacccacagaacttgtgcaagatgcctgagctgcctttgctacctcatgacagccactctaaggaactcattttagacgtggtccccagcagcgagaggggccccagcacagacctttctcagcttggaagtcaggtggatctggggcgggtgaaaatggagaaagccgatggcgatgtggtcttcaatttagccaactgcttccgagctgatggtctcccagcagttcctcagagaggccaggctgaagctcgggctaacgctgggcaagctcgagtgaaacgggaaagcattggggtctttacttgcaagaacagttggcagccagacgaggagacagaatctctgccacccaagaaggtcaagtgtaacaaagaaaaggaaattgaggaagaaccacggcagcagccaccaccacagccacacgataagcccatggtccggagttccttggggtccaaggtgagtgccagtatatggcctagaattcctgatggtcagcttcacttaggggtctctgctgcatcccagcccaccccctccctacagtgctcttgagcagctcagccgtgtgaagggagctgatgaacgaacgggaggcttccccctttaactcctgctctctctctgtgatattctcacctggaaagggcctagctcattccataggatataggaaatgatttcatctttggggctagagaagccattgtcctagataaagttggaaagcctgagaaggtattggtgaaggaaatcacttcatcacaggctcttccccaaggaacaattcttcctggttctttaaagatgatgaaccactgtctttggcagtttggggcccagggaggaaaggaaacgttgatagggtcattttggccccacttcttcatagctctgtgacattgattaatttctcttaccctcaattccttcatctctgcaatgagacaaataatacttatttagagaattgttggaaagattaaatgagctgttgatatgaaatatctagaacaggcaaattgataggaataagaaatagcctgatagttgccgagggctggggagggctggagggtttccatgcagggcagtgaaaaagtttctgtaccaggcaaatggtgatagttacacaattctgtgtttgtacagaaacaattgcattgtacatgtacgttagtgaattgttacagcagagctcagtaaagctattccaattaatgagatggcatataagtgcttaaaatagcactgggcacgtaattaagtgctcggttggtattagcggctgcttttgtttttagtatcacaaacagaatggccctgccctcatgcagcttaggtcttgccgtgttgacttaatgacaactgggcatagcccttccggtatgtgatggatagtttaataggctgattgaaagatgtggggggaccgagaataaagttccaggagaaggagaaggcaccagcatctccaggttttccctttggaaaccagacaatctaagtgtttcatcaggtcccattttcttgaggaacatgtgaactgataaccaagctaagatgaggcgttaattccaaacagcccattgctggggatggccaagaggcagaataagctccggttgcttgcttgaattatttttctttcaaatattttttaatacgtttgtatttcttttctgtgctcatgtgtatgtgtgtggtacatgcatgatgccacacctgaatgcagatcctgggacagttttcagctgctctctctctacctcagattgtcccatgtagcagcaagcacctttacctgctaatccatcttgcctgccaaagaatgaggtttcatttgatgctgcctgtactgtattcttgtcccttgaaacatatttcaaacatctcttaacccaaacactgatcttgctttctccatcctcccaacttctcatgcagttggagtgtgtcatagttttactttcatggctgccctggcaggagatacaaacggaaatctcttctagatgttctgttttacttattatttatttctttattttggtctaccttaggaagtaaaagttcatggtctatacttgaaagaggcagctaagaacatatttagaaataagtcagagatgttcaaattgacgcatttacctttatttcccctgccttaaaatagtttttctttggctatacctgaagttcagattttaaagtcatctctgtcttcctcttttctccctatagttctttgttttctaacaccttggttcatagaaattgccagtgacttacttttcattgcgcttagtcctctgctgagtgagcagagggtgggaagctggtgggaaatgggtgctccctgtgcctagagaactgagggttctttcccctcaaatatcccatcagtaagatggctgccaacctgcttcactgaaactagaggttgataaccctactggaaggttatatggatgtgattatgggtaggggggacatgtgtcagtctttcatcacagtgacttaagtatctgaagaaaaatgagagaggaaaggtttgttttggcttatggattcaaagatgtcagtccctcatagtgggaagagtgtagtggagcacaacagtagctcatagaaaccaaaaggggaggggggagggagggagggggagagagagagagagaatgagaatgaatgaatatgaatgagtgcatgtcacatgtctgcagtactggcctctcctttttctattttgtgtttgggtgtgctcatgtgcatgggtgtttgtgtataccggtacctgtgcagaccagaggtcagtcttgggtatgattcctcattagctgtccactttgtgttgtgacacagagtctttctctggaaccaagagctcattagttatactagagggatccacatagctctgcccccccagtgctgctagcaaaagcaggcaccaccacacttggctgttttctggtgatgactctcagatcttcatgtcttgtagcaagtatttgacctactcaactacccccccccccccatcaattttctgatttccacctgggccctcagcctactgtaggatgttccatacatagctttagggcaggtcttcgttcatccttagttaattcttcctagaacacaaaacaaaacacagatatacccagaggcatgctatattaattaggagcttgtcaatccagccaaattaataaattaagataaacttcaagtaggttgttgttgttgttgttgttagacaggttcctctggctgttctggaacttgctctgtagaccaggctagccttgaactcacagagatcttcctgcctctgcgtccgcctcctgagtgttaggattaaaggcatgagccactatgcctagctgactgcaaatatgtttaactctttctgtcttcttaaaacctaacttcacgtgccccagatcaacaggactaggaacacctaccttaccatttcttgtttagtggcatggagaaacctcacagcttgtgaaaatctgtggctttgaggcagagttcctacaatgtgtatgtaagctgataatccagtagtaggtggggatgggactggacagaaacagaggacagagacaacaaatagggaaggagatcactgaaagctcatgagaagagatccagagatgggagcaggagcaccagggcttccttccagctctatctatcttactgcagatgtaagggtgacctggtcaacggcatcccttcagttagtgtgtatgctagcttgtgtgtggcccaggaacagtcagttgacctcttctctgagtgtctgtctcttcatctgttcggtgaggtggttcttaggacgaagcaaatgatggagagtaaagcatcctttaaatacacccaacttcgctgtgaatggcgtcccagagctgcccctgttcaccgtgttaatagggaggtgggaatcgtacctcctacgtaatggtttgagtccatttcctgctattaactgacacatgagaaaaggtttccttgacttgcctgttctcagaattattatcaattgatagcaatgccatccacaaggaagatgtttgagccatgtagttacctaacttacagaaaaggcatttttgtttaatgcctatttctacttgggtttgggtgtgcagagtatggatcccaagtctggaccttttaagaaaaaacctttggatgtgtgttgaggggtcatgaatacagattctgtagatctctgatacaaatcactgaaggaactagcaaggacactcgactgagtccaacagaacctttataacccagtgtgtcctgtgacatacatacacactcccagtcctaactccggcatatgacatgatccttcctaagactggagaacattgttaagcagcaaggctgacctcacacctgacttgtcctaccttaacacagtgccggaagctgcctggagacccccaggaacccaccaagaaaagccccagaggggctttagattcaggaaaagagcacaatggagtcaggggaaagcacaagcaccggaagccaacaaagcccgagtcccagcctccaggaaaacgaacagatggtcatgaggaaggtaggtctccaaggccatgcatgaccttcaagcctgaactccagagggatccaatggaattttggtggggagagagttgctgagagattgagtggaaaatggatccttctttgctgtggaatagaaagagaattggaactcagaagttaacagctcaggaggataggtctgttctggtcatgagtttgtgagtaccccaccttctacagtcttaacattgaacaaagtgatttgcaaatggacacagaacactcaccaaccggttccatgaggtggcatctaggctcaaagaagaagcagctgtaagaatatttattcaaaaaccgtagaattgggattcattaccctgttttttctaccttttggtatgttagaaaactcccattctaagacctgaaacaaatagctggctgactagctagatagatagaaaggttaaacgatgtctcaaacttttttttttatcagctaagaatacccagaacgtttgatttaggtatagggtatacttgatctatatactctactgtagatggcccctcagtgccttcattggagataatccaggcattcctggccacagtagtccatgttcatgatcttgctcattggacatgacataccacttctattttactcttatatacctgtttctatgtgtccaccactcccagccttaccttgttttgtttgttttttattttttttgttttttgattcttgtttttttgttttttgtttttgttttttgtttgttttttaaagatttattttatttattatatgtgagtacactgtagctgttttcggacacaccagagagggcatcggatgtcattacagatggttgtgagccaccatgtgctgggatttgaactcaggacctctgcaagaccagtcagtgctcttagctgctgagccatctctccagcccttgtttgtgtgtgtgtgtgttgttgttgttgttgtttgttttgttttatttatttatttatttattttggtttggtttggtttggtttggtttggtttttcaagacagggtttctctgtgcagccttggctgtcctggaactcactttgtagaccaggttggcctcgaactcagaaatctgcctgcctctgcatcccgagtgctgggattaaaggtgtgcaccaccactgcctggctcagccttaccttgttaaggtccatcgaggccgtgcttctttgggacagctacagctcagttagaacttgaggaacacacaccaacctttgtgttgtgtaggcagagattatactttggagcaatctgttaaattgcttctgtgtgttgctttcattggtgtcagcaaaaatgacccagccccagttttgaaaaatcaccattcccagaaagagctgggtagtgatagcagcttaaggagagtcagttgtgttaagttagggtaactgcaggctcaatacaagcctttcggttttctcatttcagcatcccatgtgggctttctggtttatagatttcttttttttttttttttttttttttaaaaatgttcaacattcttttttttttttttttaaagatctattttattattaatatatgtaagtacactgtagctgtcttcagacactccagaagagggagtcagatcttgttgcggatggttgtgagccaccatgtggttgctgggatttgaactctggaccttcggaagagcagtcgggtgctcttacccactgagccatctcaccagcccggtttatagatttctaattgtgatatttctgccttctgcccctaaaccacacatcactccaggttccttggaaaagaaagcaaagaacagtttccgtgacttcatccctgtggttctgagcactcggacacgcagtcagtctggtgagtaagactaagggtacctttgaaaaggtagacatgaagtttgaatggttttaccattggcgtaagtagacattttgtttccctgtgacaaaatgacaggcattttgcaggaataacagagtcctgggttgggcagaaggcttgcctgaaattttagaacagtttgcttaacaatgttagattagagatttaacatcatctttggttaagagtcagtgatgcgaagaagaacggcccctgccactcaggaaatttgtgctctaacattttgcatctcatgatcattgaggcccatttgaagtcctcagactttcaacctttgggctttaatctcgtcaccctatgcataaagcattatcaaaattggaaggttcattgaatcctatgggctggcacaattacttttgctccacagaacttgtattggtttcggtctaaagaagatagttgtttccagtttgtgttcttctctgctggctctctgttgggtcacaggacagagatggttgcctgcattcacccagattgccgtgcaaattggaaggaatagagacgactaatccaacgagctgacgtcctgttaactggtccctcagcacatggcaagctctatagtaactggggcttagaatgatggcctggcggcctcacaaagtcctgaagtgtcctctgaatcatcaaagagtgattacattcttgccagtcccatttttgtgttaaacacattgtactgtatttgattctttggaaattggtgatttctgtgcgattctgtattaaccagaatattaggttaactagaacactctgttccctgcctggtccatataatgcaaagtttagtgggatagttgttgtctttaagcacttgagcaacttgaagctttggtctagggtggggtttttgttgtttgtttgtttggtttggttttttcccctccaaccacctttttcttctgctgaccttactagggtgtagatactgctgagttaacagctaggctttcgggagaaacatagtactgctccttctaaggaaggtgtgagatctgtggtgtaaaaccaggccaatttagggttgtgcttttactgttagccaagttaagggtaagtagggagagagcgaatagcctcttggcaaggtgacccaagaggataggaaagatgctgtttgtcctggggtgatcggccttgtacttgtccagcagcaaggaacagctgcagtggatgggcagacagactagagagaaaagtccatccttgaacttctgcaactatgtaagaggtaggattagtttaatggaagagggcctactgtactccactgggacatgcctgaatcagattgtggcataggaaagggactccctgcctttcctctctgtcagagacactcttcttttatgtcaattctgcttggccaaggtagctctcttggccatattggtggaaccacaaggttattaggacctaagttgtcaccccagacttccttactcatttgctcccatttgccaaccagcagaggactacagctctctcctgcccttcatgcagtgcttggctcctcatcatcactgagagtttgtgagtgggattcaagttaacactgcactggggaggagtgaggatggttcctagtacttcatggtattttggactctataaagtacgtacttaagagtggaagacttcacttgagcccccagaacagtccttcgagataagtgtacccctaataactgacagagcctgaccttgaactcagttctacaaatttctactccagggaagctgtgtcaataccatacgtaatgccttgaagaagtacctgaatgtcttctgtacatatcccatccgtaggtagcatctgtagctcttttgctggtatggcagacagtgacatgggaagccaggaggttttccctacagaggaagaggaggaggtcgctcccaccccagcaaagaggagaaaagtcagaaagacccaaagggatacccagtaccgcagccatcatgcccaggacaaaaccctgctgagccaaggccgcaggcatctgtggcgagcccgagagatgccctggaggacagaggctgcccggcaaatgtgggacaccaatgaagaggaggaagatgatgaggaagagggcctcgtgaagagaaagaaacggagacggcagaagagccgaaaataccagaccggggagtacctgattgaacaagaagagcagaggcggaaagggagagcaggtaaggctggctctaggctgctgttcctgttgtgacgtcagctggagccttaggactgacaggaacctggtactatagtcttcacatgtgggatacacagatccatcttgagtatgtgcctttgaatctagaatgaatgaacacaaactagtctacaaactagccttttaaaaatgtatatctgaacctgtggtccaagccactgtgatattgttggcttgggccactgtcttatcagcgagttatgattggcttgacagagtcaagtttttggagactataggttctttttttctgtgatattcagtttaaaagtaagacaagccaggtgtggtatatacgtctgccatccaagcagtcaggaagttgaggtaagaggacagtgagtttgaggacagcctgggttacatagtgaaaccctgtctcaaaacaaagagggaggggagggcattggctgccacacctggcatgcttctgctcacaaactaaaatgaaatgtagtaattctaaaggcaatagaaaacctgaaatatgtaaaactctctgctttctcaggtaaagccacaaggggtttttttagagttaaagttttgaggtgacataggtggccctgagctgtgaaagcaggcagttcaaaaagaaaactttctatggccatggctcatgcttaaataccatcatggaaggatagacagtcataaaaagcttgttcataccagggtacttcattaagtgccgctcaggactgttcccatagtggctttctaattgagcaaaaaaaaaaaaaaaaaaaaaaaaagctcatctctggattccatagcaacacatttgtctcttcttattctctggcctcttcccttgaaataacaatcgattgtctcttacagtgtattcacttttagctggtgataaatatgtatagtccccttattatctaaaacaaaccaagctcacattctgtaggccatagttcctgggcatgctataatgccgagaaggcttaacctcgtttctgactctgttgaagtggaggtgtatatgatacctgtccccacgctcaagagtaattgagctcattttcatcaactgtctgaacaagtggggcaattttgcccttcttttgccggaactgtaatggattggtcatgaatgaattgtcaaaccattggcctcagccgcttgttaggacgcccagcagtgtgtgtattactcagtcctctctaatgaaggctgcttgcctagcttgggagcctctcctggagctatcagctctttctttcttcttcttcttcttttaaaatctattttcctttccttttctttctttccttctttcctttctttctctttttctttttaaaatatcttttttatccctttgagacagggtctctttactataaagctctggctgtcctgaaaataactctgtagaccaggctggcctcaaactgacagtgatccacctgcctctgcctctcaagtactaggattaaaggcacatgatactagctctttcagtcagaaggacctctttggagttgcctggacctatttgctagctagtccataacactgagatagacgttgccacagcatgcatgataggggcttagctagccgttgctagaccatctgcagtaacatactgaataccagtgatcaaggtatcttgcttgtttaagggcagcccaaactattgagaagtaggtcattctccctctctgagtatttttgggagctatgcattgaagccactggtgttagcaaatcttttcatgcagaaatttcttaaaaaaaaatatatatatatttaaacagggtttctctgtatagccctggctgtcctggaactcactttgtagaccaggctggcctcgaactcagaaatctgcctgcctctgctttgcctcccaagtgctgggattaaaggcgtgcgccaccatcgcccggctaaaatatatttttattgatttttttatgtttatgggtgcttttcctgtatgtatgtctgtgcagcacatgcaggcacttactgaggaggctagaatagggcaccagaacctccagactgcaatacagatcattgtgattctgtgtgagtgctgggaatcaaacccgtgtcctcatgaagagcatctagtgttcctaaccacggaggcatctctctaaccccgggccggggggtgagttttgacaagcacgcccctcctcagaaagctcaagtctccttacctacactatttggctttcaggccagggtcagagaagtaggaaacggacaagccaggtagatcaccctcctctctaactctcatggcctctcctttcatcttgtgcttggctcgcttccttttcattctatgaaagaggtagaaacagctctttccatgtgcctacctgtcccctgcacactctgtgcttttgtaggctagcataaagctctggttcttctgcaactgagtacactccagagtttgccctgcccttggttacatggagtagatgcctgtttatttccttctttattgaactccgagatgtggttttccgtgctctccacggttttcacaaggcacagttctgtttcttcctcttgctttaaccctcttgttgggtcagaagctctggattaaggctgagtatggtgggtgtatgcctttaattatagcactcaagaagtagaagtaggcgaatctttatgagttctagactaacctggtctacatagtgagtttcaggtcatccaggaccatatactgagaccatgtctataaaacaagccaggaggtggtggcgcacgcctttaatcctaggacatgggaggcagaggcaggccgacctctgagttccatgtcagcctgctctgcagagtgagttccaagactgacagggctacacagagaaaccctgtctctaaaaataaaataaaagaagcagtgcagaatccctagcactcagggtgcagaggcaggtgcttctccaggcagccagggttttacagagaaactctgtctcagaacaaaagggagcagggatacctgctgggcaagtgagaattgggtttgttcaatgagtgtcgctgggtatatcaaccacacactagtccaggttgaatgcacacagtagttggctaacacaaaacatactccatgtttttttttaatgggctttttgttttgttttcatatttttttgccatgctgattcatttttgtttttcatgtttgtgttttaggtttttggagagagggaaaacattttaaaaagactaaaaatggggtaaaaagacctgagtttgaatgttcttgctggaagtgtcagagaccatgtagcacagcatttcttggccatattgtgaggacccactaatacactaggtggaagaaggatagtatgatagctagggcttctttcctaaatccataagctacagccagttgtgcaatttccttttattgttgttattgttttgagacaagttctgtctgcatagtccttgcagtcctggaacccacgacatagaccaggccgtcttccaactcacagagattcaaggcttgcgctacctcccaccccagccaattcactggtcttgaatagagactcctacatctgcatctgcctttggcagttttacagatgagagtccatttcaagtttggggtggcagtgagttgagaactctgggattccagtctcttcatttcacacatggtagaaactgaagttgcagctacttcattcatagccttactgatctgttgtgtgctaggcttggtgttcaggtttgtgacggagataccccttccccctagagcttgcactgaagtcatataataaatagtgcagcaacaaataagagagaccctccctcaatacaaggtggagggaggggcctgacacctgatgttgacctctgtaactgctcattacagcacctacaaatacagacatagccacacacacaagccatgcatctccattgccaatcgatacaagtgaatggtttatgtcacctacacaagaggtttaaggcagaccctatggggtgaggctcttgctagtggagtttgcagtagacctttttgaaattacaattttagacacatgttgttgccctgtgataccaattacctgatttccaatcagggaaggcagtatctttctgccattacacacaagtaggcctatactgcgctggggagtgtctgttgcatttaccttggtatcttcagacaggaactgacaggcagttagaggtgaggagaactgagctcgtaaagttagccctccactttgtacttgaaccccactgtacttgattgatacttcagcaaaactgccaagttgcttttgattttggagagggagggggtagagaaaggctgaaaagagattctggtttgctctgagctatggggagatcctttcaaaatgacccgcattttgggggccagttagatgggctgccccctgctggcaggtctgggaagcgcctcccacggatagatggggaatttgcatggtaaagcactaaaggatggtgttccatttctgtgacagtcgttctttcctgtttcttgttcagattcaaaggcccgtaagcagaagacttcctcccaaagttcagagcactgcctcaggaacaggaaccttctcttgtccagcaaagcccaggggatctcggactcaccaaacggtttccttccagataacctggaggagccagcctgccttgaaaacccagaaaagccgtcaggaaagcgaaagtgcaagaccaagcacatggcaaacgcctcagaagaggcaagggtatgtagccaccaaagggaccaatatgacgaccgtgggctagagaggccgactttctagcacgtctgtctagctgtaattctctcccagagggcaaaggaaacaagtagatgggggagggggccactgagctgtatgaaagtattctaaaagtattctagaaacgcgggacacattcaaacagtggaaactgaagttatagttaattatggggtttgacccctgatttcttttccctaacaatccttgtacctcatttttaaatatggcagggtattagcctgaacagattgttaacatccagtcaagaagctcctgtctgactttctgagacaactaaggtagagtgtaacttgttgaagccaggattttgttacctagaccaaggtttaagggtccaggttagctgctgtctccatcctgtcccctgttcctttgcctctggaggaagcctagcagcgaatgaattgggtacttagcagttagccaggcaagcattctttgaacccttttcaaaattaccagttcatttgcttctgcggttcataacacttgcagcgctgtcagattctacaatgtaccgctaaagaagaatggcatagtcctttgaaggaagtgagttgcaggtccagcgtgtacctgtgataggtatctgccattgacaacagaaaatcaaatgaccacgttgggctggtttggttagttacagctcttattcttctgtctggctttcaagtaggaattcccaaatgataccagtgagggatagatgcttgtctttgcccacctcttcctcccccgtgaatccttgttgcagcttagacaagacactcaagtctatttgctcatctttaaatggagctgatgctccctgccccttctgtctcacaggagtacttggggggaacaaaagcaatgtctgtgacaggctttgataacggaaagtgttctctgagggtcagtatgcatccttgcacttcaggcagagacaggaatgagagaactagagggaaagccagaccaactgtgatctggcatgccagggaatccattatcccaaacccatagactacaggactgataggagccactgggagagtacagacacgtgcttggctctggccgcctctttcttcttgtcactttttatttatttaatgtatgtgcttatattgtgtgtagaggtgagaggacaagctcgggtgtaggtcccttgtttgagacagtctctctgtttttctgctgcatgcactgggtaagcaggaatggatttttttctgtctccacctcccatcttcccatagagtactgggtttataggcacttgtatcacaagtccagcttttatatgggttctggggattcgaactcatatcctcatgcttgtatggcaaagttgcttttactccagctctcctgttggtgctcttaattcccaagtacttcttagaggtaggcacttatattccagtcattttacagtaaagacttatgagaggtgactcagtggtcctccttgccagaatcaggacatgaaacaaatttgtctgcctgaggaagaggcctaggttgtcaatgtgtcttgcagtctctgagtaactgctttctgcccgtttctgggcctccctaggaagtaggttagtaggcagaaaacactaccatctttaaacagttctgagacaggtagaggtccccgggtcctgccctccttcccatcttccctggccccatcccacacaaagggctcagcagcacactcatgcttctgtgtgcttgctctggctggcaccgggtctgctaaaatgttctcctggagagggttttgtctctccctgcagcctcccttccccctcctgcctttctttctctcccagtcaccacacctgctccagttgcccccatggcacggggctttgtagtaggaagcaaggcagggggaggatgggggatgctcctgcaacactaaagcgcagcattggacaagagcctcttcccacaggggctcagagccaggaggaagaggggggaggggtccccttacatggtctcacccctccccctctcgggcagccttcttgcctgctctggcagcctggctttcagaaaggaacttactggagctggcttagtgtcacaaaacctgagtccatttccccatggtttccagtcctggtgttatagtttccatcttcctagcaataaagcagtatcatatagttagtgttttcttgctagggattgtgcctccaccgttctgccatggaaactgatcaagacttgttgaaatttacccgagggcatagattccctggccctgtatcatttatctcttagtgccccttccttgactttatggaactttctaggtaactttttttgactccccaggctttgtacagggatagcttgaatcaaggcaacacataattgtaatgcgcccagctctgacttcagtgccgtaagcaacaactgagaaggtgacagtgggaccggtgcccctaaggaacttaagaactagcgagagctacgtgtagagggtaaagaaggcttgtttgatcctggagctgaaggccagcttaagcaaagtagtaagacagaatcctaatggaaattaagaaaaaaaaacttcctaggggtttcaagactcaactacccatggaaaacagcaagaaaataagaagtgagatgtcagaggataaactctgagtaggctttggacttgcagtggggccagagggcagaaaagtgcagaggacaggattggactgagcttcggatgctcgggggggctttgagtagatgctcgtgtttttagcataaacagtcactctgaaatctagcggccccgcataaccagaagcagatagccacgtatcatcttttagtttctggagctcagggtttcaggaacagcttagctgagcccagtgtggggttttgtgtgaggtcacagtccaggtgttaggcaggactacatcggtgtgtttctggtgtatgtagtttgtgcacgtagctggcaaaatgatgctgaccattgggaggaggcctctattcccttcctcgtggatcccctcaaaggtcttttctcacagaaaataatttgagagagaaccaaaaaggtgccatagtgtcttttggaacctgactttggaagtgacaccccattccctttgtagtcttacctgggtaaaccttatcccagtgtgggaagggagctacacagagctggaccctcagggataggatcgtcagggttcattgtggtggccaccccgttactcttctatctgctttctagtggattcaagtctctcatccatgcagggtctaaaaccctgctaacatcccctcaggtgaccttcagttcatagctttgacttggagccaggtgcagctgaggctgctcccatcttggaatccagttgctacagcgcagttattcctcacctagaacctgagtttgagatataagtgacctgtgcccctacagaccagaccaagggaggcacagtcgagcaagcacagaaagctcctatgtacgtaccttcaactcaaaatggggcagagggaagcacctctgtgtggcttctgcagacagacctctcagaacatttgtagtccacagcctttgtaggacttcattatttcagaagggaaaaatgaatgctccgaggagttaggctttacttaagggtcttaaagaatatatttattcatttattttatatgtacatgagtacaccattgctgtcttcagacacacctgaaaagggcatcagatccctttacagatggttgtgatccaccatgtggttgctgggaattgaactcaggacctctggaagggcagtcggtgatcttaaccactgagccatctctccagccctactttaggggttttaactagtgggtggcagaggcaaacttcaagcccagccctgtctggttccagggcctcacagtccactgcccaggatgggcctgaatataatcttaggccatggtatgaaaaaagctgatgcaagcttatgaggttggatatgggggcaggtttatagaggagtgaagggattgagaattgtgcctggtcagactgctgcctctgtgtgtctctttgttctcattacctatagacacagcttgtccaaaatgtcaacaagtggacgttggggccaggtagaaaaggcataccaagtgcttgagagaagctgggctgtctcgtcccaattttcaatcctcccgtcttgccagggtttatggggctgaggatctgatatttctaacatgttgtcttcttagtcagggtctctattcctgcacaaacatcatgaccaagaagcaggttggggaggaaagggtttattcagcttacacttccacattgctgttcatcatcaaaggaagtcaggactggaactcgggcaggtcaggaagcaggagctgatgcagaggccatggagggatgttctttactggcttgcttcccctggcttgctcagcctgctctcttatagaacccaagactaccagcccagagatggcaccacccacaaggggcctttcccccttgatcactaattgagaaaatgccttacagctggatcttgtggagtcatttccccaactgaagctcctttctctgtgataactccagcctgtgtcaagttgacacaaaactagccagtacacatgtatccacccatggaaatgcaggggctttccttattttgaaaataagctcacatgactagtgactaacctagcctccaggctcccaagctgacagtagactgggccacttggcatagtgtcaataaaggaaaacatgagtgccggatgtaacgaggtggctttcgcagccaaatggcatggccatgatgaattggatatgttgcctggcctgacccaggacttcatttctgttttccagagcaaaggtcgttggagccagcagaagacacgatcttctaaatctcccactcctgtgaagcccacagaaccatgtacaccctcgaagtaccgaagtgctggccctgaagaggcctcagagtcacccactgcccgacagattcccccagaggcacggagacttatagtgaataaaaatgccggggagaccctgctgcagagagcagctcgcctgggttataaggtgagtaagtctccctgaacaggcgatgacaggatgacgacgttggcctggaccttagggagcagctatactgttggttcctctgcatccgatggtctccctctactctgcacatggcctctgaggatgccccttatgtgcgctcctctttaaaatgtcagttcaggagaaatgcatttgaaaaggtagcacaatatcgtccactgcattcctaggctatgaaggggatttgaaattttcactttgtcttaggttaacaaaggggaagtaatggcttccccaacgacacgtggtgatgattactggttacacattatctatctcctgtggtttctcctcatttgggctttcaggtagaagggttaagagcctgttcaataatcctgggctaacccacccgtactacatactttcttaaacatgggaatgagaacaaacaaggcaggcttccttccttctttccttctttcctttccttctttcctttccttctttcctttccttctttccttccttccttctctccttccttccttccttccttccttccttccttccttccttccttccttccttctctccttccttctttccttctctccttccttccttccttccttccttccttccttccttccttccttctctccttccttctttccttctctccttccttccttccttccttccttccttccttccttccttccttccttccttccttccttctctcctttcttcctcctctctgtgtaatagtcctggctgtccagaagctcactctgtagaccaggctggccttgaactcagagatctcccccacctctgcctcctgggtgctggaattaaaggtgtgtgccaccatgcccggcaaaaggcagcattccttgagtacttattttatcatgttaaggcctttgattatagtaagtctgttgaggtaggtcttattcctagagttagcagtatgaaatgatatggcaagatgtatgtggtagattacccaggtgataatccaaagccctgggaagtagagataggcaagtcagcaattgaaggccagcctcggctacatagcgaattcaaagccagcctgggctaccaacaaaagaaaataaaatgtgtccaatatcagttatgacagtacttttgtctgagttcaaacacatcctgtgcctcccatgtgagatgtacctgaggctgtatgttggtgcacgtttttatccttgtctgctctctgttgaaacacatacctttggctatgtatctctgccccactgtgtgatggtttccttgggatttgcttgtggatgcggacttatccacattgcagagtttaccttctctattaggctttctgtacctgtaagggtccactctggtctgtgcaacttgcacggtgtctccatcaagctgccaatgtacctttcttgagtatttagtatggatgtctgcatggctctcagggagacctcaggatgtattgaaatccagtctccgcagaaacagcaaacaggagaaaattggagtaagactagaacagagctggacacccccagcccaggcacagagtagctatctccagacatcctctcacggtgtctcctgggcttcctgagagcactgacagcagaactagtgggtaccatgttctagaagcttcacccaatggaactgccaatctccatcccagtttattcatagctttgtcccacggtagcaggaatgcttcaagtcacttgagttctccctcttgtcccaccatctcagctccaggaaggtagcattacccgaggctgaatgatagaagtacattgtggctatagatctaactccattgctttgcctagcaggcacagagccctggtctcaattcccagtactacatcaattgggtagaatggtatacacctttaatccgaaagatctgagattcaagatcattcttggctatatagggagtataagagcagcctggctgggcagtggtggcgcacgcctttaatcccagcacttgggaggcagaggcaggcagatttctgagttcgaggccagccttgtctacagagtgagttccaggacagccaggactacacagagaaaccctgtctcagggaaaataaaaagagcagcctgggctacaacaagaccctgtctcaaagcaaaaaaccaaagtgaattgtggagttgtgcttgcctggggtaactggaatttatgagcctgtcaggagcagagttcccatgtatatcttgtaaagctcagaaaggtgattgctgggcagcagaggagcctctctgaagaccttactccaaagatcaccacccagatgagtgcccttggccataagaaatgtcttcctcctgccaagggaccagctcagggctggggcccagcaatggaggctgagaactacctttgttcacaaaagattttgaattgtgtcatttgtttcctcgtataaagaacaggctgtaaaacttgtcagacacttgtggagtggcaagtctaacagggaggattcaaaaaacttcagacttgtctttgctcacagagctgtctcccatccctacaggacgtagttctctactgcctccaaaagcacagcgaggatgtgaatcaccgtgacaacgcgggctacacagccttgcacgaagcctgttcccggggctggactgatatcctgaacatcctcttgcaacatggggctaatgtgaactgcagctcgcaggatggcacaaggcaagaaggctgttcctctgccaagtctcagacctcagttcagtccctcgcttcagagctttactcagacctggatatttgcagaatgtccagctgctggtgtcaaaaaggctttaaccaggaagccttttgaaaggatgtctgaagggagccagcttaggggcaggagctgatgagttcctcaatggccagtctgtatgggactaaggaaaggctgaggttgtccagggttcactctgtcccatgccaagtcaatccactcaaccctcctgaataccatcatcgtcgtgggccatttatctcatgtggaattgaggccttaggttccaagcagagcactaatctaggtttcacattccagattgggtttttgtaatttagtctctgtgaacatacaaaaaaattaactacctgggtctgtgagattggcttgatatatgtaggcacttgccttcaagcctggccctcttggctgccacatgatggaagaagagagccgattcctgcaagttgtctcctaacttctgcacacatattcatgcacacacacacacacataatacagaaataagtaaatgcactacaccatattaatgtgcacacataaacaaacataaaacctttccatgtctcagagaagtcacacccatctcctctactccaggggaagtgtataccaagtagaaggggccagatcaaagtgtacaggctctgcttggctgctacctggtgtggagcctccctacctatccaaccctgcccttgcgcagtcacctgggcccttcctcttccacaaccacccacacctgctttaattttaacttccaccagggacctgttctccactgaactcctagtagatcgacattgtgctctagatactgtccgaagatgcgggggaacacagaggagagacaaatatgggaaagaaaaagaggtgcacagagacaatatgaagcgtaggccagaggtggctcccctgctctcttacccatgttacactggggttacctcgaggtcaccatactatctttctcactcttcttccccctaatatcgcattgtgaaagttctccattaaatcctgtagccctgactcttatttgacctccacaggccagttcatgatgctgtggtcaatgacaacctagaaaccatctggctcttgctatcctacggagctgatcccacactggctacctactcgggtcagacagccatgaagctggccagcagtgataacatgaagcgctttctcagtggtaagcattgaccacagttgcagccagaatcctcagggtttgttggccttggactcctcaaccgggggatgggggaggtcttcagtcactctgtcctagacagttcccacaaggatgtgttctgtcttcacgtattccttcagtgtcttggcaatttctagctactttaaaaagtcccttgctgtgagtgtccacatcactacctcagtaaggccctcacctcctacagagattcatttcaccactaggtgtctggagcagacctcccaatgggaaactggctatactcttggctggaagcaggatatgttgacctgtgctatgaatggaatgtcggtggtagagaatgaataatccccattttgctgttgctgcagtctcttcttgattgtaattaaagtgggacctctgggacccttcctgatgcttgattctttgtggctcttctcccatggtaactttgatactttctatgcattccagtattccccttctctccattcctgcctcttctccaccctctgccttctagtgaagtgtcatgttcaggtccacggccagggccacaagtcatttcatagatttttctctctagtacgtagcactgtgtgtcagcaggtaggcaggctgatctgagttgggcagctaggatgggaatgaaagagaagactctacttacagcatgctcagtgtcagttccttctgccgttatctcaactctttgtgacatcatggcttagtccttcggattgcctgagtgatggatgctgcagttgggagttgcagccgtgaccctcttcataggcttcagttgtgatacaaacatctattcccctcttacccaaactttggcccattggtcaccaactacacctgccaatgatgcagcactgggttcccaggttaggcgggagtcacgcttgcttaagagaattttgctgagtagctaataatgtcaggagtaagagaacctatactaaaagttcccatgggagggaaaagaggtggggatattgtagaggctgcagggaggcaaggggatgacagattgcctaggaagggtttgacttgtgcccgtccaccctccaaacagtgcccttaactaacctctgagtataggcctcaggctttccagccttccttatcctcgggctaggggaccgaccggaggcttccttttttaatttcttccatgacgctgggtccttgagcatctggtcatcatgagacatagtcacttagggatttctttccatcagtcacttagtgtaggccagtaatgactggttattaatcctttcagcagagccactccaagggtgcaacatctgtagcctcctcccacgcgtgtacacctatgtatattctgtcttagatgtcagcatggctctgcaggacaatgaagcttctttgtctttcgtaacttgtctgatgggggtggggggctgcaaaccaggtagcacctctggttactttattgaatataagtgtaaacctttcctccctgattgatctgtcaaactccaaaagactttaaatgttgacactttgttgattttgagatgggatctctctgtgtagtcctggctcttctggaacttgctatatagaccagactagcagagatctgtctgcctctgccttgtaagtgctaggattaaaggcatgggccaccatactctgccaatactattttttaatgcctaaaaaatgagagataagaacttcttctctttttattttctataaactcatcccaatctcctaggtaattgttttaaaaaaaaataacacttttaacgataaggtctcactgtgtgactctaatcagaacttgttgcttatatcaggcaggcctcaaactcaagaggtctgaagttttgtcttaaataacatctgcttgcctctgtttcctgaatgctggaattacaggtgtgtgcaactacccccagccaaaaagaattttaagacatgtattacatgttttatgtaattctattatgattaatagaattaataaatacatttatcattatgtaaagctattctgggttacatagtgagttccagaccagcctgtcctccttaagtgaacaaacagcaagacactgcttaaaaaaaaaaaaaaggaaacgaaattcatctaatataacagtttaactgactaattctatgacattaagtgcgttcatgatggtgataataaccatcattgggggctctgatgcctcaaaactgagcagcgcctctcttccgtttcatccctggatgctacctcaccggttccccaggagccataaggtcgaatgtttctgaggtaggaaggtagggaggtgctcttcttatgttacaccatatatccagctacctatgcatgggcggcttttgttggtgttttttcagaggtggaggttgtttctggtattgctgttgttgttgttgttttaaatttcagttcacctgtctggctgagacatttaaaagtatcccattcatcttcaagcacttgcttagccaggtgctgcagacatgcattgtctgcgtcctccctagcccaagtcttccagtagaaaatgaggcaaacccatgtagggtgctaaggactccatattttgcaagcatcaggattgggcttcatggctagctttcctcattctgtgtaaggctcctgctctggaatggttgcctaggacggaactcttctaagaaagctatcttgtttacatggagcatggagctgtccaaacccccaagagatctaggaaaggcttcccccatgggccatcttgctaatttacctttgaccctttggagaaaaaaaaagagcaatatccaatgttactgcgagggaaaatagaccgagttttgcctcctctgtggaagcgcacaggaactgtgcagttagggctcagacattagacttctttccctttcactggggaaagggttagccaatgaccagtcaaggtcactgaagcacacagttttggttttcctgcagagacttctatgatatgaagccatattgaagacagctcatttctttttctcctttcatgtccctcagctggtgactttggttgggtagggtatgctaggatgctgggatctagagaaactctactagctccaattccatacgtgggaacaaggttttctctacttaagaatgaggtactgaaggccgggcagtggtggtgcacgcctttaatcccagcacttgggaggcagaggcaggaggatttctgagttcgaggccagcctggtctacagagtgagttccaggacagctagggatacacagagaaccctgtctcaaaacaaaacaaacaaacaaacaaaagtactgctgagggggctttcaataaaaaagtgtagggtaagattgatgaggtaaaatgactaattgatcaaattactgatcaccacgtgatcgtcggttcagtgccctttacttcatttacagggttccagccgctgcggtctagttctgaaacattatcatcgtccttgcatacaaccttgtacaaactgtttattcccgtcaccttcttctcagctcctgcagttgccaatctgcactcctgtctctgtggctttgcctattccagacatttcatatacatggaaccctataaggcataatcatgtagtatagtggttttatggcccatctatatgctagcatgtttcagaactacactcattttaatattctatcacactctctccctctccttctcttccttcaccctctgtctgtcagtttgtatgcgtgacaaatgtcagaggacaagttgtgggaacttagtctgtctttccatgtgggggcctgggattgaacttggatcttcaggctgatggtaggcacctttacctattgagccatctatctgacccaacattcttttatgactgactaatagtgtgtcctctgtgtgtgtgtgtgtgcgcatgtgtgcgcatgcacacgtgcacacactatttttatctgttcattcatgcatagccctttgcgctgtgtccatcttttagcttttccacggtgcagctttggtcacgtgtgctccaatccttgttttattggtcctggtgcatttgtatgtgaacaggaatgtttacgctcacaggagtttctcacacaacgggtaaaatcttgcaagtttgctggggatgaaggcagaatccaagaaaataaaggccactcattttgatggtagtcctatctgaggactatggattaatgctataccatcaggtgactccgcccacgtgtttgtcacgcatgggcctgttccaactttagcatctttgctcatgccagctaactttggcaggttcacctgtccacgacaaagctttgcaggcggtggagagaattagaggaatgtgctgggctctgaaggcgattcctagtgggagccacaggaatgtggtgaacttgacctgctccagtggaatcctgtgtgactgcgggtagggggacaggggcggcggagtgcatatgttttggcacactgcttaagcaagccctttgctgtctcactttattgtgattctctcctttctccttagtcatcctcttccctagtatgtttcttagtatgttcttctcttagtatgtttattaagctcttcttaggggccagacactggagttccggcaaaggagggacagtagttaacaaaaagtagaccctgttccttccttttacagaaagaagggcctccttcctttattttctatgatacaaagcataggactagactcagagtagactagacacctgcccaacagatgcttctggaaggaagtccttgtgatttaggcagtacagtgtactgaagatgtggaggctgtcagcggggcctccattttatgtggggtgtacagagatctaacctccacaacgtaaggtgcctcactctgctgttactttaaaagctattccctggtgccttcccagtgggagcctgagctcgtcatgtcttggaagatggctaagaagggagtggctttggaaggttacattaacagacagttcttgctgctggattggtccagaaggggcactgggtggcgatggtaccttcagtggaggaagcaagctgcactccttggggggaataactcccagtggaattctgggactggctttgcaggtgaccaccctcatctccttgtgttctttgtgttctcttctttcctgttacctaggtgctacttgagagctggtggcgatcccccatcgctcagccagcctgttaattgtacaattgggcacactggcaacttcctagccttgcactcacaggcttcatcaggaaagcctgctttgtatctgggtggggagaagaggtgaacctgtctactgactgatgctaagaagcagggaggctgagggcgacctgaggcctgtctttagagctagccaatgaaaggtgggttgtaaacccctttcattgtgggagtagatacatagaagaagttagccacttgagacagctgtgtgatggagtgttgttgagtcacagtgttgtactacagtcaccactatctgctttcagaacttttttatcattgcagagggaaaccccagatctattcttagtcactgccctcccccccacacacacactgccatccatgcttagtctgccttctgtcttattgactttgcctagtctggagatttcattgagatggatatatatatatatatatatatatatatatatatatatatatatcctttgtaactgattcttagtagcatcatgtatttccagtatgtgacatattatcactcttttttgattaatttttgtattcgctttacatcacagtatcacccctcccattaacccctactcttttctttatatggcactttgtgtctggcttctttcacctaccattcatgttgttcctttttatggtttagtaatattcttctttgtggatattacctcattctgtctgtccattcatcccttgacggacatttgggctgtttctgacttttgaccattgtgaatggagccatgtcagttcatgtggacagaattttgtttgaatacttgtcttcggttctttttttaaaaagtaatttattgtgtgagtgcatgcatgtttgtgtgtgccacccttacaggccacatcatgcaggtagcagccactgggcacgttttggggtggtagtcctctcagagcaccttgttttcaagcaggatctatttttggtgtgatgtgctccagcctagttgagcttttagttgactctcctgtttctccttcaagtcttgctggtggagttctgagactataaatacttcctaccatacccagctttttccatgcctccaaggatcaaactgttaccaggcttgtgcagcgggcactattacctgctgagccattttctagcactgcctcttgagctcttttgggtagaagcaaaggggtttctggtttgtttgtttggttttcttttttttttttggttttgttttgttgagacagtgtttcttctagtggcccaggctgacctcaaagtcagttttcttcccttagccttctgagtggtagggtgtgtgtgtgtgtgtgtgtgtgtgtgtgtgtgtgtgtgtgcacgtgagtgccaccctgctgttatttatgtattttttgagctataaataaacttagattcttgcatgtgctaagcatgcactctaccactgagctaccccatagctacttaccttactttatagaagctagatcgtgactggacacacattcctattgtgataggcgtgggattctgcttgtagaggaatgccctgtgccttttgaagctgaggtccccaagtaacagccttcaggctgacgtgtaagcgagaagaggcccagtggggactggaggctgtacatgtgtcacagtgtcctctggccaactgttgacatagaggaatgcagaggcagtgctgccagatcttagaatttttatcttttttatatataaaatgttggaaatctatttttttaatttaaacccccatttaataatactagagggtaatttttccttttattaaaaactaggtcatacatcagtgaggctacatgggacttctgcttgcttgcaatctgttgtgtctctttcctgtcacccctggccactcttgtagccttgcccacttcccctcccccaaccccatataagctaatcctcaagagctcctctgtgtctcacacctacctctgttctctcatcagatcacctctcggatcttcagggcagggcagagggcgatccccgtgcgtcctgggatttctacagcagttctgtgttgggtaagttcagagtgggaagaagctgggagggctggatgcagctccgtgtggctcagaggtaggagccccgctgtggaggcagcctttcctcacctgctagtagctttacgggccctttcagccctccccctcagtctcaataatcaccagtctgaagcctgagatgccacaaggatttgcacaatgtcatcctctcctgccttgtccctttccccacccgggatgctttgtaatcctagagttacctcaaatcctagtgttagccccttacccggcagctttcattgtcccccactctgtccctgtgacattgccctcattcgttttttttttttttttaattttcttctgggaagggtgtggtggtggtttggtttggttttcttgtttgctgctctgttttttgttttgttttgttttgtttttttgagacagggtatcaatctgtaactctggctggcctgaaactcacaaacacccttctgcctctgcctcccaagaacagggattaaaggtgtgggccaacaaggtgctgggcttagctcttagtttttgagattgctgctgtcctgggcccttaaccctctgtcacaagcactgtgcagcaggaagctcagcacaccagtgtctgccatcatccagcgtttgtctagtgagctgggggccgaggagtaagagcagaaggctgagatgaaatacgtcgggccgcacccggacgatcgatcgggtggagaagggaaccttctgagtctatggaccttgggatcgggcagtgaggtggatggaggaacctgcagccagaggacaggtggactagcccgtagtagctgctagtgtcttccgtctttatctgcaacagctgagcttgcaaccttcagggcactttgcttttcccaaccagagggtggagaaggataatggccttctggccacagcatagttccttccaagactagaactttcctgtgccctctccagaattcgagtccatagtcgatccagccaggggcctgtggccctgtatttatcccctaagtggtcccttcatactcctttatggagccgttcctttccttcagttttgtgcttgtagctgatgccccatgttctcatcctacagagaaaaaagacgggtttgcctgtgacctcctccataatcctcctgggagtgccgagcaaggagatgattcagaacaggatgacttcatgttcgaactctcagacaagcctctcctcccttgttacaacctccaagtgtcagtgtcccgtgggtaagtgtctgggaagtctatggagactgtgtgacagtgtcctggcaacctgtggcctgcttagggaaggaggagctctgcagaaggaggcacaggctgtctggggaatgagtgctggagcagaggaaagacaccctgttcctccagtccaaactcaagcttcacagacctccagagctacacctcagctatcaacttgatgcatttccaggcccccaaatcggaagaattttgtgcactgttgtgtgtggaggcgataatctgggaaatatctgggatgatgaactattagaatctctggaacatttttgtggtttctggggacagttacacagaatacttgcaattgaaattcttggaaaagccaagacatatggtggccatagctttggatccaccagaattcttagcaatgcaaagcacagggcttccacagcctgtggtcagtaaggtgatcagttctccaggctcagatgactctgagaacatgagaacacccttttttggagactagagtatacctcacacccggtagtagactgagcccaactgactcttagctgagggcagttcgtcagccttcaagcccatggcttgtgattgcttttccagtgcatcatatggaagtgttaggcagatggataaaaatgctacgtcagggcgctggagagatggctcagcgacttagagcacatggaaagggcccaggtttgattcccagcacctacatggtagctcaggaccatatataactccacttccaagggatctggtgccctcttttggtctccacagacactaatcacatgtgtggtacatacacatgcctgcaggaaaaccctcatataaaatgaatatatctttttttaatgcaggatcagttaaacataatttttttatgtaggatcactcacctttttgttcttagtctccttgttctggacagaagctgatcccagggggtgaggctgggcctctgggatatagtattgcacagttgattatttcccccaaagtattcagcacctccttctctgaaactggatcctgggccacaggcagtaaaagaaccagagtcgttttctctaggtacagacagaacatgggcaacccgttaagccaggcgcatggacctctgagccatgtatgtgcctgctgcctacagaggccagatgaggccgttggatttactagaactggagctgcacacagtcatgagctgagccactacataagtgctgggaattgaactcaggtcccctggaagagcaagcagtgctcttaaccatggaaccatctctccagcccctttatcctcgttctttgaaagagttggtccacatatatggtattgattgttccgttctcttagctgagagcgctccattccctaattttatgatgtggcagactttgccatggaagaaatgctgaattttagggaaaaggactgagtctaaatagatgagagtatcttgttttgttgatacaggatctatatgtagccctggctagcctagaattcactaggtagacaaggctgacctcaacccacctgcctctgccttccaatttctgtaattaaagacttgagccaccaggcccaggtagataggcgttttagataccatatggaatgactgatcccataaacatgttttataccctggatccaaccttgtgatccatagtacagataactctggccttcaaaacagcccagctgagtgtagtacacagggaagtgcgcaatgaactttaataagaccaaatgctctaagcaggtttattactataaaaagaatgtcaagtgaaaaagaaaaagttcacttcatcctgagctctggtgaagaccagagaaagccagagtttatgttgactttgtagccttttggaaatgggctgcgtgtcatgagagcgtagaagatgtactgaacactcaattacttgggggtttgtaggttgaaaatggcatccgagctgggctaaaagaaggagaggcacagggaaggcatgaacaaaggcattatagcaggcacactcaagtcgttcagaaagcaagagccagatgttatgacacatgcccagcacttggagacagaggcaggtggatctctgtgagtttgaggccagcctgctctacagaatgaatcaccagttagctaaggttatatagtgagatcctctgaaaaagggagggcgagctggagagatggctcagaaattaagagcactggtctccaggatctgtgttcaatttctggcacctgttatggttgcccataattgtctgtaacaccacttacaggagatccaacattcatgcaggcaccaggtatgtacaagaagcatacagacagtggtggcgcacgcctttaatcccagcactcgggaggcagaggcaggcagatttctgagttcgaggccagcctggtctacagagtgagttccaggacacccagggctatacagagaaaccctgtctcgaaaaacaaaaaacaaacaaacaaacaaacaaaaaaagcatacagatacattgggcaaagtatctatacacataaaatttgtaaaaaaaataagtgtttctggtaggacaggaatacagtaccggtgagtagctgtgggagctgcagactgagtagaagaaattgaattggggtcatcttttggaggtctgacttaatactacacgaaaaacttgctgtgtgacctggaacttactctgcagaccagcctggactcagattcagagatctgcctgcctctgcttcccaagggctgggatggaaggcaggtgcctccaggcctggcttctattttctttttaattatgcatagatgtgtgaatttgcatgtgtgtatatagacatgagtgtgggtacccaaggagatctgcagctggggtcccagcaatgaggcagctgacgtgggtactgacaattgaatctgagcactagaagaccagtatatgctcctggttgttgagccccaagtcggtatgcttgctggaactaagagagagccatcataagctattcagtgaggggggagacggaggtcatattaccttttaagaaaagagggcccgagggcctgagaaacctggtatgtctcactttctgttcagtacctttagtcttaaacctatgtacttaagcctatattaaaatagctttattaggttggtcccccattaagaaaacagagacagagcaagtgtaaggctggtgtattgtaacccaaactagaagtggcaaaggctgcagaggagaagtggagtgactaggaggaagaactataaagtggggtgagcgagtgaggggagactgcagcacttcctcctgggttgagttcctgcaagtgcttgcctggtaagcagaggcctctgcagtgcccctcccagctgtccctaggctgccgcccagtctcagatgtgctccacaagggcagactggctgtaatgtgagccctgggcctgcagaaacattggtgctgccgctgctggaggaaaaaaaagttgtctaatacattccagagccaaagagaaatgccttttggattacccacagtttaggcctttctccacagctccacctccaccagggaagatctagaacaagtgagcaggagtcaggtcaggagagggaggccaggcagggttgcctagagtgggggtcaggaagatgtggccccagcagatagtaaatgccaggccatggggtagcaggctaagcctagtttgcccctggcttgccttctatggaagagctagcctgtggggtgagtactcagtgatgctcagctagaagctggggcaggtattgtgctctatcccagcctcagtccagagactcgtggtttcctgagaggcagcagttaagtgtcaataggaagtatggctgtgggggtggactgtgggggtcacttggtctcttggccttctatgctttgggggctccactccccctcctgagcctgcttccctaattctttctttgcctttccagaccctgcaactggttcctcttcagcgatgtcctgaagaggctgaagctctcctcaagaatctttcaggcccgcttcccacaccttgaaatcaccaccctgcccaaggctgagttctaccggcaggtggcctccagtcagctgctgagccctgctgagaggcctgggagcttggaggacagatctcccccagggtcttctgagactgtggagctggtgcagtatgagccagagctgctgcggctcctagggtctgaggtggaataccagtcttggagcagttgacagaaacagcccctctccccgtcttctttctccttcgagttcacccttcccccaccgctcatgtgtcccccaccgagcaccagactgcagaaagaggcaataatacggaccaacaagaagccgccttatcaatgccagcattagtgactggattcctttcttttttgggggggggagggggttacagttagttctcatctccctgttgttgttgtggttggtgatggggtggaaagttgaactccacttctgaagacaagaggtctggagatggtgggaggtggcaccagggtcccttggactggcttctacacttctgaccaagaccaaacatgggcctgggtggctgtggcctgtcctaaggagaagtgagaaaaacccaaatctcttgagtgcccccttttgtctccctgtgctcttctgtcttccatagtatttattttattagtatttaatttgtattgtttcattggtttctgataagtctgtatcactgtgacgatttgagacaacttgttgtattgagggactttctttacctcctctcccttttctttctacgtgagctctggggatgctcgctccctccctccctccctccctccctccctccaagaaaagtattcccagcttgtctttctccatgtggggagggagcagggtgaggaaggatagggggacatcatcatatgattaaacaacctggctgctgctgacctagagctggggggctgggggcaaatccctggcctttggtgctcccccaccccctgccagttttaccccaccctttgtagcagctcttccatcttgagattggtgtttactagggagcagggttcctgagctgctccgataaaggcaggttgagatgggcctgaggcaagggtgctcctcacactgatctctcagtgcagtttgaacttgttccagcatctttggccctgcacccctcccctacttgcctcaccttacctaccctgggctcctcatctggaaatattgagcctttgccttgccaccactcccacagccttacagcatcctctacccctctctcctccacctgccccccaactctcctttggaatctgtaaagggcccggaactgactaggctccacatcaactcggggaatgagtgagtggctcctaggcctttggatgcctggttagatctggtaccagagggacggaggaggagcttgggttgtttccctggccccacccctccatggcattgtctccccccccccttcttatttttctaccgattgctatttttccgaacaatccttgtagagagtatgtaccatccaaaggcaggagggccttgctggggttggctctggatggagatggtacagttttattgtacaggtgctaaactacaacaaagaagaaaatagaaaaaaaaagacaaaaaaaaggaaaaaaaaagccagtttggggatgggacaatctgtcctctgggggctcctgacccatttaggagagttctttcttttaactgtgtgtgtgtgttttgttcccagaggaatttctgagtccccttctgtaggacagccccatcatcctacccaattggttttgaacaactgttttccctttttaacggcaacaaaattatatatatagatatacatatatatatatatatatataaagttgggggggtggatttcaattttgttttgttggaaattatgatactgtgtggtttgttttctggttttttggtttgcttttgttttgtttttcttttttgttttgcatttcggtgtgtattctggctgccctttatgtttcgttttaagcaactggctgtggagtcaaaaacacttgcatact

SEQ ID NO: 792 - DNA, 66692 bp, mus musculus; identical to SEQ ID NO: 791

SEQ ID NO: 793 - DNA, 51277 bp, mus musculus
gaaggtagatctgcggggccgaaagcggagggagggaggcccgaggcagcgcggcggcagcggcggcggcggcggcggcggcggcggcggcggtggcggcgaaggccagcttccgcggagtttgtgcccgggcttcccagctgggctccggtcgcctcccgcgcacaaatggggttaggggactgactggtaagcaactcccggtgttggacgggcttcccaggcgattcccggaaaaccgagggaagacgccgtctgcaatatgccgcaccccaccactccacctcttagcatctggattctgctcttcggggtcggtggacccttccccaccacaatccttccaatcttccagcaccccttccgtctccctcttatccttggccatctaaatctcctagtggtatgctttggaggggtggaaggcgtcgagggctgcactttccctcccttgggggcagcctagtttgtgtcttattcctgccaggtaatgttgcttggcatggtgtggacctggggtttagataatttaagccccggatccaagcttttttgatggcttttaaggaaagggacggatccctggattttcatgaccagaatggggtttgaggactggagttactctcagctcacttccagtaccaacctctttactatgaaccatttctgtgggggctcgaacgtggagggtgggatacgggagcattaatgtgctttgcttctctgtgtttccacagggtcagcgtggtgaaggacagctagtgtcagagggaaagtagacactagtccaactacggccgcccccactaatacttcggtaagggggacacgactaaggggatgctggtgggttggggcccagtataagagtagaggtgggtagtcgcccccaggactctttcctggcggggagagaaaggcgagcccctacttcggggagggttccggggaaggagatggagggtggcgactggggggggtgcgggaagaatggaagagtcacaccctgcttgcaaggggagcctcccttaggctcctgggaaaaggggactgaatacgtgtgctctgtggtaccagggcaggggagatctggggatggttcaaagagtgatttgcacactggttctggcactagtggcctgagaaagtcaggttggggcataaggtggagaatgttggaaggaaggcagacaaccaagcctctggccccagtgcccagatcatttcccttcctcaacctccctcctaaggggcatcggggtggggggcgtggagctcttggagccccgcggattgagtgcctccgcctttcttgggagtctatctttttgcccagcttgctacagctaccactgcctctctctctggaatctgctcggttctctctgcgatcccctcctcctcctcctcctctcccctcccctcccagtgtcaccggggctgcttggctctgcccccttcgccgccgcttgctcccagctttagtccctccttctcatgcttgctccctcccttcgcctcctcctccccatcccccccctcgccaaggccgcattctgggagttgtagtctcttgcagcgctggcaggcgccgcccgcgaacaaggctggactcgacttcccgtcgagccctgcgaccggcacccactccaccaggcttcgctcacacacacagacacacacacacacaccgctctccccctcactctttcgctcgccgcggcgctgccagtgtgtggctctgtctctcctccgctttgctgagccctcccttcttcctctcagttcctagagtccgaccgccgccgccgtgagaggagaaggaggtcggtagcgataaggggcggaggggggcatcggatgccggcagtgttaggcgggtggtggttcaaagagggtgagagggagctcgggtggcggcctgagcctccctgcggagccgacccgggaacaggtgcgtcttttttctctctcccccaacccctccaccccttttgactccctggctttttcgtattcccccacccgcttctttctatcctaagcctttccccaaccctgtccgttcctcttcccttagcttctcagcttgccccccgggggcgccgtcctcttcgtgtccccggacgtagagctctcgggagctctctctgtcctcgcccctcccttcgggacagctcccctccacttccaccttcgtaccccatccctgccctgccctatccccttctcgacctccttctcttttagccaggtgagacttgttcaccaggatccaagagagtcttcccctcggctgggcgggggtctccatggaaacgggggtctgtagatcctggggcggggggggtaaccataggaattaccccactgaacagaaaaggaggtggaggctatggtcttggaagtacctggccccaaaccctgatccatccaaggatccgacgatccgaagggaacctggccaacagggcagggcgaaaaagggcttgttattttttggggggggtggtggtgtccgtgatgaagtcttgaagagaccgggagaaaatgccctccaaccttagaggtggaggtgcgacgggagctctctcggggttgctttctcctcttttcaggggtgcaggaaccgtagggtaaggggtacccctaggtggcggcggggcctgggttcgggagtgggagtgctgtgatgggggcaggggcaattatccgagtccctggaaaaaaggcgggggatgacttcggagcgcccaagctccgctgccctcgctctaggggcgggggctaccgggccaggcgaggcggggagggtgctcaaattgaagaaggatgagatgggggcaattcatactggccccggcaagcctggtgggagacccagctggcttgcaagccctcaacccgcttcgcgccaggcctggaggctaggggtctgggaggaaagcagagggctggaaaggagggaggctccggttacggggccggatttcgggatcaggggcaatcccctggcccttggagagggagggagagggatggccgcgaaccccagggttcccccaccctgcttcataaggggcgtgaggaatggacagcaggcccagcggagctggattcaagcggatcgtggccagggagtgggggggcttagtggtggtcttcgggggggagtagtccggcggcggggcgggcgggcggggcgtggggctccggcgggcggcggggcggggcccgggcggcgctgctgccgctgccgccgccgccgccgctcctgctagggccgccgccgccgttgctgccgccgccgccgccgcttctgggcggggaaccgaggccaaagagagtcccgtgccggggcagagggcgcaggcggcgcgcggtggggaggggggctttctgcgggcgggggcaggctgggggtggagtccccgacggggggcggtacgagctaggacgacgacgaagaggagccccgggggcccggtgcgtggaggacgaggtgctgggagaaggaaggggggggggtgggtcccgcgacgggcctcgtgggcttggctcccggaggttcggcttcgggacggagccttgtgggggcgcccagaagccaggaaagggatagaggggtgaactggacggtggagggggccctcctcgccggggtcccgtggagaggaaggctgggccagagggacgtccgggcaaggctgggaggagccggcggcaccaaggctggggttttcgtgttatggaggtgcaggagattgttgtatcgaaagatgtggttgaggggaaaggcgggagggaagcacgctgcaaacccaggaggcccaacaccacaggccgttgggggtgcccttctgttccgctcaagcttcccctcctctccccattagaagcactgtgtttttgttgtattgttttgaaaatttcaaggttgcctgatcaaactgtcgacgtggtgatactttcttattcttgctggtttctagagtagacagtcaggacaggcttcagttggcgagcattcttccagcccagcgttttgggggctctttgcatgcccgtgggaagggggcttgtgaagcaaggcacagatgaatactctcaaggcgatttggaggtcgttcctatgacactgggtagagggcagctgcagatagctttggtcagacttctggggtacactcgaaggcttcaagtgttagtcccatgcgtctttcaacttagaagactatttctcggaatcacactgcagaaacgtttcatggggaaagaaatggggcatgaatttggagttgggagttgattaggctcataataaaattcaaaggatggctgggagttaccattttaatggtcatctagcgctgttctgtttagtgtgtcttgtccttgaatgttagcagtgaggggcctttcttattggggagactgcaggtggcatagtcaaagctaaatttgggcagagttttaggatactcgaatgtgatgtcacctggtggtactgaagatgacagtctgtaggaaagaaacttacaagattccactggggattaaagagataatcccgcaccaagaatcacccagaggctccaaaaggcagtaaaaggttgagaaggaacctgtaaaattttgacagaaacaaaagtagcaagccaaacagagggagcaacagggacatggtgagtcaagttaaaagaatccaaagttccattatgcacttgaggcttgccgtgggcatcttgagtagttcatgaggacctcggtggcaggtagtttttgcacctgaggagattattttgaggtggatctgggagatgggagcccccagggcttggcacaaaagctcgctaaaatggactttgttaatggattttcatgtacacttgagtgcaggcattagtgaaaagatagacactcggaaaaaatgaaatttattcttgtgggtatgaactaatcaagggaaagtcactcttaaactgacttttgaaagtctgactctttataggcacagacctttaatctcagtactcagtgggcagaggcaggtgagtctctggagttaaaaggccagcctggtctacagaataagttccaggatggccagggctacacagagaaaccctgtctagaaaccttctgaatctcttactagctttgcagaaacagtatgtaggttcctttccattctgacccagaggtgaagagagctagatacctagttgatacaggaaggggaagagatgcagaagtctggcttgaatagactagttctgtaaaacagtaataaggaagggacggctaattgttggaatagggcagggtaaagctaagtgagtcctagccagctttgctgttgtcaaagtagagggacgttgtatgagaaatggggccataccaaggcactcttctggatctagctttttttttttttttttttttttttgatttgccaggactggtagagaagatgtgtggcatcctggagattgcctttctttcttactggctttggggctcttgggaagcagaggaggtttctctgggggtgtgtatctgagccttattcatgatacagttccctaccctggcaaggaaatgcttggtgaaggtggcagaggatctcaagccttgattaatctgtgctgtgagctttagggaggagctttgctgagagaaacagaatcataggagcaaaagaggcttaccactagaaagaaggaaggcaaaagaagtcagggagaggggaccatagggcagggaatgggggaaggaagatgaagatgagcatcattgttcccatgtcaggtctaactaagaagaaagcagtaagttgaaacctccagggtaatgttttccaaagaaagttcgaagaacccttagggctctctacagtttagtactagaattgctaaggctggagtaagaaagaagatcttggataaaaataggctaggaagaaactggcatttagaaagaaatataaatatatttacccataaagaaggagaggtagtatccatattaagaatttaaaatgtacaatgtgggctgggcatgtaaaatgcttgcctagaatgtatgatggcctgagttcaagccttagcattgaaacggaaaaaaataaataaataaaacaaaaccctacaatgtgaaagaaaagcagatcattaaagagccaaaggagagaggcattcagatgctgttcaaagctgggattgaggagtgtaaagattaatttttgatagtcactactgtgggaggacccaggaaacagaatagctgggattaagctgaaacatttcttagcaaatccagatgaatgtcaagattctgaatgggaaaggggagtcttggtcccatcttgagtggagaataggagaaagtgggactacaccagtttttccagtctgtaagctggaggaatcctagatataaggaggtaagcaatagaaattccagagcaaaacaaacaggataaagaacagggacctgagagccttgggccagaattgaacagtagagttaagggcaccaaaaagagactttaatcaggatttgactggactatgtttacactggtttgtgaattctaggtggagctatctgggatggattgggttgaatatatagagctttcccagggtcagctagcctcttaagaagccatgcaagaattctgtgctgagtttggatgggaacatgaacactagaggggaatggagagactagagagtgaaacttgctactaattggacaggaagggggagaaaacacggaggatggctgtgtgaaggaagagggggcacttagatcagtgggagtttttagaaaggaaatttcttaatgttagcattggaagtcagtctgagtctgtgtctgctcgaatctttagtgccaggatagctaaagagggaggaaataagtaatctccctttgtgtcactaggggattcgagggcagtattttatatgatctcttatatgagccaggtattattcatgccagtctgtaaaatgtaggaaatcgtcctctttctaaatcatagcctttcctgctgttcataactttaaaatggtcttttatgttgaaaatgttcttttagcgaactaaagttgtgttctggtcaagagcaaaacgtaactctgtttctgtctccaaaattccagtaagctcttgtagtattttttttaaagcagtagcaactctttcctcataaaacatgtaaaaatttatcatttttagcatagtaagtgtagatttgttaaggaacaatgagaaaaactttggagtatgtgcatgggggtgggggggggcaggcagggaacaatactctgataggttgactattttatttatttatttattttgtcttttttttttttttttaatgagatatggcctatggagaccagactggccttgatctcacagagatttgcctgcttctgtctcagccttccaagtgcttggataagagtgggtgatactatgcttagtttcctccctaccaccccccactcccccccccacctttaaagaaaactgcaggtctagtgttgaggtggtgttttcctctttgttggtagataaattgtgatgagtttgaagatgtggcttgttctttgtaaaatgctgtgattttccgatttccccagtagagttaaataaataaggcaagatgtggcttcatttgtatttaaagattttaacttgggctaaagatttgggaaggcctgaattctatgtagcagcagttttggggttgagacatcgttactatctgctaagaaacaaaatttccttacctcattactaagatctatcttagtgttgattccatttaaagctacagtagaattttgccactgcagggctatgaggacaccaaggaggtctttctttttctgagttctgtgaaatgtataacacacagatatgatcccagggaggagatccactgaagacttggatctatgagaggattgaatatattttctcatgaagagtctttactcagttgaacttgggtcttctgccttgcccaggtggccttgcatcctaattaatctcctttggagacagagctgtgtctggtccttgttgttcaactttctaatagtatggcaggaaacaagtcactaactttcctgagcctcagtgttcttatctagacaagggagatgatactaaatatcataggatggttagaattctatcaaataaaatgtatataggcactgctaaggtacttaacaaatggaatatatttttagaactaaaatttcttgtgtcttatgacgttacttactacatacaaggcagaatgaaactaaaaattcattctgctatccacccctcatattagccctttgtcctttttctctgtaattctttttgattagtagacatccagggtttattgcatggtaggaagtaataccttaacacattgctgcatctgcctcagaggtggaggtggtagttgcttttacggttgtgccatgacaacatctactctttctggacaggaactgaagactgaatatcccattgaaactttaagggatcttttgcaccagagctatcaaattccctgaagctgcctgatgtaggtgctgggaacttaactagggttctctgcaagagcaatatatactcttaaccactgagccatgtctccagcccaaaatactgctttcagtaaaggactcttgtgttatattatggctggttaagtgttctaactatctctggaaatgctccgaaagctgatagaacccggagctgatgtgcttcgatgataaagatgctcaccagtgattgaatgggagagaataatactggagaaagctctgggttccccaaaccaaactttctgggcaaaggaaaaacagtggccttcaaagtagatctcctctctgcagctggagtggactttggtgtcaacaattgggtctctgttagttttgccaatacagggagagactgaggacaggccaattgaaaacggcagattggctgacaaattaacggtttttctgtttgacttagaaaatgcattgttattttctacctgtcctctagccctgagatttacctacctatttttcttctgtttaggcaaatattatggctgttccctgagcacacatctactggtagtccataagtctcctgggtttaaaaggtagctgtgggtgcagcacaccaagatagttggggagtcgattttattattttgcttggcacaattttagttgagttctgtgtttctctttattgtagaaataaagcaggaatagagttgaagtgagagcaaggcagtaaaagaaagacttgcatgcagtgctgttttgtttatttgatgtgtatgcccgcatgtgcacatgtgaacgaacatgtgtatgcacgtgcatgacagcttgcaggagttggctctctcctcccaccatgtgggtcccagggattaaattcaggtcatgaggcttggtggcaagtgcatctcactggccatgttttgttttgcttttgagacaaagtctcattgtattgctcaggctagtcttgaacttgtgcattcaagtgatcttcctgtctcggtctcctgagtagctgggactgcaggtatacaacgttgtgcttaaatatttctacctgggtacctggtctctctatgatatagtaaaagggtggttttccctagtagtttattttagcaagctattgagccatattgtgtgtcttatattatgctacaccctgttgggagggggctagtaaatctataggtgggtaggagagtgagtcatggagtttgcatactgtgtaataagagggataaaaataaaataatagcttctaatgaattatatacataatctatgtagtcatagcagagcctcatcttcagataaaagaacagaaaaagtaacctgataatggtgtctccaaatattcatgtacatttatggtctaggagaggtttacagaagcaaaccttaaatgaggaggaatcccctttacatgaaaaagtccatgtcatacctacagtacactaaatgttttcagagacccactgaagaccaagatggaggaaagccaactcttatttttggattaacagaaattagaagtctcacaaaatgtttctatttacgtagatgtcttgctgaagtagctttgctgattgattttataatgcagacttaagttttgtaggtatctgtgacgtgtagacgttacacaagaacttttaaaggatttatcctctctgtttctctctgtctctgtctctctctgcatgtgtctatatgagtgcaatggtgtgtgtgtgtgtgtacatgtatgcagtgcctacagaggacagaaacatcattggactcccttgagatgcagttcccaggcagttgtaagccacttgacataggtactgagaagcaaactctagtcctctggaagagcagggagaattcgaaactgctaagccatctttccagccccatctgtataaagtcttattagctggagcttgattttagtataaagttattaatacaatgatatgtttttcctaaatagagcaaataagtttcttttactacaggaaaagaaaacgaatagtgtttgaatagtaagagggaaaatcaaggcagagtgtagatgagctaacgcaatctgatggcatgaaaatggaagtaaaccatgaaaacttcgcttttggttcacatcatcctcaaaatatacctctggcccctgcaagtgcctctgtgttatgctcagttcttgactaataagatgaatatattatctggcatagtgagatggtcttgaggtggctgagaaatggagaaggggagtattttttaaggtttctaccatagtttaggctatgggtcctgtaatacatcactgttccaggtgatgggacactggtgctctaatactgttgctatctgattacattcatcttcttcctcttcctcctcctcctcctcctccctcctcttctttcttctcctctttatctttttgagacagggtctcactatgtgttacaggctgtctctgaaccaactgcatagcccaggctggcataaaagtaacctctctaagttctaggtttatacctccacacttatgtcatgaatggattatggctgttcctaaatatcgagtcatctctaaaagcatggggtttagcagctacagtagtgaagagatcgaaagggtgtatataatagttaggattccatgttagtgctctcaggagctctgtggaaaattgtaagccttggccgtctagtcactgaggtgactgcccagcctcccaaggtaactaaattcatcagaatgagtaagctctcatgtgtttaatagatagttaactttcctttgtatccagtctcataaatgtttataggcacatgttttaaacatggtggtacccaaggagtctatgaaggcatccaggctagaatcatatacaggtaatttcttaagtcttcttgttaaatacaagaattgtatcttggaagaaaatgcaatatcccctgagtctgctctcatatgatagacaccagtggacatattcagaataaaagaaagaaaaaccaaacttaagtgacccagaaaacgttagaatagatttagttagatcaaacggacagttttttttaatacgttttattaggtattttcctcatttacatttccaatgctatcccaaaagtcccccataccctcctccccactcccctacccacccactcccactttttggccctggtgttcccctgtactggggcataaaaagtttgcgtgtccaatgggcctctctttccagtgatacaaacggacagtttttttaaaaaggtgttatattcttgaggtgattgtttctggttgatccttgtgtgtgtgtgctattgcatggggctagaagggaagcacgggaaagcagttgggacatttctatgtcactcaagtttcagggatgatagctgattagtagctagaagagatgagggggatagaggtatgagggagggcaggtagcagaatagaagaccatttttccatgggaaatgactaaaacagagcactttcagggggagaaaacattctcattgggttaaagcttggggtatgtaattaaatggggaagcacaagtgttgttaatatcctgttcaatacacacagagggaggcagaacagtgctgctgctttccccaaagtgagctggtagggtaacctttcttttgcctttttaaagttttcttcttataagagtattgcccaaagttctgcatttctatcagaacagtaggacccaaagttagttttctttcattagtcaccaccggcccaaccctccttcttaaactgtctaccggccacagctataatctcaaggacagatttagggccaagcttcaagatgaatattttctgttttttttttttttttaagtcataattgcttccaggtcaaaggtcactaagcagtgtgggccaaaaggagtctgaaagagtactgccagagttgttttacctgagaccctgtcctgatgttgagctcagccacaaggaacagacaggtgtcacacatgggttagagagactgatgtgacctgtgtatctactgccacctttgctcatcactaattgagtctttggttgcaaagggaggaatgaagattttgacagattcgaggttataaactttaaaaacaccatctatggtggattatgtctgtaaccaaagcacatagaaaactaagaaatgaagattgcctcgtgtttaagaccagcctgggctacatagtatgggtaacaggccaaactggaatccatatcaaaatgctgtttccaaaatcaacaagcaagccaggcgaggtgacatatacctgcagtcctaacactcaggagacagaagcaggcagatcagtaattcaaggccagagtcagctctatagtaactttggggccagtctgagtgttgtggaagtccatctcaaaacaaaacaaaaaaactaatcccaagaccccaagttgataaacaaaaacccattatctacttccatgtaaaatatttgtcagattctttctctgatactttgctcttttgcttttttgtttgttttgtttttgaaacaaggtttctctatgtagccttggttgtcctgggacttacactgtagaccaggctggccttgaacttaaagatccctatctatcggtaccctccaaatgctgggattaaaagtgctggacaccatagcttagccatgcttggcttttaattgtcgtggaatcgacttttgtcatcttcctttcaaaacagattctgccctttggtaagatcttggtattttagggctgctcatttcctatttgtgatgcgcctaaccctgactgggggcataacttgttatatagaacctcttcttcctttttttgataacacattctctttaagcttttctaaaatgcttccgtgcttccccacagtatttcagtttggcttgtgatggtgaaatctttcaggttcccctatttcatttttcccgtttggttgccgtgtgtgtggcctcttctttccatgctctagcttctagcacattgtctttgcttttgcagttttttttctctctctctccctccctccctccctcctgctcttttcaccctgttaacattattgccctcccattactccattcctgccttggtgtcccctactctagtatggctgttatggcagatggtgtactttattcagccttcttcctaggcacatttcctaggatcccagtcagtctctgctgctagctacataggcatcctgaatggctaagttgtcttttttcaggcacacttgctgctttgagcgggtggaacttgtgttcttcattgtccttatcatgagttagataagactttttgagtgacttcgaccaaagtgaagatagtttacagtggtccctctcagtgctttgcaggcagtggcagcatttgagtcttgggtcatgcagcttattcctaacaatgacatagttgtgacacctgggaaaaccctttgaggtatttcatatccctgtgcctgtgatttctgggtcacttgggattaccgggtttcttctaagttccttttccgaactttgccttcacttgtgggcaaagaaagagagaaggaggaggaagcgagaatgcgactatccctgtgggtacagtgagtggaagcacgtggatcatgtgcgtttgtaaggtttttctttttctgctcacctccactgtgtacctatggtgagctttatagtgagtgattgctaacttgattagacaggatggaacaaaacgagatcctaggcttactgaatcagaatgtgtggagctgagacctaagatactatttggaagcagctcctcagggaccttggctggttgcattgactgttctggtcccgactactcctttgccagtggaagcctgtttcctagtgcagcatttgatgcttctattggctttttctcttgctacatgaatcttgccttcttatgtaggccacttagttcagtgtcctgcttgtgtgtctgctgttttccaccccttgagcacaaagactactgttaattagcaacagtgaacttcagatggtcaggagtactgctctgataaaatcaggagaaaagttacaaggccaagatttaagaagatgcccaattttcaagatttcatgggggccagagagaaggttcagtggtcaagaagaatgttactgctcttacagaagacagaatttgattcccagcacccaaatcaggtggcctatagtgacttctctaactccagcttcagggattcaacgccttctggtgtctgcactcataagtacatacacacacacacacacacacacacacacacacacgtttagaaatagtgaaagtcaattttaaaagagattttctgaaagcagaggtatccagagtcagttttgctctctaggttgttacacactacatcatgaacgtgtttgactttagcttccgttttgtttgttttgcctctacctttcctttcatgttttgttgggcctaaaagctctttatctaggggatgtttggtctattgctgtttccaaacactgagaatccccctttgacttctgtcctggacctgcaaacagcttatctcttcaacacagaacagaaataattctgagtgaaaaatcatgtggttggagccagtggtggtggtgcacacctttaaccccagcactagggaggtagaggcagtcggatctctgagaaggttttctgtgtagccctggctgtcctggaactccctttgcagaccaggctggcctcgaactcagagagatccacctgcctctgcctcctgagtgctgggattaaagtcatctgctgtctccttatgcagcccagtctggccttgaactctcagtccattttggattacatgtaccactaagcctagggaatagggtctttgttaaaaacgtttctaaaatcaccccagtgttagtaatgttaaaaggtaatcatcaggaaaaaggtaaggcattatgactccaaatactggaaagggaacacatggtacgggtctgatttttcttcctaattaatgagaaagctagacatgttatagctactgtaaagctagatgtgtaaagctagacatgttatagctactgtcaagaaaacgtcaagaatcacaaatttatgtggagtaaaggaattagatgtaaatggaggtgaaactgggttttccacagtgaggcagaggttggggcaggagatcaatccgaactttatggaaccatgacagagtttgtatatccatcagctacttgtaatttacagaggcgtaaagtagggcaaaaatggtgaactcagacagaatccagcaactgtgagcaaagtgcactatatagataatgcatggattttttttaatagtaagcaagtgtggtagacactttttcattttggttcattttgcttctagtgatttctcagaatcatcacctcagttctcatctagaattcagccccatataacatgtatttactgactccttactatgtgtgaagtattaagaagagccaaagaccagggggaaaaagaatgttgttccttaactgcagagctgatcctgtgctggagagacacacgttccaggttcccagctaactcacagcagaggagagccagagggaagaaggaagaaaagagaagaaagaggagaaaaaaggaagaggagagccagaaagggagagttaacggttcctgggctgaggctaggggagtgacacaatgacatttgagctaggctttgagggatggtagctggggaagaagaggcacagggggaggccatctcagagtgaagaaatagcagagtcctgaaactaggggggccaggagctggggtgccgaggatggcaggcaaagggccagatgcagcagaagaggagcacgcagaggtttgaggcaaggaaggctgtctgaagaattctgccttgggtgctgccttgattctgatggcttttgacgagagtagggaggtctgatcgaagcagcgattcagaagatgaattgattgtggaatcaagcgatgggaggctaagagagcagttaagaggccagtataatgttcctggggtgagatgatgaaggcctgtactagggcagtggcaagagggacagaaagagagaaggaattggctttatcaagacttgactcctgatttgatcagtgtgatggggagaggagttgaagaaatttcaaccaaggagacagaagtgccagtaacagaggaagcatgctgtggctgggcatggtggatgggctgcagagtacatttatggggacagataatgagtccactccgagatctcttggatttgagaggtttggtggacatccagttaactgcaagttgctggcatctggaattctgctctgggcctatggagagaggtcggggtttagagatgtccatatgagagtgaccagtccatctaggggtgaactgaatttgtgaaagctgagagagatagagggtaagggttgtttacacagcagggggagacacagaaagagacccagaagcaagaagaggagacgggcagaaagatgatggagggagacagaagtgagggtgggaaagactggaagggaggcaggtaatgagactgagagactaaagaggagccagggaagtgaggaggaggaagagacacaggaaggggaagcctgggaagagaggcaggaagggaaattggaagaggctgtgctcagagagttcctagaaaagggaagggagcacaagccgtctcaaagaaagattagagagagaatgaggagagtgaggaagagagcagggagagatcaggagagacgaataagaaaagacaagacagaggaggtagtaagagaaggaagattaaggtaaaggctcattttcagtgaacaccaaggtttttggggtagataacaggaggagcacatacagagaaaccaggcagcacgaagccaggaaaggctagcgaagggaagtataaagaaaagggtgagcagcagctgactgacatatgcagggacccacagctggacattagactaagctctggaagtcttgtgcaggagttgggggaaggattgtgagggtgggggtgggggaggggagtagggagccccagttctgttgtctgcctgtgaatcctatttccctaactgggctgctttgtctgacttcagtgggagaggatgcacctagtccttcagtgacttgatgtgccagggtgataccccaggggaacctccctcttctcagagacaaaggggaggggcaatgtgaagggggactgggaggaggggcatgcgcttgggatgtaaagtaaataaattaattattttaatggaaaaatacaaataattttaattaaaaaagaaaaactagaaaaggagggtaaggacaagagagcctgttggctgccacagagatggggttaggatgcagtcaaggaagagaatgggttggtccatttctgttgctcttcctttaccaccttccctgaatccagctacgatgacctcttggctctcccttgatctgagcaagcagcctcctcctgctttgagaacttttctttccctccacacatgtagatcactcattccttcacatcctgtaggttgttgaaatgattccatctgagggaggcctatgttgattgcctgattgtgactcatagcccctccactcactcccccgatactgtccccaggctccttagtgtgccttgtatagcttggaatgtactataacacggattactctaaatgtgcttattgtccttgtcactacctctagaatgcaagtgctgtgcaggtacacattttgtcaggttttgttagttcttgaatccctaggacctaggacaaatgtttgttgagtgagtaagtgaattatgttgagtatgaacaatctgtgaacattgaaaggctaaatggagcaaatctctgatgtaactgtactttactatgacatctttggaacacagagaacagcagacaagtctggtcactgtagggttctgttcagttgaaattggctgaatggtgattttagctaataggttaacacaacactggctcactggataaagctatttttcttgatctccctttttctatcaaaaatgaaatggctgcgtgatgattgtcagtagcaagaactaggctttggctcatgaaggggttagtaagccacggtggggattaataggaaaggacaaggacagaaatgtgtggttcctgatggaggcttgtttttgttcatttgcttgtggccggagtacaaagggtattgcacctaatttggcgggagctttctacaccttacatagatgtattgggacgaacttggaagcagagcagagcacttctgaaaggcttataaagaaagtgtgggcctcctctggagagcttaaattggccatgtaactcagatccttccctatccgtgcattcgcgagcaggagcagaagacgacccctagttgtctctcacttcacttgctgcttaggtctggacgcagcactctaactggatgtgcttaggctaaatggatgtagaaaatacactgtcccttaactgtatgcagcagattcaacttcctcaaacattcaagcatatgtgtctctgatgattgacagtgtcctcatctccatcctgagtgtgggttcctagaaagctgctgtgaagttggccttatttggaccttcatttcccatagcagactggcttgtgagagtgatcactttagcacttggaggccatgattgccttcattaagatgtttccgtgtaaaagatggctaaagcagctatacttgttctcagctttaactttttggtattcttttcccccagggggagtggccagagcagatcctatctggtggtgagtggctgtcatgatctctacagcaccgctctacagcggcgtgcacaactggaccagttctgaccggattcgcatgtgtggcatcaacgaggagaggtaaggttgctgtacctagtcccagggaggggttggacctggggacaagattctggtttgtttctgattttcctaaaacacaggggtcacctgctctaccacactgtcccggatccactgaagatgaagaaactatcagatgacatttgccacctagtattatctgtctagtgataaagaactctaacattgtggagtaaagaaaagctcggatgcctgtagtttctgattcttatgtcaaagtttggtgttcagaagttcatgtaagatattttcagttcttgtccagggcttagaagaaagttggtctcatcatgtagctttatggtggggagcaggtcatcaaaattctgggggccagtacttcttacctcaagaagctaccaaaatatgtcaggaagaccttatgacatatcaaaggaagatgaggttgctgaccataactttaatgtaaagttcagttagtgatacctgtctggtctgtgtgtccatgtttcagtttctgatatttggttgttcaagagaggcctttttaaaaattatgcatcataccaaggctagccaattgcctttcagagttgatatttcccttttatcctccttggccaagttgctctgtatggtggttatgaggtttcttcaaacttcaagagattgttctgtcatgcctgttggtgttttaatccattggctatctaaattcaaacatgccagaggattctgataggattctcccctccaatttaagattggcagtctttaaaaagaaaaagaaaatagatcctggtgtagatctgttaagatagttcactgggtaaaaatgcttgcctccaagcctgacaacccgagttaggtccccagaacccactaagtgtaagaggagaagtaagtcccacaagcagtcctctgatgtccacaatcacacatgactgtgccaccttacaccccaaaaaaccagagggaagtgaaagaaatagatccagagtttctcaagtaattctaaaaagtatttgtatgtcgggagaggtaatggtgatagttttagagggaaaaagagactatttttgtttttatattctatgggtgtgtgtgtgtgtgtgtgtgtgtgtgtgtgtgtgtgtgtgtgtgtatctagggatgggatactgggaatcctgagtgctgagtatgttctatacctctgagctacaccttcagcttcatgtttttatagaagtcattttttttcttttcctaactagagaagggtatatttgtctgagattagggttaggagaatagacttctattttcttaatccattcacacctgatagcttaatggtccctgttctgaggagtgtgttagaggtggacttcaaaaaggaatttaattttagaatacaaaaatcaaaagtaaggagaataaggcgaaattcttctgagagacaggagaaaagaagtatgtccctttgtgtgtgaggtctgctcttagaatattcaaagagatgctcctggcaaggcaggctgctgggtgctttgtgagcacgcactgacaggctgcattacagtcacaagtagttggggctgatgtagagctgtatgcctgagccttcaagaacttagtacacaagcaaggtgtgcttactcgcatctataatcccaggactcgggaggtaacggcaggaggacctggggtttgtcaatagcccgggctgcctattaacttttaggctagccttgtctaccaaagtgagaccctgtctctgtaaaacaaggctaacctgagaaattaaaaagcactggacaaattaccttgttccctccctgtctgtgctgtattccttgcaagaagggagtcagaggtagatgtgaaatctgattttctctttttacagacctttcttgggatgctaaattacccaatatgcccagtggttaagatgattttttttaaagcattgtcatttctgatcccatctaccctttgtcaccttcttaccactgtctaggctgtgttacagctgatttccaaatgtaatctcatcctatatgcttttagttcttcttttgagacagggtctctttctgtgtgttgcctgggctggcctggagcttactgttatagcttagggagacgtcagacttgtagcggccctcctgcttcagactgcgtgctagatgtcatgtgtgagctaccgtgcatatcataacatatataatacacatctcacacacacacaagatctatttctgtgtgtgcatgtttcacctccatgcatgtctctacaccatgtgcatgccttgggctcatagagatcaaaaagagggcatcagatcccccagaactggacttgcaggtggttgtgaggatctgggtgggtgttgggaattaagcccaggtccttttgaagagtaggaagtgctcataaatgctgaagcatctctccatcccccagcgccacccccattttaaagacaaggccttgctatgtagcacagaaagaaaatcttcctgccttagcctcccaagtactatgattacaagcatataccaccaagcccagctttatcctatgtaaaaaccatcttcctccatcctttccaacttgtagaccttacaaatttgaggtataaagctgtttttagggataaacttaaaattacattgtaggagtctgccaggtttatcaaatatggttggggcatatagaacagaaggcataaatcagcctttttgactgctctaggtggtctgtcagctttagtcaaaccttcggctaaatagtcttgcttgcctttagcattaattcattccttcattcaataagcatgtattcaatacaagagcaaactggtagttcgtcttcatacattgctgttgaatgtgtggactggtgtgaacaggtcctatggagtctagctggaagaatgatgtatttctttgggaatatcagaggacagtgtcacctgagcccaggctagacatgtgattaggagtttgaggtgagggccgatatccatgcatccttgattattaggggaaggccttggctggagtgaaggggggttctggtgaaaagtctcaggggttggtaggtaggtaaggtgcctcatgcattctgggttggatatttctcttagatattgttccaggcccaacaggaactgaaaaccgtccagtgtggcaggtcctgccgttaatctttaataattaggaaaatggccctgagagatggtggctggttttggttaagttcaacaaagccttgagcacaccagctgtcttctagtgagaagaaacagtggaactgatttctaatcctgcttggagcctcttttggcctatgtttcccccctcacctgtatccccataaccttgctcagttgacccagctccctcccctgcctttctgatcccaggctcctctctcagtggaacatttttttttttttttaatatttgcttagctttgcatccccttcagaggatttgaaacaccatcgcacacattttcctccctgagcttggggggctggtgctgcagcttaggcatggctggagtagccagaagtgctgcctttgctgccaccaccagcctctctgcctggctctaggcttcactgctaacctctggcttgtgagaatatagcttctgctttcttcttctgggcagaatttctgcccaaggaggagcccaccaagcaggagggagcgtggtcaggaggagaaagaatgtaaacaaatagggccttcccatgtggagttgtggaggggagaggtgcgccctccccctaaaccatccctggagagtctagttggaacatgcttctccagcccaaggctggctccatataggtcctgcttttctgctctctcaggagttgatgtgaaaagtgtgttttcccttctctgtagccctccatctctcctcttcctcaagacccctaactgcggtccaaagcccttgcctcacagtcctgtgttaccagcagtcatttccagtggtggaactgtcccacttctgccaccctagctgtttgttaaaggggacaagcctttcccccttgattagccccttctggagccggctccgatcctcattgccattcttgcttctcttgccccaggtacagttagaaagtctgtgtttcagtcggagggagggagttatttgcaggggtgctcctccttgctggagttgactgcaggcacccccaaataccctttagactagagtgtggtcgctaaggcagacgctgctgacttttcttcacgggctgtattggatctctggcagggctccaaagatggcaggcaaacccaaacaaagagcaggcagagcagccctgtgctttgcccacccagaaaacttgctgcagctttgttctttgaccccctacctcctctgcagccactcccacccaggcggctgccctattgatatggctcctgagcacaggggccgggttcctgctgcacttaaagcggccagcggccggtatggagccaccacttgtccttcgactttactttagcgtgtgatccttttatttgttcgttttgtcaaatggcacatgttttaggattcttacctgaagtttagagaattcttcttgagcagtttgggggagggggttacggttgaatttttctcctttgagatccagctttctggcctttagactttctttatggcacataccaatagaaatacagagttctgtggctttgaggcgctccctttgggaggagagaggatgtggtgatgcagagaggctgaaaggaaggtgcgcccatgtactgtgagaagagagcatgttgtgtggagccaggttgacttctagaaatgctcctttggagaaaaaaagaagtgtttgctttgttttgctggtttttcaagtaacacacggggtcttactcttactgtataggcttgctgagtctaagctggccttgacctcaaagagatccacctgcttctgcctcctgggtgccaggatttaaagacacacatcaccagtccactgcattttccttgttgtttgagacaggatcttctgtggcccaaatgactgaattccttaccttcctgtctctacttcctaagtactcacattacagacaggacacatgctcagctaaatgtcgtagttttaaagagcctctcggtgtcagtgaccagatggcctcacatcagtgctgtaaatgtgagtgtggttgggcttcaggcccgccttgcccgatagaggagcaaacgcttcagattttgactagattggaaagcactgtggaagtggagatttgcttacaaagaggtttaccctgaatggcacttcccatatagacttgaaacaagattggatttaaaataaaactaatttgtgtacccttgaggattctgggttacatctctctccttttgggcaatgccttgtatatcctggagtgaatggtcaacttgatggttaagctccaggcgaaaggagaaggtgctaaggtggggttcatctgcactttgggtgagaacactagaaagcacaataagtggcccccaaattctggtcagacaaggctcctcctcttcagcaacttgcaaagttgcgtgtggcggctccgctttgcctggttcagctcctagtcttctgccatcccctgaggtcaccatggaagtgagacaggagggtttggaaagctaggcaggcaagaccttctagaagtgtcagtgctctaagtccgggccttatctcccttttctgctgtgtcttccctgccagaagagcacctctttctgatgaggagtccacgacaggtggctgccagcactttggatctcaggagttttgtgtcagcagcagtttttccaaggtaaggagctatgtgctgtcacatgctacccatcaaagggtgagcttcttggaccatgtgcctagtttggccttcctgagactgggagcaagaagacacaagttgctgtaggtgagacagaaacggctctgcgcatgccctgtacattgcagttggttgagttgtcgagaggaccagcaggtacttcccaggggcctcagggtacctgcatcagttcccaggactttgctaagatggccatgctattctttcgtcgcaggtggagctcacggcagttggaagtggcagcaatgcccgggggacaaacccagatggcaataccacagaaaaacttgggcacaggtcagaagatcagtctgatgaccctcagccaaaaatggactatgttgggaatccagcagaggctgagggcctcctggtgccactgagcagcccgggagacgggctcaagctgcccactcctgacagcactgaggccagccacagcagagccaactgctcctggactcccttaagcacccaaatgagcaaacaggttgactgctcgccagccggggtaaaggctttggactctcggcacggtgttggggagaagaacactttcattttggcaactctgggaactggagtccctgtggagggtaccctgcctctagttaccactaacttcagtcagctgccggcacctatctgccctcctgcccctggatcggcctctgggaccccctcggttcccgatccattccaagttcccctttctgtcccagctccagtgccccactcaggactagttccagtccaagttgccacatcggcttcagctccttcccctcccctagccccagcagcgccctcggtgcctactctcatctctgattcaaaccctctctctgtgtcagcctctgtcttggtgccagtaccagtgtctgctccccactcggtccctgtgcccttgtcggctcctgctccgacccctctcacagtctctgtgtccgcacctcccttggctctgatccaggctcccgtgcctccctcggctcccaccttggtccttgcttctgtcccaactccagttctagctcccatgccagcatccacacctccagcagctcctgcccccccatctgtaccaatgcccactccgaccccttcctctggcccaccctctacccccacccttattcctgcctttgctcctacaccggtgcctgcgcccaccccagccccaatctttactccagcccccacgcccatgccggctgccacaccagctgctatccccacctcggcgcccattccagcctccttcagtttgagtcgagtgtgttttcctgcagctcaggcaccagctatgcaaaaagtccccctgtcttttcaaccagggacagtgctgacccctaaccagcctctggtatacatcccacctccgagttgtggccagcccctcagtgtggctacactgccaaccactctgggtgtgtcttccacactcacactcccggtcctgccatcttacctgcaggacaggtgtctcccaggtgtgttggcctctccagacctccgctcttatccatgtgcattttctgtggcccgacctttggcttcagattcaaagttggtctctttagaggtgaacaggctctcctgtacttccccatccagcagcactaacagccagcctgctcccgatggggtccctggacctttggcagatacctccctcaccactgcttctgccaaggtgcttccaacttcacagcttttgctgccagcccccagtgggagctcagtcccaccacacccttccaagatgccaggtggcaccgatcaacaaacagaagggacttctgtcaccttctctcctctcaagtcacctccacagctggagagagagatggcctctccacccgagtgcagtgagatgcctcttgacctctctgccaagtccaaccgccagaagcttccattgccgaaccagcgtaaaacacctcccatgcctgtgttgacccctgtgcacaccagcagcaaggccctcctttccacagtcctgtctaggtctcaacgcacaacccaggctgccggcagcaacgttacttcctgcctaggctccacctcttcaccttttgttatctttcctgagatggtgaggaatggagacccaagcacttgggtaaaaaactcaactgctctgatcagcaccattcctggcacatatgtgggagtggccaacccagtgcctgcatccctgctgttgaacaaggaccctaacctgggccttaaccgagatcctcgtcatctccccaagcaggagcccatctccatcattgatcaaggagagcctaagagcactagtgccacttgtggcaagaaaggcagccaggcgggtgctgaaggacagccaagcacagtgaaatcccgttataccccagcccgcattgcccctgggctgccagggtgccaaaccaaggaactgtctttatggaagcctacaggcctgacaaatatgtacccacggtgttccatcaatggaaagcccactagcacccaggttctacctgttggctggtcaccataccaccaagcatctctgctttctattggcatttctagtgccgggcaactaacccccagtcagggggtgcctatcaggcccaccagcattgtttctgagttttctggtgtgtcacctcttggttccagtgaaactgttcatggacttcctgaggggcagccacggcctgggggcccttttgctccagagcaggatgctgtcacaaagaacaaaaattgccgaattgcagccaagccttatgaagaacaagttaatcctgtcctcttgactctcagccctcagtcagggaccctggcactgtctgttcagcctagcagtggggacatgggagtaaatcagggatccgaggaatctgagagccacctctgctctgacagtacccctaagatggaaggcccccaggcagcctgtggcctgaagctggcaggagacacaaagcctaaaaaccaagtgctggctacctatatgtcccacgagctggtcctggccaacccacagaacttgtgcaagatgcctgagctgcctttgctacctcatgacagccactctaaggaactcattttagacgtggtccccagcagcgagaggggccccagcacagacctttctcagcttggaagtcaggtggatctggggcgggtgaaaatggagaaagccgatggcgatgtggtcttcaatttagccaactgcttccgagctgatggtctcccagcagttcctcagagaggccaggctgaagctcgggctaacgctgggcaagctcgagtgaaacgggaaagcattggggtctttacttgcaagaacagttggcagccagacgaggagacagaatctctgccacccaagaaggtcaagtgtaacaaagaaaaggaaattgaggaagaaccacggcagcagccaccaccacagccacacgataagcccatggtccggagttccttggggtccaaggtgagtgccagtatatggcctagaattcctgatggtcagcttcacttaggggtctctgctgcatcccagcccaccccctccctacagtgctcttgagcagctcagccgtgtgaagggagctgatgaacgaacgggaggcttccccctttaactcctgctctctctctgtgatattctcacctggaaagggcctagctcattccataggatataggaaatgatttcatctttggggctagagaagccattgtcctagataaagttggaaagcctgagaaggtattggtgaaggaaatcacttcatcacaggctcttccccaaggaacaattcttcctggttctttaaagatgatgaaccactgtctttggcagtttggggcccagggaggaaaggaaacgttgatagggtcattttggccccacttcttcatagctctgtgacattgattaatttctcttaccctcaattccttcatctctgcaatgagacaaataatacttatttagagaattgttggaaagattaaatgagctgttgatatgaaatatctagaacaggcaaattgataggaataagaaatagcctgatagttgccgagggctggggagggctggagggtttccatgcagggcagtgaaaaagtttctgtaccaggcaaatggtgatagttacacaattctgtgtttgtacagaaacaattgcattgtacatgtacgttagtgaattgttacagcagagctcagtaaagctattccaattaatgagatggcatataagtgcttaaaatagcactgggcacgtaattaagtgctcggttggtattagcggctgcttttgtttttagtatcacaaacagaatggccctgccctcatgcagcttaggtcttgccgtgttgacttaatgacaactgggcatagcccttccggtatgtgatggatagtttaataggctgattgaaagatgtggggggaccgagaataaagttccaggagaaggagaaggcaccagcatctccaggttttccctttggaaaccagacaatctaagtgtttcatcaggtcccattttcttgaggaacatgtgaactgataaccaagctaagatgaggcgttaattccaaacagcccattgctggggatggccaagaggcagaataagctccggttgcttgcttgaattatttttctttcaaatattttttaatacgtttgtatttcttttctgtgctcatgtgtatgtgtgtggtacatgcatgatgccacacctgaatgcagatcctgggacagttttcagctgctctctctctacctcagattgtcccatgtagcagcaagcacctttacctgctaatccatcttgcctgccaaagaatgaggtttcatttgatgctgcctgtactgtattcttgtcccttgaaacatatttcaaacatctcttaacccaaacactgatcttgctttctccatcctcccaacttctcatgcagttggagtgtgtcatagttttactttcatggctgccctggcaggagatacaaacggaaatctcttctagatgttctgttttacttattatttatttctttattttggtctaccttaggaagtaaaagttcatggtctatacttgaaagaggcagctaagaacatatttagaaataagtcagagatgttcaaattgacgcatttacctttatttcccctgccttaaaatagtttttctttggctatacctgaagttcagattttaaagtcatctctgtcttcctcttttctccctatagttctttgttttctaacaccttggttcatagaaattgccagtgacttacttttcattgcgcttagtcctctgctgagtgagcagagggtgggaagctggtgggaaatgggtgctccctgtgcctagagaactgagggttctttcccctcaaatatcccatcagtaagatggctgccaacctgcttcactgaaactagaggttgataaccctactggaaggttatatggatgtgattatgggtaggggggacatgtgtcagtctttcatcacagtgacttaagtatctgaagaaaaatgagagaggaaaggtttgttttggcttatggattcaaagatgtcagtccctcatagtgggaagagtgtagtggagcacaacagtagctcatagaaaccaaaaggggaggggggagggagggagggggagagagagagagagaatgagaatgaatgaatatgaatgagtgcatgtcacatgtctgcagtactggcctctcctttttctattttgtgtttgggtgtgctcatgtgcatgggtgtttgtgtataccggtacctgtgcagaccagaggtcagtcttgggtatgattcctcattagctgtccactttgtgttgtgacacagagtctttctctggaaccaagagctcattagttatactagagggatccacatagctctgcccccccagtgctgctagcaaaagcaggcaccaccacacttggctgttttctggtgatgactctcagatcttcatgtcttgtagcaagtatttgacctactcaactacccccccccccccatcaattttctgatttccacctgggccctcagcctactgtaggatgttccatacatagctttagggcaggtcttcgttcatccttagttaattcttcctagaacacaaaacaaaacacagatatacccagaggcatgctatattaattaggagcttgtcaatccagccaaattaataaattaagataaacttcaagtaggttgttgttgttgttgttgttagacaggttcctctggctgttctggaacttgctctgtagaccaggctagccttgaactcacagagatcttcctgcctctgcgtccgcctcctgagtgttaggattaaaggcatgagccactatgcctagctgactgcaaatatgtttaactctttctgtcttcttaaaacctaacttcacgtgccccagatcaacaggactaggaacacctaccttaccatttcttgtttagtggcatggagaaacctcacagcttgtgaaaatctgtggctttgaggcagagttcctacaatgtgtatgtaagctgataatccagtagtaggtggggatgggactggacagaaacagaggacagagacaacaaatagggaaggagatcactgaaagctcatgagaagagatccagagatgggagcaggagcaccagggcttccttccagctctatctatcttactgcagatgtaagggtgacctggtcaacggcatcccttcagttagtgtgtatgctagcttgtgtgtggcccaggaacagtcagttgacctcttctctgagtgtctgtctcttcatctgttcggtgaggtggttcttaggacgaagcaaatgatggagagtaaagcatcctttaaatacacccaacttcgctgtgaatggcgtcccagagctgcccctgttcaccgtgttaatagggaggtgggaatcgtacctcctacgtaatggtttgagtccatttcctgctattaactgacacatgagaaaaggtttccttgacttgcctgttctcagaattattatcaattgatagcaatgccatccacaaggaagatgtttgagccatgtagttacctaacttacagaaaaggcatttttgtttaatgcctatttctacttgggtttgggtgtgcagagtatggatcccaagtctggaccttttaagaaaaaacctttggatgtgtgttgaggggtcatgaatacagattctgtagatctctgatacaaatcactgaaggaactagcaaggacactcgactgagtccaacagaacctttataacccagtgtgtcctgtgacatacatacacactcccagtcctaactccggcatatgacatgatccttcctaagactggagaacattgttaagcagcaaggctgacctcacacctgacttgtcctaccttaacacagtgccggaagctgcctggagacccccaggaacccaccaagaaaagccccagaggggctttagattcaggaaaagagcacaatggagtcaggggaaagcacaagcaccggaagccaacaaagcccgagtcccagcctccaggaaaacgaacagatggtcatgaggaaggtaggtctccaaggccatgcatgaccttcaagcctgaactccagagggatccaatggaattttggtggggagagagttgctgagagattgagtggaaaatggatccttctttgctgtggaatagaaagagaattggaactcagaagttaacagctcaggaggataggtctgttctggtcatgagtttgtgagtaccccaccttctacagtcttaacattgaacaaagtgatttgcaaatggacacagaacactcaccaaccggttccatgaggtggcatctaggctcaaagaagaagcagctgtaagaatatttattcaaaaaccgtagaattgggattcattaccctgttttttctaccttttggtatgttagaaaactcccattctaagacctgaaacaaatagctggctgactagctagatagatagaaaggttaaacgatgtctcaaacttttttttttatcagctaagaatacccagaacgtttgatttaggtatagggtatacttgatctatatactctactgtagatggcccctcagtgccttcattggagataatccaggcattcctggccacagtagtccatgttcatgatcttgctcattggacatgacataccacttctattttactcttatatacctgtttctatgtgtccaccactcccagccttaccttgttttgtttgttttttattttttttgttttttgattcttgtttttttgttttttgtttttgttttttgtttgttttttaaagatttattttatttattatatgtgagtacactgtagctgttttcggacacaccagagagggcatcggatgtcattacagatggttgtgagccaccatgtgctgggatttgaactcaggacctctgcaagaccagtcagtgctcttagctgctgagccatctctccagcccttgtttgtgtgtgtgtgtgttgttgttgttgttgtttgttttgttttatttatttatttatttattttggtttggtttggtttggtttggtttggtttttcaagacagggtttctctgtgcagccttggctgtcctggaactcactttgtagaccaggttggcctcgaactcagaaatctgcctgcctctgcatcccgagtgctgggattaaaggtgtgcaccaccactgcctggctcagccttaccttgttaaggtccatcgaggccgtgcttctttgggacagctacagctcagttagaacttgaggaacacacaccaacctttgtgttgtgtaggcagagattatactttggagcaatctgttaaattgcttctgtgtgttgctttcattggtgtcagcaaaaatgacccagccccagttttgaaaaatcaccattcccagaaagagctgggtagtgatagcagcttaaggagagtcagttgtgttaagttagggtaactgcaggctcaatacaagcctttcggttttctcatttcagcatcccatgtgggctttctggtttatagatttcttttttttttttttttttttttttaaaaatgttcaacattcttttttttttttttttaaagatctattttattattaatatatgtaagtacactgtagctgtcttcagacactccagaagagggagtcagatcttgttgcggatggttgtgagccaccatgtggttgctgggatttgaactctggaccttcggaagagcagtcgggtgctcttacccactgagccatctcaccagcccggtttatagatttctaattgtgatatttctgccttctgcccctaaaccacacatcactccaggttccttggaaaagaaagcaaagaacagtttccgtgacttcatccctgtggttctgagcactcggacacgcagtcagtctggtgagtaagactaagggtacctttgaaaaggtagacatgaagtttgaatggttttaccattggcgtaagtagacattttgtttccctgtgacaaaatgacaggcattttgcaggaataacagagtcctgggttgggcagaaggcttgcctgaaattttagaacagtttgcttaacaatgttagattagagatttaacatcatctttggttaagagtcagtgatgcgaagaagaacggcccctgccactcaggaaatttgtgctctaacattttgcatctcatgatcattgaggcccatttgaagtcctcagactttcaacctttgggctttaatctcgtcaccctatgcataaagcattatcaaaattggaaggttcattgaatcctatgggctggcacaattacttttgctccacagaacttgtattggtttcggtctaaagaagatagttgtttccagtttgtgttcttctctgctggctctctgttgggtcacaggacagagatggttgcctgcattcacccagattgccgtgcaaattggaaggaatagagacgactaatccaacgagctgacgtcctgttaactggtccctcagcacatggcaagctctatagtaactggggcttagaatgatggcctggcggcctcacaaagtcctgaagtgtcctctgaatcatcaaagagtgattacattcttgccagtcccatttttgtgttaaacacattgtactgtatttgattctttggaaattggtgatttctgtgcgattctgtattaaccagaatattaggttaactagaacactctgttccctgcctggtccatataatgcaaagtttagtgggatagttgttgtctttaagcacttgagcaacttgaagctttggtctagggtggggtttttgttgtttgtttgtttggtttggttttttcccctccaaccacctttttcttctgctgaccttactagggtgtagatactgctgagttaacagctaggctttcgggagaaacatagtactgctccttctaaggaaggtgtgagatctgtggtgtaaaaccaggccaatttagggttgtgcttttactgttagccaagttaagggtaagtagggagagagcgaatagcctcttggcaaggtgacccaagaggataggaaagatgctgtttgtcctggggtgatcggccttgtacttgtccagcagcaaggaacagctgcagtggatgggcagacagactagagagaaaagtccatccttgaacttctgcaactatgtaagaggtaggattagtttaatggaagagggcctactgtactccactgggacatgcctgaatcagattgtggcataggaaagggactccctgcctttcctctctgtcagagacactcttcttttatgtcaattctgcttggccaaggtagctctcttggccatattggtggaaccacaaggttattaggacctaagttgtcaccccagacttccttactcatttgctcccatttgccaaccagcagaggactacagctctctcctgcccttcatgcagtgcttggctcctcatcatcactgagagtttgtgagtgggattcaagttaacactgcactggggaggagtgaggatggttcctagtacttcatggtattttggactctataaagtacgtacttaagagtggaagacttcacttgagcccccagaacagtccttcgagataagtgtacccctaataactgacagagcctgaccttgaactcagttctacaaatttctactccagggaagctgtgtcaataccatacgtaatgccttgaagaagtacctgaatgtcttctgtacatatcccatccgtaggtagcatctgtagctcttttgctggtatggcagacagtgacatgggaagccaggaggttttccctacagaggaagaggaggaggtcgctcccaccccagcaaagaggagaaaagtcagaaagacccaaagggatacccagtaccgcagccatcatgcccaggacaaaaccctgctgagccaaggccgcaggcatctgtggcgagcccgagagatgccctggaggacagaggctgcccggcaaatgtgggacaccaatgaagaggaggaagatgatgaggaagagggcctcgtgaagagaaagaaacggagacggcagaagagccgaaaataccagaccggggagtacctgattgaacaagaagagcagaggcggaaagggagagcaggtaaggctggctctaggctgctgttcctgttgtgacgtcagctggagccttaggactgacaggaacctggtactatagtcttcacatgtgggatacacagatccatcttgagtatgtgcctttgaatctagaatgaatgaacacaaactagtctacaaactagccttttaaaaatgtatatctgaacctgtggtccaagccactgtgatattgttggcttgggccactgtcttatcagcgagttatgattggcttgacagagtcaagtttttggagactataggttctttttttctgtgatattcagtttaaaagtaagacaagccaggtgtggtatatacgtctgccatccaagcagtcaggaagttgaggtaagaggacagtgagtttgaggacagcctgggttacatagtgaaaccctgtctcaaaacaaagagggaggggagggcattggctgccacacctggcatgcttctgctcacaaactaaaatgaaatgtagtaattctaaaggcaatagaaaacctgaaatatgtaaaactctctgctttctcaggtaaagccacaaggggtttttttagagttaaagttttgaggtgacataggtggccctgagctgtgaaagcaggcagttcaaaaagaaaactttctatggccatggctcatgcttaaataccatcatggaaggatagacagtcataaaaagcttgttcataccagggtacttcattaagtgccgctcaggactgttcccatagtggctttctaattgagcaaaaaaaaaaaaaaaaaaaaaaaaagctcatctctggattccatagcaacacatttgtctcttcttattctctggcctcttcccttgaaataacaatcgattgtctcttacagtgtattcacttttagctggtgataaatatgtatagtccccttattatctaaaacaaaccaagctcacattctgtaggccatagttcctgggcatgctataatgccgagaaggcttaacctcgtttctgactctgttgaagtggaggtgtatatgatacctgtccccacgctcaagagtaattgagctcattttcatcaactgtctgaacaagtggggcaattttgcccttcttttgccggaactgtaatggattggtcatgaatgaattgtcaaaccattggcctcagccgcttgttaggacgcccagcagtgtgtgtattactcagtcctctctaatgaaggctgcttgcctagcttgggagcctctcctggagctatcagctctttctttcttcttcttcttcttttaaaatctattttcctttccttttctttctttccttctttcctttctttctctttttctttttaaaatatcttttttatccctttgagacagggtctctttactataaagctctggctgtcctgaaaataactctgtagaccaggctggcctcaaactgacagtgatccacctgcctctgcctctcaagtactaggattaaaggcacatgatactagctctttcagtcagaaggacctctttggagttgcctggacctatttgctagctagtccataacactgagatagacgttgccacagcatgcatgataggggcttagctagccgttgctagaccatctgcagtaacatactgaataccagtgatcaaggtatcttgcttgtttaagggcagcccaaactattgagaagtaggtcattctccctctctgagtatttttgggagctatgcattgaagccactggtgttagcaaatcttttcatgcagaaatttcttaaaaaaaaatatatatatatttaaacagggtttctctgtatagccctggctgtcctggaactcactttgtagaccaggctggcctcgaactcagaaatctgcctgcctctgctttgcctcccaagtgctgggattaaaggcgtgcgccaccatcgcccggctaaaatatatttttattgatttttttatgtttatgggtgcttttcctgtatgtatgtctgtgcagcacatgcaggcacttactgaggaggctagaatagggcaccagaacctccagactgcaatacagatcattgtgattctgtgtgagtgctgggaatcaaacccgtgtcctcatgaagagcatctagtgttcctaaccacggaggcatctctctaaccccgggccggggggtgagttttgacaagcacgcccctcctcagaaagctcaagtctccttacctacactatttggctttcaggccagggtcagagaagtaggaaacggacaagccaggtagatcaccctcctctctaactctcatggcctctcctttcatcttgtgcttggctcgcttccttttcattctatgaaagaggtagaaacagctctttccatgtgcctacctgtcccctgcacactctgtgcttttgtaggctagcataaagctctggttcttctgcaactgagtacactccagagtttgccctgcccttggttacatggagtagatgcctgtttatttccttctttattgaactccgagatgtggttttccgtgctctccacggttttcacaaggcacagttctgtttcttcctcttgctttaaccctcttgttgggtcagaagctctggattaaggctgagtatggtgggtgtatgcctttaattatagcactcaagaagtagaagtaggcgaatctttatgagttctagactaacctggtctacatagtgagtttcaggtcatccaggaccatatactgagaccatgtctataaaacaagccaggaggtggtggcgcacgcctttaatcctaggacatgggaggcagaggcaggccgacctctgagttccatgtcagcctgctctgcagagtgagttccaagactgacagggctacacagagaaaccctgtctctaaaaataaaataaaagaagcagtgcagaatccctagcactcagggtgcagaggcaggtgcttctccaggcagccagggttttacagagaaactctgtctcagaacaaaagggagcagggatacctgctgggcaagtgagaattgggtttgttcaatgagtgtcgctgggtatatcaaccacacactagtccaggttgaatgcacacagtagttggctaacacaaaacatactccatgtttttttttaatgggctttttgttttgttttcatatttttttgccatgctgattcatttttgtttttcatgtttgtgttttaggtttttggagagagggaaaacattttaaaaagactaaaaatggggtaaaaagacctgagtttgaatgttcttgctggaagtgtcagagaccatgtagcacagcatttcttggccatattgtgaggacccactaatacactaggtggaagaaggatagtatgatagctagggcttctttcctaaatccataagctacagccagttgtgcaatttccttttattgttgttattgttttgagacaagttctgtctgcatagtccttgcagtcctggaacccacgacatagaccaggccgtcttccaactcacagagattcaaggcttgcgctacctcccaccccagccaattcactggtcttgaatagagactcctacatctgcatctgcctttggcagttttacagatgagagtccatttcaagtttggggtggcagtgagttgagaactctgggattccagtctcttcatttcacacatggtagaaactgaagttgcagctacttcattcatagccttactgatctgttgtgtgctaggcttggtgttcaggtttgtgacggagataccccttccccctagagcttgcactgaagtcatataataaatagtgcagcaacaaataagagagaccctccctcaatacaaggtggagggaggggcctgacacctgatgttgacctctgtaactgctcattacagcacctacaaatacagacatagccacacacacaagccatgcatctccattgccaatcgatacaagtgaatggtttatgtcacctacacaagaggtttaaggcagaccctatggggtgaggctcttgctagtggagtttgcagtagacctttttgaaattacaattttagacacatgttgttgccctgtgataccaattacctgatttccaatcagggaaggcagtatctttctgccattacacacaagtaggcctatactgcgctggggagtgtctgttgcatttaccttggtatcttcagacaggaactgacaggcagttagaggtgaggagaactgagctcgtaaagttagccctccactttgtacttgaaccccactgtacttgattgatacttcagcaaaactgccaagttgcttttgattttggagagggagggggtagagaaaggctgaaaagagattctggtttgctctgagctatggggagatcctttcaaaatgacccgcattttgggggccagttagatgggctgccccctgctggcaggtctgggaagcgcctcccacggatagatggggaatttgcatggtaaagcactaaaggatggtgttccatttctgtgacagtcgttctttcctgtttcttgttcagattcaaaggcccgtaagcagaagacttcctcccaaagttcagagcactgcctcaggaacaggaaccttctcttgtccagcaaagcccaggggatctcggactcaccaaacggtttccttccagataacctggaggagccagcctgccttgaaaacccagaaaagccgtcaggaaagcgaaagtgcaagaccaagcacatggcaaacgcctcagaagaggcaagggtatgtagccaccaaagggaccaatatgacgaccgtgggctagagaggccgactttctagcacgtctgtctagctgtaattctctcccagagggcaaaggaaacaagtagatgggggagggggccactgagctgtatgaaagtattctaaaagtattctagaaacgcgggacacattcaaacagtggaaactgaagttatagttaattatggggtttgacccctgatttcttttccctaacaatccttgtacctcatttttaaatatggcagggtattagcctgaacagattgttaacatccagtcaagaagctcctgtctgactttctgagacaactaaggtagagtgtaacttgttgaagccaggattttgttacctagaccaaggtttaagggtccaggttagctgctgtctccatcctgtcccctgttcctttgcctctggaggaagcctagcagcgaatgaattgggtacttagcagttagccaggcaagcattctttgaacccttttcaaaattaccagttcatttgcttctgcggttcataacacttgcagcgctgtcagattctacaatgtaccgctaaagaagaatggcatagtcctttgaaggaagtgagttgcaggtccagcgtgtacctgtgataggtatctgccattgacaacagaaaatcaaatgaccacgttgggctggtttggttagttacagctcttattcttctgtctggctttcaagtaggaattcccaaatgataccagtgagggatagatgcttgtctttgcccacctcttcctcccccgtgaatccttgttgcagcttagacaagacactcaagtctatttgctcatctttaaatggagctgatgctccctgccccttctgtctcacaggagtacttggggggaacaaaagcaatgtctgtgacaggctttgataacggaaagtgttctctgagggtcagtatgcatccttgcacttcaggcagagacaggaatgagagaactagagggaaagccagaccaactgtgatctggcatgccagggaatccattatcccaaacccatagactacaggactgataggagccactgggagagtacagacacgtgcttggctctggccgcctctttcttcttgtcactttttatttatttaatgtatgtgcttatattgtgtgtagaggtgagaggacaagctcgggtgtaggtcccttgtttgagacagtctctctgtttttctgctgcatgcactgggtaagcaggaatggatttttttctgtctccacctcccatcttcccatagagtactgggtttataggcacttgtatcacaagtccagcttttatatgggttctggggattcgaactcatatcctcatgcttgtatggcaaagttgcttttactccagctctcctgttggtgctcttaattcccaagtacttcttagaggtaggcacttatattccagtcattttacagtaaagacttatgagaggtgactcagtggtcctccttgccagaatcaggacatgaaacaaatttgtctgcctgaggaagaggcctaggttgtcaatgtgtcttgcagtctctgagtaactgctttctgcccgtttctgggcctccctaggaagtaggttagtaggcagaaaacactaccatctttaaacagttctgagacaggtagaggtccccgggtcctgccctccttcccatcttccctggccccatcccacacaaagggctcagcagcacactcatgcttctgtgtgcttgctctggctggcaccgggtctgctaaaatgttctcctggagagggttttgtctctccctgcagcctcccttccccctcctgcctttctttctctcccagtcaccacacctgctccagttgcccccatggcacggggctttgtagtaggaagcaaggcagggggaggatgggggatgctcctgcaacactaaagcgcagcattggacaagagcctcttcccacaggggctcagagccaggaggaagaggggggaggggtccccttacatggtctcacccctccccctctcgggcagccttcttgcctgctctggcagcctggctttcagaaaggaacttactggagctggcttagtgtcacaaaacctgagtccatttccccatggtttccagtcctggtgttatagtttccatcttcctagcaataaagcagtatcatatagttagtgttttcttgctagggattgtgcctccaccgttctgccatggaaactgatcaagacttgttgaaatttacccgagggcatagattccctggccctgtatcatttatctcttagtgccccttccttgactttatggaactttctaggtaactttttttgactccccaggctttgtacagggatagcttgaatcaaggcaacacataattgtaatgcgcccagctctgacttcagtgccgtaagcaacaactgagaaggtgacagtgggaccggtgcccctaaggaacttaagaactagcgagagctacgtgtagagggtaaagaaggcttgtttgatcctggagctgaaggccagcttaagcaaagtagtaagacagaatcctaatggaaattaagaaaaaaaaacttcctaggggtttcaagactcaactacccatggaaaacagcaagaaaataagaagtgagatgtcagaggataaactctgagtaggctttggacttgcagtggggccagagggcagaaaagtgcagaggacaggattggactgagcttcggatgctcgggggggctttgagtagatgctcgtgtttttagcataaacagtcactctgaaatctagcggccccgcataaccagaagcagatagccacgtatcatcttttagtttctggagctcagggtttcaggaacagcttagctgagcccagtgtggggttttgtgtgaggtcacagtccaggtgttaggcaggactacatcggtgtgtttctggtgtatgtagtttgtgcacgtagctggcaaaatgatgctgaccattgggaggaggcctctattcccttcctcgtggatcccctcaaaggtcttttctcacagaaaataatttgagagagaaccaaaaaggtgccatagtgtcttttggaacctgactttggaagtgacaccccattccctttgtagtcttacctgggtaaaccttatcccagtgtgggaagggagctacacagagctggaccctcagggataggatcgtcagggttcattgtggtggccaccccgttactcttctatctgctttctagtggattcaagtctctcatccatgcagggtctaaaaccctgctaacatcccctcaggtgaccttcagttcatagctttgacttggagccaggtgcagctgaggctgctcccatcttggaatccagttgctacagcgcagttattcctcacctagaacctgagtttgagatataagtgacctgtgcccctacagaccagaccaagggaggcacagtcgagcaagcacagaaagctcctatgtacgtaccttcaactcaaaatggggcagagggaagcacctctgtgtggcttctgcagacagacctctcagaacatttgtagtccacagcctttgtaggacttcattatttcagaagggaaaaatgaatgctccgaggagttaggctttacttaagggtcttaaagaatatatttattcatttattttatatgtacatgagtacaccattgctgtcttcagacacacctgaaaagggcatcagatccctttacagatggttgtgatccaccatgtggttgctgggaattgaactcaggacctctggaagggcagtcggtgatcttaaccactgagccatctctccagccctactttaggggttttaactagtgggtggcagaggcaaacttcaagcccagccctgtctggttccagggcctcacagtccactgcccaggatgggcctgaatataatcttaggccatggtatgaaaaaagctgatgcaagcttatgaggttggatatgggggcaggtttatagaggagtgaagggattgagaattgtgcctggtcagactgctgcctctgtgtgtctctttgttctcattacctatagacacagcttgtccaaaatgtcaacaagtggacgttggggccaggtagaaaaggcataccaagtgcttgagagaagctgggctgtctcgtcccaattttcaatcctcccgtcttgccagggtttatggggctgaggatctgatatttctaacatgttgtcttcttagtcagggtctctattcctgcacaaacatcatgaccaagaagcaggttggggaggaaagggtttattcagcttacacttccacattgctgttcatcatcaaaggaagtcaggactggaactcgggcaggtcaggaagcaggagctgatgcagaggccatggagggatgttctttactggcttgcttcccctggcttgctcagcctgctctcttatagaacccaagactaccagcccagagatggcaccacccacaaggggcctttcccccttgatcactaattgagaaaatgccttacagctggatcttgtggagtcatttccccaactgaagctcctttctctgtgataactccagcctgtgtcaagttgacacaaaactagccagtacacatgtatccacccatggaaatgcaggggctttccttattttgaaaataagctcacatgactagtgactaacctagcctccaggctcccaagctgacagtagactgggccacttggcatagtgtcaataaaggaaaacatgagtgccggatgtaacgaggtggctttcgcagccaaatggcatggccatgatgaattggatatgttgcctggcctgacccaggacttcatttctgttttccagagcaaaggtcgttggagccagcagaagacacgatcttctaaatctcccactcctgtgaagcccacagaaccatgtacaccctcgaagtaccgaagtgctggccctgaagaggcctcagagtcacccactgcccgacagattcccccagaggcacggagacttatagtgaataaaaatgccggggagaccctgctgcagagagcagctcgcctgggttataaggtgagtaagtctccctgaacaggcgatgacaggatgacgacgttggcctggaccttagggagcagctatactgttggttcctctgcatccgatggtctccctctactctgcacatggcctctgaggatgccccttatgtgcgctcctctttaaaatgtcagttcaggagaaatgcatttgaaaaggtagcacaatatcgtccactgcattcctaggctatgaaggggatttgaaattttcactttgtcttaggttaacaaaggggaagtaatggcttccccaacgacacgtggtgatgattactggttacacattatctatctcctgtggtttctcctcatttgggctttcaggtagaagggttaagagcctgttcaataatcctgggctaacccacccgtactacatactttcttaaacatgggaatgagaacaaacaaggcaggcttccttccttctttccttctttcctttccttctttcctttccttctttcctttccttctttccttccttccttctctccttccttccttccttccttccttccttccttccttccttccttccttccttctctccttccttctttccttctctccttccttccttccttccttccttccttccttccttccttccttctctccttccttctttccttctctccttccttccttccttccttccttccttccttccttccttccttccttccttccttccttctctcctttcttcctcctctctgtgtaatagtcctggctgtccagaagctcactctgtagaccaggctggccttgaactcagagatctcccccacctctgcctcctgggtgctggaattaaaggtgtgtgccaccatgcccggcaaaaggcagcattccttgagtacttattttatcatgttaaggcctttgattatagtaagtctgttgaggtaggtcttattcctagagttagcagtatgaaatgatatggcaagatgtatgtggtagattacccaggtgataatccaaagccctgggaagtagagataggcaagtcagcaattgaaggccagcctcggctacatagcgaattcaaagccagcctgggctaccaacaaaagaaaataaaatgtgtccaatatcagttatgacagtacttttgtctgagttcaaacacatcctgtgcctcccatgtgagatgtacctgaggctgtatgttggtgcacgtttttatccttgtctgctctctgttgaaacacatacctttggctatgtatctctgccccactgtgtgatggtttccttgggatttgcttgtggatgcggacttatccacattgcagagtttaccttctctattaggctttctgtacctgtaagggtccactctggtctgtgcaacttgcacggtgtctccatcaagctgccaatgtacctttcttgagtatttagtatggatgtctgcatggctctcagggagacctcaggatgtattgaaatccagtctccgcagaaacagcaaacaggagaaaattggagtaagactagaacagagctggacacccccagcccaggcacagagtagctatctccagacatcctctcacggtgtctcctgggcttcctgagagcactgacagcagaactagtgggtaccatgttctagaagcttcacccaatggaactgccaatctccatcccagtttattcatagctttgtcccacggtagcaggaatgcttcaagtcacttgagttctccctcttgtcccaccatctcagctccaggaaggtagcattacccgaggctgaatgatagaagtacattgtggctatagatctaactccattgctttgcctagcaggcacagagccctggtctcaattcccagtactacatcaattgggtagaatggtatacacctttaatccgaaagatctgagattcaagatcattcttggctatatagggagtataagagcagcctggctgggcagtggtggcgcacgcctttaatcccagcacttgggaggcagaggcaggcagatttctgagttcgaggccagccttgtctacagagtgagttccaggacagccaggactacacagagaaaccctgtctcagggaaaataaaaagagcagcctgggctacaacaagaccctgtctcaaagcaaaaaaccaaagtgaattgtggagttgtgcttgcctggggtaactggaatttatgagcctgtcaggagcagagttcccatgtatatcttgtaaagctcagaaaggtgattgctgggcagcagaggagcctctctgaagaccttactccaaagatcaccacccagatgagtgcccttggccataagaaatgtcttcctcctgccaagggaccagctcagggctggggcccagcaatggaggctgagaactacctttgttcacaaaagattttgaattgtgtcatttgtttcctcgtataaagaacaggctgtaaaacttgtcagacacttgtggagtggcaagtctaacagggaggattcaaaaaacttcagacttgtctttgctcacagagctgtctcccatccctacaggacgtagttctctactgcctccaaaagcacagcgaggatgtgaatcaccgtgacaacgcgggctacacagccttgcacgaagcctgttcccggggctggactgatatcctgaacatcctcttgcaacatggggctaatgtgaactgcagctcgcaggatggcacaaggcaagaaggctgttcctctgccaagtctcagacctcagttcagtccctcgcttcagagctttactcagacctggatatttgcagaatgtccagctgctggtgtcaaaaaggctttaaccaggaagccttttgaaaggatgtctgaagggagccagcttaggggcaggagctgatgagttcctcaatggccagtctgtatgggactaaggaaaggctgaggttgtccagggttcactctgtcccatgccaagtcaatccactcaaccctcctgaataccatcatcgtcgtgggccatttatctcatgtggaattgaggccttaggttccaagcagagcactaatctaggtttcacattccagattgggtttttgtaatttagtctctgtgaacatacaaaaaaattaactacctgggtctgtgagattggcttgatatatgtaggcacttgccttcaagcctggccctcttggctgccacatgatggaagaagagagccgattcctgcaagttgtctcctaacttctgcacacatattcatgcacacacacacacacataatacagaaataagtaaatgcactacaccatattaatgtgcacacataaacaaacataaaacctttccatgtctcagagaagtcacacccatctcctctactccaggggaagtgtataccaagtagaaggggccagatcaaagtgtacaggctctgcttggctgctacctggtgtggagcctccctacctatccaaccctgcccttgcgcagtcacctgggcccttcctcttccacaaccacccacacctgctttaattttaacttccaccagggacctgttctccactgaactcctagtagatcgacattgtgctctagatactgtccgaagatgcgggggaacacagaggagagacaaatatgggaaagaaaaagaggtgcacagagacaatatgaagcgtaggccagaggtggctcccctgctctcttacccatgttacactggggttacctcgaggtcaccatactatctttctcactcttcttccccctaatatcgcattgtgaaagttctccattaaatcctgtagccctgactcttatttgacctccacaggccagttcatgatgctgtggtcaatgacaacctagaaaccatctggctcttgctatcctacggagctgatcccacactggctacctactcgggtcagacagccatgaagctggccagcagtgataacatgaagcgctttctcagtggtaagcattgaccacagttgcagccagaatcctcaggg

SEQ ID NO: 794 - DNA, 51277 bp, mus musculus; identical to SEQ ID NO: 793

SEQ ID NO: 795 - DNA, 64280 bp, mus musculus
tctttcgctcgccgcggcgctgccagtgtgtggctctgtctctcctccgctttgctgagccctcccttcttcctctcagttcctagagtccgaccgccgccgccgtgagaggagaaggaggtcggtagcgataaggggcggaggggggcatcggatgccggcagtgttaggcgggtggtggttcaaagagggtgagagggagctcgggtggcggcctgagcctccctgcggagccgacccgggaacaggtgcgtcttttttctctctcccccaacccctccaccccttttgactccctggctttttcgtattcccccacccgcttctttctatcctaagcctttccccaaccctgtccgttcctcttcccttagcttctcagcttgccccccgggggcgccgtcctcttcgtgtccccggacgtagagctctcgggagctctctctgtcctcgcccctcccttcgggacagctcccctccacttccaccttcgtaccccatccctgccctgccctatccccttctcgacctccttctcttttagccaggtgagacttgttcaccaggatccaagagagtcttcccctcggctgggcgggggtctccatggaaacgggggtctgtagatcctggggcggggggggtaaccataggaattaccccactgaacagaaaaggaggtggaggctatggtcttggaagtacctggccccaaaccctgatccatccaaggatccgacgatccgaagggaacctggccaacagggcagggcgaaaaagggcttgttattttttggggggggtggtggtgtccgtgatgaagtcttgaagagaccgggagaaaatgccctccaaccttagaggtggaggtgcgacgggagctctctcggggttgctttctcctcttttcaggggtgcaggaaccgtagggtaaggggtacccctaggtggcggcggggcctgggttcgggagtgggagtgctgtgatgggggcaggggcaattatccgagtccctggaaaaaaggcgggggatgacttcggagcgcccaagctccgctgccctcgctctaggggcgggggctaccgggccaggcgaggcggggagggtgctcaaattgaagaaggatgagatgggggcaattcatactggccccggcaagcctggtgggagacccagctggcttgcaagccctcaacccgcttcgcgccaggcctggaggctaggggtctgggaggaaagcagagggctggaaaggagggaggctccggttacggggccggatttcgggatcaggggcaatcccctggcccttggagagggagggagagggatggccgcgaaccccagggttcccccaccctgcttcataaggggcgtgaggaatggacagcaggcccagcggagctggattcaagcggatcgtggccagggagtgggggggcttagtggtggtcttcgggggggagtagtccggcggcggggcgggcgggcggggcgtggggctccggcgggcggcggggcggggcccgggcggcgctgctgccgctgccgccgccgccgccgctcctgctagggccgccgccgccgttgctgccgccgccgccgccgcttctgggcggggaaccgaggccaaagagagtcccgtgccggggcagagggcgcaggcggcgcgcggtggggaggggggctttctgcgggcgggggcaggctgggggtggagtccccgacggggggcggtacgagctaggacgacgacgaagaggagccccgggggcccggtgcgtggaggacgaggtgctgggagaaggaaggggggggggtgggtcccgcgacgggcctcgtgggcttggctcccggaggttcggcttcgggacggagccttgtgggggcgcccagaagccaggaaagggatagaggggtgaactggacggtggagggggccctcctcgccggggtcccgtggagaggaaggctgggccagagggacgtccgggcaaggctgggaggagccggcggcaccaaggctggggttttcgtgttatggaggtgcaggagattgttgtatcgaaagatgtggttgaggggaaaggcgggagggaagcacgctgcaaacccaggaggcccaacaccacaggccgttgggggtgcccttctgttccgctcaagcttcccctcctctccccattagaagcactgtgtttttgttgtattgttttgaaaatttcaaggttgcctgatcaaactgtcgacgtggtgatactttcttattcttgctggtttctagagtagacagtcaggacaggcttcagttggcgagcattcttccagcccagcgttttgggggctctttgcatgcccgtgggaagggggcttgtgaagcaaggcacagatgaatactctcaaggcgatttggaggtcgttcctatgacactgggtagagggcagctgcagatagctttggtcagacttctggggtacactcgaaggcttcaagtgttagtcccatgcgtctttcaacttagaagactatttctcggaatcacactgcagaaacgtttcatggggaaagaaatggggcatgaatttggagttgggagttgattaggctcataataaaattcaaaggatggctgggagttaccattttaatggtcatctagcgctgttctgtttagtgtgtcttgtccttgaatgttagcagtgaggggcctttcttattggggagactgcaggtggcatagtcaaagctaaatttgggcagagttttaggatactcgaatgtgatgtcacctggtggtactgaagatgacagtctgtaggaaagaaacttacaagattccactggggattaaagagataatcccgcaccaagaatcacccagaggctccaaaaggcagtaaaaggttgagaaggaacctgtaaaattttgacagaaacaaaagtagcaagccaaacagagggagcaacagggacatggtgagtcaagttaaaagaatccaaagttccattatgcacttgaggcttgccgtgggcatcttgagtagttcatgaggacctcggtggcaggtagtttttgcacctgaggagattattttgaggtggatctgggagatgggagcccccagggcttggcacaaaagctcgctaaaatggactttgttaatggattttcatgtacacttgagtgcaggcattagtgaaaagatagacactcggaaaaaatgaaatttattcttgtgggtatgaactaatcaagggaaagtcactcttaaactgacttttgaaagtctgactctttataggcacagacctttaatctcagtactcagtgggcagaggcaggtgagtctctggagttaaaaggccagcctggtctacagaataagttccaggatggccagggctacacagagaaaccctgtctagaaaccttctgaatctcttactagctttgcagaaacagtatgtaggttcctttccattctgacccagaggtgaagagagctagatacctagttgatacaggaaggggaagagatgcagaagtctggcttgaatagactagttctgtaaaacagtaataaggaagggacggctaattgttggaatagggcagggtaaagctaagtgagtcctagccagctttgctgttgtcaaagtagagggacgttgtatgagaaatggggccataccaaggcactcttctggatctagctttttttttttttttttttttttttgatttgccaggactggtagagaagatgtgtggcatcctggagattgcctttctttcttactggctttggggctcttgggaagcagaggaggtttctctgggggtgtgtatctgagccttattcatgatacagttccctaccctggcaaggaaatgcttggtgaaggtggcagaggatctcaagccttgattaatctgtgctgtgagctttagggaggagctttgctgagagaaacagaatcataggagcaaaagaggcttaccactagaaagaaggaaggcaaaagaagtcagggagaggggaccatagggcagggaatgggggaaggaagatgaagatgagcatcattgttcccatgtcaggtctaactaagaagaaagcagtaagttgaaacctccagggtaatgttttccaaagaaagttcgaagaacccttagggctctctacagtttagtactagaattgctaaggctggagtaagaaagaagatcttggataaaaataggctaggaagaaactggcatttagaaagaaatataaatatatttacccataaagaaggagaggtagtatccatattaagaatttaaaatgtacaatgtgggctgggcatgtaaaatgcttgcctagaatgtatgatggcctgagttcaagccttagcattgaaacggaaaaaaataaataaataaaacaaaaccctacaatgtgaaagaaaagcagatcattaaagagccaaaggagagaggcattcagatgctgttcaaagctgggattgaggagtgtaaagattaatttttgatagtcactactgtgggaggacccaggaaacagaatagctgggattaagctgaaacatttcttagcaaatccagatgaatgtcaagattctgaatgggaaaggggagtcttggtcccatcttgagtggagaataggagaaagtgggactacaccagtttttccagtctgtaagctggaggaatcctagatataaggaggtaagcaatagaaattccagagcaaaacaaacaggataaagaacagggacctgagagccttgggccagaattgaacagtagagttaagggcaccaaaaagagactttaatcaggatttgactggactatgtttacactggtttgtgaattctaggtggagctatctgggatggattgggttgaatatatagagctttcccagggtcagctagcctcttaagaagccatgcaagaattctgtgctgagtttggatgggaacatgaacactagaggggaatggagagactagagagtgaaacttgctactaattggacaggaagggggagaaaacacggaggatggctgtgtgaaggaagagggggcacttagatcagtgggagtttttagaaaggaaatttcttaatgttagcattggaagtcagtctgagtctgtgtctgctcgaatctttagtgccaggatagctaaagagggaggaaataagtaatctccctttgtgtcactaggggattcgagggcagtattttatatgatctcttatatgagccaggtattattcatgccagtctgtaaaatgtaggaaatcgtcctctttctaaatcatagcctttcctgctgttcataactttaaaatggtcttttatgttgaaaatgttcttttagcgaactaaagttgtgttctggtcaagagcaaaacgtaactctgtttctgtctccaaaattccagtaagctcttgtagtattttttttaaagcagtagcaactctttcctcataaaacatgtaaaaatttatcatttttagcatagtaagtgtagatttgttaaggaacaatgagaaaaactttggagtatgtgcatgggggtgggggggggcaggcagggaacaatactctgataggttgactattttatttatttatttattttgtcttttttttttttttttaatgagatatggcctatggagaccagactggccttgatctcacagagatttgcctgcttctgtctcagccttccaagtgcttggataagagtgggtgatactatgcttagtttcctccctaccaccccccactcccccccccacctttaaagaaaactgcaggtctagtgttgaggtggtgttttcctctttgttggtagataaattgtgatgagtttgaagatgtggcttgttctttgtaaaatgctgtgattttccgatttccccagtagagttaaataaataaggcaagatgtggcttcatttgtatttaaagattttaacttgggctaaagatttgggaaggcctgaattctatgtagcagcagttttggggttgagacatcgttactatctgctaagaaacaaaatttccttacctcattactaagatctatcttagtgttgattccatttaaagctacagtagaattttgccactgcagggctatgaggacaccaaggaggtctttctttttctgagttctgtgaaatgtataacacacagatatgatcccagggaggagatccactgaagacttggatctatgagaggattgaatatattttctcatgaagagtctttactcagttgaacttgggtcttctgccttgcccaggtggccttgcatcctaattaatctcctttggagacagagctgtgtctggtccttgttgttcaactttctaatagtatggcaggaaacaagtcactaactttcctgagcctcagtgttcttatctagacaagggagatgatactaaatatcataggatggttagaattctatcaaataaaatgtatataggcactgctaaggtacttaacaaatggaatatatttttagaactaaaatttcttgtgtcttatgacgttacttactacatacaaggcagaatgaaactaaaaattcattctgctatccacccctcatattagccctttgtcctttttctctgtaattctttttgattagtagacatccagggtttattgcatggtaggaagtaataccttaacacattgctgcatctgcctcagaggtggaggtggtagttgcttttacggttgtgccatgacaacatctactctttctggacaggaactgaagactgaatatcccattgaaactttaagggatcttttgcaccagagctatcaaattccctgaagctgcctgatgtaggtgctgggaacttaactagggttctctgcaagagcaatatatactcttaaccactgagccatgtctccagcccaaaatactgctttcagtaaaggactcttgtgttatattatggctggttaagtgttctaactatctctggaaatgctccgaaagctgatagaacccggagctgatgtgcttcgatgataaagatgctcaccagtgattgaatgggagagaataatactggagaaagctctgggttccccaaaccaaactttctgggcaaaggaaaaacagtggccttcaaagtagatctcctctctgcagctggagtggactttggtgtcaacaattgggtctctgttagttttgccaatacagggagagactgaggacaggccaattgaaaacggcagattggctgacaaattaacggtttttctgtttgacttagaaaatgcattgttattttctacctgtcctctagccctgagatttacctacctatttttcttctgtttaggcaaatattatggctgttccctgagcacacatctactggtagtccataagtctcctgggtttaaaaggtagctgtgggtgcagcacaccaagatagttggggagtcgattttattattttgcttggcacaattttagttgagttctgtgtttctctttattgtagaaataaagcaggaatagagttgaagtgagagcaaggcagtaaaagaaagacttgcatgcagtgctgttttgtttatttgatgtgtatgcccgcatgtgcacatgtgaacgaacatgtgtatgcacgtgcatgacagcttgcaggagttggctctctcctcccaccatgtgggtcccagggattaaattcaggtcatgaggcttggtggcaagtgcatctcactggccatgttttgttttgcttttgagacaaagtctcattgtattgctcaggctagtcttgaacttgtgcattcaagtgatcttcctgtctcggtctcctgagtagctgggactgcaggtatacaacgttgtgcttaaatatttctacctgggtacctggtctctctatgatatagtaaaagggtggttttccctagtagtttattttagcaagctattgagccatattgtgtgtcttatattatgctacaccctgttgggagggggctagtaaatctataggtgggtaggagagtgagtcatggagtttgcatactgtgtaataagagggataaaaataaaataatagcttctaatgaattatatacataatctatgtagtcatagcagagcctcatcttcagataaaagaacagaaaaagtaacctgataatggtgtctccaaatattcatgtacatttatggtctaggagaggtttacagaagcaaaccttaaatgaggaggaatcccctttacatgaaaaagtccatgtcatacctacagtacactaaatgttttcagagacccactgaagaccaagatggaggaaagccaactcttatttttggattaacagaaattagaagtctcacaaaatgtttctatttacgtagatgtcttgctgaagtagctttgctgattgattttataatgcagacttaagttttgtaggtatctgtgacgtgtagacgttacacaagaacttttaaaggatttatcctctctgtttctctctgtctctgtctctctctgcatgtgtctatatgagtgcaatggtgtgtgtgtgtgtgtacatgtatgcagtgcctacagaggacagaaacatcattggactcccttgagatgcagttcccaggcagttgtaagccacttgacataggtactgagaagcaaactctagtcctctggaagagcagggagaattcgaaactgctaagccatctttccagccccatctgtataaagtcttattagctggagcttgattttagtataaagttattaatacaatgatatgtttttcctaaatagagcaaataagtttcttttactacaggaaaagaaaacgaatagtgtttgaatagtaagagggaaaatcaaggcagagtgtagatgagctaacgcaatctgatggcatgaaaatggaagtaaaccatgaaaacttcgcttttggttcacatcatcctcaaaatatacctctggcccctgcaagtgcctctgtgttatgctcagttcttgactaataagatgaatatattatctggcatagtgagatggtcttgaggtggctgagaaatggagaaggggagtattttttaaggtttctaccatagtttaggctatgggtcctgtaatacatcactgttccaggtgatgggacactggtgctctaatactgttgctatctgattacattcatcttcttcctcttcctcctcctcctcctcctccctcctcttctttcttctcctctttatctttttgagacagggtctcactatgtgttacaggctgtctctgaaccaactgcatagcccaggctggcataaaagtaacctctctaagttctaggtttatacctccacacttatgtcatgaatggattatggctgttcctaaatatcgagtcatctctaaaagcatggggtttagcagctacagtagtgaagagatcgaaagggtgtatataatagttaggattccatgttagtgctctcaggagctctgtggaaaattgtaagccttggccgtctagtcactgaggtgactgcccagcctcccaaggtaactaaattcatcagaatgagtaagctctcatgtgtttaatagatagttaactttcctttgtatccagtctcataaatgtttataggcacatgttttaaacatggtggtacccaaggagtctatgaaggcatccaggctagaatcatatacaggtaatttcttaagtcttcttgttaaatacaagaattgtatcttggaagaaaatgcaatatcccctgagtctgctctcatatgatagacaccagtggacatattcagaataaaagaaagaaaaaccaaacttaagtgacccagaaaacgttagaatagatttagttagatcaaacggacagttttttttaatacgttttattaggtattttcctcatttacatttccaatgctatcccaaaagtcccccataccctcctccccactcccctacccacccactcccactttttggccctggtgttcccctgtactggggcataaaaagtttgcgtgtccaatgggcctctctttccagtgatacaaacggacagtttttttaaaaaggtgttatattcttgaggtgattgtttctggttgatccttgtgtgtgtgtgctattgcatggggctagaagggaagcacgggaaagcagttgggacatttctatgtcactcaagtttcagggatgatagctgattagtagctagaagagatgagggggatagaggtatgagggagggcaggtagcagaatagaagaccatttttccatgggaaatgactaaaacagagcactttcagggggagaaaacattctcattgggttaaagcttggggtatgtaattaaatggggaagcacaagtgttgttaatatcctgttcaatacacacagagggaggcagaacagtgctgctgctttccccaaagtgagctggtagggtaacctttcttttgcctttttaaagttttcttcttataagagtattgcccaaagttctgcatttctatcagaacagtaggacccaaagttagttttctttcattagtcaccaccggcccaaccctccttcttaaactgtctaccggccacagctataatctcaaggacagatttagggccaagcttcaagatgaatattttctgttttttttttttttttaagtcataattgcttccaggtcaaaggtcactaagcagtgtgggccaaaaggagtctgaaagagtactgccagagttgttttacctgagaccctgtcctgatgttgagctcagccacaaggaacagacaggtgtcacacatgggttagagagactgatgtgacctgtgtatctactgccacctttgctcatcactaattgagtctttggttgcaaagggaggaatgaagattttgacagattcgaggttataaactttaaaaacaccatctatggtggattatgtctgtaaccaaagcacatagaaaactaagaaatgaagattgcctcgtgtttaagaccagcctgggctacatagtatgggtaacaggccaaactggaatccatatcaaaatgctgtttccaaaatcaacaagcaagccaggcgaggtgacatatacctgcagtcctaacactcaggagacagaagcaggcagatcagtaattcaaggccagagtcagctctatagtaactttggggccagtctgagtgttgtggaagtccatctcaaaacaaaacaaaaaaactaatcccaagaccccaagttgataaacaaaaacccattatctacttccatgtaaaatatttgtcagattctttctctgatactttgctcttttgcttttttgtttgttttgtttttgaaacaaggtttctctatgtagccttggttgtcctgggacttacactgtagaccaggctggccttgaacttaaagatccctatctatcggtaccctccaaatgctgggattaaaagtgctggacaccatagcttagccatgcttggcttttaattgtcgtggaatcgacttttgtcatcttcctttcaaaacagattctgccctttggtaagatcttggtattttagggctgctcatttcctatttgtgatgcgcctaaccctgactgggggcataacttgttatatagaacctcttcttcctttttttgataacacattctctttaagcttttctaaaatgcttccgtgcttccccacagtatttcagtttggcttgtgatggtgaaatctttcaggttcccctatttcatttttcccgtttggttgccgtgtgtgtggcctcttctttccatgctctagcttctagcacattgtctttgcttttgcagttttttttctctctctctccctccctccctccctcctgctcttttcaccctgttaacattattgccctcccattactccattcctgccttggtgtcccctactctagtatggctgttatggcagatggtgtactttattcagccttcttcctaggcacatttcctaggatcccagtcagtctctgctgctagctacataggcatcctgaatggctaagttgtcttttttcaggcacacttgctgctttgagcgggtggaacttgtgttcttcattgtccttatcatgagttagataagactttttgagtgacttcgaccaaagtgaagatagtttacagtggtccctctcagtgctttgcaggcagtggcagcatttgagtcttgggtcatgcagcttattcctaacaatgacatagttgtgacacctgggaaaaccctttgaggtatttcatatccctgtgcctgtgatttctgggtcacttgggattaccgggtttcttctaagttccttttccgaactttgccttcacttgtgggcaaagaaagagagaaggaggaggaagcgagaatgcgactatccctgtgggtacagtgagtggaagcacgtggatcatgtgcgtttgtaaggtttttctttttctgctcacctccactgtgtacctatggtgagctttatagtgagtgattgctaacttgattagacaggatggaacaaaacgagatcctaggcttactgaatcagaatgtgtggagctgagacctaagatactatttggaagcagctcctcagggaccttggctggttgcattgactgttctggtcccgactactcctttgccagtggaagcctgtttcctagtgcagcatttgatgcttctattggctttttctcttgctacatgaatcttgccttcttatgtaggccacttagttcagtgtcctgcttgtgtgtctgctgttttccaccccttgagcacaaagactactgttaattagcaacagtgaacttcagatggtcaggagtactgctctgataaaatcaggagaaaagttacaaggccaagatttaagaagatgcccaattttcaagatttcatgggggccagagagaaggttcagtggtcaagaagaatgttactgctcttacagaagacagaatttgattcccagcacccaaatcaggtggcctatagtgacttctctaactccagcttcagggattcaacgccttctggtgtctgcactcataagtacatacacacacacacacacacacacacacacacacacgtttagaaatagtgaaagtcaattttaaaagagattttctgaaagcagaggtatccagagtcagttttgctctctaggttgttacacactacatcatgaacgtgtttgactttagcttccgttttgtttgttttgcctctacctttcctttcatgttttgttgggcctaaaagctctttatctaggggatgtttggtctattgctgtttccaaacactgagaatccccctttgacttctgtcctggacctgcaaacagcttatctcttcaacacagaacagaaataattctgagtgaaaaatcatgtggttggagccagtggtggtggtgcacacctttaaccccagcactagggaggtagaggcagtcggatctctgagaaggttttctgtgtagccctggctgtcctggaactccctttgcagaccaggctggcctcgaactcagagagatccacctgcctctgcctcctgagtgctgggattaaagtcatctgctgtctccttatgcagcccagtctggccttgaactctcagtccattttggattacatgtaccactaagcctagggaatagggtctttgttaaaaacgtttctaaaatcaccccagtgttagtaatgttaaaaggtaatcatcaggaaaaaggtaaggcattatgactccaaatactggaaagggaacacatggtacgggtctgatttttcttcctaattaatgagaaagctagacatgttatagctactgtaaagctagatgtgtaaagctagacatgttatagctactgtcaagaaaacgtcaagaatcacaaatttatgtggagtaaaggaattagatgtaaatggaggtgaaactgggttttccacagtgaggcagaggttggggcaggagatcaatccgaactttatggaaccatgacagagtttgtatatccatcagctacttgtaatttacagaggcgtaaagtagggcaaaaatggtgaactcagacagaatccagcaactgtgagcaaagtgcactatatagataatgcatggattttttttaatagtaagcaagtgtggtagacactttttcattttggttcattttgcttctagtgatttctcagaatcatcacctcagttctcatctagaattcagccccatataacatgtatttactgactccttactatgtgtgaagtattaagaagagccaaagaccagggggaaaaagaatgttgttccttaactgcagagctgatcctgtgctggagagacacacgttccaggttcccagctaactcacagcagaggagagccagagggaagaaggaagaaaagagaagaaagaggagaaaaaaggaagaggagagccagaaagggagagttaacggttcctgggctgaggctaggggagtgacacaatgacatttgagctaggctttgagggatggtagctggggaagaagaggcacagggggaggccatctcagagtgaagaaatagcagagtcctgaaactaggggggccaggagctggggtgccgaggatggcaggcaaagggccagatgcagcagaagaggagcacgcagaggtttgaggcaaggaaggctgtctgaagaattctgccttgggtgctgccttgattctgatggcttttgacgagagtagggaggtctgatcgaagcagcgattcagaagatgaattgattgtggaatcaagcgatgggaggctaagagagcagttaagaggccagtataatgttcctggggtgagatgatgaaggcctgtactagggcagtggcaagagggacagaaagagagaaggaattggctttatcaagacttgactcctgatttgatcagtgtgatggggagaggagttgaagaaatttcaaccaaggagacagaagtgccagtaacagaggaagcatgctgtggctgggcatggtggatgggctgcagagtacatttatggggacagataatgagtccactccgagatctcttggatttgagaggtttggtggacatccagttaactgcaagttgctggcatctggaattctgctctgggcctatggagagaggtcggggtttagagatgtccatatgagagtgaccagtccatctaggggtgaactgaatttgtgaaagctgagagagatagagggtaagggttgtttacacagcagggggagacacagaaagagacccagaagcaagaagaggagacgggcagaaagatgatggagggagacagaagtgagggtgggaaagactggaagggaggcaggtaatgagactgagagactaaagaggagccagggaagtgaggaggaggaagagacacaggaaggggaagcctgggaagagaggcaggaagggaaattggaagaggctgtgctcagagagttcctagaaaagggaagggagcacaagccgtctcaaagaaagattagagagagaatgaggagagtgaggaagagagcagggagagatcaggagagacgaataagaaaagacaagacagaggaggtagtaagagaaggaagattaaggtaaaggctcattttcagtgaacaccaaggtttttggggtagataacaggaggagcacatacagagaaaccaggcagcacgaagccaggaaaggctagcgaagggaagtataaagaaaagggtgagcagcagctgactgacatatgcagggacccacagctggacattagactaagctctggaagtcttgtgcaggagttgggggaaggattgtgagggtgggggtgggggaggggagtagggagccccagttctgttgtctgcctgtgaatcctatttccctaactgggctgctttgtctgacttcagtgggagaggatgcacctagtccttcagtgacttgatgtgccagggtgataccccaggggaacctccctcttctcagagacaaaggggaggggcaatgtgaagggggactgggaggaggggcatgcgcttgggatgtaaagtaaataaattaattattttaatggaaaaatacaaataattttaattaaaaaagaaaaactagaaaaggagggtaaggacaagagagcctgttggctgccacagagatggggttaggatgcagtcaaggaagagaatgggttggtccatttctgttgctcttcctttaccaccttccctgaatccagctacgatgacctcttggctctcccttgatctgagcaagcagcctcctcctgctttgagaacttttctttccctccacacatgtagatcactcattccttcacatcctgtaggttgttgaaatgattccatctgagggaggcctatgttgattgcctgattgtgactcatagcccctccactcactcccccgatactgtccccaggctccttagtgtgccttgtatagcttggaatgtactataacacggattactctaaatgtgcttattgtccttgtcactacctctagaatgcaagtgctgtgcaggtacacattttgtcaggttttgttagttcttgaatccctaggacctaggacaaatgtttgttgagtgagtaagtgaattatgttgagtatgaacaatctgtgaacattgaaaggctaaatggagcaaatctctgatgtaactgtactttactatgacatctttggaacacagagaacagcagacaagtctggtcactgtagggttctgttcagttgaaattggctgaatggtgattttagctaataggttaacacaacactggctcactggataaagctatttttcttgatctccctttttctatcaaaaatgaaatggctgcgtgatgattgtcagtagcaagaactaggctttggctcatgaaggggttagtaagccacggtggggattaataggaaaggacaaggacagaaatgtgtggttcctgatggaggcttgtttttgttcatttgcttgtggccggagtacaaagggtattgcacctaatttggcgggagctttctacaccttacatagatgtattgggacgaacttggaagcagagcagagcacttctgaaaggcttataaagaaagtgtgggcctcctctggagagcttaaattggccatgtaactcagatccttccctatccgtgcattcgcgagcaggagcagaagacgacccctagttgtctctcacttcacttgctgcttaggtctggacgcagcactctaactggatgtgcttaggctaaatggatgtagaaaatacactgtcccttaactgtatgcagcagattcaacttcctcaaacattcaagcatatgtgtctctgatgattgacagtgtcctcatctccatcctgagtgtgggttcctagaaagctgctgtgaagttggccttatttggaccttcatttcccatagcagactggcttgtgagagtgatcactttagcacttggaggccatgattgccttcattaagatgtttccgtgtaaaagatggctaaagcagctatacttgttctcagctttaactttttggtattcttttcccccagggggagtggccagagcagatcctatctggtggtgagtggctgtcatgatctctacagcaccgctctacagcggcgtgcacaactggaccagttctgaccggattcgcatgtgtggcatcaacgaggagaggtaaggttgctgtacctagtcccagggaggggttggacctggggacaagattctggtttgtttctgattttcctaaaacacaggggtcacctgctctaccacactgtcccggatccactgaagatgaagaaactatcagatgacatttgccacctagtattatctgtctagtgataaagaactctaacattgtggagtaaagaaaagctcggatgcctgtagtttctgattcttatgtcaaagtttggtgttcagaagttcatgtaagatattttcagttcttgtccagggcttagaagaaagttggtctcatcatgtagctttatggtggggagcaggtcatcaaaattctgggggccagtacttcttacctcaagaagctaccaaaatatgtcaggaagaccttatgacatatcaaaggaagatgaggttgctgaccataactttaatgtaaagttcagttagtgatacctgtctggtctgtgtgtccatgtttcagtttctgatatttggttgttcaagagaggcctttttaaaaattatgcatcataccaaggctagccaattgcctttcagagttgatatttcccttttatcctccttggccaagttgctctgtatggtggttatgaggtttcttcaaacttcaagagattgttctgtcatgcctgttggtgttttaatccattggctatctaaattcaaacatgccagaggattctgataggattctcccctccaatttaagattggcagtctttaaaaagaaaaagaaaatagatcctggtgtagatctgttaagatagttcactgggtaaaaatgcttgcctccaagcctgacaacccgagttaggtccccagaacccactaagtgtaagaggagaagtaagtcccacaagcagtcctctgatgtccacaatcacacatgactgtgccaccttacaccccaaaaaaccagagggaagtgaaagaaatagatccagagtttctcaagtaattctaaaaagtatttgtatgtcgggagaggtaatggtgatagttttagagggaaaaagagactatttttgtttttatattctatgggtgtgtgtgtgtgtgtgtgtgtgtgtgtgtgtgtgtgtgtgtgtgtatctagggatgggatactgggaatcctgagtgctgagtatgttctatacctctgagctacaccttcagcttcatgtttttatagaagtcattttttttcttttcctaactagagaagggtatatttgtctgagattagggttaggagaatagacttctattttcttaatccattcacacctgatagcttaatggtccctgttctgaggagtgtgttagaggtggacttcaaaaaggaatttaattttagaatacaaaaatcaaaagtaaggagaataaggcgaaattcttctgagagacaggagaaaagaagtatgtccctttgtgtgtgaggtctgctcttagaatattcaaagagatgctcctggcaaggcaggctgctgggtgctttgtgagcacgcactgacaggctgcattacagtcacaagtagttggggctgatgtagagctgtatgcctgagccttcaagaacttagtacacaagcaaggtgtgcttactcgcatctataatcccaggactcgggaggtaacggcaggaggacctggggtttgtcaatagcccgggctgcctattaacttttaggctagccttgtctaccaaagtgagaccctgtctctgtaaaacaaggctaacctgagaaattaaaaagcactggacaaattaccttgttccctccctgtctgtgctgtattccttgcaagaagggagtcagaggtagatgtgaaatctgattttctctttttacagacctttcttgggatgctaaattacccaatatgcccagtggttaagatgattttttttaaagcattgtcatttctgatcccatctaccctttgtcaccttcttaccactgtctaggctgtgttacagctgatttccaaatgtaatctcatcctatatgcttttagttcttcttttgagacagggtctctttctgtgtgttgcctgggctggcctggagcttactgttatagcttagggagacgtcagacttgtagcggccctcctgcttcagactgcgtgctagatgtcatgtgtgagctaccgtgcatatcataacatatataatacacatctcacacacacacaagatctatttctgtgtgtgcatgtttcacctccatgcatgtctctacaccatgtgcatgccttgggctcatagagatcaaaaagagggcatcagatcccccagaactggacttgcaggtggttgtgaggatctgggtgggtgttgggaattaagcccaggtccttttgaagagtaggaagtgctcataaatgctgaagcatctctccatcccccagcgccacccccattttaaagacaaggccttgctatgtagcacagaaagaaaatcttcctgccttagcctcccaagtactatgattacaagcatataccaccaagcccagctttatcctatgtaaaaaccatcttcctccatcctttccaacttgtagaccttacaaatttgaggtataaagctgtttttagggataaacttaaaattacattgtaggagtctgccaggtttatcaaatatggttggggcatatagaacagaaggcataaatcagcctttttgactgctctaggtggtctgtcagctttagtcaaaccttcggctaaatagtcttgcttgcctttagcattaattcattccttcattcaataagcatgtattcaatacaagagcaaactggtagttcgtcttcatacattgctgttgaatgtgtggactggtgtgaacaggtcctatggagtctagctggaagaatgatgtatttctttgggaatatcagaggacagtgtcacctgagcccaggctagacatgtgattaggagtttgaggtgagggccgatatccatgcatccttgattattaggggaaggccttggctggagtgaaggggggttctggtgaaaagtctcaggggttggtaggtaggtaaggtgcctcatgcattctgggttggatatttctcttagatattgttccaggcccaacaggaactgaaaaccgtccagtgtggcaggtcctgccgttaatctttaataattaggaaaatggccctgagagatggtggctggttttggttaagttcaacaaagccttgagcacaccagctgtcttctagtgagaagaaacagtggaactgatttctaatcctgcttggagcctcttttggcctatgtttcccccctcacctgtatccccataaccttgctcagttgacccagctccctcccctgcctttctgatcccaggctcctctctcagtggaacatttttttttttttttaatatttgcttagctttgcatccccttcagaggatttgaaacaccatcgcacacattttcctccctgagcttggggggctggtgctgcagcttaggcatggctggagtagccagaagtgctgcctttgctgccaccaccagcctctctgcctggctctaggcttcactgctaacctctggcttgtgagaatatagcttctgctttcttcttctgggcagaatttctgcccaaggaggagcccaccaagcaggagggagcgtggtcaggaggagaaagaatgtaaacaaatagggccttcccatgtggagttgtggaggggagaggtgcgccctccccctaaaccatccctggagagtctagttggaacatgcttctccagcccaaggctggctccatataggtcctgcttttctgctctctcaggagttgatgtgaaaagtgtgttttcccttctctgtagccctccatctctcctcttcctcaagacccctaactgcggtccaaagcccttgcctcacagtcctgtgttaccagcagtcatttccagtggtggaactgtcccacttctgccaccctagctgtttgttaaaggggacaagcctttcccccttgattagccccttctggagccggctccgatcctcattgccattcttgcttctcttgccccaggtacagttagaaagtctgtgtttcagtcggagggagggagttatttgcaggggtgctcctccttgctggagttgactgcaggcacccccaaataccctttagactagagtgtggtcgctaaggcagacgctgctgacttttcttcacgggctgtattggatctctggcagggctccaaagatggcaggcaaacccaaacaaagagcaggcagagcagccctgtgctttgcccacccagaaaacttgctgcagctttgttctttgaccccctacctcctctgcagccactcccacccaggcggctgccctattgatatggctcctgagcacaggggccgggttcctgctgcacttaaagcggccagcggccggtatggagccaccacttgtccttcgactttactttagcgtgtgatccttttatttgttcgttttgtcaaatggcacatgttttaggattcttacctgaagtttagagaattcttcttgagcagtttgggggagggggttacggttgaatttttctcctttgagatccagctttctggcctttagactttctttatggcacataccaatagaaatacagagttctgtggctttgaggcgctccctttgggaggagagaggatgtggtgatgcagagaggctgaaaggaaggtgcgcccatgtactgtgagaagagagcatgttgtgtggagccaggttgacttctagaaatgctcctttggagaaaaaaagaagtgtttgctttgttttgctggtttttcaagtaacacacggggtcttactcttactgtataggcttgctgagtctaagctggccttgacctcaaagagatccacctgcttctgcctcctgggtgccaggatttaaagacacacatcaccagtccactgcattttccttgttgtttgagacaggatcttctgtggcccaaatgactgaattccttaccttcctgtctctacttcctaagtactcacattacagacaggacacatgctcagctaaatgtcgtagttttaaagagcctctcggtgtcagtgaccagatggcctcacatcagtgctgtaaatgtgagtgtggttgggcttcaggcccgccttgcccgatagaggagcaaacgcttcagattttgactagattggaaagcactgtggaagtggagatttgcttacaaagaggtttaccctgaatggcacttcccatatagacttgaaacaagattggatttaaaataaaactaatttgtgtacccttgaggattctgggttacatctctctccttttgggcaatgccttgtatatcctggagtgaatggtcaacttgatggttaagctccaggcgaaaggagaaggtgctaaggtggggttcatctgcactttgggtgagaacactagaaagcacaataagtggcccccaaattctggtcagacaaggctcctcctcttcagcaacttgcaaagttgcgtgtggcggctccgctttgcctggttcagctcctagtcttctgccatcccctgaggtcaccatggaagtgagacaggagggtttggaaagctaggcaggcaagaccttctagaagtgtcagtgctctaagtccgggccttatctcccttttctgctgtgtcttccctgccagaagagcacctctttctgatgaggagtccacgacaggtggctgccagcactttggatctcaggagttttgtgtcagcagcagtttttccaaggtaaggagctatgtgctgtcacatgctacccatcaaagggtgagcttcttggaccatgtgcctagtttggccttcctgagactgggagcaagaagacacaagttgctgtaggtgagacagaaacggctctgcgcatgccctgtacattgcagttggttgagttgtcgagaggaccagcaggtacttcccaggggcctcagggtacctgcatcagttcccaggactttgctaagatggccatgctattctttcgtcgcaggtggagctcacggcagttggaagtggcagcaatgcccgggggacaaacccagatggcaataccacagaaaaacttgggcacaggtcagaagatcagtctgatgaccctcagccaaaaatggactatgttgggaatccagcagaggctgagggcctcctggtgccactgagcagcccgggagacgggctcaagctgcccactcctgacagcactgaggccagccacagcagagccaactgctcctggactcccttaagcacccaaatgagcaaacaggttgactgctcgccagccggggtaaaggctttggactctcggcacggtgttggggagaagaacactttcattttggcaactctgggaactggagtccctgtggagggtaccctgcctctagttaccactaacttcagtcagctgccggcacctatctgccctcctgcccctggatcggcctctgggaccccctcggttcccgatccattccaagttcccctttctgtcccagctccagtgccccactcaggactagttccagtccaagttgccacatcggcttcagctccttcccctcccctagccccagcagcgccctcggtgcctactctcatctctgattcaaaccctctctctgtgtcagcctctgtcttggtgccagtaccagtgtctgctccccactcggtccctgtgcccttgtcggctcctgctccgacccctctcacagtctctgtgtccgcacctcccttggctctgatccaggctcccgtgcctccctcggctcccaccttggtccttgcttctgtcccaactccagttctagctcccatgccagcatccacacctccagcagctcctgcccccccatctgtaccaatgcccactccgaccccttcctctggcccaccctctacccccacccttattcctgcctttgctcctacaccggtgcctgcgcccaccccagccccaatctttactccagcccccacgcccatgccggctgccacaccagctgctatccccacctcggcgcccattccagcctccttcagtttgagtcgagtgtgttttcctgcagctcaggcaccagctatgcaaaaagtccccctgtcttttcaaccagggacagtgctgacccctaaccagcctctggtatacatcccacctccgagttgtggccagcccctcagtgtggctacactgccaaccactctgggtgtgtcttccacactcacactcccggtcctgccatcttacctgcaggacaggtgtctcccaggtgtgttggcctctccagacctccgctcttatccatgtgcattttctgtggcccgacctttggcttcagattcaaagttggtctctttagaggtgaacaggctctcctgtacttccccatccagcagcactaacagccagcctgctcccgatggggtccctggacctttggcagatacctccctcaccactgcttctgccaaggtgcttccaacttcacagcttttgctgccagcccccagtgggagctcagtcccaccacacccttccaagatgccaggtggcaccgatcaacaaacagaagggacttctgtcaccttctctcctctcaagtcacctccacagctggagagagagatggcctctccacccgagtgcagtgagatgcctcttgacctctctgccaagtccaaccgccagaagcttccattgccgaaccagcgtaaaacacctcccatgcctgtgttgacccctgtgcacaccagcagcaaggccctcctttccacagtcctgtctaggtctcaacgcacaacccaggctgccggcagcaacgttacttcctgcctaggctccacctcttcaccttttgttatctttcctgagatggtgaggaatggagacccaagcacttgggtaaaaaactcaactgctctgatcagcaccattcctggcacatatgtgggagtggccaacccagtgcctgcatccctgctgttgaacaaggaccctaacctgggccttaaccgagatcctcgtcatctccccaagcaggagcccatctccatcattgatcaaggagagcctaagagcactagtgccacttgtggcaagaaaggcagccaggcgggtgctgaaggacagccaagcacagtgaaatcccgttataccccagcccgcattgcccctgggctgccagggtgccaaaccaaggaactgtctttatggaagcctacaggcctgacaaatatgtacccacggtgttccatcaatggaaagcccactagcacccaggttctacctgttggctggtcaccataccaccaagcatctctgctttctattggcatttctagtgccgggcaactaacccccagtcagggggtgcctatcaggcccaccagcattgtttctgagttttctggtgtgtcacctcttggttccagtgaaactgttcatggacttcctgaggggcagccacggcctgggggcccttttgctccagagcaggatgctgtcacaaagaacaaaaattgccgaattgcagccaagccttatgaagaacaagttaatcctgtcctcttgactctcagccctcagtcagggaccctggcactgtctgttcagcctagcagtggggacatgggagtaaatcagggatccgaggaatctgagagccacctctgctctgacagtacccctaagatggaaggcccccaggcagcctgtggcctgaagctggcaggagacacaaagcctaaaaaccaagtgctggctacctatatgtcccacgagctggtcctggccaacccacagaacttgtgcaagatgcctgagctgcctttgctacctcatgacagccactctaaggaactcattttagacgtggtccccagcagcgagaggggccccagcacagacctttctcagcttggaagtcaggtggatctggggcgggtgaaaatggagaaagccgatggcgatgtggtcttcaatttagccaactgcttccgagctgatggtctcccagcagttcctcagagaggccaggctgaagctcgggctaacgctgggcaagctcgagtgaaacgggaaagcattggggtctttacttgcaagaacagttggcagccagacgaggagacagaatctctgccacccaagaaggtcaagtgtaacaaagaaaaggaaattgaggaagaaccacggcagcagccaccaccacagccacacgataagcccatggtccggagttccttggggtccaaggtgagtgccagtatatggcctagaattcctgatggtcagcttcacttaggggtctctgctgcatcccagcccaccccctccctacagtgctcttgagcagctcagccgtgtgaagggagctgatgaacgaacgggaggcttccccctttaactcctgctctctctctgtgatattctcacctggaaagggcctagctcattccataggatataggaaatgatttcatctttggggctagagaagccattgtcctagataaagttggaaagcctgagaaggtattggtgaaggaaatcacttcatcacaggctcttccccaaggaacaattcttcctggttctttaaagatgatgaaccactgtctttggcagtttggggcccagggaggaaaggaaacgttgatagggtcattttggccccacttcttcatagctctgtgacattgattaatttctcttaccctcaattccttcatctctgcaatgagacaaataatacttatttagagaattgttggaaagattaaatgagctgttgatatgaaatatctagaacaggcaaattgataggaataagaaatagcctgatagttgccgagggctggggagggctggagggtttccatgcagggcagtgaaaaagtttctgtaccaggcaaatggtgatagttacacaattctgtgtttgtacagaaacaattgcattgtacatgtacgttagtgaattgttacagcagagctcagtaaagctattccaattaatgagatggcatataagtgcttaaaatagcactgggcacgtaattaagtgctcggttggtattagcggctgcttttgtttttagtatcacaaacagaatggccctgccctcatgcagcttaggtcttgccgtgttgacttaatgacaactgggcatagcccttccggtatgtgatggatagtttaataggctgattgaaagatgtggggggaccgagaataaagttccaggagaaggagaaggcaccagcatctccaggttttccctttggaaaccagacaatctaagtgtttcatcaggtcccattttcttgaggaacatgtgaactgataaccaagctaagatgaggcgttaattccaaacagcccattgctggggatggccaagaggcagaataagctccggttgcttgcttgaattatttttctttcaaatattttttaatacgtttgtatttcttttctgtgctcatgtgtatgtgtgtggtacatgcatgatgccacacctgaatgcagatcctgggacagttttcagctgctctctctctacctcagattgtcccatgtagcagcaagcacctttacctgctaatccatcttgcctgccaaagaatgaggtttcatttgatgctgcctgtactgtattcttgtcccttgaaacatatttcaaacatctcttaacccaaacactgatcttgctttctccatcctcccaacttctcatgcagttggagtgtgtcatagttttactttcatggctgccctggcaggagatacaaacggaaatctcttctagatgttctgttttacttattatttatttctttattttggtctaccttaggaagtaaaagttcatggtctatacttgaaagaggcagctaagaacatatttagaaataagtcagagatgttcaaattgacgcatttacctttatttcccctgccttaaaatagtttttctttggctatacctgaagttcagattttaaagtcatctctgtcttcctcttttctccctatagttctttgttttctaacaccttggttcatagaaattgccagtgacttacttttcattgcgcttagtcctctgctgagtgagcagagggtgggaagctggtgggaaatgggtgctccctgtgcctagagaactgagggttctttcccctcaaatatcccatcagtaagatggctgccaacctgcttcactgaaactagaggttgataaccctactggaaggttatatggatgtgattatgggtaggggggacatgtgtcagtctttcatcacagtgacttaagtatctgaagaaaaatgagagaggaaaggtttgttttggcttatggattcaaagatgtcagtccctcatagtgggaagagtgtagtggagcacaacagtagctcatagaaaccaaaaggggaggggggagggagggagggggagagagagagagagaatgagaatgaatgaatatgaatgagtgcatgtcacatgtctgcagtactggcctctcctttttctattttgtgtttgggtgtgctcatgtgcatgggtgtttgtgtataccggtacctgtgcagaccagaggtcagtcttgggtatgattcctcattagctgtccactttgtgttgtgacacagagtctttctctggaaccaagagctcattagttatactagagggatccacatagctctgcccccccagtgctgctagcaaaagcaggcaccaccacacttggctgttttctggtgatgactctcagatcttcatgtcttgtagcaagtatttgacctactcaactacccccccccccccatcaattttctgatttccacctgggccctcagcctactgtaggatgttccatacatagctttagggcaggtcttcgttcatccttagttaattcttcctagaacacaaaacaaaacacagatatacccagaggcatgctatattaattaggagcttgtcaatccagccaaattaataaattaagataaacttcaagtaggttgttgttgttgttgttgttagacaggttcctctggctgttctggaacttgctctgtagaccaggctagccttgaactcacagagatcttcctgcctctgcgtccgcctcctgagtgttaggattaaaggcatgagccactatgcctagctgactgcaaatatgtttaactctttctgtcttcttaaaacctaacttcacgtgccccagatcaacaggactaggaacacctaccttaccatttcttgtttagtggcatggagaaacctcacagcttgtgaaaatctgtggctttgaggcagagttcctacaatgtgtatgtaagctgataatccagtagtaggtggggatgggactggacagaaacagaggacagagacaacaaatagggaaggagatcactgaaagctcatgagaagagatccagagatgggagcaggagcaccagggcttccttccagctctatctatcttactgcagatgtaagggtgacctggtcaacggcatcccttcagttagtgtgtatgctagcttgtgtgtggcccaggaacagtcagttgacctcttctctgagtgtctgtctcttcatctgttcggtgaggtggttcttaggacgaagcaaatgatggagagtaaagcatcctttaaatacacccaacttcgctgtgaatggcgtcccagagctgcccctgttcaccgtgttaatagggaggtgggaatcgtacctcctacgtaatggtttgagtccatttcctgctattaactgacacatgagaaaaggtttccttgacttgcctgttctcagaattattatcaattgatagcaatgccatccacaaggaagatgtttgagccatgtagttacctaacttacagaaaaggcatttttgtttaatgcctatttctacttgggtttgggtgtgcagagtatggatcccaagtctggaccttttaagaaaaaacctttggatgtgtgttgaggggtcatgaatacagattctgtagatctctgatacaaatcactgaaggaactagcaaggacactcgactgagtccaacagaacctttataacccagtgtgtcctgtgacatacatacacactcccagtcctaactccggcatatgacatgatccttcctaagactggagaacattgttaagcagcaaggctgacctcacacctgacttgtcctaccttaacacagtgccggaagctgcctggagacccccaggaacccaccaagaaaagccccagaggggctttagattcaggaaaagagcacaatggagtcaggggaaagcacaagcaccggaagccaacaaagcccgagtcccagcctccaggaaaacgaacagatggtcatgaggaaggtaggtctccaaggccatgcatgaccttcaagcctgaactccagagggatccaatggaattttggtggggagagagttgctgagagattgagtggaaaatggatccttctttgctgtggaatagaaagagaattggaactcagaagttaacagctcaggaggataggtctgttctggtcatgagtttgtgagtaccccaccttctacagtcttaacattgaacaaagtgatttgcaaatggacacagaacactcaccaaccggttccatgaggtggcatctaggctcaaagaagaagcagctgtaagaatatttattcaaaaaccgtagaattgggattcattaccctgttttttctaccttttggtatgttagaaaactcccattctaagacctgaaacaaatagctggctgactagctagatagatagaaaggttaaacgatgtctcaaacttttttttttatcagctaagaatacccagaacgtttgatttaggtatagggtatacttgatctatatactctactgtagatggcccctcagtgccttcattggagataatccaggcattcctggccacagtagtccatgttcatgatcttgctcattggacatgacataccacttctattttactcttatatacctgtttctatgtgtccaccactcccagccttaccttgttttgtttgttttttattttttttgttttttgattcttgtttttttgttttttgtttttgttttttgtttgttttttaaagatttattttatttattatatgtgagtacactgtagctgttttcggacacaccagagagggcatcggatgtcattacagatggttgtgagccaccatgtgctgggatttgaactcaggacctctgcaagaccagtcagtgctcttagctgctgagccatctctccagcccttgtttgtgtgtgtgtgtgttgttgttgttgttgtttgttttgttttatttatttatttatttattttggtttggtttggtttggtttggtttggtttttcaagacagggtttctctgtgcagccttggctgtcctggaactcactttgtagaccaggttggcctcgaactcagaaatctgcctgcctctgcatcccgagtgctgggattaaaggtgtgcaccaccactgcctggctcagccttaccttgttaaggtccatcgaggccgtgcttctttgggacagctacagctcagttagaacttgaggaacacacaccaacctttgtgttgtgtaggcagagattatactttggagcaatctgttaaattgcttctgtgtgttgctttcattggtgtcagcaaaaatgacccagccccagttttgaaaaatcaccattcccagaaagagctgggtagtgatagcagcttaaggagagtcagttgtgttaagttagggtaactgcaggctcaatacaagcctttcggttttctcatttcagcatcccatgtgggctttctggtttatagatttcttttttttttttttttttttttttaaaaatgttcaacattcttttttttttttttttaaagatctattttattattaatatatgtaagtacactgtagctgtcttcagacactccagaagagggagtcagatcttgttgcggatggttgtgagccaccatgtggttgctgggatttgaactctggaccttcggaagagcagtcgggtgctcttacccactgagccatctcaccagcccggtttatagatttctaattgtgatatttctgccttctgcccctaaaccacacatcactccaggttccttggaaaagaaagcaaagaacagtttccgtgacttcatccctgtggttctgagcactcggacacgcagtcagtctggtgagtaagactaagggtacctttgaaaaggtagacatgaagtttgaatggttttaccattggcgtaagtagacattttgtttccctgtgacaaaatgacaggcattttgcaggaataacagagtcctgggttgggcagaaggcttgcctgaaattttagaacagtttgcttaacaatgttagattagagatttaacatcatctttggttaagagtcagtgatgcgaagaagaacggcccctgccactcaggaaatttgtgctctaacattttgcatctcatgatcattgaggcccatttgaagtcctcagactttcaacctttgggctttaatctcgtcaccctatgcataaagcattatcaaaattggaaggttcattgaatcctatgggctggcacaattacttttgctccacagaacttgtattggtttcggtctaaagaagatagttgtttccagtttgtgttcttctctgctggctctctgttgggtcacaggacagagatggttgcctgcattcacccagattgccgtgcaaattggaaggaatagagacgactaatccaacgagctgacgtcctgttaactggtccctcagcacatggcaagctctatagtaactggggcttagaatgatggcctggcggcctcacaaagtcctgaagtgtcctctgaatcatcaaagagtgattacattcttgccagtcccatttttgtgttaaacacattgtactgtatttgattctttggaaattggtgatttctgtgcgattctgtattaaccagaatattaggttaactagaacactctgttccctgcctggtccatataatgcaaagtttagtgggatagttgttgtctttaagcacttgagcaacttgaagctttggtctagggtggggtttttgttgtttgtttgtttggtttggttttttcccctccaaccacctttttcttctgctgaccttactagggtgtagatactgctgagttaacagctaggctttcgggagaaacatagtactgctccttctaaggaaggtgtgagatctgtggtgtaaaaccaggccaatttagggttgtgcttttactgttagccaagttaagggtaagtagggagagagcgaatagcctcttggcaaggtgacccaagaggataggaaagatgctgtttgtcctggggtgatcggccttgtacttgtccagcagcaaggaacagctgcagtggatgggcagacagactagagagaaaagtccatccttgaacttctgcaactatgtaagaggtaggattagtttaatggaagagggcctactgtactccactgggacatgcctgaatcagattgtggcataggaaagggactccctgcctttcctctctgtcagagacactcttcttttatgtcaattctgcttggccaaggtagctctcttggccatattggtggaaccacaaggttattaggacctaagttgtcaccccagacttccttactcatttgctcccatttgccaaccagcagaggactacagctctctcctgcccttcatgcagtgcttggctcctcatcatcactgagagtttgtgagtgggattcaagttaacactgcactggggaggagtgaggatggttcctagtacttcatggtattttggactctataaagtacgtacttaagagtggaagacttcacttgagcccccagaacagtccttcgagataagtgtacccctaataactgacagagcctgaccttgaactcagttctacaaatttctactccagggaagctgtgtcaataccatacgtaatgccttgaagaagtacctgaatgtcttctgtacatatcccatccgtaggtagcatctgtagctcttttgctggtatggcagacagtgacatgggaagccaggaggttttccctacagaggaagaggaggaggtcgctcccaccccagcaaagaggagaaaagtcagaaagacccaaagggatacccagtaccgcagccatcatgcccaggacaaaaccctgctgagccaaggccgcaggcatctgtggcgagcccgagagatgccctggaggacagaggctgcccggcaaatgtgggacaccaatgaagaggaggaagatgatgaggaagagggcctcgtgaagagaaagaaacggagacggcagaagagccgaaaataccagaccggggagtacctgattgaacaagaagagcagaggcggaaagggagagcaggtaaggctggctctaggctgctgttcctgttgtgacgtcagctggagccttaggactgacaggaacctggtactatagtcttcacatgtgggatacacagatccatcttgagtatgtgcctttgaatctagaatgaatgaacacaaactagtctacaaactagccttttaaaaatgtatatctgaacctgtggtccaagccactgtgatattgttggcttgggccactgtcttatcagcgagttatgattggcttgacagagtcaagtttttggagactataggttctttttttctgtgatattcagtttaaaagtaagacaagccaggtgtggtatatacgtctgccatccaagcagtcaggaagttgaggtaagaggacagtgagtttgaggacagcctgggttacatagtgaaaccctgtctcaaaacaaagagggaggggagggcattggctgccacacctggcatgcttctgctcacaaactaaaatgaaatgtagtaattctaaaggcaatagaaaacctgaaatatgtaaaactctctgctttctcaggtaaagccacaaggggtttttttagagttaaagttttgaggtgacataggtggccctgagctgtgaaagcaggcagttcaaaaagaaaactttctatggccatggctcatgcttaaataccatcatggaaggatagacagtcataaaaagcttgttcataccagggtacttcattaagtgccgctcaggactgttcccatagtggctttctaattgagcaaaaaaaaaaaaaaaaaaaaaaaaagctcatctctggattccatagcaacacatttgtctcttcttattctctggcctcttcccttgaaataacaatcgattgtctcttacagtgtattcacttttagctggtgataaatatgtatagtccccttattatctaaaacaaaccaagctcacattctgtaggccatagttcctgggcatgctataatgccgagaaggcttaacctcgtttctgactctgttgaagtggaggtgtatatgatacctgtccccacgctcaagagtaattgagctcattttcatcaactgtctgaacaagtggggcaattttgcccttcttttgccggaactgtaatggattggtcatgaatgaattgtcaaaccattggcctcagccgcttgttaggacgcccagcagtgtgtgtattactcagtcctctctaatgaaggctgcttgcctagcttgggagcctctcctggagctatcagctctttctttcttcttcttcttcttttaaaatctattttcctttccttttctttctttccttctttcctttctttctctttttctttttaaaatatcttttttatccctttgagacagggtctctttactataaagctctggctgtcctgaaaataactctgtagaccaggctggcctcaaactgacagtgatccacctgcctctgcctctcaagtactaggattaaaggcacatgatactagctctttcagtcagaaggacctctttggagttgcctggacctatttgctagctagtccataacactgagatagacgttgccacagcatgcatgataggggcttagctagccgttgctagaccatctgcagtaacatactgaataccagtgatcaaggtatcttgcttgtttaagggcagcccaaactattgagaagtaggtcattctccctctctgagtatttttgggagctatgcattgaagccactggtgttagcaaatcttttcatgcagaaatttcttaaaaaaaaatatatatatatttaaacagggtttctctgtatagccctggctgtcctggaactcactttgtagaccaggctggcctcgaactcagaaatctgcctgcctctgctttgcctcccaagtgctgggattaaaggcgtgcgccaccatcgcccggctaaaatatatttttattgatttttttatgtttatgggtgcttttcctgtatgtatgtctgtgcagcacatgcaggcacttactgaggaggctagaatagggcaccagaacctccagactgcaatacagatcattgtgattctgtgtgagtgctgggaatcaaacccgtgtcctcatgaagagcatctagtgttcctaaccacggaggcatctctctaaccccgggccggggggtgagttttgacaagcacgcccctcctcagaaagctcaagtctccttacctacactatttggctttcaggccagggtcagagaagtaggaaacggacaagccaggtagatcaccctcctctctaactctcatggcctctcctttcatcttgtgcttggctcgcttccttttcattctatgaaagaggtagaaacagctctttccatgtgcctacctgtcccctgcacactctgtgcttttgtaggctagcataaagctctggttcttctgcaactgagtacactccagagtttgccctgcccttggttacatggagtagatgcctgtttatttccttctttattgaactccgagatgtggttttccgtgctctccacggttttcacaaggcacagttctgtttcttcctcttgctttaaccctcttgttgggtcagaagctctggattaaggctgagtatggtgggtgtatgcctttaattatagcactcaagaagtagaagtaggcgaatctttatgagttctagactaacctggtctacatagtgagtttcaggtcatccaggaccatatactgagaccatgtctataaaacaagccaggaggtggtggcgcacgcctttaatcctaggacatgggaggcagaggcaggccgacctctgagttccatgtcagcctgctctgcagagtgagttccaagactgacagggctacacagagaaaccctgtctctaaaaataaaataaaagaagcagtgcagaatccctagcactcagggtgcagaggcaggtgcttctccaggcagccagggttttacagagaaactctgtctcagaacaaaagggagcagggatacctgctgggcaagtgagaattgggtttgttcaatgagtgtcgctgggtatatcaaccacacactagtccaggttgaatgcacacagtagttggctaacacaaaacatactccatgtttttttttaatgggctttttgttttgttttcatatttttttgccatgctgattcatttttgtttttcatgtttgtgttttaggtttttggagagagggaaaacattttaaaaagactaaaaatggggtaaaaagacctgagtttgaatgttcttgctggaagtgtcagagaccatgtagcacagcatttcttggccatattgtgaggacccactaatacactaggtggaagaaggatagtatgatagctagggcttctttcctaaatccataagctacagccagttgtgcaatttccttttattgttgttattgttttgagacaagttctgtctgcatagtccttgcagtcctggaacccacgacatagaccaggccgtcttccaactcacagagattcaaggcttgcgctacctcccaccccagccaattcactggtcttgaatagagactcctacatctgcatctgcctttggcagttttacagatgagagtccatttcaagtttggggtggcagtgagttgagaactctgggattccagtctcttcatttcacacatggtagaaactgaagttgcagctacttcattcatagccttactgatctgttgtgtgctaggcttggtgttcaggtttgtgacggagataccccttccccctagagcttgcactgaagtcatataataaatagtgcagcaacaaataagagagaccctccctcaatacaaggtggagggaggggcctgacacctgatgttgacctctgtaactgctcattacagcacctacaaatacagacatagccacacacacaagccatgcatctccattgccaatcgatacaagtgaatggtttatgtcacctacacaagaggtttaaggcagaccctatggggtgaggctcttgctagtggagtttgcagtagacctttttgaaattacaattttagacacatgttgttgccctgtgataccaattacctgatttccaatcagggaaggcagtatctttctgccattacacacaagtaggcctatactgcgctggggagtgtctgttgcatttaccttggtatcttcagacaggaactgacaggcagttagaggtgaggagaactgagctcgtaaagttagccctccactttgtacttgaaccccactgtacttgattgatacttcagcaaaactgccaagttgcttttgattttggagagggagggggtagagaaaggctgaaaagagattctggtttgctctgagctatggggagatcctttcaaaatgacccgcattttgggggccagttagatgggctgccccctgctggcaggtctgggaagcgcctcccacggatagatggggaatttgcatggtaaagcactaaaggatggtgttccatttctgtgacagtcgttctttcctgtttcttgttcagattcaaaggcccgtaagcagaagacttcctcccaaagttcagagcactgcctcaggaacaggaaccttctcttgtccagcaaagcccaggggatctcggactcaccaaacggtttccttccagataacctggaggagccagcctgccttgaaaacccagaaaagccgtcaggaaagcgaaagtgcaagaccaagcacatggcaaacgcctcagaagaggcaagggtatgtagccaccaaagggaccaatatgacgaccgtgggctagagaggccgactttctagcacgtctgtctagctgtaattctctcccagagggcaaaggaaacaagtagatgggggagggggccactgagctgtatgaaagtattctaaaagtattctagaaacgcgggacacattcaaacagtggaaactgaagttatagttaattatggggtttgacccctgatttcttttccctaacaatccttgtacctcatttttaaatatggcagggtattagcctgaacagattgttaacatccagtcaagaagctcctgtctgactttctgagacaactaaggtagagtgtaacttgttgaagccaggattttgttacctagaccaaggtttaagggtccaggttagctgctgtctccatcctgtcccctgttcctttgcctctggaggaagcctagcagcgaatgaattgggtacttagcagttagccaggcaagcattctttgaacccttttcaaaattaccagttcatttgcttctgcggttcataacacttgcagcgctgtcagattctacaatgtaccgctaaagaagaatggcatagtcctttgaaggaagtgagttgcaggtccagcgtgtacctgtgataggtatctgccattgacaacagaaaatcaaatgaccacgttgggctggtttggttagttacagctcttattcttctgtctggctttcaagtaggaattcccaaatgataccagtgagggatagatgcttgtctttgcccacctcttcctcccccgtgaatccttgttgcagcttagacaagacactcaagtctatttgctcatctttaaatggagctgatgctccctgccccttctgtctcacaggagtacttggggggaacaaaagcaatgtctgtgacaggctttgataacggaaagtgttctctgagggtcagtatgcatccttgcacttcaggcagagacaggaatgagagaactagagggaaagccagaccaactgtgatctggcatgccagggaatccattatcccaaacccatagactacaggactgataggagccactgggagagtacagacacgtgcttggctctggccgcctctttcttcttgtcactttttatttatttaatgtatgtgcttatattgtgtgtagaggtgagaggacaagctcgggtgtaggtcccttgtttgagacagtctctctgtttttctgctgcatgcactgggtaagcaggaatggatttttttctgtctccacctcccatcttcccatagagtactgggtttataggcacttgtatcacaagtccagcttttatatgggttctggggattcgaactcatatcctcatgcttgtatggcaaagttgcttttactccagctctcctgttggtgctcttaattcccaagtacttcttagaggtaggcacttatattccagtcattttacagtaaagacttatgagaggtgactcagtggtcctccttgccagaatcaggacatgaaacaaatttgtctgcctgaggaagaggcctaggttgtcaatgtgtcttgcagtctctgagtaactgctttctgcccgtttctgggcctccctaggaagtaggttagtaggcagaaaacactaccatctttaaacagttctgagacaggtagaggtccccgggtcctgccctccttcccatcttccctggccccatcccacacaaagggctcagcagcacactcatgcttctgtgtgcttgctctggctggcaccgggtctgctaaaatgttctcctggagagggttttgtctctccctgcagcctcccttccccctcctgcctttctttctctcccagtcaccacacctgctccagttgcccccatggcacggggctttgtagtaggaagcaaggcagggggaggatgggggatgctcctgcaacactaaagcgcagcattggacaagagcctcttcccacaggggctcagagccaggaggaagaggggggaggggtccccttacatggtctcacccctccccctctcgggcagccttcttgcctgctctggcagcctggctttcagaaaggaacttactggagctggcttagtgtcacaaaacctgagtccatttccccatggtttccagtcctggtgttatagtttccatcttcctagcaataaagcagtatcatatagttagtgttttcttgctagggattgtgcctccaccgttctgccatggaaactgatcaagacttgttgaaatttacccgagggcatagattccctggccctgtatcatttatctcttagtgccccttccttgactttatggaactttctaggtaactttttttgactccccaggctttgtacagggatagcttgaatcaaggcaacacataattgtaatgcgcccagctctgacttcagtgccgtaagcaacaactgagaaggtgacagtgggaccggtgcccctaaggaacttaagaactagcgagagctacgtgtagagggtaaagaaggcttgtttgatcctggagctgaaggccagcttaagcaaagtagtaagacagaatcctaatggaaattaagaaaaaaaaacttcctaggggtttcaagactcaactacccatggaaaacagcaagaaaataagaagtgagatgtcagaggataaactctgagtaggctttggacttgcagtggggccagagggcagaaaagtgcagaggacaggattggactgagcttcggatgctcgggggggctttgagtagatgctcgtgtttttagcataaacagtcactctgaaatctagcggccccgcataaccagaagcagatagccacgtatcatcttttagtttctggagctcagggtttcaggaacagcttagctgagcccagtgtggggttttgtgtgaggtcacagtccaggtgttaggcaggactacatcggtgtgtttctggtgtatgtagtttgtgcacgtagctggcaaaatgatgctgaccattgggaggaggcctctattcccttcctcgtggatcccctcaaaggtcttttctcacagaaaataatttgagagagaaccaaaaaggtgccatagtgtcttttggaacctgactttggaagtgacaccccattccctttgtagtcttacctgggtaaaccttatcccagtgtgggaagggagctacacagagctggaccctcagggataggatcgtcagggttcattgtggtggccaccccgttactcttctatctgctttctagtggattcaagtctctcatccatgcagggtctaaaaccctgctaacatcccctcaggtgaccttcagttcatagctttgacttggagccaggtgcagctgaggctgctcccatcttggaatccagttgctacagcgcagttattcctcacctagaacctgagtttgagatataagtgacctgtgcccctacagaccagaccaagggaggcacagtcgagcaagcacagaaagctcctatgtacgtaccttcaactcaaaatggggcagagggaagcacctctgtgtggcttctgcagacagacctctcagaacatttgtagtccacagcctttgtaggacttcattatttcagaagggaaaaatgaatgctccgaggagttaggctttacttaagggtcttaaagaatatatttattcatttattttatatgtacatgagtacaccattgctgtcttcagacacacctgaaaagggcatcagatccctttacagatggttgtgatccaccatgtggttgctgggaattgaactcaggacctctggaagggcagtcggtgatcttaaccactgagccatctctccagccctactttaggggttttaactagtgggtggcagaggcaaacttcaagcccagccctgtctggttccagggcctcacagtccactgcccaggatgggcctgaatataatcttaggccatggtatgaaaaaagctgatgcaagcttatgaggttggatatgggggcaggtttatagaggagtgaagggattgagaattgtgcctggtcagactgctgcctctgtgtgtctctttgttctcattacctatagacacagcttgtccaaaatgtcaacaagtggacgttggggccaggtagaaaaggcataccaagtgcttgagagaagctgggctgtctcgtcccaattttcaatcctcccgtcttgccagggtttatggggctgaggatctgatatttctaacatgttgtcttcttagtcagggtctctattcctgcacaaacatcatgaccaagaagcaggttggggaggaaagggtttattcagcttacacttccacattgctgttcatcatcaaaggaagtcaggactggaactcgggcaggtcaggaagcaggagctgatgcagaggccatggagggatgttctttactggcttgcttcccctggcttgctcagcctgctctcttatagaacccaagactaccagcccagagatggcaccacccacaaggggcctttcccccttgatcactaattgagaaaatgccttacagctggatcttgtggagtcatttccccaactgaagctcctttctctgtgataactccagcctgtgtcaagttgacacaaaactagccagtacacatgtatccacccatggaaatgcaggggctttccttattttgaaaataagctcacatgactagtgactaacctagcctccaggctcccaagctgacagtagactgggccacttggcatagtgtcaataaaggaaaacatgagtgccggatgtaacgaggtggctttcgcagccaaatggcatggccatgatgaattggatatgttgcctggcctgacccaggacttcatttctgttttccagagcaaaggtcgttggagccagcagaagacacgatcttctaaatctcccactcctgtgaagcccacagaaccatgtacaccctcgaagtaccgaagtgctggccctgaagaggcctcagagtcacccactgcccgacagattcccccagaggcacggagacttatagtgaataaaaatgccggggagaccctgctgcagagagcagctcgcctgggttataaggtgagtaagtctccctgaacaggcgatgacaggatgacgacgttggcctggaccttagggagcagctatactgttggttcctctgcatccgatggtctccctctactctgcacatggcctctgaggatgccccttatgtgcgctcctctttaaaatgtcagttcaggagaaatgcatttgaaaaggtagcacaatatcgtccactgcattcctaggctatgaaggggatttgaaattttcactttgtcttaggttaacaaaggggaagtaatggcttccccaacgacacgtggtgatgattactggttacacattatctatctcctgtggtttctcctcatttgggctttcaggtagaagggttaagagcctgttcaataatcctgggctaacccacccgtactacatactttcttaaacatgggaatgagaacaaacaaggcaggcttccttccttctttccttctttcctttccttctttcctttccttctttcctttccttctttccttccttccttctctccttccttccttccttccttccttccttccttccttccttccttccttccttctctccttccttctttccttctctccttccttccttccttccttccttccttccttccttccttccttctctccttccttctttccttctctccttccttccttccttccttccttccttccttccttccttccttccttccttccttccttctctcctttcttcctcctctctgtgtaatagtcctggctgtccagaagctcactctgtagaccaggctggccttgaactcagagatctcccccacctctgcctcctgggtgctggaattaaaggtgtgtgccaccatgcccggcaaaaggcagcattccttgagtacttattttatcatgttaaggcctttgattatagtaagtctgttgaggtaggtcttattcctagagttagcagtatgaaatgatatggcaagatgtatgtggtagattacccaggtgataatccaaagccctgggaagtagagataggcaagtcagcaattgaaggccagcctcggctacatagcgaattcaaagccagcctgggctaccaacaaaagaaaataaaatgtgtccaatatcagttatgacagtacttttgtctgagttcaaacacatcctgtgcctcccatgtgagatgtacctgaggctgtatgttggtgcacgtttttatccttgtctgctctctgttgaaacacatacctttggctatgtatctctgccccactgtgtgatggtttccttgggatttgcttgtggatgcggacttatccacattgcagagtttaccttctctattaggctttctgtacctgtaagggtccactctggtctgtgcaacttgcacggtgtctccatcaagctgccaatgtacctttcttgagtatttagtatggatgtctgcatggctctcagggagacctcaggatgtattgaaatccagtctccgcagaaacagcaaacaggagaaaattggagtaagactagaacagagctggacacccccagcccaggcacagagtagctatctccagacatcctctcacggtgtctcctgggcttcctgagagcactgacagcagaactagtgggtaccatgttctagaagcttcacccaatggaactgccaatctccatcccagtttattcatagctttgtcccacggtagcaggaatgcttcaagtcacttgagttctccctcttgtcccaccatctcagctccaggaaggtagcattacccgaggctgaatgatagaagtacattgtggctatagatctaactccattgctttgcctagcaggcacagagccctggtctcaattcccagtactacatcaattgggtagaatggtatacacctttaatccgaaagatctgagattcaagatcattcttggctatatagggagtataagagcagcctggctgggcagtggtggcgcacgcctttaatcccagcacttgggaggcagaggcaggcagatttctgagttcgaggccagccttgtctacagagtgagttccaggacagccaggactacacagagaaaccctgtctcagggaaaataaaaagagcagcctgggctacaacaagaccctgtctcaaagcaaaaaaccaaagtgaattgtggagttgtgcttgcctggggtaactggaatttatgagcctgtcaggagcagagttcccatgtatatcttgtaaagctcagaaaggtgattgctgggcagcagaggagcctctctgaagaccttactccaaagatcaccacccagatgagtgcccttggccataagaaatgtcttcctcctgccaagggaccagctcagggctggggcccagcaatggaggctgagaactacctttgttcacaaaagattttgaattgtgtcatttgtttcctcgtataaagaacaggctgtaaaacttgtcagacacttgtggagtggcaagtctaacagggaggattcaaaaaacttcagacttgtctttgctcacagagctgtctcccatccctacaggacgtagttctctactgcctccaaaagcacagcgaggatgtgaatcaccgtgacaacgcgggctacacagccttgcacgaagcctgttcccggggctggactgatatcctgaacatcctcttgcaacatggggctaatgtgaactgcagctcgcaggatggcacaaggcaagaaggctgttcctctgccaagtctcagacctcagttcagtccctcgcttcagagctttactcagacctggatatttgcagaatgtccagctgctggtgtcaaaaaggctttaaccaggaagccttttgaaaggatgtctgaagggagccagcttaggggcaggagctgatgagttcctcaatggccagtctgtatgggactaaggaaaggctgaggttgtccagggttcactctgtcccatgccaagtcaatccactcaaccctcctgaataccatcatcgtcgtgggccatttatctcatgtggaattgaggccttaggttccaagcagagcactaatctaggtttcacattccagattgggtttttgtaatttagtctctgtgaacatacaaaaaaattaactacctgggtctgtgagattggcttgatatatgtaggcacttgccttcaagcctggccctcttggctgccacatgatggaagaagagagccgattcctgcaagttgtctcctaacttctgcacacatattcatgcacacacacacacacataatacagaaataagtaaatgcactacaccatattaatgtgcacacataaacaaacataaaacctttccatgtctcagagaagtcacacccatctcctctactccaggggaagtgtataccaagtagaaggggccagatcaaagtgtacaggctctgcttggctgctacctggtgtggagcctccctacctatccaaccctgcccttgcgcagtcacctgggcccttcctcttccacaaccacccacacctgctttaattttaacttccaccagggacctgttctccactgaactcctagtagatcgacattgtgctctagatactgtccgaagatgcgggggaacacagaggagagacaaatatgggaaagaaaaagaggtgcacagagacaatatgaagcgtaggccagaggtggctcccctgctctcttacccatgttacactggggttacctcgaggtcaccatactatctttctcactcttcttccccctaatatcgcattgtgaaagttctccattaaatcctgtagccctgactcttatttgacctccacaggccagttcatgatgctgtggtcaatgacaacctagaaaccatctggctcttgctatcctacggagctgatcccacactggctacctactcgggtcagacagccatgaagctggccagcagtgataacatgaagcgctttctcagtggtaagcattgaccacagttgcagccagaatcctcagggtttgttggccttggactcctcaaccgggggatgggggaggtcttcagtcactctgtcctagacagttcccacaaggatgtgttctgtcttcacgtattccttcagtgtcttggcaatttctagctactttaaaaagtcccttgctgtgagtgtccacatcactacctcagtaaggccctcacctcctacagagattcatttcaccactaggtgtctggagcagacctcccaatgggaaactggctatactcttggctggaagcaggatatgttgacctgtgctatgaatggaatgtcggtggtagagaatgaataatccccattttgctgttgctgcagtctcttcttgattgtaattaaagtgggacctctgggacccttcctgatgcttgattctttgtggctcttctcccatggtaactttgatactttctatgcattccagtattccccttctctccattcctgcctcttctccaccctctgccttctagtgaagtgtcatgttcaggtccacggccagggccacaagtcatttcatagatttttctctctagtacgtagcactgtgtgtcagcaggtaggcaggctgatctgagttgggcagctaggatgggaatgaaagagaagactctacttacagcatgctcagtgtcagttccttctgccgttatctcaactctttgtgacatcatggcttagtccttcggattgcctgagtgatggatgctgcagttgggagttgcagccgtgaccctcttcataggcttcagttgtgatacaaacatctattcccctcttacccaaactttggcccattggtcaccaactacacctgccaatgatgcagcactgggttcccaggttaggcgggagtcacgcttgcttaagagaattttgctgagtagctaataatgtcaggagtaagagaacctatactaaaagttcccatgggagggaaaagaggtggggatattgtagaggctgcagggaggcaaggggatgacagattgcctaggaagggtttgacttgtgcccgtccaccctccaaacagtgcccttaactaacctctgagtataggcctcaggctttccagccttccttatcctcgggctaggggaccgaccggaggcttccttttttaatttcttccatgacgctgggtccttgagcatctggtcatcatgagacatagtcacttagggatttctttccatcagtcacttagtgtaggccagtaatgactggttattaatcctttcagcagagccactccaagggtgcaacatctgtagcctcctcccacgcgtgtacacctatgtatattctgtcttagatgtcagcatggctctgcaggacaatgaagcttctttgtctttcgtaacttgtctgatgggggtggggggctgcaaaccaggtagcacctctggttactttattgaatataagtgtaaacctttcctccctgattgatctgtcaaactccaaaagactttaaatgttgacactttgttgattttgagatgggatctctctgtgtagtcctggctcttctggaacttgctatatagaccagactagcagagatctgtctgcctctgccttgtaagtgctaggattaaaggcatgggccaccatactctgccaatactattttttaatgcctaaaaaatgagagataagaacttcttctctttttattttctataaactcatcccaatctcctaggtaattgttttaaaaaaaaataacacttttaacgataaggtctcactgtgtgactctaatcagaacttgttgcttatatcaggcaggcctcaaactcaagaggtctgaagttttgtcttaaataacatctgcttgcctctgtttcctgaatgctggaattacaggtgtgtgcaactacccccagccaaaaagaattttaagacatgtattacatgttttatgtaattctattatgattaatagaattaataaatacatttatcattatgtaaagctattctgggttacatagtgagttccagaccagcctgtcctccttaagtgaacaaacagcaagacactgcttaaaaaaaaaaaaaaggaaacgaaattcatctaatataacagtttaactgactaattctatgacattaagtgcgttcatgatggtgataataaccatcattgggggctctgatgcctcaaaactgagcagcgcctctcttccgtttcatccctggatgctacctcaccggttccccaggagccataaggtcgaatgtttctgaggtaggaaggtagggaggtgctcttcttatgttacaccatatatccagctacctatgcatgggcggcttttgttggtgttttttcagaggtggaggttgtttctggtattgctgttgttgttgttgttttaaatttcagttcacctgtctggctgagacatttaaaagtatcccattcatcttcaagcacttgcttagccaggtgctgcagacatgcattgtctgcgtcctccctagcccaagtcttccagtagaaaatgaggcaaacccatgtagggtgctaaggactccatattttgcaagcatcaggattgggcttcatggctagctttcctcattctgtgtaaggctcctgctctggaatggttgcctaggacggaactcttctaagaaagctatcttgtttacatggagcatggagctgtccaaacccccaagagatctaggaaaggcttcccccatgggccatcttgctaatttacctttgaccctttggagaaaaaaaaagagcaatatccaatgttactgcgagggaaaatagaccgagttttgcctcctctgtggaagcgcacaggaactgtgcagttagggctcagacattagacttctttccctttcactggggaaagggttagccaatgaccagtcaaggtcactgaagcacacagttttggttttcctgcagagacttctatgatatgaagccatattgaagacagctcatttctttttctcctttcatgtccctcagctggtgactttggttgggtagggtatgctaggatgctgggatctagagaaactctactagctccaattccatacgtgggaacaaggttttctctacttaagaatgaggtactgaaggccgggcagtggtggtgcacgcctttaatcccagcacttgggaggcagaggcaggaggatttctgagttcgaggccagcctggtctacagagtgagttccaggacagctagggatacacagagaaccctgtctcaaaacaaaacaaacaaacaaacaaaagtactgctgagggggctttcaataaaaaagtgtagggtaagattgatgaggtaaaatgactaattgatcaaattactgatcaccacgtgatcgtcggttcagtgccctttacttcatttacagggttccagccgctgcggtctagttctgaaacattatcatcgtccttgcatacaaccttgtacaaactgtttattcccgtcaccttcttctcagctcctgcagttgccaatctgcactcctgtctctgtggctttgcctattccagacatttcatatacatggaaccctataaggcataatcatgtagtatagtggttttatggcccatctatatgctagcatgtttcagaactacactcattttaatattctatcacactctctccctctccttctcttccttcaccctctgtctgtcagtttgtatgcgtgacaaatgtcagaggacaagttgtgggaacttagtctgtctttccatgtgggggcctgggattgaacttggatcttcaggctgatggtaggcacctttacctattgagccatctatctgacccaacattcttttatgactgactaatagtgtgtcctctgtgtgtgtgtgtgtgcgcatgtgtgcgcatgcacacgtgcacacactatttttatctgttcattcatgcatagccctttgcgctgtgtccatcttttagcttttccacggtgcagctttggtcacgtgtgctccaatccttgttttattggtcctggtgcatttgtatgtgaacaggaatgtttacgctcacaggagtttctcacacaacgggtaaaatcttgcaagtttgctggggatgaaggcagaatccaagaaaataaaggccactcattttgatggtagtcctatctgaggactatggattaatgctataccatcaggtgactccgcccacgtgtttgtcacgcatgggcctgttccaactttagcatctttgctcatgccagctaactttggcaggttcacctgtccacgacaaagctttgcaggcggtggagagaattagaggaatgtgctgggctctgaaggcgattcctagtgggagccacaggaatgtggtgaacttgacctgctccagtggaatcctgtgtgactgcgggtagggggacaggggcggcggagtgcatatgttttggcacactgcttaagcaagccctttgctgtctcactttattgtgattctctcctttctccttagtcatcctcttccctagtatgtttcttagtatgttcttctcttagtatgtttattaagctcttcttaggggccagacactggagttccggcaaaggagggacagtagttaacaaaaagtagaccctgttccttccttttacagaaagaagggcctccttcctttattttctatgatacaaagcataggactagactcagagtagactagacacctgcccaacagatgcttctggaaggaagtccttgtgatttaggcagtacagtgtactgaagatgtggaggctgtcagcggggcctccattttatgtggggtgtacagagatctaacctccacaacgtaaggtgcctcactctgctgttactttaaaagctattccctggtgccttcccagtgggagcctgagctcgtcatgtcttggaagatggctaagaagggagtggctttggaaggttacattaacagacagttcttgctgctggattggtccagaaggggcactgggtggcgatggtaccttcagtggaggaagcaagctgcactccttggggggaataactcccagtggaattctgggactggctttgcaggtgaccaccctcatctccttgtgttctttgtgttctcttctttcctgttacctaggtgctacttgagagctggtggcgatcccccatcgctcagccagcctgttaattgtacaattgggcacactggcaacttcctagccttgcactcacaggcttcatcaggaaagcctgctttgtatctgggtggggagaagaggtgaacctgtctactgactgatgctaagaagcagggaggctgagggcgacctgaggcctgtctttagagctagccaatgaaaggtgggttgtaaacccctttcattgtgggagtagatacatagaagaagttagccacttgagacagctgtgtgatggagtgttgttgagtcacagtgttgtactacagtcaccactatctgctttcagaacttttttatcattgcagagggaaaccccagatctattcttagtcactgccctcccccccacacacacactgccatccatgcttagtctgccttctgtcttattgactttgcctagtctggagatttcattgagatggatatatatatatatatatatatatatatatatatatatatatatcctttgtaactgattcttagtagcatcatgtatttccagtatgtgacatattatcactcttttttgattaatttttgtattcgctttacatcacagtatcacccctcccattaacccctactcttttctttatatggcactttgtgtctggcttctttcacctaccattcatgttgttcctttttatggtttagtaatattcttctttgtggatattacctcattctgtctgtccattcatcccttgacggacatttgggctgtttctgacttttgaccattgtgaatggagccatgtcagttcatgtggacagaattttgtttgaatacttgtcttcggttctttttttaaaaagtaatttattgtgtgagtgcatgcatgtttgtgtgtgccacccttacaggccacatcatgcaggtagcagccactgggcacgttttggggtggtagtcctctcagagcaccttgttttcaagcaggatctatttttggtgtgatgtgctccagcctagttgagcttttagttgactctcctgtttctccttcaagtcttgctggtggagttctgagactataaatacttcctaccatacccagctttttccatgcctccaaggatcaaactgttaccaggcttgtgcagcgggcactattacctgctgagccattttctagcactgcctcttgagctcttttgggtagaagcaaaggggtttctggtttgtttgtttggttttcttttttttttttggttttgttttgttgagacagtgtttcttctagtggcccaggctgacctcaaagtcagttttcttcccttagccttctgagtggtagggtgtgtgtgtgtgtgtgtgtgtgtgtgtgtgtgtgtgtgtgcacgtgagtgccaccctgctgttatttatgtattttttgagctataaataaacttagattcttgcatgtgctaagcatgcactctaccactgagctaccccatagctacttaccttactttatagaagctagatcgtgactggacacacattcctattgtgataggcgtgggattctgcttgtagaggaatgccctgtgccttttgaagctgaggtccccaagtaacagccttcaggctgacgtgtaagcgagaagaggcccagtggggactggaggctgtacatgtgtcacagtgtcctctggccaactgttgacatagaggaatgcagaggcagtgctgccagatcttagaatttttatcttttttatatataaaatgttggaaatctatttttttaatttaaacccccatttaataatactagagggtaatttttccttttattaaaaactaggtcatacatcagtgaggctacatgggacttctgcttgcttgcaatctgttgtgtctctttcctgtcacccctggccactcttgtagccttgcccacttcccctcccccaaccccatataagctaatcctcaagagctcctctgtgtctcacacctacctctgttctctcatcagatcacctctcggatcttcagggcagggcagagggcgatccccgtgcgtcctgggatttctacagcagttctgtgttgggtaagttcagagtgggaagaagctgggagggctggatgcagctccgtgtggctcagaggtaggagccccgctgtggaggcagcctttcctcacctgctagtagctttacgggccctttcagccctccccctcagtctcaataatcaccagtctgaagcctgagatgccacaaggatttgcacaatgtcatcctctcctgccttgtccctttccccacccgggatgctttgtaatcctagagttacctcaaatcctagtgttagccccttacccggcagctttcattgtcccccactctgtccctgtgacattgccctcattcgttttttttttttttttaattttcttctgggaagggtgtggtggtggtttggtttggttttcttgtttgctgctctgttttttgttttgttttgttttgtttttttgagacagggtatcaatctgtaactctggctggcctgaaactcacaaacacccttctgcctctgcctcccaagaacagggattaaaggtgtgggccaacaaggtgctgggcttagctcttagtttttgagattgctgctgtcctgggcccttaaccctctgtcacaagcactgtgcagcaggaagctcagcacaccagtgtctgccatcatccagcgtttgtctagtgagctgggggccgaggagtaagagcagaaggctgagatgaaatacgtcgggccgcacccggacgatcgatcgggtggagaagggaaccttctgagtctatggaccttgggatcgggcagtgaggtggatggaggaacctgcagccagaggacaggtggactagcccgtagtagctgctagtgtcttccgtctttatctgcaacagctgagcttgcaaccttcagggcactttgcttttcccaaccagagggtggagaaggataatggccttctggccacagcatagttccttccaagactagaactttcctgtgccctctccagaattcgagtccatagtcgatccagccaggggcctgtggccctgtatttatcccctaagtggtcccttcatactcctttatggagccgttcctttccttcagttttgtgcttgtagctgatgccccatgttctcatcctacagagaaaaaagacgggtttgcctgtgacctcctccataatcctcctgggagtgccgagcaaggagatgattcagaacaggatgacttcatgttcgaactctcagacaagcctctcctcccttgttacaacctccaagtgtcagtgtcccgtgggtaagtgtctgggaagtctatggagactgtgtgacagtgtcctggcaacctgtggcctgcttagggaaggaggagctctgcagaaggaggcacaggctgtctggggaatgagtgctggagcagaggaaagacaccctgttcctccagtccaaactcaagcttcacagacctccagagctacacctcagctatcaacttgatgcatttccaggcccccaaatcggaagaattttgtgcactgttgtgtgtggaggcgataatctgggaaatatctgggatgatgaactattagaatctctggaacatttttgtggtttctggggacagttacacagaatacttgcaattgaaattcttggaaaagccaagacatatggtggccatagctttggatccaccagaattcttagcaatgcaaagcacagggcttccacagcctgtggtcagtaaggtgatcagttctccaggctcagatgactctgagaacatgagaacacccttttttggagactagagtatacctcacacccggtagtagactgagcccaactgactcttagctgagggcagttcgtcagccttcaagcccatggcttgtgattgcttttccagtgcatcatatggaagtgttaggcagatggataaaaatgctacgtcagggcgctggagagatggctcagcgacttagagcacatggaaagggcccaggtttgattcccagcacctacatggtagctcaggaccatatataactccacttccaagggatctggtgccctcttttggtctccacagacactaatcacatgtgtggtacatacacatgcctgcaggaaaaccctcatataaaatgaatatatctttttttaatgcaggatcagttaaacataatttttttatgtaggatcactcacctttttgttcttagtctccttgttctggacagaagctgatcccagggggtgaggctgggcctctgggatatagtattgcacagttgattatttcccccaaagtattcagcacctccttctctgaaactggatcctgggccacaggcagtaaaagaaccagagtcgttttctctaggtacagacagaacatgggcaacccgttaagccaggcgcatggacctctgagccatgtatgtgcctgctgcctacagaggccagatgaggccgttggatttactagaactggagctgcacacagtcatgagctgagccactacataagtgctgggaattgaactcaggtcccctggaagagcaagcagtgctcttaaccatggaaccatctctccagcccctttatcctcgttctttgaaagagttggtccacatatatggtattgattgttccgttctcttagctgagagcgctccattccctaattttatgatgtggcagactttgccatggaagaaatgctgaattttagggaaaaggactgagtctaaatagatgagagtatcttgttttgttgatacaggatctatatgtagccctggctagcctagaattcactaggtagacaaggctgacctcaacccacctgcctctgccttccaatttctgtaattaaagacttgagccaccaggcccaggtagataggcgttttagataccatatggaatgactgatcccataaacatgttttataccctggatccaaccttgtgatccatagtacagataactctggccttcaaaacagcccagctgagtgtagtacacagggaagtgcgcaatgaactttaataagaccaaatgctctaagcaggtttattactataaaaagaatgtcaagtgaaaaagaaaaagttcacttcatcctgagctctggtgaagaccagagaaagccagagtttatgttgactttgtagccttttggaaatgggctgcgtgtcatgagagcgtagaagatgtactgaacactcaattacttgggggtttgtaggttgaaaatggcatccgagctgggctaaaagaaggagaggcacagggaaggcatgaacaaaggcattatagcaggcacactcaagtcgttcagaaagcaagagccagatgttatgacacatgcccagcacttggagacagaggcaggtggatctctgtgagtttgaggccagcctgctctacagaatgaatcaccagttagctaaggttatatagtgagatcctctgaaaaagggagggcgagctggagagatggctcagaaattaagagcactggtctccaggatctgtgttcaatttctggcacctgttatggttgcccataattgtctgtaacaccacttacaggagatccaacattcatgcaggcaccaggtatgtacaagaagcatacagacagtggtggcgcacgcctttaatcccagcactcgggaggcagaggcaggcagatttctgagttcgaggccagcctggtctacagagtgagttccaggacacccagggctatacagagaaaccctgtctcgaaaaacaaaaaacaaacaaacaaacaaacaaaaaaagcatacagatacattgggcaaagtatctatacacataaaatttgtaaaaaaaataagtgtttctggtaggacaggaatacagtaccggtgagtagctgtgggagctgcagactgagtagaagaaattgaattggggtcatcttttggaggtctgacttaatactacacgaaaaacttgctgtgtgacctggaacttactctgcagaccagcctggactcagattcagagatctgcctgcctctgcttcccaagggctgggatggaaggcaggtgcctccaggcctggcttctattttctttttaattatgcatagatgtgtgaatttgcatgtgtgtatatagacatgagtgtgggtacccaaggagatctgcagctggggtcccagcaatgaggcagctgacgtgggtactgacaattgaatctgagcactagaagaccagtatatgctcctggttgttgagccccaagtcggtatgcttgctggaactaagagagagccatcataagctattcagtgaggggggagacggaggtcatattaccttttaagaaaagagggcccgagggcctgagaaacctggtatgtctcactttctgttcagtacctttagtcttaaacctatgtacttaagcctatattaaaatagctttattaggttggtcccccattaagaaaacagagacagagcaagtgtaaggctggtgtattgtaacccaaactagaagtggcaaaggctgcagaggagaagtggagtgactaggaggaagaactataaagtggggtgagcgagtgaggggagactgcagcacttcctcctgggttgagttcctgcaagtgcttgcctggtaagcagaggcctctgcagtgcccctcccagctgtccctaggctgccgcccagtctcagatgtgctccacaagggcagactggctgtaatgtgagccctgggcctgcagaaacattggtgctgccgctgctggaggaaaaaaaagttgtctaatacattccagagccaaagagaaatgccttttggattacccacagtttaggcctttctccacagctccacctccaccagggaagatctagaacaagtgagcaggagtcaggtcaggagagggaggccaggcagggttgcctagagtgggggtcaggaagatgtggccccagcagatagtaaatgccaggccatggggtagcaggctaagcctagtttgcccctggcttgccttctatggaagagctagcctgtggggtgagtactcagtgatgctcagctagaagctggggcaggtattgtgctctatcccagcctcagtccagagactcgtggtttcctgagaggcagcagttaagtgtcaataggaagtatggctgtgggggtggactgtgggggtcacttggtctcttggccttctatgctttgggggctccactccccctcctgagcctgcttccctaattctttctttgcctttccagaccctgcaactggttcctcttcagcgatgtcctgaagaggctgaagctctcctcaagaatctttcaggcccgcttcccacaccttgaaatcaccaccctgcccaaggctgagttctaccggcaggtggcctccagtcagctgctgagccctgctgagaggcctgggagcttggaggacagatctcccccagggtcttctgagactgtggagctggtgcagtatgagccagagctgctgcggctcctagggtctgaggtggaataccagtcttggagcagttgacagaaacagcccctctccccgtcttctttctccttcgagttcacccttcccccaccgctcatgtgtcccccaccgagcaccagactgcagaaagaggcaataatacggaccaacaagaagccgccttatcaatgccagcattagtgactggattcctttcttttttgggggggggagggggttacagttagttctcatctccctgttgttgttgtggttggtgatggggtggaaagttgaactccacttctgaagacaagaggtctggagatggtgggaggtggcaccagggtcccttggactggcttctacacttctgaccaagaccaaacatgggcctgggtggctgtggcctgtcctaaggagaagtgagaaaaacccaaatctcttgagtgcccccttttgtctccctgtgctcttctgtcttccatagtatttattttattagtatttaatttgtattgtttcattggtttctgataagtctgtatcactgtgacgatttgagacaacttgttgtattgagggactttctttacctcctctcccttttctttctacgtgagctctggggatgctcgctccctccctccctccctccctccctccctccaagaaaagtattcccagcttgtctttctccatgtggggagggagcagggtgaggaaggatagggggacatcatcatatgattaaacaacctggctgctgctgacctagagctggggggctgggggcaaatccctggcctttggtgctcccccaccccctgccagttttaccccaccctttgtagcagctcttccatcttgagattggtgtttactagggagcagggttcctgagctgctccgataaaggcaggttgagatgggcctgaggcaagggtgctcctcacactgatctctcagtgcagtttgaacttgttccagcatctttggccctgcacccctcccctacttgcctcaccttacctaccctgggctcctcatctggaaatattgagcctttgccttgccaccactcccacagccttacagcatcctctacccctctctcctccacctgccccccaactctcctttggaatctgtaaagggcccggaactgactaggctccacatcaactcggggaatgagtgagtggctcctaggcctttggatgcctggttagatctggtaccagagggacggaggaggagcttgggttgtttccctggccccacccctccatggcattgtctccccccccccttcttatttttctaccgattgctatttttccgaacaatccttgtagagagtatgtaccatccaaaggcaggagggccttgctggggttggctctggatggagatggtacagttttattgtacaggtgctaaactacaacaaagaagaaaatagaaaaaaaaagacaaaaaaaaggaaaaaaaaagccagtttggggatgggacaatctgtcctctgggggctcctgacccatttaggagagttctttcttttaactgtgtgtgtgtgttttgttcccagaggaatttctgagtccccttctgtaggacagccccatcatcctacccaattggttttgaacaactgttttccctttttaacggcaacaaaattatatatatagatatacatatatatatatatatatataaagttgggggggtggatttcaattttgttttgttggaaattatgatactgtgtggtttgttttctggttttttggtttgcttttgttttgtttttcttttttgttttgcatttcggtgtgtattctggctgccctttatgtttcgttttaagcaactggctgtggagtcaaaaacacttgcatact

SEQ ID NO: 796 - DNA, 64280 bp, mus musculus; identical to SEQ ID NO: 795

SEQ ID NO: 797 - DNA, 1027 bp, mus musculus
tcctggggcggggggggtaaccataggaattaccccactgaacagaaaaggaggtggaggctatggtcttggaagtacctggccccaaaccctgatccatccaaggatccgacgatccgaagggaacctggccaacagggcagggcgaaaaagggcttgttattttttggggggggtggtggtgtccgtgatgaagtcttgaagagaccgggagaaaatgccctccaaccttagaggtggaggtgcgacgggagctctctcggggttgctttctcctcttttcaggggtgcaggaaccgtagggtaaggggtacccctaggtggcggcggggcctgggttcgggagtgggagtgctgtgatgggggcaggggcaattatccgagtccctggaaaaaaggcgggggatgacttcggagcgcccaagctccgctgccctcgctctaggggcgggggctaccgggccaggcgaggcggggagggtgctcaaattgaagaaggatgagatgggggcaattcatactggccccggcaagcctggtgggagacccagctggcttgcaagccctcaacccgcttcgcgccaggcctggaggctaggggtctgggaggaaagcagagggctggaaaggagggaggctccggttacggggccggatttcgggatcaggggcaatcccctggcccttggagagggagggagagggatggccgcgaaccccagggttcccccaccctgcttcataaggggcgtgaggaatggacagcaggcccagcggagctggattcaagcggatcgtggccagggagtgggggggcttagtggtggtcttcgggggggagtagtccggcggcggggcgggcgggcggggcgtggggctccggcgggcggcggggcggggcccgggcggcgctgctgccgctgccgccgccgccgccgctcctgctagggccgccgccgccgttgctgccgccgccgccgccgcttctgggcggggaaccgaggccaaagagagtcccgtgccgggg

SEQ ID NO: 798 - DNA, 1027 bp, mus musculus; identical to SEQ ID NO: 797

SEQ ID NO: 799 - DNA, 28306 bp, mus musculus
aatgcttccgggttggcgctgcggtggcgtttcctactgtggtagcctccgcttcccagtcgtctgctgagcttgagcaggtgagggggatgctcctggacttccaggttggggagcggggctgggccgcgccaggccgcgcggggccgggttggcttggttcccggcctgggaggggcttaacggtcctttgatctctctctctcccctcagctgagtcccttccctgtctttcactcttctggcatcggtggctttacttcttcgattgagctctgcttcctcgaccccccgggaggccgcctccttcaggcgcctcccttctctctacgaactcgctctgacagccgaggaactggcaagatcctgcacccagagggtgaatgggtatctttcccggaataatcctaatttttctaagggtgaagtttgcaacggcggcagtgattgtaagcggagtaagcaaccccctccattgtataagtgtgagggatgctgttgaaagatgctccccatcacttcctatccccctgtcactcgtgaggttcaggcattgaaggcatctattaaaatgcagttcagttacttgattgggatcacagctattatcaacatgaattttgtttctcagacaaggtagtagcagggacatttatagttttctaccagtgtgtccttgcccaaaccatagagatgcctagactagaaattaactctttcctcctcttcatttatatcatgaagtgtcttttgtcaatgtctcaacagtttaacctcattgtcaattagcattctttttttttttttttgcctgcttcccactctcctaagctattttcctacctcttctgtttgcaatccaccgtgctcggggtccctagtagctaattacaataggctattaccttaattcacttgcctattaatagatctagtcttcctccagcaccttgtttccaagccttccagtagaatctaccccttttacttgtttcagccaacaaatttattgcttattctgctcgggtccttcatttctgtctcagtacaaaccattggtgcacatttctacatgagtgtgcgcatttgcacatcttaccccacctagatgtctcccttccctgctccttttttttatattaaagatttatttatttattatatgtaagtaccctgtagctatcttcagacactccagaagagggcatcagatctcattacggatggttgtgagccaccgtgtggttgctgggatttgaactcaggaccttcggaagaacagtcagtgctcttacccgctgagccatctcgccagcccctccttccctgcacctaaccagattcagtcggctctgtggaaacccggcttaagttctctcacttccaacagcttttacaagttgtttacacacatgcgattgttttctgtgcttctcttgatctcatagactgctctacgttttaacacttcatttttctctaacaaagtattcaatttcatccaccagatgattgggcagaaaagataggaagaatggcaattactgtcttttgttagattatatttgtgaatttattggttttttttttttttttgtaacagggtttcgctatatagatcaggctggctgcactcaccgagatccacccattttatctctcaggtgctggattcaaaggcaggcatcaccacaccctgctgtgattacaaaacaaacaaacatgaccaattagattattaacaaattgctggtttgagtattgagtatgccttcaacacatagatttaggctcccaattgctatcttctaaacatgagaatttctaatacctactctttcttaaaggagaaaccaagaaggttaaccagaatttcctgaccagactttgaagtaagtgtaggggctatataatatggattctaggatcttttattttcacttgttaggctatcaagatagccataatcagatcttatgaagagatgtacaaattctgaagccagattttactggtatctttctataataaaaatatttagggtactgtatttatattgttccttagataatgacttctgtattttcacccaaaactgaggttaacatttacaagtcaaaataactttgaaaggagtttggtatactttacaaagcaattctctgcaacaaaaccaagaggcaagggtttgtaggtagaaactttggcaatgagagtgttgagcagggtgtatagtatagtctagaggcagcaaattccttttgcggcttcctctataatggtttatatacagttgcatacacaagatagtcaacgactggtttgtttggactcattctgtgataactcctatgaggtttataagaagttttgcaaagtgtggtgtcgtctttttaggaatcttacctatttaagaggggaagagacaggacacctagagaataaacctcaccttactcatcattttatgcctgaatttaagatgtcagagaaaaaaggttctcagaaatatgcatagctgtagaacaggtgggacataacttgcatacatgatacagctttgtgtgaaagacgggtatttgctggaacattaatgtttcagttgtggaatgtgcctctctcaaagaaacagaggttttcagccttagtaactaaattaaaacacataggatgtaggaaacgatcaggagtatttagtctgagaaagaaaatatagaaacatgaaaactgactttaaatatttgaagggctcctttgggggaaaattaatttgttcagtgtacctctaaattgttctagtatgaggaaggggtggtataaagtctaatcagaagtgatacaaaatttctttcgtgattttcctttctaacattgaactgaaagagtttatcttgtgtgactggggaggtgctataagggaccatcttgattttggtcagttgtctacagggttgagtaattttatgggctaatgaaatttaaatcaaagtatggtggtggggatacctataaagattggtatgcttattttatcaaataagggcattaaatattaactactcattaccattatcattttatataagatgatttgtcagtgtcccagggataatgatataattaatagccatctaatggcatatatttagccggaaaaaaaaagcagctctagatatttttttcatataagccctcaactgtgaaaacttcattgggggaacccctgagctacaggacctaggatccagtgactgatctttctgcttcctagtgtgactctgtcccgaactttcaggaattcattattagagagctcctgcactctaggcacatcttccttaattaaaagattgggtaggggctggagagctgtcttggctgttaagagtagtagcagctcttttagaggatccaggttcaagtcccagaattcacatggcagctcacaaccatctgtaaccagttccagagaatggaacaccctctaatggcctctgtggctatgaggcatgcctgtggggcagaggcatacatacaagcagacactcatatataaaacagtgagaaaatgttgagtagtaggtagtagagttatggtagagttcttttattcctcctgtactggcaaaggatgcaggaagttgtaaagggaaagtttgggggagcagcacagcagacatctgaaccatcaaaggctatttaggggaaatctcgacatttgacaccatagagtaaattttcctttattttttttttctgtgcattcttttggagacagagttctgtggcccaggctggtctcaaactccctatgttacaaagggtgtgactttgaatgactgatcctcctgactctaacttcccaagtgctgccattacaggcctgatttcacatttcatgtctgatttcacatttctttttcttgtaaactcaggaggtatgccacagttctatttttcccatcaattcctaatttgccctttagagttttaatgaactctcctccaataggggtgatctctcacatactcaatattgtactatgtctgaaaggcagtttcaacaatcatttttgtagtatggtaactaagacatttatttgcatgctcactagccacgttttactttgtttcagagaattgctttggtaaaaaagaataaatcaaaaccttgtttcctctaggagcagactgtggcttcaaggtactaacccaaactggcaaggggagcatcgagagcaaatgctatctattaagatgtaaattcagcaatgtagtactgataattgacttattgagcagacttttctcggtgttagatatatatctatatctatatacaacacaacaaccctatgacatacgtttttattattattgttttcagaaaatggaggcagagaaagattgaattactttcccagagccacgactagtaagtgatagtcaagcactgaatccggagccatgattcaactttagatgatctaattacagagggttccttttttgactgtaaatccttttgaaaatgggtagtatacacactttgaaactctcaagaaagaaagaaatatctcaagaaaattggagagtctataagaatgagtatttccaagtggacctggatttaggaagtgatgcctacagcagtagtttttaaaggaggaagaaacatcagtattctttgagaactctctgactctcagggcaagacttaaaccaccagtcagaaactctgtggggagaggcttagtggcctatgtttttacatgaagcatgtagcaacgggtgactttgaacttactgatcctcctgactctgcttcccaaatgctgggattacaggcctgtgtcactacgtctgatttcaaatttatttttcgggttaactcaggaggcatgccatagtccatagaggcagaagcaaggcgaattgctgcttagctcagcctgggtctcactgaggagcggggatttggtgtatagctcgctcagttcctagagagctgagatgctaaatttcagtggagagctgagagggttgagaccattcctgcgtagtgttgggagcttgcgctttgtgcctaaatcaagctaactgaataccacgaactgcttttataagatgcctcagcctatgtaacttgagttctggttcccttgactcgtgattgtctagttgaatgtcagagatgggtgtgctggatgggctgaaacgtctttgggtggggaagagtgttaaattagagagaatgccagtcacacattggtttcttgagtgattgcatgccttccctccagaatgacattaaagaagaaactcatgaccatccagcacatgaaacaggactctccatgctgtctcatttcacttggtggcttttagtttttcctctacatttgtatgatttgccagttctacttatttaaatcatagaatcaagtattaacaaatgttctcttccttctcgtgccccgttctgattcgtgtttgtttttagcatcagaaaagttccactttaagccatgagatgtctggtctgaactggaaaccttttgtgtatggcggccttgcctctattgttgccgagttcggtaagaattgagaaaaatgacaaatctgagtttcatgtcactgagggtcatgtatggaccaattatttttggagaaaatcagtggggaaaaatattgtcatcttttgttttaaaaattactgttgtgtggctatcaagtaatattcctgaggaggttctagtcatgatatagggaatgaggttaagtcaaattttgaactttttttgataacgtagtttttcaagtcaaatatgcatggttataaaggactatatatgatagtagtttctgtgtattcctgtgctaatggtctttaatttatgctaaggttataatttcttcttatccaggcttcttttttgcaaacccctcttccattttagaagcaaacaagatcattagattgtgacttcattttctagattcctctttttcctaactgattcctcgttgtctacaatccagcagtgtttgttaactttttttctttttggtttttcaaaacaatgtttctctgtgtagccctggctgtcctagaactcactctgtagaccaggctagccttgcactcagagatccacctacctctgcctcccaagtgctgggattaaaggcatgagtcacctctgcccagcctgttgattttcttgttatatgctctggtcttatataatccaggtcacaaaagttcagagctatatacataaagagcttactagttttagatctttaaatctttcttaaaacctattttgttcatgcaaaaaccacttttatgtgctgatataagaaaaaggagctttattgaagaatcctgctagggaagacaaggtggcccagcaggtaaagtagatgcatgctgccaagcttgatcgacctgagttggatgggaaccatgtggttaaattaaaggacagatctgactcctggagatttgcctctgacctccatacatacccacacacatacatgagcacacatgagtaaataaagcacaattaaaaataagaatggcctaaatactctgctggtattggtctgcaatcatccaagacaccatggtgagtagacccacgtgagacttttaccattttctctcataatattaggaagttgtaaacacacccccccaccccccacccacccacacacccacacacccactattgtaataccatgtaggaacagctaatgctttcctatgcttgtgataatgtgaggcgaggaggtgtggagacttgagatgggaggaaaagggtaatgaatgccactgacattggtatgttagagacagtgtgaaagacatgtctaaatccctttgcatttatagcctattattatcttccagcattttctatgtcagtgtcaggtaccctgtgcagcaagttgtacttcctagaaaggctagtacatttcacctatagcctttatcctctggcaatgatggtagaatagatattcaggtgttatgaaaatgattgccttgtatttccagtattctcatcgcccttatatttaacataactgttatttgtaaatacttaggagtctgttccttcataggcactttccctgtggatcttactaaaacacggctgcaagtccaaggccagagtatcgatgttcgtttcaaagaaataaaatatagagggatgtttcatgccttgttccgaatctataaagaagaagggatcttggctctgtattcagggtaagactggtttctttttttatatcatgaacagaatgttttttaaatttttttagaagaaaccatggatttaatctgcatgacagtttacactcttcgcatccaccatttcaacttataattctgtattgattaactattgtacatgtaaaaatgtataatatcgttgcagcataagcttttttcctggcttcctgacactctgtttttttttttaaagatttatttatttattatatgtaagtacactgtagctgtcttcagacactccagaagagggcgtcagatcttgttacggatggttgtgagccaccatgtggttgctgggatttgaactccagacctttggaagagcagtcgggtgctcttacccactgagccatctcaccagccctgtttttttttttaagatttatttattttatttatatgagtatactgtagctgtacagaaggttgtaagccatcatgtggttgctgggaattgaactcaggatctctgctcactctggggtcctgctcgctctggggccctgcttactctggcccaaagatttatttattattatacataagtacactgtagctgactttagacacaccagaagagggcgtcagatctcattacagagggttgtgagccaccatgtggttgctgggatttgaactcaggaccttcggaagagcagtctgtgcttttaaccactgagccatctctctagcccttcctgacactctttgatggctattgtaaaagcagcaccagttagctgtacacattcttgtgagaaattttcctagcatcctttaagacttcttacataaaacaaacgttattctggcagtttaagtagtagtgaagactaaaagaatggagaatcatcttttttcatcactcttgattacccatcagtttatgatttagtgttcagtttgttgttcatgtgctgcagatttcctaggtcatccgaaatctaggctaccaatattgctgagatgattgaaataaaatttaccagtaacctatgttgggcttatttaaaatataattttcttggagaaaaaaacccaacaacccaagccagatcctcatgcagaagtgagtgattcctggaccatctcttttaccttgttctttcattagcatagataacctcaagatttttcttttcctgatacaagtaatagagtcagaaagattcatatttagtcattcgtttctttttccttcttccatcctaaccatttgagctgttgctttagttctatttatatcccctaaagtatagttctgcaatttggaagaatctcaaaggaggcatgagtgagaacatcttcagtttatgagcaaaatttaagtaggttgagatcttggtgttgttgcttcctttttcattgggttaaagatgtatctgcagttgttaggaaatagaggctgattttttaaaaaaatatgtggtataggtaataatgtctgactctttttattattgctacattcaatttgttcgtcttttctgaaggatttttgcatctaagtttatgtgtgatatggatgtgtattttttatgttccttttaaacatttttttatttctgtattttttaatgtatgagtgctctgttagcatgtgtgcatgcatgtgagcagaaggcatcagatcccattacagatggttgtgagtcactatgtggttgctaggaattgaactcaggacctctggaagagcagtcagtgctcttaacctctgagccatctctctagtcctaggcatatggtttttatttgtactattttttgtttggtttttgctatcaaggtaatattagctagagtgatttgggaaacattccctcttttatttctggagagttttttttttttttaaataagattaatgttaacttttcaacagttttgtggtatttttcagtaaacttttctgagcttggaattactatttttttgaactttaaaaaaaaacaatgagccaggcggtgatggcgcatacctttgatcctagcacttgggaggcagaggcaggtggatttctgagttcgaggccagcctggtctacaaagtgagttccaggacagcgagggctacacagagaaaccctgtctagaaaaaaaacaaaataaataaataaataaataaataaaccaaccaatgaattccatggggcaggaaccaggccatgtttacaattgcgttaatatcagctctctaaaatcagctagtgacaggagccaggtgaggatttgacaccctagtcacaatttatgctattcctttgagcctgtgaacgcttacagcagggggttctgctcttgctgtccttttcctgaataatgcaatactgttaataccttaaacccaaccctcctccttcctaggccatggtaaattcttgcatatgggagtaacttggctgctcttttaaatgtctgtagggaatctccatttgtcagaagaactcactaactttcttctaatatgcaatgtagtctgccacacctgactgtaatgaggattctaagttttactattttgaactagccctgagattactagctcctatctggcaaactgtgagatgcctgattactgactgtcaacactggggcatttcgtctgaatgagtaacattcttatgaaattccaagcccagggtcagctcctggactgcctaggacattggtgaaggccaggaagcaaaagttcaacctgatttagatatttgacaacttatttcttggaggcacctataataaaacaatactgaaagaaagcacacagatccgttcactgactaatgcaaggacaagtttggagcattcatgttacaggatgccaaggctccaggagactaagtttccgtgaaattttttgctcaggactgcatccaagcttttgggcttgtcacacagtcttcctggagtgggtgtggcatccactattggtgattgaatgcaaggtttaacacttggcatgcaagtattctatcagtgagctacctagtcttatcgttttatagtaagacagggtcacgccaagctgttcaggctggccttttactcaccccagttcaaacaggccaggaactcctcattctcttgctttagcctgcaaggagcagctgggattgctgacctgtattgctaagtgtggctgtgtcccatgttttatttttttaaatttttataatatttttaattttaaaattatgattatataatttttttcttccctttcttcttccacccactcccatgtatctgtttgctctctctcatattcatagcatcattttctttagttgttgttataaccacatgtattttataggacatatttgaaattttactcaggcctatacattaatttttttacaactttctataacccatatgttgtttaaatatatgttgtttgatttccaagtgtttgagcctccttaccagtttccgatttgcttccactatacattctgcataatttcagttcttgtaactttgttgacatttgttttatgacctgggatgtgaactttctttggcagtttttcatggatgattgaaaaaacatgcttattattgcttagaaagatacagatttaaacattgtaaaatctacaaatgtgtgttaagtaaaattaacttttctttatttttttctctttggtttttttttttttgttgttgttgttgttttgggcagaattgcccctgcgttactaagacaggcatcatatggcaccatcaaaattggtatttatcaaagcttgaagcgattatttgtagaacgtttggaaggtcagtatgctcaactttcttttgagattatcctccaagggattgttgaaatcatgcttagtgtgaaatgtttatcatcttatgttggcagtccatgaaaggtacttaatgcatgggtaaaggtgagcttgtgttgaggtgggctaaatccatacagaggggatacatgggttagaggacctgctcttcacatatatcttttaccatcgactaaaaaacgtctaggctgccaagatggcttaatgggtaaattccatgcaagtgtgactacctgaatttgatatgtagaacctttgccaaggtggaaggagtgaaggcattccacagagctgatccctgacctccatacatgtgccatgtgccatgtcctcccccaaaggaagaattcctttttttgttgttggtttgtctgtttttgccaagaagggtttctttgtttgcaactttctctgtaggccaggctagcttcaaactcagagatccacctgcctctgcttcccaagtgcagggattaaaggtgtgtgccaccaccacttgacttaaaataaaaattctttttttttcttttgcttgttgtttgttttttgagacagggtttctctgtgtaaccctggctgtcctggaacttgctttatagaccaggctggcctcgaactcatagggatctgcttgcctttgcctctcaagccatggaacaatatgtatataaccactaccgcctggataaactaagaattcttttttttaaaaatatttatttattatatcttaagtacactgtagctgacttcaggcacaccagaagagatcatcagatctcattgcaggtgattgtgagccaccatgtggttgctgggatttgaactcaggacctctggaagagcagtcagtgctcttaaccactgagccatctctccagccccaagaattctttaaaaaaaaaaaacaactttattgttattcttgaagaagcctaggtcagccatgttcttgaaaatgaatacacttttcattagttagaggacttgacactttctaaatgtcaattttggtaaggtttgggtaggtagataaattttagtctgttacagtctggattcaaggattccctttcatcttccctgaaactattttcctttcatagatcgctcacatcgatttactaattttctagttctagactcttctgaggaggaggaatggtaaagatgagattttcgctgtagaacaatatgtcctgttgttcctctccttgtttagttgagggaatttacttctatataatttcttctggacatgagtattactgtgtagcagagagctggcttatcgtgtccaagtctctccgttcatcccccaatgccagggattatactactgctttttcatatttgactatagaagccttctgtacataaatggaggctgggagatatataaagccactcaaagttaatatttagataactttgttatacataatattaattttttaacatctagttattaagtctttaagttgactatccataaaaagagttaaaaattgaacaaggatgttaccagttgatatgccacactagacagggaaaagcccacgaggcttcaactctacactaagaactgtcagcaaatacagaaggctgggagcaggggaggcggtcttccccagggaagagagcacatcaattggttgtccaatgccaaatggtcagcccggaaaacatatatacaagtaatgctatgtggggtaaacattatatttaaggatatgtatctatatagagccatatatgcatgtaataactatatgtgaaaaaaagaggccatgaatttgaaggagactgcggagggatatatacaggagtttagaggaaagaaaggaaagggagaaatgttgtaattataatctccaaagaatttttttttgagacagtgtttctctgtgtagccctggctgtcctggaagtcactctgtaaaccaggctggccttgaactcagaaactcaaaagaatttaaaagacaaaaatcagatgcattaatatgtttgaagtggttgaaatggaaagacaatattctaatttatataacattctgatagttatgtagaagaatatgaataatggttttatggaaataatggtttgtattgtataatttgtacacattttgtattgatttgggatggtctataaatacttcagagactttactttgataaactttgaagttaatttttaagtcatctctccagaaaagattcccttcatgcaatatctcaggtagtccagaaatcagtacttaataaaatgaaccttcattttttttaaagatttatttgtatgtagtgttctgtctgcttgtgcaaccgcaggccacaagagggcaccagatgtcattacagatggttgtgagccaccatgcggttgctaggaattgaactcaagacctttggaagagcagtcagaactttcaacctctgagccatccctcagcccatgaaccttcttttatttatttcttttgcacttttacagatgagactctcctaattaacatgatctgtggggtagtgtcaggagtgatttcctctactattgccaatcccactgatgttctaaaggtaagagacattcctgccatggaagcccgcaagctttgactcacattcaagttgccatctttacacaatctattgttagttctaaaatcttgggcagctctcttaactatgtggtgtctcattccttccttgttttgaaatgaagataaatgcagtgtttatagcataaagttgttaagaattagagataatacatgtaaacttgtctaatattatgcatcacagtagatgttcaaaaatagtttaatgtgatgtccattaatccattggttttcagcctagggtttgtgatcctataggctaggttcaaggctaggtcttgcataacctgggacatcaaagggatagattaaagtagagatctttacaggagtttcttttcataactgctttaccttaaatttatactgtttctgtctttccttagcctgtccatgtttttattaaggatgagctttggcttatgtaactggactactactttttttttttttggtttttcgagacagggtttctctgtgtagccctggctgtcctgaaactcactctgtagaccaggctggcctcgaactcagaaatccgcctgcctctgcctcccaagtgctgggactaaaggcgtgtgccaccaccacccggcgtaactggacttctttagtgttttatcaatcacagaatgaaacattttaacgccagccttcagttttatctgactaatagtaaaaatcttctatttaattaataaagcactaaatgtatgattaaactgtgtgaggggaccacaacttaggatttttgtttgtttttctgagacagaatcatatgtagcccattttatcttggagctcacaaagtagcaaagaatgaccttgaattcttgttcctcctgtcttactgagaatagagctatttacagctatgaatctcaagtttaaaaagtctttttatgtgtgtggggttttgcctatgtgtatgcctgtgtgccgtatgcatgcagtgttcgtggaagccagaacagggagtccctagaactggagttaaggactgttgtctgctgccatgtgggtgccggaatcagacctgggtcctctgcaagaccagcaagctctcctcattgctaagcctgacctccagccatgagctcggagaaaagaaatcaagtttgttatttctaataagagaaagtacaaatcaggatcgaagttagctcaaagcaagtgcaggagactcaggataagcactgttttatgcctgataagctctgctgttaactgctgagtttccaggactttgtgcagctaagtaacaaaatccttggatgttcaagtcccttacatagaccaaaactatttatgcataatgtgtgtgtattcccttatatattttaaaacctctttagatttacttatgtttaatgtaaacatataagaatacttgctataatattccagaaataatgacaaggaaaaaagtctacatgtgttcattacaaatataagttcttgcaaatatttttcaattggtgattggttgaatccacaaatataagactgctgactatgtgccaccacgcccggctatcattattattattattagtagtagtattcattattttggaggggcacgtgtatgcccatgtagaggtcagaagaaaccatttgcaatccgttctctgtcaaccacgggccctagggattaaactcagtgctcatctgtaaactcccattcatatgtaaacctttgttaatatttgggtttggatgctcatcctgttttttcactgtgttttaaaaactttacatgttttggtaagaattatatatactgctttgcagcacttttctgtttaacaatcaattttaacagtttctcaaggctacatatattttaagagaaaatgttatgattctactgtattttgtgaaatgaatgtgtcatcagttatgtaaccaatatgttgttgctattggtttttggcatttgaatcacccctattttttactggaactaattacatatgtttgtctgtctgtctatctttcttgaactaattacatatatttgtctttctttctctctctctttctttctttctttctttctttctttctttctttctttctttctttctttctttctttctttctttctttctttctttcgttttttccttccttccttccttttttttttccagacagagtttctctgaataacagtcctgtccatcctggaacttgctctgtactccaggctggcctcaaactcactgagaattgcctgcctctgcctccagagtgctgggattaaatgcatgtgccaccactgcctggctaatacatatgtttttattcaaacagggtcttactgtgtagctatgggtatgctggaactccctctgttgatcaggctggccttgaactgacagagattcacctatctctgccttctgagtgctgggattaaaggcatgtgcaaccatatctggctcaaactagttatatctcactgaatgcttgttactgtcaattccagaaattatggatttagtatgggggatatgagatctaatgaaaatctttatagatacactttggcacaaattatgttttatttgtgtacaatttaattcattaatttcaccatggtaacagctttaaaaacaattccaaaacctatttttttcttaatatttaaaggagtgaactatctcattttggtttttgctgtcaaaataaaatattctatttttgttttagattcgaatgcaggctcaaggaagtttgttccaagggagcatgattggcagcttcattgacatataccagcaagaaggtaccaggggtctgtggagggtgagtccccttttactggtgagatattacactctacacttgagtcttcatattaagtcatgagattgtgacttataactccaagcaaagcaaggtgctcatgctacccatgaaaggaccaaaacttaccagtggctcctatttcgatagtggtgttcagctgtatgtaagaaacatgtataatttgagatcgccattttgttttcctaaactttatagtgaatttgtttcaatgtagttttgtcagttttggattaaacacattaatatgtgtttatgatggtctctgtagtgcatatgttcaaagagtaggacagtatttttaatcttataaagtaaatgatatatgataaaatattgataaaatttacaaaaaaatggggaacaattccagcagtcccagcactggagagaatcactgtgaacattttgttatcttcaaatatttatttatattttatcatttgttgtattattacaatattttttgggtttgttttgagacagggttttctaagtagcccaggctggccttgaacttttgatcctcctgcttctgtctcctgagtcctgagaagtcaagtctgttccactccacctgtctcttgctatagtaactcttctttctgagactggatctatgtagccctggctgtcttagacctcactctatagaccaggctggtctcaaactcaccgagttccccctgcctctatgttctgagtgctagaattaaaagcttgcaacaccacaactggttattggataactttttaatctgctgtgatctctgaattattctaacagcaaataagagtattattagaatatgcagagagtgagtgagcgagagcgcagaataggatggaaataaagttttgttattttctttctttatactttttatagctaattttactttaaaacttcaaacaaaatagagctgaaagaattgaattacaaacacacatcatctagattacacaactcataaagctttggcacaattacttgatctgtttctgattgcatagactcatatgttattttgcacaacaatataattgttgtagacattctaaaagttccacaaactgtccgtgatgtatctcctaagaaggtggagagatgtctctaccattaagatcacagacagctctggcagaggacccatgtgtgggctgtgcagaatgcatgcacctgtgctcatgtttccatatcctctcagacacacatatagttaaacataagttaaaatttaggaaaagtacaagattctctgatatcagtactattgtcgagtgtaagaaagtaatttttaaggggctggagagatggctcagtggttaggaacacttgctatgcacattttatgcagatggatctgtttgaggccagcctggtctatagaagagagttaccattacacagaaaaccctgtcttgagaaaaccaaaccaaaccaaccaagcaagcaaacaaaaaaatacttgctgcttttgtagagttgggtcgccagtccccacgtggcagctaccaaccattcatggctccagttccagggaaacaaagccctcttctgattttttttttgcaggcaccgggcacacacatggtatatagacatacataaaggcaaaatgtgtgtgtgtgtgtgtgtgtgtgtgcatgtgtgcatgtgtgcacacccgtgcggacgtattgcctgtgtatgtatgataaataactctgaaaaatgagcctaatacttgaaatcgagaccatattaaaaattcacctatttgtgagctgaggatatggtgtttatatagtgttatatagtgttttcatgtctttggcttgttcctctattgcctgaaacttgagaccactagctttattatagtcattctaaaccttttgcatcaagtaaggtgtgcatgtttggttacaccacattaaacagtgcagagattgcctacttagtcatatgatatccagcatatcttgctgttgtaaaaggtaaacttttcttttgcaattagcaagtaatttattaggtgaaattctgatcacatgcatatgtcccaatacctaataatcaaatgtaactacttttatggtcatgttacttgtatgatcctagcacacaatgctacaggaacaaagtacattatgctatgtattctttggataatagatataacttttatgtaatgatcacagcacccactagtgatgcttgaggtttgagtcttagtaacaggcgggtagactttcttgattaatccaatttaaaaccagagtagagctaactagaacattttcatgaattggtgccaagagacaaagagcaaacagcaagattataaattaggtgggggaactgagacattttctttttattcactggtaattgttataaagtacaaacaaaatctcagtggcattggatatattcacattgtttgctaccaggatccagaatttaaaaaaccgagcatatgctgatgagttccatgatattttaatccgtgtatctgatgtatttttatcacagttactcctcattaccctctcttgctgccctcccactcttgcttactccttcctctttcccatttgtctcctctacttccatgtttttagttgtgtactgatgtttcattagttttacttataggaatgtggacaccttaccagtatctacaccactgaaataaaatgtcttttcctccccgcagcaaccgtgaactgtctatggatccttgggcaggggtggggcctcaggagcccctcccttctagcaagtgttaactgcctttaaatcctcagggaggagtggggcctcatgagtctctgtaatccatgatgtatccagaatttatttcataaactgaaaccctataatcactaaacaaccatccttcctctccctgctctctggcaaccccatactgttgtctgtctttgggaatgtgtcaagtctaagtaactctgagtggactcgtgaaagtttgtccttttgtgggattttatttagcataatgtccctgaggttcatccatgtgctagaatggttttgaatttctttcctgttaaagattgaaaaaatattatttatacatttcacacactcacatgcacacacacacacacacacacacacacacactacattttatctattcaaccattgatggatgtttgggtgtctttcattttttgggtattgtgaatgatgttgcaatgaacctgggtatgtaaatatccttttggggatactgtacttagtattttgggggatatatctagcagtgctgaactatctggtagttctgtgtttaagtttttgaggagcttgacagttacttttattttccagaccacttaacataatctgggtgtgtaacgagaagcaaagtgtattttggtatgtgtttccttgagataggtatatcttatataaatatataaaaatggttctgggaaaatatagctcagtgatggatattttgcctagcatgcataaatccttaggttcaaactctagtatgcctgcacgtcaatttatattaaaaccttaactgcaattttgtttcaaaaactttaaaaatttcaacaaagaaatatttatttttccctctgcagataggtgatctttttagtctgcttaatactcttgctttggttgtagcagttgctcctgggaatttttcatgctgttcctaacttcactatacaaagaaacagcagcaaaatagaactaagagtaggagaaagagttgtatggtgagacttttctggtgagctggaacacaccttctctgttcagtagggtacctgctccttagctgtggcctgttgccagaacacattaatgagaaactgagtgtggttaagttttcacttgtttttttttttttagatttttatgtttattttatatatatgaatattttgcctgaatgttatataaatgcaccacatgcatgcagtgccagcagaggccagaagagggcaccaagtaccttggaactggagttagagaaagttgtgagccactatgtgggtgctggaaagtgaatttgggtcctccgcaagagcaacaagggttcttaactctgagctgtcactccagctcttaaagtttgacttttcaagagaagctagaaacttgcatttctttgcgaaacacctcaatcaacagctaactaaatcttttaagaatattctataggccacatacataaatacatctgtgggctgaaatcttccagtagttttagggccctattgttcatcattggtcttatggggaggtcacactgtttagtctaagtaactctgagtggtgaagcagggggaagagtcctagaggaagctactattaggcgaggtcagcaggatcagccttggcacagtcacatcacctgtatatagggtttgggagttcagagatgaagttagctcaaaaagcagttatctacataatatggtattttcagttcttaaactttatttattttcattgattatctttattcaagtacccttgcacataattaagaagtcctgtggattgtggggatatttctagtggtaaaatgtttgatgtacaaatgagtatggacccaagtttgagttccataacccccataaaagtatcaaaagctgggcacagaggtgtgaatttttttcatgattttcttttctttttattattgactgttttattagatcttttacagccctattaaagatttttcacaagcctaatttaatagctagatattcaaattagaaattgttacattatttttcctttgttatttaaatctgtctcattttattctttatcctttttccctgtttatgtttttatttcattctattttcttttttcttttattggatattttatttatttacatttcaaatgttatcccctttccaggtctcccccccagaagtcccctatcccttccccctccccctgcctctatgagggtgctcccccacctacccacccacccacccacccacccagagatgtgcactttaatcccagcactggagagacagagatggacgagtctctgaacctctctggccagccagcatagcctaatatgtgaagcccaggtttcgatgaaagtttccgtgtcaaaaaacaaggtacatcactccaggggattgttcacgtgtaaacttgcctccacacacaatgaataatgttcacgtgtaacttggctccacacacaatgagtaatgttcacatgtaacttggctccacacacaatgagtaatgttcagttaagcttatgacggtaaagaacctgctgtgaattagtaaaaactgctggtgaggtgcttcatgggatgatgccaccctctgcaagcctgccagcttcagttcaatctctgagactcacacggtgcaaggtgtcccctgacagccatgtgtgtaacatgatgtgtgtatccacacatataacacacacacacacatgcacacacaaaaataaagagggaaggtataaaaatcatctctaactgtacaaacacaaattatctcattatatttctttctgaagagtatatattcctttctctctgaacttagaatagcagtgctggatataatttcacatcatgcatttgtaaacaatcattagaatgatttccttgtataattaatattcttcaaagattcccccctctctctctttgtgtgtgtgtgtgtgtgtgtatgcctgcatatgtgtatgtggctacacttgtgtgcactgtatgtagcggccaggggaaaactttaaacgtcatttttttttttgagacagggtttctcattggcctgttactcatcaggctagagtaggtgtctagcaagccccagggatctgcttgtctctgttctgggataaggagcagctttgccttgtgcgctgccagccctctgtggtctcatgagtgggataggaatatcctgctagttgattggtatcgcagtgcaggaaggccttcaggggagcaccgtttcctccttgctctttcccttcagcctcagactcgtgcttccacccactctcatccttggttcaggaatcaatcagggaagtgtccctctcctcactgacattttttttttcaaattttagagacaaaaatagcactgtgtatctctggctcgcctggaacttgctgtgtagacttgaactctggatctacctgcttctgcctttcaagtgctgggattaaaggtgtgcaccaccacgcccagctgccaatgtttttattattttgtccttctaatgagtgtatactcacgtctcgtctcctcttgtctaaagaaattcttctcctagtcctgcagattgaagtcagggcctcatgggtcccactgaactgtgtcagcagccctctttctactctgtcatgctagccatgaactcactttgtagtcagcactaggccctgaatttaggattcttctgcctcagcatcatgagcagctgagattaattacaagactgtatcatcgggcctatcatgcttttttctttttaaaaacctttttaatcagtgtatattgtagaaatgtgtttcatgctgatattttcatatatgtatataacatactttgatatcatcccttcttgcatgcactttccatcgttctcacagattatcccctttctgctttgatgttggtgtgtgtgtgtgtgttgtgtccatgcatttgcatggatgacagtgaataacttcaggtgtcattcatcaaaagctgtctactctgttgttttgagataggtctctcactggagggagccctctctgcctccccaatactgagattctaagtctgcatccccgtaactcactttctattatgtgggttctgagttgaattcaagctttcatagttgcatagcaagtttagcactttactgattgggccatttctctaccctcttaagtctttttgaaaatgtccttttagtcatcatcttcctccttgttgtcatctttctctttttctttccttcttcttcttcttcctcttttccttctcttctttttcttcttttttttttttttttgagacagggtttctctgtgtagtcctggcagtcctggaactagctccatagaccaggcaggccttgaactcacatagatctgcctacctctgccacctgagtgctggtattaaaggagagtgccaccaccacctggctgtttttatttttaattatgtgtatctgtgtgtgtttgcaggtgctcttggaagctagtggcattgggtgacctggagctagagttccaggcggttgtgacctgcttgatatgggtcctatgaattgaacttttagcaactgagatatcttttgagcacccccttaattttttaaaaaagatattctatttatgtgtatgtttttttttttttttttgcctgcatgcatgtctatgtaccacacgagtgcctgatgactgcagaggccagacaagggtgttgcatcccttagaactggagttccaggtacttgtgagttgccatgtaggtgactggaactgaactatgaaagaacagccagtcctctttcttattgctgagccttttcttcagccccataggctttttaaaacaattgatccagggtctaactatttattagccctggctggcgtgcacttgttatatagaccagcttggccttggacttaaagctctgcctcccaagttctgtgatttaaaggtggtatccaccatgcctgttcccttaaaactttgtatatgggctaaaataggatctgttttgtagaaagttctacgggctactgagaagaatttatattagacaactttgggctacaatattctatagataatattttgtcaattttacctgtataaacaggtaaattgtgtaactgaggtttctttccttttttgcctagatgagctttgttggtggcaatgagttactgaagtctctcactgtgattgcatctgtattcacttgttgctctatgttagttaggtttgttttatgaaattgcatgtcccaatatttggtgcacatatatctacagttgttatattttcttggttgattattgtattttattagtgtgtggagaccatctttattttctttgctgtgctagagattgaactctgggccttatgtatgccagtcaagtagtgtactgctgagccataatcctatctagagacttttaacttttcttaaaaatttcattttgaagtcagcattgtcacctatcgagtgtagttatttctgtttgctttcagattctctttgctttgaatataatttttcattacttcccattttagtctcagtatgtctttgctaatgaagcaaatttacagataacaaacacttagatcttgagtgttctcttaattccatatagccagtttgtggcttttaattagagacataataccatcacattatgttaaggttattattgaaaaggtatgtactcttcttttccttatcttagtaattggctcatttagcatttatgtgggctggagagacggttcagtggtcaagacttattccagagtacctgggttcaattccagcacctacatgttagcttaccactgcctgtaactccagttccagaagatctaacatctttacatagacatgtatgcagggaaaataccaatgcacataaaataaagataaatcaatttttaaaatattcttttaaaaaagagttaataaggtttgattcttttctcctaattcttatttacccactctatcaagattagtctatcaagatttattgtgtattttaaaaacgtttttaattatggatacttgtatgtatgtatgtatgggcatgtgttcaggtgcctttggaggttaaaactgaggcatggaatccttctggagttggagttgcagtcagttgtgatctacccagtgtgggtgctgggaactgaactcgggacttctgcaagagcttagagttctcagcctccaatgtaacataggttgcaagactcactgctccctatggaagaagggagcgcattctacctcatgcgcctcaaacttccttctacttctacttaacattcagtaggtctgtgtctaacttgccttctctatgtgactttttctgatggccatctcctatccaggcactgtgataggatatccttcagcatcctaggcatccttatcactgacattgtgattttttcccccttgctttcagttctgtagattagctcagtcaagcaatggttcccttctcaaggtggtatctgattattatgctccagcatttggggagtgacagtacactgcttctccaatgttagcctgccatacaggagcacttaatgtggcaccaagtctccatatttgatttaaggcttgcaggactgccacttagttgccactctggctgcttggactctcctgcttatgtgttggttgctacttggcatccttctcacccttgtgatggggctggagctgcggacttgtccttaggtttctttgcctcacctttctgtatctgttttttttttagctgtcttttctcctcttgattgctcattattttatgtctttttaatacagactccctgttgtcctgatttgtatagagattcatagggaaggaaacttctaacctgccaccttaccaccaacctctgccctcttcagtgctttttgctttctgattttattttttctaacagctttatagagaagagtcacatattgtaaaacttttcagctttagaacacacaattgtatcaggtggtttcatgctctatgccagtattgctactgtctaagttgagaacattttaattaccaaaaagagactccctaccgtttaatagtcatttccaccacggctaatgctcagaacactgtaatacactattccttttattcatatacattggcctactttatgcatttcatccaagtggaattgtattatgtcagctgttagggcatagatatgcacaccttccctccctctccctattcccctcctctatttctaagtaaatactctggcgctgagctaaactccaagtcccagtatgtcatttctttttgtggctagatagcagttaaattttggggatatgctatatttttaatttatatactcaataattaaagagcatttgtattgttttgtgcttttcaataatatgctggctattgctatgaacattgatatgtatttttgcataaaatgtgctttagttcttcttggtatatatatctacttatggaattgctagatgatatggtaattttatgtttaatatattaaggagatgccaatttatcatgttggtgctccattttatatatttaccaacagctggtaagggttccaatttccccacatctttaccaacccttactattttatttaaaaaaatgactagagacaggcccaaagtgggatccagctcaaggggaggttccaaggcctgacactattactgaggctatggaacactcacaaaaagggatctatcatgactgccctctgaaagacccaacaagcagctgaaagagtcagatatttgcacccaaccaatggacccctgttgttgaattaggggaggctgaaagaagctgaggagaagggagattctgtaggaggaccagcagtctcaattaatctggacccccgagatctctcaaacactggaccaccaaacagacagcatacaccagctgataggaggccccaacacacatacagtagaggacttccgggtctgcgttcattcagagatgatgcacctaacccttaagagactggaggccccagggagtttagaggtcaggtagggtgggggtgggggcatccatgtggaaacagggtgtggtgggaaggaggtgtgggatgtggaacagctggagggtgggagcggaggggcggggaatggaatatggagtgtaaaaaatgaattataaataagattaaattaaaaaaatgactagagtcatccaagtaggtaagaaatggcatgtcactgtaatgtatatttgtttgattttgagacagggtttctctgtgtagccctggctgtcctggaactcactctgtagaccaggctggtctcagactcagacatagctggctctgcctccttaggtgggggaatgaaaggtgtgtgccaccaccacccagctgtcatcatggttttgatgtacatttttctaatgccttaattctttaagatttttaaatatttctccatcatgtgggttatcttctcgcttacgttgtgttatcttttaaattgcaactttttaataatggtaaagtctaactttcatatttaactatttttcttttgtctcttgtgctttaggtgtcatgaatggttttatttgtagtacaacatttatggatagggaattatcagcatccagtattagccaccaatttgaaagactgtactatacatttcagagtttattttctgacagtttccactagtgacaattgttttcacttgaagacatatgtgactctcagtagtcctctgatatcactttggttttacagggtgtggtcccaactgctcagcgtgctgcaatcgttgtgggagtagagctgcccgtttatgatattaccaagaagcacctgatagtttcaggaatgctgggagacacaattttaacacactttgt

SEQ ID NO: 800 - DNA, 9588 bp, mus musculus
ggtaccctcactttccacattcggggccccttggatctgctgaggactggaggggggctctcttttgagtagcaggtatggtatcagcactgtgaccctctgtcctggagtttattaatttcctccttagaataatcaaaggctctgcagtcagagactctctacaaagctgtttagagaaacaatataatgataaattattatgccagttatgttttgtgtttgggggtgctcactgatttgcccaaggccatcctgctgcgtagtcactaagcaggcctcctgacttttggcctaacatcttcttgaagatagcagtcagtctactttggagagaatgaatagtttgatattggtattttagaaatatggttatttgatggtagttttaaaatgtcattcctattcatgaaaactacagggaaaaatatctcccatagacccaattccctatgacagtccctcagatgggattttgaagaagaaaaccggcagaaaattgtatgcttgttggggaagatataatcaaagggaagaggagtaggggggggcacacagaaatgaagcctgggctgtgagaatttccttactctgcaggttttcttggcatgacctctgcttgggtggtctgggggattgctctatcactgttttcgtgctcatgcgtactgtgtagaagccagagatgatctggaaaaggcaaatggttggtgatgcgccattgaatttattctcctttctctcgatcacagtcaacacagtggagacaagtgttggggcaaatctgtggaagggtgtgtggatgtgagtgtgtagatagctctttgtaagtggaacagatagggaggaggaagagagaggcagaatggatgactggaaagagcatcctcagtgtgtcctaaaagcctccaattgaggaagggtctatttggtgtgagtaggcctggagatatagtcagttcttaataatctttataggaacaaaggagagaaaatggatttaaattagtaaaggaaaacataaaaggatgatgatccctctcagtcctgtgacattcatgtgaccttcaactaggctataagatcccaagggcaggagctgaggccttccatttagctagccctccctctctctctaacagccctggcttatgcatgatgccgagccagccatagtcggtactcaattccttctgtggcccagttagtcttctctacatttcacaagctaacctcatcttcccatatactgcatctcccatcaaggaagacccagtggaaacatagctctcctttcccctctaaaagtgagcttcctgttggcagtaggtgagtatccattttcactctttaaaggtgggccaggggcattcttcagcagggcaagatatcccattcatactcagataaaagtacttcagcctagcagtccttacatagatgacttgaagggtttttcttttttgagtgagaggagttccttactctgggacaaatataccctttagataattctttaatcatattttatctttggatttgcatccctaacacatataatgtttgttatggtataaaggcatacatagacttgagagtcacagaagtgaggtactttactaagtcatacacttggtatttgaacatgtaaggcttccatttaaatccaggtttccaatgtgaaacacatacatgcgcacacgagagagagagagagagagagagagagagggagagagagagagagagagagagagacagagagagagagagacagagagacagagagagacagagagacagagagacagagagacagagagacagagagagacagagatagtgagggagaaatagagacagagaggagacagagagaaccagagaacctttattcccacttctcagatgctttttgtaaaactttagttaagccaggagttctccagagctctagtttgttgttgtctgtgaagaggagataatcccagcccacctcctttccaggggttgttggaagaagtggcatgattcatttattcatgaatcatggataggctgttttaattgtaagagctttatattctcacaaacccttagagtttataatcctatgattcacctaaagaacacttattgaacacctactgtgtgccagggcctagacataaagaacttatagaaagcacttgaaaaaaatgagaagcacaaggcaaattaaacattaattattattttaccacccatttatagaacatcttatttttctctcctttgccactatttaatagaaatagcaactaaaagatggaaatgatgacacagcttgtgatggcaacactgttatgtaccctgatacatactgcagacaacattgagaaaatctatatcttgaatttgatattgtattgccttgtttacaccatcctttgggatatttagagcataaagattgcctttcacctccttgagctggagattttttctttagtccataaaatttaaaaagggcatactacattctatggaatgacaattgtacaaagatgctgttaattctggtggctgcctgccttctatatgatttcctctggatttatggaattagacttattatgtattcattcttctgagttcattatctagcaatgtaaaaatcttgcagctattgagagaatttgtagatgggatagtagaaaatgccctgacactgagaaatggattcatgtccagtctcttattaagtggctgtgttgccttggaaaaaaaatcccatttttctctgagcctcagtttcctgaaatgcagaagaggttttggacaaggtgatagttaagtttaactcttatccccatagtattatattcttggaagagaattttagacccagggctttgcttgagatatttaaacattactaccttcagtttatgagcctctgtcgtggcatgatgggctgactgcagggactgaagaacgctgtccccagatttaattatcttggggcatcaccactgcacaggctaaaatgagtcattttgttcactgcatctgcagcctttgctgaaatggaggttatgggataacaacttaaaggctaactcattaatgctagagatgaatgaggtaatgtgtcagcagaccaaattggtgcccagatgtgttcagctagagtcctgtatctttttcccaggttgtgatgtattaatggggatgtctttatgcagcgtcactgcctgtacacacttgaatgatgtagatgtgataccttctggacacccagcccctcgcactatcaatttcccaaacaccaaggagcttttagtggcttggagtaaaattctaatgatgccacaaggtgcctaattaatagagatttcaaccactgcgtcagcgtggtccctgtgggtttttttcccatctatgtttactggtgagagttagaccaatcctaacttatttggtgggagcaatggagtacattaggtctccacactgtgagggccgtgaatttatggtttgctcagaacatttctgtcctctccatgttcaagtggttgacctttctaaagttaatttgtttctccatctgtgccatgcatttcaggaggacatggagaataggcttgatgccacccaagagtgctcaaccctttgcattgctcaatactgccctttgttcagcttctcctgcgtgctatttattcatttcgaaactcctttgctgatcgaaataatattgtatgttcttttgctggtaacatggaaaaaccggatggttagaaagaaaactacatttgtggatatatctgcattttactcatcagaataacagcatttgaaatatttaattatgctgttagtttttctgactcttgcaagatgattaaaaatgcttgaaattgaagagtgaagaaaacagagcttttcctaatggatccccagatatcttcatctgtgctaatttaattcaaacttagtagaaattgaacagagtagattgatcaatgtattgataccaattcccattttatgtaatcactttagcagcctggtagtttcagatggatttgggcccatctgaaaagaatctttgatattacatttttattttttaaaaaaagcagtgctacttattacatacacagtagtcatttaccatgtaactgaggaaatggaagctatgtcatttctctattttcagagtgggtcaccaagactcagaaccaactggttctcctatgcttatatagcaaagaaataataaagcttggttttggttctaactttttttaccccctgaatttgtttgtgtaaagaaattacttttgcaaataacttgaattttaggccaaaattcagctggtttgctttcaccttccttcttggtatctttttaatctcataaccatttcaagctagtgctagagtatactgaagggaggaggggaggacaatgaagcaagagaggtctcttggcattttgttccctgtggtgagccttcttttgtgtccagcttggagagtcaggcctgaggacaaatagattggttaaatctaaagaatttgttttatgcctgtctcttcctgttgaaccctatatattttcttctactcctcattggctgctccttgggcattttagccttcctagctctgctgtagtcttggggcctactggtgatctgagagcgttgaaggtatgcaagatggagtcaattttgttggcagtactgcagcctatgactgttgttaagttcagccctgtgtgttcaagcagggaggcaatgacaaacggtttattgtaaggcctttgatttccctcggaattgtaagcatctaggctgactcatctctcaaaagctcccccctcctctctctccctctcctttttgggctgatgatgatttgaggtttcactgtttgttcttacctttctttctgtggaggggagggatttatttccatcctgtatttttgaggagagaagcagctctgctctctgggtgaacagctctggtaagctacaggaagaaatagctgaaactccaagacaggtacaaagatgtttggattgggctaaggggagggggactgtgatgttagagattttaagccaaagctagactgtgtattgacatgagaccctcattgatggattttagatttgctattttaagtggggtttgttggaagtttagtatgcaactgcacttaaatgcatatatgtctttggttaaaatggttatttgtggttatttggtagtccagctttgctgttcactttgggttcagggtatgtgctttgcagttgaaggaattttagaatctatgggctttcatcttggcttcatctgaaagccacaggaaaagccctcattctttctcatgctgtgcctcagttagccaacaagcatttcttatatctatgacttgccattaaggtatgtgaggagaagagaattttgttgataaaacccaagaagtatattttctttttaaacagcattgctcatttgtttacattatatgatgaacctttttcctacgttttatatgtcacagccatattactgatctttaagctcctctaagaataatatatagaacatatttgtaaaccttcatgagagttaagcttagaaaaactgtataggattgcttgtttttgtcaaaagtcttagttctccatgttccaaatttgccataaacaaaagtaatttagccctaagccttgttatttccattcacgatctctgatatacatcactagccctttgccccttagctaatctacttgcttcaggctttctacacaaaatagggttttcatggctctgtatttttttttttacaaaggtaaagctgtgactctgtcactccctgcctaaacccctatagtagtgccctattgcctagagaaaaaagtctctatctttaacatggtgttatagggcctttcatgatttatcttctcccaacttctgcatattgctttaagtagataacaatctttcttccattttttttcctttgcacaagccattatctctctgtctttgtctcgttgcccccacacccccatctccaggcagacttagatattttctcctgtatattctcacagtattttttctttatacctttgccagctgacataccaaaagattttgcaaactgttgctaacctgtgtatgtccttcactgcattattgaatcttttatgaagggagcagtactctcttgttcaccccctgaatatttagtacctggtttaaagtagacaattaattcagatttctctttaatacagattattttcttttaatgagtcactgaaagaacaagagtaccagaggatgtgataaaagatgcttatgtggggtctagactgagggatgtgcagtgtcatttatggctattgaggaaggccatataaaacacctttgccattatattaagacaaatttcacggtgattgctaattctgtatagaattaggagatgaagtttgttttcataaaagttgactttccccccaagaaatgaagtatttcaggtttaaaaaatgagaaaaactaccaacaaacaaaatcctgccactaaagactatttgttagaattttggtgtgtttctttcagtgttttatgcatgtttttcttcacatacaagtaatcataatttctgtattttgtatttgctcttgaaaacatctttataaacatacatgtatggttgcatttttttcatactagttattacataactatgtaagtaatcttgtttgtgggctttctctctctctctctctctctctctctctctctccctcccttcctccctccctcttccctcctttccttccttccttccttccttccttccttccttccctttttcccttcttcccttatttctttttagtggatgtctcatttgtatgtgatgtttcctgtttgtagcaagatttcattaggatagattcctagaaggggaattactaggtcaaaaggcctggggacaaattttggctccagatccatgtgtccagcttgtcttttgaaagagttatttaaatttacagtgcccattatcttggatagatgcctcctttttacctaactcagatagcttagagcatcatcatgaaagaaaagaaaaaatttttatcagggttgtaattaattaatagaaaatattatgtcttattgttgtatcaaactgggtttttttttaaaatataaggttgcttattattttttaaaaactattttccttaatttttgttagtttctctctctcttttctggactatctactcagagctgttttttttttttttaagttggttttcttttcttttcccctgaatattcaacacagaggcagctcagcttgagggtgaagccacctcccagttttccctccctctttacccccctccctatagttccttccaccaggtccagtcagtgacagttggatgatgcagtcttgataatcatcctattccagaatgggtggctgcattccttttctaaaggcaataaggacacgatgtcccataatcatcccctttttgctgttgttgtctgccttcatttttttagtgagcgtcctgggaggagccccaggacagaactcagaccgcagcatggacatggtatccattcacagcctctctgagctggagcgcctgaagctgcaagagactgcttaccacgaactcgtggccagacatttcctctctgaattcaagccggacagaggtgagctatatccggagtgtggagtcctcgcatttgggcgagtagaccccccgggcggagtggggcagattgaaagtctaggagaggaagagggtgtcattactgctctcagaacgggaccagtctcctggtgtcctgggatcggaggaaggcaggagttgaatactgttgttaaatttcagagaaggtaaaattagttgagttgagtcgaagcctggggttttgagggaacggtaagcccggtaggagcgaggacaggtgaagaaacgggctcaccaggtgtggtgggagaatcgggcaaagagggaccaaggctcaaagggacactctaaaagaggaccgggacaggaagagactgcgcggttgagagagatagagacagcgagaaagaggcagagagacacgcgccaatccgggcaaagagcgggctagaggtgcgggcttgaggtttggcagtgggaggtgcgctccgagcgcaacccagccctgctggctgcggggaccaggcacaggacagggttccagcgcttcgggagacctcaggggtttgcgcacagatttggctgcgggctctacgggaggtgggggatgttcgcgttgctcgaggggcgctccctttaaactgggaagtgcaagggtaggaaccaggaccgtcaggcgcgcacccctggtgcagcctgaactgagcaaagcaaagagcaaggagaccccccgctagcaatcaccactgcggggtttggcgccgagacacagccaggtgtcgccgattctctcaccgcagcaaagggagcaaaggcaaaaacgcgcgtgagcgcttccgcagtaacttggcgaccctcacccgtggtggcgctgcaggcagagcccctcccctcgcctgttgcatgatcggaggcgcctctgagctttttaatttatgttttaagtgtgctgagcaattactggttcatagtaagatgcgtctggcgcattaaactgcttaggctaaattcttggaaccttgcacgtgctaggtggggctagtcttgttgtcagatagggaaactgaggctgggcgaaaatgaacattgtttttttttggggggggctgcacacagcgcccctccccctcccgtggctacatatcaatgtaatgtttcagttacttctcaattccttatgtatgtgaatgcatatgtctttttcttttcttcttctatagctctacccactgaccgtccaaacaccctggagaagtggtttttgatgctgagaggacaagacaggggtgagtgctctctctctctgctctctctctctctctctctctctctggaaaagaaaatgcaacctcctttctggtagtgtagccctggatactggaaatgtccaatgtttattgcccctgaagactcttcgctctccctcccagaaccccccaccaggggtttatatcaggaaatggaagaatagctgctggctcttttgttggtcctctcagacctgccttagctttcctgtggacacgccacaggcagatgaatttgaagaaatcttgctcatttctacaaggtgttcctgcactggcaagacgtagggtaggcagggttgaaaccttgagccacatctggtagttgagtgacactgagtgatttttacctaaccatttcagggtcccgctccccgggggagggggtgctgcgggtctgggggagtgggatccattgtggaccgattgcttagaagagtgctataaacccatgccgttccccctaatataagtgctgcaggtctttgaaatttctcatttttccctagctgcatcactcaagacctttg

SEQ ID NO: 801 - DNA, 9588 bp, mus musculus; identical to SEQ ID NO: 800

SEQ ID NO: 802 - DNA, 4566 bp, mus musculus
gctcttcgcgctgctgcctcgaggccgccgcaggcggatgcacgacctcaggcgacgctgggacctgggctccctctgccgggccctgctcactcggggcctggcagccgtgggccactcgctcaagcacgtgctcagtgcgatcttctccaagattttcggtcccttggccaggtacgtggtgagcgaacgtggggctttcgctccgggtccagggtgagcccgggcggcgggaggagggaaggcagttgggagcgagggcaaggctcaaagttccagggtgccggtggtggcggggctgggggactcgagacgggttgagcgcgcaactgaccgctgttccgcgggaaagggctgcgctgcctctgcttgcaaagtcaggcagcccgcgggctccttccttctccccctggggaaccccgaagccccagctcacttctagaggccacccggtgagcaacgggacgcgcgccaagggagcccgggtttagggtcagcagctcgcgcacaaggagggaaatggggtccggggccccagagagtcccgcgggccaacgggatggggatgggagctcgagagaggagagcgggaagcacccagcgcctgaagaggggtggcgtgagttagggagtagagagaccaggaccggagggatcctgcggccgcggagtgggtcggggtttttccgcgggggagggggccaacggccagcgggatggagtcggggtgagggggggtgtgcggcagaagccacagcgctgagcctgccgggaaggaaggaagcggggaagggcgccgccgccgccgtggtggagtactcggtacggacgggaggggaaaggggcgcaacggtggcgccacggggagggggcggtgcgggagcgaggcgagcacgggccaagctgcgggattgacgtaacgagcttgggtttcccccagcgtcgggaacatggatgagaaatctaacaagctgctgctggctttggtgatgctcttcctatttgcggtgatcgtcctccaatacgtgtgccccggcacagaatgccagctcctccgcctgcaggcgttcagctccccggtgccggatccgtaccgctcggaggatgagagttcggccaggtttgtaccccgctacaatttcagccgcggcgatctcctgcgcaaggtagacttcgacatcaagggcgatgacctgatcgtgttcctgcacatccagaagactgggggcaccacttttggccgtcacctggtgcgcaacatccagctggagcagccatgtgagtgccgcgtggggcagaagaaatgcacttgccaccggccgggtaagagggagacctggctcttctccaggttctccaccggctggagctgcgggctgcatgccgactggaccgagctcaccagctgcgtgccggcggtggtggatggcaagcgcgacgccaggctgagaccttccaggtgagtctcagtgagtcccttaagggtggtcacggacctgggccacagtgaaccaggggcgggaaaggctgtttctgtagttgctgtgggtccccgtgtacaccttggcgcccagtccctgctgggtagacactagagcctatcttagttgctctgtcaggaagcatctgggctgcagcccaggacagccggtctgcccatcagaaggttagcctgcttgctgagtgagtgtggggaaagcggcctggctgcctggaaagtcgcccagcagccgcaaggactggacactacactctgagcactagaaagtcctaaagaaccgtgctctgcatgcagattctcaggcccatcctccttatcctctcctcccttctgcacctggtcccaaagaccaggcttgttctccttccattcccgtccagcattccccctcccctcccttttagtttctggctttctctagtgggaaattctctgcccatcttgtctgctgttggttacttcttccttcctttttcctggtctttctctttctatctgctgttcccctttccccttttcttctctctctctttctcacctttctctttcttctttccctgacttctatcacctccctacctccaggccccacttttctctggagagcagatgtcattctgccactgtttggggacgctcagggagagctcctggctctcatcttgtgccccttaccgttgcccacacttgaagtgtccatcatacttttcgaatataaggacgcacttggcctgctcggtgaccaggaaagtagctctggaccctgcatagggctcaggagtcataggagtgctaggagcttgttctgaggctcagaaatccaggagcctcagcatccatggtcagctcaggttcttgccaacagggaatgaatgaaatagaaaaaactggtttgtggataatctgtagccagtgaggaggcattttcttcggtttagctgttatggcagttcctggaggtcatggggtactgtgaagtggacaaaaggagctgctttggagtgaaatcaatccagccagagctattgttttgcagagcccttgaaaacaaatctggaccagggcagggagtctagctgagttacttgcagggagtgaaattggggtcttctggtgagcaatcaccatagtgtcttgctctgtccattttggtgacttcttgggctctcaaaggttctgctgccactgctgcttttgttcacttggacccctcctgccttacacagcctatgctcacctcacttcctagctgaagtgatgttttacaggtagctgtaaaggatgaactgtaggtacgatgatttcttctatctagctttagcaaagggagcccctggttttctggtcacaccagtttacagtggcctttctcaaaggccggagtcctggctgaatcctttgaactttcatttttctttctacactaacaggtttgttttcctatcacaagagatccttggccacagacagaaaggctgagtgtcagttcatggcaagaattgggttaagtcgtcacaacagcattgtgctgtttaagaaagtccccttcagatctggcagtactgtaaatgatctcttatgctagctagcttgtaggtgtactgaagaattgtgatcacaaacaatgtttagggcgaaagtagacttccacacctacaacagtgggggtagtggtggtggagattagaagtcttaactgctgtcgaagccatagctgtgtctagcattgtatatgacatgtgtgcctataccagttcctttgaacatgtaggtcagggtgtgatatctgcaaatagactcttaatgtggtctgaattatctattcagttgaagcaaaattgtttgtaatacaatatagttttctcaggcattaaaagggtgatatcatagtgccatctagtctaatcaaagaagaaccacgtttggaaaagtcagttgattgtacggtatttatgaaaatgaaataaaatttcctagagaaatacaatatcacctctttattagttcactcctttctgcctatctccagaattatcagtgattgcctaaaggatccagacttttccaggctattgagagatccctgcttgcaggatgacagtactgacaacgtgtatgcatcatgtgtgcttgtacatgggagatgaaaatttagtagtcgacgcaactgcacagctagcggtttgtagacatactcgtctcaggactacagaataaacctctaaatccctagtagtgcagtctatgtggagagaacattctattttgtaatgagttttcatagtgtcttgttattcctccgggaatgtgtactatcttttggagaatggcagacaggacaagaatattccctttttatcagaagacaatgagtgacatgcaaagaggctgaatgacgtttccaaggtcattgaggtctttagtgacacagcagaaatctgactccatttctgtctggctccttcgtctttggtatagtgactctaccttgatgagtagttttacccaaacacaatgaggtatttcctactagtgatgataaatgttagtgggaattgttctcacctccattattactgttatcagccattttacacttgtagctttagaggaatggctgggccacccttgccaccctcatccaagaagaatggatttctggaagaaggaagctttattctcagcaggagcaagtcttggggccagtttgctgtgaggcttctttttatgttgtaaatctctgtaaagctaaacaggatgagactagattggagatgcgattggtgagtagattggtgagttccggaagtagccaccttctgagggtgagcctttctcccacattagggttagcaagaggtccctctattcttccatcagtgtaacacctgaaatggtttcatgcttctgtggaaggtaaagtgcttgggtgatatatcataatatgttgttgaatagaaatgactgatcatattgtctggctaaagggaatgactgagggaagggagggagctagatactgagtctgagaaatgctcgagttgtttattagactaatatttcct

SEQ ID NO: 803 - DNA, 4566 bp, mus musculus; identical to SEQ ID NO: 802

SEQ ID NO: 804 - DNA, 574 bp, mus musculus
gcggggaagggcgccgccgccgccgtggtggagtactcggtacggacgggaggggaaaggggcgcaacggtggcgccacggggagggggcggtgcgggagcgaggcgagcacgggccaagctgcgggattgacgtaacgagcttgggtttcccccagcgtcgggaacatggatgagaaatctaacaagctgctgctggctttggtgatgctcttcctatttgcggtgatcgtcctccaatacgtgtgccccggcacagaatgccagctcctccgcctgcaggcgttcagctccccggtgccggatccgtaccgctcggaggatgagagttcggccaggtttgtaccccgctacaatttcagccgcggcgatctcctgcgcaaggtagacttcgacatcaagggcgatgacctgatcgtgttcctgcacatccagaagactgggggcaccacttttggccgtcacctggtgcgcaacatccagctggagcagccatgtgagtgccgcgtggggcagaagaaatgcacttgccaccggccgggtaagagggagacctggctcttctccaggttctc

SEQ ID NO: 805 - DNA, 574 bp, mus musculus; identical to SEQ ID NO: 804

SEQ ID NO: 806 - DNA, 909 bp, mus musculus
aaggctcaaagttccagggtgccggtggtggcggggctgggggactcgagacgggttgagcgcgcaactgaccgctgttccgcgggaaagggctgcgctgcctctgcttgcaaagtcaggcagcccgcgggctccttccttctccccctggggaaccccgaagccccagctcacttctagaggccacccggtgagcaacgggacgcgcgccaagggagcccgggtttagggtcagcagctcgcgcacaaggagggaaatggggtccggggccccagagagtcccgcgggccaacgggatggggatgggagctcgagagaggagagcgggaagcacccagcgcctgaagaggggtggcgtgagttagggagtagagagaccaggaccggagggatcctgcggccgcggagtgggtcggggtttttccgcgggggagggggccaacggccagcgggatggagtcggggtgagggggggtgtgcggcagaagccacagcgctgagcctgccgggaaggaaggaagcggggaagggcgccgccgccgccgtggtggagtactcggtacggacgggaggggaaaggggcgcaacggtggcgccacggggagggggcggtgcgggagcgaggcgagcacgggccaagctgcgggattgacgtaacgagcttgggtttcccccagcgtcgggaacatggatgagaaatctaacaagctgctgctggctttggtgatgctcttcctatttgcggtgatcgtcctccaatacgtgtgccccggcacagaatgccagctcctccgcctgcaggcgttcagctccccggtgccggatccgtaccgctcggaggatgagagttcggccaggtttgtaccccgctacaatttcagccgcggcgatctcctgcgcaaggtaga

SEQ ID NO: 807 - DNA, 909 bp, mus musculus; identical to SEQ ID NO: 806

SEQ ID NO: 808 - DNA, 109 bp, mus musculus
ttgtccgctatcactgtaccgtcatttttcagtctcagacagagataccttctctgaattcatagaagctgctctccgttccgaagggattcagaagtgataaatccag

SEQ ID NO: 809 - DNA, 12558 bp, mus musculus
tttttccgtgtcgctgtccccttcttcccggcattcctttttccgcgttctctcggcggctctctgggtctggccaccgccggcacttcgcgcccagggctctggtgacgtcatgttcctgcgccgcgtggacgcccgccggtgaaaggaggagtacctctgccgcccttcgtctccttttgttgggctgccgctccttctgaatcatggcgccgtcgctgtggaaggggcttgtaggtgtcgggctttttgccctagcccacgctgccttttcagctgcgcagcgtaagtaactgagggactgggaccgctcgcgtgggggacaccaggggctgtgggggcgctcccctaagggactgttgaacccagtgcaggagagccgttttaggtcggggtgactaagtaaagccgtgcagggtcctcagcggagggcttgagatcagatggctgaggaacacctagattgcaggacggccagaagaggttgctgaggtttgagaaagaattcagaccgggactctgtcccagaactccagacacgacatgccatatgcagcctaggtagctaagacaaagtgtggaattgagaactttgcatgcatgtggcatcgtgacagctagctagacagcatcccggccactctgctgtccaggcaaagacggagaagttaagtgaccgcttgcctcagggaggcactgtgacacggggaaagagcagtggactggtttaaaaggttggttgttaacattttgcttaactgttaaatctgtgtgaccttgggcaaatgataacggtgctgtatggtgggtttttatttttgtatttttttgttttttgtttttgtttgttttctcagatcaataattgaagttgcttctgcttttaggtgctagaggttccttgattcctttaagggaattcttagactagtggaaaaactagtgggccaacaaataattgcagtaagataatgtgaatgttccaaaggtgtgtgtgtgtgtgtgtgtgtgtgtatgtgtatgtatgtgtgtatgtatgttcatggggagtagtaatttggtgggaccctggggaaagtgccttagagctttgctgctcatagtgtggtcagtagagcagcatcgtggacatcacctgggaccttgttagtgtctactcaggctccacctcagaactgttgaatcagaatattcgttttaataaatccctgggtgatttatagtttgtgaagcactgtcctggaggagaataggatacactggagtactggttattttcgaagtaagctttggctctactatagtcacaaagcaagtaaggcccttgcttgaactccaacagcctcattttcccagtgaagaaatgcctagctgaagatagtcttaaatttccagagtagacttcattcaaacaagaaagttagctagaagtgtgtcattaaaaggttaatccaaacagcatatgatattggattgattttgcttttatccctgtccttacaggctctgtaagttcaaatatactctgcctgcatatttttttaagcagactcaatacattcacacaagtcattttaagtctagagtacattatgaattagggattgtcctatttaatctagaagtggattgtcctacttcatctagaataatattgtcctgcttgatgtagaattaagattttggatttttatatttttcaagtgctaagaatgccttgtggactgaagcaagacctctgcactgctcgtgctggcaaaagactgccatttacctttgacactagttgtgtcatgggaaattgtggcagcagatagcatcctatggtgctggagcatgctcatctctgccatagtgacctttgatatagcagagctctcactgttcatacacgaaataaaccctgttcacctttcacgttcccatttgccacagaggaaactgaggcagtgcaactctgttcactttcccattgtaacattctgcaattgaagtaagtgctggagttgctgaggatgtcttgaatgaggtacagtaaattgtagtaaacagaaaagctggtgctatgtatgacttggggttaccagtttctagatcctgatcgcagccttcagtcccttgcagcctgcagaagtgaaggcagcagcagaattaagcagtagcaaggacagaaattgaagtcctggaactcgagttacatcactgcactgaagaggaacatttccataccagttttcactttggcttcactatgcagtggcagggtcattgagcattgaaaatgtttgtagtcctattgattgttaaatagttatgacttctttgactacttagtgaaagaaacagtttcaaaatttctagagtttctatactaatgaaaaattatgcttagttctttcggtttcatatttgccatctgtcacttacttaaggtgataagacaggccttgacaagcataaactaattcataaagataaggctaactatattagaagaggtttttgaggaatctgggatcattactttatgtagtatataagtcaaccactttggtctattgattttcttgtattttaagaaaggaaaatgggctataatttcctaatggtgtgcttctgctttctagatcgttcttatatgcgactaacagaaaaggaagatgaatcattaccaatagatgtaagttggtcgtttatattccattaagtacacatttaaaatcagtcactttgcttatgacaatttttattttgtctttttaattttttttataattttcaagcatgatatggcatttgttacctgcttcttttttattaaatttttttgaattagagtctcagtatgtagctctgaatggcttggatcttgctatatagacttggctggtctcaaattcacagagatctacctgcttctgcctctgcctctttctttgcctcctgagtgctaggattaaagtcctgtgttaccttgcccagctgttacctgctcttatcactgtaaaatcgaaagattttgaaatcttaaaaaaattctattagacctttttgatcagacatggaggcttatacctataatcccagcgcttggagattgaggcatgaggattggtgtgagtttgaagtcaacttggactacagaataagacccttgtcgtaaaaacaaaagctaaagaaggaaatgggggtgtctctgtattgacagtataaaatggcctttaaaaattgtcatttggctcaaatttttataaaaattcctttttaaatattttattatgcgtgtagcagttcatgccacagcgtaagtgtgtaggtcacttatgtgacagtgtaacagcaggagtcaggtctcttcttccaccatgtgggtcccagggaaaaaagtctcaggtcgtcaggcttgatggcaagcatcctcacctgctcagccatttcactgtcccaacagttagttcttttgaaaatgaaggttaagaacaagcagtgcggaaaaaggtggctttcaacttgagttaatcctagtcctcacttgactgttttactagtttactgttattagatttaaacttaccaaaactgtaagttctttgtaacaaacttaaacaatagtgtgaaaatatctaatcattcaaaattaaaacagtggaagcaacaaaactgatcccattccctggcaacttcacatttgctcttaatagtttaaagggcatcagtgtttaggctgtagagtgtatggacagtgttgtcttgctgcatgtactttacctaactgagacagctttgcgggggctggcgaggtgtctcagtggggaaagacgctggctgaaaagcctgataatttgactttaatccctggaacctacatggtaggagagatccaacttgtgccagatggctcagatttgaacccttccttatgctatggcacttactgcccccacctataaatatgaaccaaatggcaaaattaaggtgaaaactagatcctttaaaaaagcattatgcacttgcatgtgtagtttacaaattgtttttgaaattaaaatataattgtatcattttgccctttcctttcctccttctcaatgcttcccgtgcactcatcccccactctcactcaacttcatggcctctgtttctttaattattgttatatgcatacacatatgtgtatatattcctaaatatataaatacaacctgctcagttcttgcaatgttacttgaatgtgtatgatttcagagatgcccatggggcctcagccctagacaaagcacagccagctaaggaatgccgagagcatggagaaatagtcttcccgagggaagagctcccagattcgctctctaatgctaagtgtgtatttagctttatagttagctaacgttcctgttttgtttgttgagacagagtctatgtggcctaagtaagcactgaaatcatatggcccaagcatggccttgaaagtcttgagtctgctgccttcatctgtgtgctgagattacaggcatgtgccagtaaacctacttcagagttaccttttcatggacataatctttctggaatgtattttgatgacaatccattggtttttcacattcttactaacagtgtgttctatgaaggacattctctgtggggctagggatgtaactcagtacagtgtttgcctggcataaacaaatccctgtgttttctcctctacacccgataaagtggacatgatggaacacacctataatcctagcacttgggatgtagaaaaggaggctcagaaaataaggttttgctcagcaacatggaactgaatccctgtcttaaaaacaacaacaaaacaagacaatctctttggaatattagtggttggaatgtaaagtgacatttcagatgtcattaatttttaatttagacagtgatagcttgtgattagttttgtctctctttaaagatgtggtacatgtggctgtttgctcatcctctttttaccttctcttcttgggagctatatacaaacatataatcacatatatattttcaaaataaaaatcatgtgatcgtaactcagaaaataggctcataatcctatgtggttaatttcaaacattcagattattgcttgcacaacctgtttggaaagcagtttggtgttatgtaatacattgaacacatacatcctctgttctcaagagtttccattcctgtgtaccaggaaacatgtaggaatatttatgctggccttgtagaaatgtcaagaagcatcccacattcccagtaataacgcagtaagccatggtgctttcatatgataggtactaagcacaaagaaaaggaatagattactgctgcagggatgaatctcacaatgttgagggaagatggctagactcaaaagaatgtatttgagtgcatttaaatgagagtcacaatgagtaaaagtaaatggtaatgtgttttagacatccttaaattgttcagaagcacaaggaaaactgtcaggaagaacaaggaatggattactggtatagtagttaactttgagaaggaaggttctgggaagccatgtttggtggcgtacctggaaagactggtgcaggagaattgtgaatgccaacttgactgtttcaagtgagacaggaggaaagactggacctttagctggttggtgggtatctgataccttttcattgctctcctttatattgtgctcatatgctttgtgccctctgctactaaacagcaataacaaaaaggagttttaattgctcttggaagcagacagtttggtacttgagttctgaggggcttagtaccattcagtacttggtgattttgcttctgtgaacatgttgctaagttcactttctaaatcatcaggagtgttattgtacttaagaggttttattgtgtctgagtacaaatcatttcaagtaagaactgaccccttgatgagtggctctgaggaatgtttgttagaagtcatccagagagcttcttttagttgggagattttcaattattgcctctatatcatcggttagtatggaactctttaaattattcacattatcttgctttaattttggtagatcacacacatctagaaaatcatctgtttgaaaagattattccagcttggtggaatgtaaatgttaaaaggattgaatactctccatgtctcctttctcctctttaattttattaatttcactcatttatttcttttggttaacttggcttgaaggtgtgccaatcttgttaatgttttcaaagagccaactctttgtttcactgattctttatatttttgtttttatttcactgatttcagccatgattaatgggatctctatattataccccttccacaaggctcaaagaccgtcttgaaagatggggcagaaagactgtaggagcctgaagtcagggaggatcagagggaaacagtctcttctggctgtgacaagagtgctacactcacgactcagagcagctgtggtcacctgcacagcatcagtccactcaacagtcaagcgtggagtgggaagggtccatgagtccctactcctcactgatgcactgtggatagttaatggcttctgtgaagggagggacagtttttcttaaaggttgactcctggggtcggttattaaacaataatttaatgtagaagagatacaaacttgggggtcaaagaaactgagacatgtgggtgggataaatgggaggcatatcatcaaaataaatggtatgaaagcctcaaagaattagtaaaaattattcaagaatattcatctaaaataaaagtcgcccagagggggaaagcagattgtcagttccagtagcattcatatgctatatgttaatctgcatctttatactcacagatagttcttcagacacttctggcctttgcagttacctgttatggcatagttcatatcgcaggggagttcaaagacatggatgccacttcagaattaaagaataagtaagtcccttttcagaagcatttaatttcaaagacatgttttatgtacatgatttacagtcggtttttgactacgtaaaagttgttttcatctttgtattatggttatgtagtttgtaagggtaatgagggaaataattaagtcagtgtttggtgtcataggacaagcagaagttgaaagccaggtatggtggcacatgcctataagcccaaaactcttgagaagtgaaaagcagaaggattgtgagttccaagacagtgtgagctctatgggaagataaaaaataaaagtaaaattaaaatggagaccactacaaataagatattagattgtggttcctgctagtggcctaaagtattggttggttagaatgtgataggtggatgaaaataggtgtatagaaagctaatagctcagaactggcttccttccctgctttttcttcccatgtatccccttccttcctcccttctcccctccctttctaatgcttttatcctcttgtctcagcgtattatttcgaaaaataactgatttttctgtttcctctgtcctttaatcttgacttgagtcctgccctcagccctatttctgtgtgtggattaaataatactgttgttctgcatatttctcctgtcttttgtttgctctcttgccccatatttttaatttgctttctttaattctatttctggactttcccaaccttccttatctagaaataataatcccttacaatattttctttgaagtattcacaggcagcatctatatactggagaaaatccctccccctccatttacttcattatttctatttattttaagattattttgtatttatgtatatgtggctacatgagtttatgtgcacactatgcacacaggtgcctgtggaggccagagggaattgaattcccctggaattggaagtagaggtgcttaggagccacccacccagcatggttgctgagaactaaaccctgttctctgcaggagcagtacacgtttttaatccttgagctgcctctcaaatatttccattttgaaggtattcttgggtggttaaatggggctaactttgagatttggtcttttttttccataaagagaagattctctggtttttttcagaaaataatatttcaaagcaaacactaaaagtgtttaaattaatacttttttaattttttaaattaattaaattagtgttttgagaagccattaatatctcaagatgtttatggacttttctagaggatacaaatctcactggaagagtctttgaaggatctcaggcaaggagccaaaccaaatggcatcaagtaaggggcagcagaatcgatgagtttggtcaatagtacatacagaaggccaaacgggatttcattgtacctgaaaaacagatccgtgaaatctcatatggcttgaaatatctatgacttaaggccaaaggagaataatcagaggtgcagtgtgtgtgctggcatggaaaggtggtatggtgattgaagttcatctagaatgtgtgtgttattattgctagacattcctgggagaatggctgaagaaaagaaagtctgagaactttatggtcatttccaagtttcatatattctctgtataggaaaaaatatacagtacagtgtgattactatttatagtttaatttgtaattcacaacaaattcgtaattcattagaagcctgcttacttttcaaatgggcttttataaaggtttatctaaaaattggtgttcttttttcttttaaggacatttgataccttaaggaatcacccatctttttatgtgtttaaccatcgtggtcgagtgctgttccggccttcagatgcaacaaattcttcaaacctagatgcattgtcctctaatacatcgttgaagttacgaaagtttgactcactgcgccgttaagctttttacaaattaaataacaggacagacacagaattgagtattggagtttggggtgtaaaacactccccccaagatcagtatttatattgctatttcagagctagttaaactaatctatgggcccttgtttatatattatcgatccgatcaaatggagtatgaattatctgtgaaatgagtctttgaactttcgtatagagttcttttgttgatttgaaacaattcccatgttttgtaaaagtcactgtttcaaacataattccctgaaaaaatgttcggatttttgtgattatttattttcatagatttcttttcttttgcactacagtttttaggaatcctggaaataccatataccatctgtgttttgcagcacaagaatcaaatggtcttcagttcttatcagaccaacttctttaagaagaccaaaatggtgactttacagtttttctttggtcccctaaaaagtgactctacttttacagatacttgccaatttttactttattaatggtttctctccggactccactccctgatactgtctaacataagctgtcttgtttcatcatttctaggattctgtgtgcagtgagcaatttttgtgtcagaaattctatcataacatatatatttaacaagctcatcttgctgtaaaactactcatgttcttttgttgtaaaattttcactgattgtataatgtaagactagttgaaagtagaccaaaaagacaacttgtgacttcattatcttgcctgagtagaatagtattgattgaggaaaactgatcgtcattagccagtctcactcattataagtctgttggtttatgttgtactaaactagtgaattagtgaaagtaaaggaaatggctcattttatctaaaggcacatgtgcaaagaaactgggccaaatatgttctaaatatttggagttcatctatttgaattctcttagaaaattcaggtcatttaggaagttggttctcagcttctgactgagagctggcctggagcttcccatcttcactctgcggtgctgagggggaggatgacatgccattggatgcttttcagaaacagtagtttactctgacaacattggagtagctttttcagctagaaagctaagaagctcaacattactgtagagattattgcttcccacgagcatgaacacattacttgtgttaaactctataggtgtaaagggaatcactgcggattttgataggaaccccgcctgatgctttttggtttgtttcaggcagggtcttcatatcgagaagctcttttacttggtagcattttttgattaggaatgaacctcagcctttctgcccagtcatacagagcctcaaaggccaaggttattttgtcatttctttgttggttttggtttttgtttgtaaacaggattccgtataacctgagctagcctcaaatgtactatgtagccgaggatgatcctcatgcctccaccgtgtcagtgctaagattataggtgctgtcactacacctggttttttgagatcctgggcactgaacccagggcctcatgcatgctaggcaagcactataccagctgaactacatcccaggcccttgacattgaattatgattcttgagctctgttttgctaactaagtctatggagcattgactgttctctaatgagaacaaacttggaaatctgctgattacctacaataatttagacataggctaaaagtgtgaagtcaagccaggtgtggtggcatgtgcttgtaatcctagcacttacaaggctgaaacaggatcacaagtttagggcagaactgggctatcttaatgaacccctgtcttaaccccaacccccaaaaagcgaacccaaggactaatgcgatagctaaatcaaaatggcgtgcaggacgcatgctgtacatcaggcttttctgccatactcctcgactattacttgactgaagagcctcttgttttcttctccttggagactgttttcccttcttaatgtgttttcataacaatgttactgagaatctgcgtgttttgtacttccattctttaaaggatgtataattgccagatgtggctcatgcctataatactaacactcaggaggctaaggcaggaaagttttcacacaggttcaagaccagaattagatacacagtgagaccttatctttaaagaagttatacaaattttaaagggtacaattaagtaactttaaatatactcacaaaattatgcaaccacttgataaatctaggccatttcactcctctccaagaagccctgtattctttagtagtcacctctgatttcctcccagtttgtcccacgtaggtcctaggaaaccaatagtttattatatgcataatctgatcatttactataaatgagttaatgcaatatttagtcacttagtttcataaatatggtttcctacgtgggataaatgctcattctgagaactcagaacccagtacagtgacagaaagtgtctgggtttgtaaatctggtaggaagcttgcctagcacgtgcgagaccctaggctcactcacagtatcccaggaaaaaaaaaagctagttgataaatcaatggatttaaagagggaaagccagatacctggcagactctagagttaatcttattaaatagagtacttttcctcctagccaaacattcattctatactactgcttctaacttacattctagttcctcccagctctgctttggttttgccaagacagggtttctctgtgtagccctggctattctggaactcactttgtagaccaggctagactccaactcacagagatccacctgcctctgccttccaagtgttgggattaaaggcgtgcaccatcagtgcccagcccattctcgtttctacaatggatattaaaatgtcttcttgtcttctcagccaagaaaatcctgcttaaaaaaatgctaaaacatttggccgataactgacatggtaaatttatttagacgtgtccacctttggacagcttgcatacctcagaccaggtaaatagccccaggtttttaaatcgacttcattgaatttctgctatcttcttgaaatatggtactatacgactaagtcagatttgggtgtgttgtaacagtgctaagtgtgctcagtagaattttatttacagtactgtgtgatagtccattactgcctagggtagttgaaaaccagtgatctgagctagtgctaggtaaacctatagctgacatgatttcagtcacactcaaaaataggagacatgtacccagcaaagttctccagaatgcaggaacacacttcataaccagggaactagccaaatcctatgggctaatagctcagctgcagggaataaagattgtgaattggtggcaagtatgcacaataactccctaataattgcttcctaagcacttgtggcatacttttgagtgacataacagcattttcttggctgtacatgaccggtttccatgatgtattgaatactgttgtttgtgagccttgatgcctgtaacaccaataaacccattgttgaatatattttctctctttaaatgaccttgccttgtccaataaataagcgattgtct

SEQ ID NO: 810 - DNA, 73 bp, mus musculus
aagctgtgatgaatttgaatccactgatcttccgacatgataaatgcattgtcctctaagaagttctgagctt

SEQ ID NO: 811 - DNA, 73 bp, mus musculus; identical to SEQ ID NO: 810

SEQ ID NO: 812 - DNA, 69725 bp, mus musculus
agacaaaagacagcacttaaatcatcttcaggttgtgggtccttttggaccatttcagtgctgagtggcaaggtatttccgcgacagaagaaattccaaaagccttaggtgtcaggttgcgtcaaggtagaccttgggggtgggggtgggggcagggaggggagcaggcagtttatttacctttcttgaccatataaaccgtccgcaccattttcttgccttttatttgacaagtattacagcaaaccagacttactcatccatcagttatttctctgtgtgttctacacaccctggaatttccaaaagcaggcatacgtcttcagtttgcacaaagtttgtaatgcataagctgtgaattaaatttgtttaaaaaagccattacaacgtgtgattatgtgacaccaataaatattattttaatgcaggtgtcggtattcaatgaaagcaaataaattaaatgcttgattaatctatggtgattaatacttgatgatcattttaatcaagaacctatgttttgagtaatcatgtgttttatattaaatttgaaaataagtacgattttattttccttcctcttcattaacagaaactgttcttttcacatccattttccataaggaaaaaaaaatctgatagggctggagatggctgttttttctacccactctttattatcttatgttgggagactcagttttgtagctagaggtcctttgatgggattccaggttagatagatagccttctacaaattgtgcttattcttaaggaaattgttgctggtgggtttggcaaccggttggcgagctactctacattatttttgtatttattttccttccacatgaaaagtaacacattattcagaaggcagactataccatttgccaactcattcagaatgtttaacgaggtggagtgccactagatacaaaagggccagtgatcagaaatagtagacagtgtcaaaagctttagtgtattaccaatgttttgaaatagaaatcaaatgtttttttcatatattctaatgtgttttttccttaaatttctcatttgtttgcttgttttctttctttcagaggactctttcaaaatatagtttgatttttaacccccactaaaatttctatgttaaagtagaattttgaatcctgaatctcttccactatatatatatatatatatatatatatatatatatatatatatatatatatattatatcaattgacccaaaccattgttctctttgcagagcctcagcttaagggtatagttaccaaactatacagccgacaaggctaccacttgcaactgcaggcagatggaaccattgatggcaccaaagacgaggacagcacttacagtaagtgactgctaaataaatagtatgtaccagcatattgttgacattgggttctttttatttgtttttaattcaaacaaactttgccaaatccttatgtcaatgcaaaatatgatcatgtgacataaccctgtttgcataggctcaccgacaggaagttgaacatggaaacatccaaaatacaaagttgagcaaatagtgttgacactatctgaaggatgatccaaatgtcatctccatggtaatctagatagatttatggctgtcctttggattttattactttttccccccagaaaaatttctcacccacacagtgatcctgaaatagcatgctatctccactcttaaagatgaacctcatcccaagaggcaggagtggtttcataccgcgataattcattgttacaagcttttgcccctgccacattataccaataagtctgagactaattgatattttaacattgagttacttgcatggctatgcaatgggatttctttaaactaaactggagaccataatgttgaattaagaaggaaatgcatcaaaatggagttttatttgcaattactgaagcccagtgatctgaaggtgtttgttatacacctttgtctacaaatatttatttagaataattaaaacaaaattacaaatagtgccccctttccttcaatattaataattgttgtttctttcaatttacagatatctgcagacttactcatttgtttctgaggactaaaaaattcttggttctcataattcattctgttttcaaaatttggattcatttccctcagatttgttagttcctagaaatattcccattgttggctgagaaaatagccacggaaagtaggtctggctgctaaggaattctctgtagttcattcttttggaactgcataactgtaggcagtaaagccatagataagtgttccagtattaaggattaaagaattttacaccttttaagaatgcttcctgggctgaggcttgaaatagtacctcaagagaaagttaccttcaattacccttgaagaaatgtctcttggttcctaggatgaaggcctagtatattaaatggctgttcagtgttttgccaaatgctgtgttgctgtgatgatattaaagttttataacgaatcctagttactctttcatgcatactactctatttgaaacaactacccaaacgaagctcagcactttactggaatgaagtaacacacgtcactacatagtggttcataataaattgtttcaccaagttatggatacaaattgatgcttggggcaggggttaagtgatggatgctactctctatagtgtctcaaaaaaagagcattcttaaagggaagtttgtgattagctaccaatctggttgcttccatatactttaattgtccaggtgcaaatagagaagaaatatttggttctagtatttcctcaaaatgaatagttttgttttgttttgttttaaatagatgattgagtgtgttgtctgctaataagagtgatatgacgaactcataaagatcatgccttatatactcattttaggagatgcacatattagcacacacagagaagtgcatacacacacagctccatttcttactctggatctttatactgtttagaaggttatgcttcttcattactccatatccataagttcttcttgtgttatcttataactctgtctgacatgccatttctgaatgctgatgacattcagagacctttaaagagcatagccagataacaagaatccatgtctactatgattataacatatagtggtaagtcaatgaaaggtaaatattaccataacatgcagcatgcaaatgaaaagtatcacaaagacccagcaggccagtcgagcttgacttcattgtgttgaggagcaaccagtgcttagggagatagctccacttccccactgctgctatgccacccagccgccataaaacatagatgcctaatcattaaactgatctctcaactttcaaatgtaacccttcgaatctatctccccctaccaaaccaagcattttagtattaattttaagtgattatttaaatgaatggggaaatagaagttttttcaactatgactcattttaatagtatttcctcaacatatcttttttattattataattttatcatttagtttcattcaattggttttatttcattttagcattgatatggtaaataaggccacataataaaacaaataatttcatgctttatgtatatctctttataaatccatgtttgatactatgcatttaaggctaccttatgtagatttattataatggtaaatgtcaatgacatttcatcatggacaagtaagacattataaattatgcatttttccctaaaaaggcaaagttgatagacatttcatcaaagctgttttgttattgggtacaatgaatggatttttaatgggtagatttcccctttattcacacttggccactttagtgtgccatgattctccaacacacattaaataatagctttattaattattatctcttggataaattgaccctaccatggctttagcttcaactgttcagcaacaagggagcatagctcagtgtgactaatccccttaagttagaaatgtttgttttgatatagtcacaagagagaacaattaaaaagcaacatggaggttatttatgaaagtttccttaaatccacaaaatgaatgaatgaatgaatgaatgaatgaatgattgaataaataagtgttcaggcatggtggtgcacacctttaattatagcactcaggatgcagagacagacatatttctgagtttcaggccagcctggtccacagagtgaattccaggacagccaaggttacacagagataccctgtcttaaaaaacaaaacaaagcaaaaacaaaccaacccaaaaaatctctagaaatctggctgaaagagttgaaagattttagctacttaatgaatttcttttagaaatacaaatgaaattaattatttttcatattaattttttcatcctgaccaaacatctttttgttatgtctagcgctagtaactgtgagttcagttttctggcaaaaagtagcaagcccgaacagaattaatgcatatgacccaatgacgtactctacatgaaattgttggttactattgagattattcataacaatactctagtatgtttctggaattaaaaaaaaattatctgtcctgaaattaacattaccttagattacattatatgtatcgttctttatagtctgaagatattaagactgtctagcctgtgactgaactaatcctaaaatcaaattgtgatacatcttaagtccataaaaacgtattacaatattagagaaggcacaacaaggctgtgagtgtcagtgagtgccagtaattctaatactaaggaagctgagacaggagaattgcttacaagttctggtgagcctgagctgcatagtaagactcagatctgccagagaaagccagattctgtctgaaaggcagggaagagagcaggaccacaatgcataggacgtgattctgtccaagcttacttctgctataacattttgtgttcttatctgggaagactgcccctttggaaaacataaaagccaactcagttatctaagaggaaatattggacttctatgtatgaacaagcagttcccatttttttttactctctttagttttggcatacacgtttgcatgtgtatatgtgtgtctgtgtctatgtttgtgtctgtgtatccagcttcataaatatttagggtacatagtaaaaagtgaatggcctcttacaaactcaatactactatccaagaatatggactatgggttgatgttgggtgcttctcttcgtcctttaagtgtctgttgtttgaattgtatgcatcatttctcattaaaccagtctgagagcagtgaaattaacataaaattccaatccttatcaatctcttctgtcccttcctccacgctcacctctgatgttaaaagctacgttcatacaactaagagggttcacaacattgttttataatatgagattctagaaataattttgagtttcatttcttctctatttccgttatctattgctataacctaatatagcctccaggaatgttggttttatagttgtaggctaatatgcagtgatatgaactttaaaccaacccacatggaaatttttttttgtttaatttatggtaggtctcaagagttttgatctatgattgctatttcttatgctcttcaaaaagatgatcatggttctaccatatagtttggtctacaaatgtgttttgagtacctgaattgaggaaggtatcatcaacagaaaaagacatgacttattcatgatatactcaaagatattaggtttatttcttgtacattacattgtcagatatagcacatgatcctggctagcatcctttgcaattagtctcctttacttcctgtaacagaagggcacaacactttatatggtgagtatcaaatgaagtgccatcagtggcatgtggtaggaacacttgtattttcaactgtacaatatgtcctacctcctccttgctagaacccagattttaaggaaaagatacattgtaggttttgcaggaggtattttgtttgttctttattaatatttctgcacatactaccacacctactgtaacagagtctatatgctcaaagataagtgattctagaaaaaaacaaaaccttatacataggagctatacctttaaattcttgttcatgaaagtaacagatcagtttatcatccctaaagtacatacaaaacaggcaaagtcatcaacattcgtctatgactcctgagagaaaggtacgcaggctatttccaaaagatgtgtgtggcaaacactacgttttaaaaatgtactgttttatttttgttcgtggtgtgggagggcagagacagctggtggtgggaggacacccactggttgtctccagtgagaggtgtgtggtggtgaggagtgcttgggtgtaagtttcatgcagtaagacctgcagacaaagcaatgaagaccatattagcctgcttgcaatgattttgcaggacacattaaaataacaaatgatacttttcttccatagattatttttattcctatacctattatctttgagactaaatgccaggagtctgctcaactctatcatcctgaaaaaaatgccagttctttatgaaaaatagttctctgggaatataggaatacaaaatattttttttctgcaaggtccagatttgtttagaggtttttgcattgtaaataatacagataatttaagtgaaaatgttgaagcagagtgtctcataagagtgtaggaatttctcaactggtagttccatctaacagggctcatgaacatttcagcaactatctcgagcagcaagttaagagattaatttgatgagaacgctatcttagtatatacagtagttcctgatactttagcccacccccaaattataaatattttccaccccagcgctctaaaattcaggatgctcccaccaaagtcttccattctccctggaatgttagagagtatgttgttattgactcacttaagtgaatataatcagtagtcaaatacactagaaagtagaacatagctatatttgtacgtgtctagatacaaaagtctagagtcatttattctacactgcttttaggaagccagacactactatggaatacattggagagtcatgaaatttggaactgtaacattttcccattctttgacatttcagctctgtttaacctcatccctgtgggtcttcgggtggtggctattcaaggagttcaaaccaagctgtatttggcaatgaacagcgagggatacttgtacacctcggtgagtctttgtgtgcatgcttttacaattcgtgttttcatctgatataaaagaaaatgtatgtccttttgatatagattctggttttgatgaaaatatatcacttggacaagcaaattattttcttgtgacaattatagctcttcctaattaatcgtgtaaaactagcatggtcaaaaaaaaatcaataatatacctaaaagttcgacagacagtgccattggagtagtaggcaccatcagatagagaacaaacctgttctttaactacatagccatatctgtccccatttattcctgaagaaattaatgagatcctttttaaaccaactcgagaatacaaaaaaatggtttgagaagtgttcatctgtgttcattactaatctgttcagataataaaatgccatctgttttggttttaattttttaattatttgaattgtcaaaattatgggtacagtgtgataattcaatatttgtatacaatatataatgttcaaatcaggaaaataaacatttccatcctttaagcacatttaaaaatttggattaacagtcatatttctggtttagagtatgctattttagcacatttgtaaaatattacccaatcagaataattatatttcactatcataattttgtttgcagagatatggaggatatggaaggcttctctattcttttccttcatattagatatattactatagtactaatgccatttttttgtttatgttcaagcacaatttaatctcctgctgcatacagattctcactggtgtttattctaacaacagtgaggagagtgaaatctgtaatatttttcagaaatattgataaataatatattgataaacagtatagcttacagtttaatgaataccatggggccagatgtacttttaaagcaagtgttttatatttaaatataatttttaaatgacatagtgctagagttaggattgtttgtttgttttgtttgtttgtttgtttgtttgtttttgagacaggctttttctctgtagtcctggctgtcttgaaattcactctgtagagcaggctggcctgaaactcatagagatctgcttgccactgcttctctagtgctggaatcaaaggtgtataccagctagggttagggttttattctttcaataaatcttgtttcaggttaaaaaagattattaatattgttattacctacgtcgaatcactgcattttaagaaagggacagagtgtgattatgttagtttggttctctaactccctacataattaatcaatcaatgaagaaaacttttaggctttcagaaatgggaaaaaacctgattattgaactgcctactagctttaagaaaaaggtgattactgaaaacaatctgtattcactcttgctctgacttgttatctgagtttcatttgaagtcagatatgtaaaaagacttgacagacatggtaaaactcagacagtcatcttggttttgagggactaagatggagaagtgggagacaaacaagcccacaaaggctcgttcatcagcaggcacattaaactctggccacttgtcaacatttcctctatcttgttgcttaagatatataggggttttactctatttagtaaactaaaacttggattcattgcaagcttcctgaaatccattactctgtgaataaaatgctagtactataggaaaaaggatgagaattttttcagctttgacatctaatgtagcacaatttcattttaagtgacctcttttagatcaacatgatcatgcaacaagattgaaagctcttaatataacaaataatttctagaactaatatgcaggtatagaaagaaaatagaataatgactgtatttgagaaaacaaaatgtggaacattctatatattgttttagttagggtttcattgctgtgaaaaggactaccttgatcaaagcaacctataaaaggaagagtttaactgggcttacagttccagatggttagagtctatgatagtggagtgaaggcatgaaggcctgagtagcagctgatagttcacacctcactccataagtacaaagctgtgacacactgggaaccgcatgagtcttttgaaacgtcaaaactcacacactcctccagcaagaccacatcctccttatccttcccaaatagttccatcactcagagaccaagtactcaaacatgtgagcctataagggccatttacatttaaactaccacattccaccccaagcccccataagcacatgggcatatcataatttgaaatgcatttagtccagtatataaattcctcatattcttttagtctcaatactgtttaaaactccaaagttcccctcccccctgagactcaaggcaatgtcttaatggtaaccctttgtcaaataaaacagtaatcacattttttctttttttaaattattattattattattattattattattattttattattttggtttttcgagacagggtttctctgtgtagccctggctgacctggaactcactctgtagaccaggctggcttcgaactcagaaatccacctgcctctgcctcctgagtgctgggattaaaggtgtgtgccaccacgcccggctatatttctaatatataatgccatagaaggaacattccaaaagggaggaatcaggcacagtgaggaaacagtgagccaaaaccagaccaaggcacatcagggaaaactccaaatcctacagcgccacttctcatgttgagaggttatatggctctgacctgcctcctacttcactgactgcaagacatgtctccactctcaggctgctgattctattacctgtgtacagatatccctggacaataccccatatctctagcatgcccagaatcttggggtctttaatacaatccagctttcacttcacataattgcttctcagggccttcgagcaggaactgccatgccgtttattgcctcagcaactttctttaaccatggaggaatatgaataaaatggttaatgctgctaagtttggctgcccgcttgtgatgcagcctggccccattgaatcacatttcctttcctttgttgctgtttttgaggaagcctagatgggttgagttttgccctgagtgacaaggagggcaaccctcctttattcttttgtggatcaggcctctccttatctctttttagcacaagccttggctccaacagtaaaatttccagtactgctcttctcttcaaactgtgaattttgtatttctttccccccattttttaaattataaacttcatgaaccttaacaacaacaatataataataattaataattaataatgaccatatgacagactcaatatttggctatcttgaaaaatctcctaccaaagaaattatttatagaataattttagaaatctattttagatttagcctcaaaatattctttttttaaaaaagatttatttattttatgtatatgagtacactacactgtagctgtcttcagacatacaccagaagagggcatggttatagggcatcattatagatggttgtgagccaccatgtggttgctgggaattgaactcaggacctctggaagagccgtcagtgctcttaaccactgagccatctctctagccccacctcaatatattcttaggacaagggatgaaaacaactacagcttttgccacaatgtgccaacctagttacaaatactgttgttcccctttgaaacttcttgagccagatgtccattgtttgtatgactataagcaatgttgtcttccaatggcctgttagtatggcccattaatctctacttacaatattcaattacttttctagttcacaatccacactctcctacatttcttcaagaattagcatggccagttccattgcaacagtcctgttcccagtactaacttctgtctcagttacttttctattgctgtgaacaaacaccatgctgaaggaaacttctgaaagaaagcctttaattgggcttagggctccataatggcagtgggcaggcattgcagctggaacagcatctgagagcttgtatctcaattcataagtaggaagcagagagccacagtggaaataatgtgagtcttatgaaacctaaaagcccacccccagtgatacaccttctcccacaaggccacatctccaaatccttctcaaagagagttctaccaattaggaaccagtattacattagtatacattagtctatgacagctattcatattcaaaccaccacatatatgcgtaacctattaaggaaaagtagccttaaataagcaattacaaatcagggagaggaagtacattcattaaggtggaggtatttctgatttatcatggagttctggtctagggaagacaactgagtcctctacaggataaatgtaccattttttccaattactctatcagttatgacttcagatcccttcaacaaattgacaaccatcctgtctggaactcttgttttattttcatctagtttaaaatgtgctctccagaccctattagaacagaattctatgactttatggccaacttacttggtaaataatttagcctttgtagataggtcataaaatttctgtcataaccatttaacattgctgttgtagcacaaaagtaatcataggcagtaaaataaaatgagtatcagtcccaggaacagtttattcaccaaaaaaggtactgggatggacttggtttaatgggtacagttttcccatgtgtggccatgtgtttctttctcctctgacccaaatagctgttctttactacctctgcccttatattgtggattttcacagatgaccttttattgtattttaatgggaaaatagaggtcatctggtaggaaatccaatggacttttctatcacatgcaaacatgatacatctgtctctgttatcctattatcaaccccttgcctatttgtagagtgacccttcttctctagttcaatctaccttttatcttatactttaatcatctcttctacctcagagttcccttcatatatctttaattatccctcatctgctagctctagtcgtttagttaacattcaccaaaaaacaacaaacaaacaaatgaaaataaatctttctaaagccttcttctctgtctacacctccagtagtctccagattattcagatattcggaccttttaccactttcattctttttttttcccatttttgttaggtatttagctcatttacatttccaatgctataccaaaagtcccccatacccacccactcccactcccctacccacccactccccctttttggccctggcattcccctgtactgggcatataaagtttgcgtgtccaatgggcctctctttccagtgatggccgactaggccatcttttgataccactttctttcttgcctatctttcttttcactgaagtgtagtttgactcaattaaaagtatttttagcaaaatcaccaaagactgccatgtaataaactgacaattcttgttttgctttttttttttttttcaagctgttgacattactgaccctgcttaaaattccctccctctttagttttggcaataccactatatatgctgaaattccttctttgctggccacttccaaataataacattttgaaatctcatttctctttccatttcacatatttttttctctttttccccatatttctgggtaccattcacattcacgcattgatagaaatgacatatctccatatactgactttttaaaaaaattgtacagtaagactcggaaggtgggtcattagagattacgaatgaaagggagaatttgatctttggcatttcagttcatggaaaaactattatccaaatggaaataaaagaaaaatggcagatttggtgatcgatatacctgaatacagattttctttcttttttctttatttttttactagatattttctttatatacatttcaaatgctatcctgaaagtcccctataccctccccccaccctgcgaccctacccacccactcctgcttcttggctctggcattcccttgtactggggcatataaagtttgcaataccaaagggcctctcttcccagtgatggctgactaggccaccttctgctacatatgcagctagagatacgagctctggggggtactggttagttcatattgttgttccacatatagggttgcagaccccttcagctccttgtgtgctttctctagcttctccattgggggccctgtgttccatcttatagatgactgtgaacatccacttctgtatttgccaggcactggcatagcctcatatgagacagctattacagggtcccttcagcaaaatatttctggcatatgcaatagtatctgagtttggtggctgatggatccctgagtggggtaatctctggatagtccatcctttcgtcttagctccaaacttggtctctgtaactccgttcatgggtattttgttccctattctaaggaggaatgaagtatccacccattggtcttccctttccttgatttccttgtgttttgcaaattgtatcttgggtgttctatgtttataggctaatatccacttatcagtgagtgtatccttgtacagattgcctttacaattccaaaaaattattcatgagattttgaaaactggtgattcttagaagacctttttaatattatctgagttttcttttacatttctgcttttctgtctcataattctcccttcattcaatgtttttcatctattaagtgaaaaacaccttcatgttcttattatcatagaagtaacaacttatctcacatgcttgtactgtacatacttcctgattattttcttgtggccatagaggacagtcttggtgtaggctcaagtggcagtgagaaccatctgtggcacagataatcataattagccattattttattacatatttacttttaactataatgtatctcttttgggaactaccattgtacatagagaacatttttctgttttttttttaactaataaggagttccacataagtgtttgagagttctcaaaacttcatagcataaatattttataacatgaagcttttgtaataaatttttcaaatgtacttgaaatatatattaactataaaagttcaagattttaaatatggaaaaattggtaacttcttagtgtatttagtagaatggtaataatataaactaggcacagatggtgagaaagcaaagataatttggtttttattttagaatgttctagacctcatagcagcatctttatctaattactatcttttatcaaaagcagcagaccatttaggagtacgcagtatcactactaagcaaaaatgtatagacactgaggattttgaaagaaggaagactttcccatgcatacatttccaatgatttttgagaattatataacaaacatgatttctggtttttggactaccaaagccattcatatgcaaggaaacacattttttttattacgtattttccttaattacatttccaatgctatcccaaaagtcccctacaccctacccccccccccacactcccctacccacccactcccactttttggccctggcgttctcctgtactggggcatatacagtttgcctgtccaatgggcctctctttgcagtgatggctgactaggccatcttttgatacatatgcagctagagtcaagagctccggggtactggtaagttcataatgttgttgcacctacagggttgaagatccctttagctccttggatactttctctagctcctccattgggggtagtttcataccttagacagcatatattactgactccaggactttactcagtctgactaaggctacatgcttttcttcactgagagattattttatatattttaaatttatcacatttcttctcccatcacacagaaattgactaatatatcatgctcaaggccctatgatacattttcattcagaggaatcactactagaaatattgagaaattaaactatacaagtcctgtagaagctagaacaaagaaactttattttatcttttctttttttttgacaattcagatttgcttcccattaagaacaacttctaatggtgggaagcaggaagattgtagaaccagaggaacaggaagtctgctatgaaattgtatcttctggtctagtagaaatatagggtagctacatccatgaaatcttaccaacatggctgcctaaatgaaacctaaacaagtacatcaatagatttccaatatggaaaagggaaattttatagggccctaacctttgaaaaagaactataagcaactaagaagtaatgagagcaggacaaatagtcttccttggggataaactgactgagatggttgtatttatatatttaggcatttttagatatatatgtatcacatgcaaatatgtaacaaccaaggaaaatatggctatgactgagagagaacaggacagagtacatgaaagagaaagtgatacaattatatattattcataaaacataaaaaaccataaagaatattgcataactcagcatcagttactgtttcataatttgatgattttgtatcatccatcccaggacgttagcaattgtgaaattagttaaaccttgctgtttaatcaagcctaaatatcataaagtatttaaggagatggaaatgttagctagtataatgtgatcagtgtacgttatatgtatatgtcatggtcacactgtactttatacatttggtaaaatttaaaaaaagataaaaataaacatgaatattgagtggaatatgctcccatgtgataaagcctcacaaagagttcctttccaggtacatgtgcttattgaagtatgtacatgtgttcagatattacagtccattacattctgtgctcctcattaacctccactggtcctcttgtcttcccatccctcttcctttagccgaatagtcttatcttcttcgtttatgtcatatatgccatttggcaaccttccaaggagggatataataatataactatagttttagcttggtgaagaagcaccacattgattcccatggaggttacaatagctcataatcttgatggctttagaacccctgcagattatacactcaagaacttcatttctgagtttcttgacctttttagatctagcatgtaggtattctctattcagtggccttcctaatctcatgtccataccattgggcattttaataggttaagtcattgactattaactctatctcttaactctatattttgcatctttcactatacatacacacacacacacacacacacacacacacacacacacatagtgaatatctatatggatatgaatgtgtgtgtgtatgtgtgtgtgtgtgtgtgtgtgtgtgaatgcatgtgtatgtcaaggtcaaagatttctccctgaacattaagcttactcactcatctaaactggtggggctttggctccagggagtaaggatgagcatattgtttagttggtaaaggctttcctgtgacagcatgagagcttgagctaaactgcccattgcccatgtaaaagcttactgtggtggtacattcctataaccccagcatagggttggcgtggaggatagccacaagaggatccttgtgtgtactcactggccagcaaatctagctgaaatatggaactccaggttcaatgagagaccctgtctcaaaaaaataaagctgagagtggtagaaaaagatagccaaagtcgcccagcagcttctatatgcatactcacagacaagcatgctgcactccatacacatatatatatacactatgcacataaagttggtgaatacaaatacatttgaaatcctttgcatgtaacttcaaagcacttcattgtttacttactagcagtagttgtaatttcttagataacacaacaaagtctagttctcaagttcagtaaatttaacataaacacaatattctagtattatatctcatctactgtacattttccaattttatgaattgacagatctgttcattatagcattttctcttcagtctaggatccagtctagagtaacagactgcattaagctgtcatatttctgcaatattttctgagctaggtaatttccagtccttttattttataatattggtagatttttctagcaatatctttttggagttagcatgttatcatgtagcctattacctaattttcaattatataaatacagatctccggtgtttatattaatgcagaaatatcaatatctacacacattcattgatcaattcataaaactaattaattcctagaagtcttattgtaacatgggaaaatttggattatgttatacagataacatctagataattgaaggcttagggttattataatagagaattacaaaattagtaaaaagcattgtagaacattgcttttataagtatagctatttatgaaactgactttgtctcaatcaacatcagcagcatcatatccaatgcagaagaaaacaatgagcaagttaacatgttaaaaccaaagagagtgggtacaaagaaagattaacttctgattgtaacattcgggggccagtgagatgccaagacctgaactcaatcatcagaatctacttggtgaaaagagagtatggagctttggaagttgttttttgacttccatttgtccactatggatcatggcccttccttctctcacaataataaacaaaaacacaaaaacgataaccttcacttaatttatatttattacagtttttattcactataaaattgaagacgttttaattgtcaaataagttcccagtttgggtgcatatgtttaaaaaaactatgaacaaagaatctacatgtatgcaatcatacattttgatgggaacttttgttcagatgagtgcattgtaatgttataacagcaattatacagacacatttctgagtcatcttttggaatgcaaattttaaaacatgagattattttaaaagaaaaaagcaaaatttcaaggccaagatcatttttcgagtcacatatttttcaactgtttaccattctttgtagtgctaagagtttcattaaaatataaaagcaaatccagcttggaatgtaaacaccttttcattgtccctataaaaacaatagccaaagccagtaacttattcagggtgaaaaaaaaatctgtgtttatgtttttaagtgtgaaagtgagtgaggactttctcagaaaacagaaagacaatagtggcagtaggtaaagacagatactgtctctgtgatctgtttctgaggccaagttggaaaggtagtgtaaattagaagtcacagggcacatatgtaataattgtctcatggttttaactcgtagttaaagtcatgtttgtaggaacacaccatttatcttggaactaaaatataaagtaattgtaaagaaagacaaaagagggttttaacctgtaaagtcagatgtgaggaggttgctcccccccctgtcttcttcctacctctgtctctcacatatgcaaaagacaaatggataaaccacactggaatccattgctctgctgttatgatgacactaagtttattttggaattcctaaaatactacgcttttaatatatagcctaccttaaccaataggagatcgttctagcaatattctcagtagagtttagtagatgtatggaaaagaaccaatggttgtttggcattattttatgttagtaaaccatgaatatcttgaagacattattcaatgaaggcattatttttagtccttaccttcttgtttattttaatccacagcagataggaaagaatagctcactaatacattttccaagttgttcgtttttctgtgaaacctgtgctttgaaatagtttgctgctgaattctgtacttatcagttagtgaccaaatttccccactctacccttagccttatattagtgtctctcaaaagtaccttttgatatttattaattgaaaaaatataaacataataaatataaaggccaatttcatgatttctgtcaggtctatttaaatatttaaaatatattaaaggcacagattattgccatttttttatctatttaaggggcaagttttcaaaattatgtaagtcagtgcattactgaagcacaaagaaaactcagaagggtttcaatgactaccagtcttcaagggaattatgagttctgaagagagaaactttaaatgaaaatatttctctgatcattataatagctgtaaccaaggttaataactggcaaacccctgactaatacattaaatatgttttgcttgagctgaatatgtctggagatggcacatctgtgcaaaaactctgattaagttattcatcagatactctgatgctaactacttttgacaaccctggaagaagaacttcagggaaaacctcaattgatttcttggatggatttttgcatatagccagtagcaataatacataatgcctgctttcatacaagcatcagatattcataggaattctggcacagcacataacaagaatagtcaaaattagaaatgacattcattttgactaacagaaaatattttcataatgatttggaaaagtcaagtgtgcataacaattttaagtattttgacttggactgcaaaagtagagaggatgaaaaatgctttaacgagtatacaaactgtcccataaaatttttataattgggaatgagacattaggcaatgaaaatgataacttagaaatgaaattcagacaggtaaaactatattatctatgacaaatactatacacccccttccccccgaaaaatctgtccatagcaaatttgttggtctaccttgcttataaaatcaaggctactacaacagtctttcttaggtgtttgatagttggtcttataaaagatttcttttaaagtgttatataaagtattcctttgtttttgaccatataatagtggtgtgtctctgaaacaaaagttttcatgcaaaaagcctctgaagaaaatagagcctagaggagtttggaagctgagtgcttctgtgctctctcataagctttaaagcagagcttcttcacgtggtttaatttccctactctcagaaaccatacctaagctcccagctaacacaacgcatgggccaatggtccacaagctttctggtgtggcttttgtatttcttcacaaaatattttattaatacttggagaatttcacacagtatgctttactcttcttcaccctcccaccctaaccctttttccaggttcccccttcccttcccacccaaatttgtgtccgttgggtttgtttttactccatcagagccagtgtgtgccacccaaatgttcttggatgtgtgacccctggagtatagtctatctaccatgggtatcactattagagaaaacgaatcctcttctccccaacacctaagaattgccaatagtttctcagctgaggatggagttgatgggattttgtcctcctagaaggttttattgtaaatcaactagcaaatacctgttaagtccctgcaagtactaagcatccaatatgtacagagagtatctagaatttataatacacacaataaagtttatactaagctctgagccctaaatgttagtagatgatctactgggggaaggcttcacatgtactatttcatctccaagccgatttgaaagtttggcaatgctatttttagcacaagactcagtgtaaagaaaaaaatatttcttttaaggaaaaaatgtaaatgtccttaaggctgggactaggggtgtatgattatggaactttaccagttgtatcaaacaatacttgctgcttctatagcagcgcagtctgcagcagatcatgttaaaattgtgtctatgtctgatgggggcagaacagttgaacatgacagagaaatgctcttcaaatatagcaaaaaatgatactacttagagtttgaaagctctctaaatctgtaactaaaaaaaaaagatatctcacagggacagcccaagtatattatattgggccccagcaacttaacctatggcagagtccactttacctttgaacagagctagctttccctaatttttaatttgcaagtgggcataggaaagagaaacagtgttgacccagagatacagctttgtggagctataatagtaaagatgcattaacacatagtaatattgaatactgaatattgaataagcattggtgtttgtttttgtttttgtttctgtcataacagagttagcactgactttcatgaatgatgaagcaacacagcagaactttgatccttatattttctcttgtttcatctttagaactctgatgtacatttgaattttccaaacccctaagactcatttaacacttcccttcaagtacaaatggtgactaatactgcagaaagcaagtagatgcaaaccatattcataaaatctatttatttatttaataaaaggtatttattacatttatattcctaaaatagttctcagtgatgaaaaacacctggccaattcatgtttcttttgtactcttctatccccagatggaagtactagcttgtaaaaagttctgtttccaatgggctaccactgacacattcaaatgccatcaggggttttagtctaacagatgttaagttgtatgtaacagactcagcaaatactttgatagctagtatttctgatacagacatataaccttattcaaacaaataatcttaagaatatggaacagcagagctatgatgggtggttttgtacagtcccttgcttcggtatagaccttagttctacttctgcctacacagagcactttgatatagcattcaagttgtttcaggtatgcctctccatcttttgaagcaaggcatttttcctctccataattcatacttcaatttaccattcctacccagtagctcctgtctttaacctatgaactgtttttatttatttatttatttatttatttatttatttatttgtatgtttgtttatgtataggatgtgtatgcttgcgtatatgcatatgtacaccatatgcatacacagccagctgagctcaatagagggcatcatatcccctagaattggagttacagatggttgaaagctaccatgggcatgatgggaaagaatcttgggtcttctgtagaaacaataaatactgcttttaaccactgagtcatctttctggccccaaacctctgaactgtcaatgatgttagtgaagattcagtgtagagagatatattgttttgtttgtttcctaatgtctatacatatttttctctcttgtgttagcatgggacattcacagtccttgttagggaagcaactgtttttcttcttgagtcttgtatattggtatggatctatacaagactcatttggcaacatactgcccacatattagtgttggttatataattgtaaaaatcaatacataacaaaaatgcaagcaagcaagtgaagaataatggtaatcaaaaaatgtaggaaactcagatgtactgatacaattctgggtgtgatttgtttcagacctagctattgttattggcagccaggacccttttattgtggcagtttgggggagccaatatgaaagtgaaacagtttttccccaacttttttagtagtctttgaaattctttcttatttatttatttattttattagatattttctttatatacatttcaaatgctatcccgaaagttccctataacctagcctacaattactaggctatacattcactatcattcctgtcccacttctgcaattatagacggcaggaagataagtgagtgtatataggagatagtatgatggcagttactttcaaatagactcacagtgcatttctcaaaaccaatgatcacgtacacatctgtgaaatatttttaaatgatttaacatttttaaatgagcatctgagagaggatggatagtgacttggtttgcattttttctttgcttttactgctcatctgtgattgcttttattaatatctcctgaaatattactatgcaccaataagtaatgacttaagcttcatgcattctagactttttctcagcacacaacctgactcattctttaacatgatagaattttctttgctaagtatatagatgacattcaattcaaaatgcagtaatctgaaaaaactctatcaaggaatcagtggcattggtagtgagatcacaccacaataaatgctcactgtatgggagatgtcataaaaagatgagattttaatcttttaagtacagacttattgaatacataacatctgtcagctaagcatggatttctttttttaatgtcatagatgtacgcgttgtgttagacctcaaaatgtttagggtgttttcaaattagaagaaagaaaaataggacccactttgaaagcatcacaatggaagttgcttgtttttggcacattaattgattactttcacaattttgttcattatgttcctttacaattttataagggcaaccacaatttttaaatgttatcaacatttaggttctcagtgaatcagtcagtaaattacccaggctataagttagaatatgagtgtgtccaaacaaatagctacattgtgttctcaaacattggttggagcatcagaaacaaacttgaaactgattatgattatttttgcagtgacttttttctctcttagatgttattattaacttttgctcttaaatggtagcatgaagacactgaaaataacatttaaaaacacctttattttatttagaattacttacttattttatgtatatgagcatactgtagctgtcttgagaaacaccagaagagggcatcagatcccactacagatagttgtgagccaccatgtggttgctgggaattgaactcagaactctggaagagcagccggtgctcttaagtgctgagccatctttccacccccccccccataacatttttttctccaaatacaaatggagtgcagagtttgtagttttatgagattgtagtgagcctttatttgctgttattgtggccagcaccctattaccatctcatcggggagatgcatcgtactctgcctgagaaaattgctctttcgagaagccccatgtagaactactataagcagaatccgtggtgggttaaaagttcacaggatataaatgtgttcatatatgggaagatcttatttccaagtttagtttatggcataaaaagaaattttgctactataaacagggttcccattctaagttttccccatcttaaaattcttagttaaggattccagagatggtccagtgttatagtataaagatgcaatatttgacataacagtttatatactgaaagcaatattgttttcattatatcacattacagtatgctcatttacttgccatatgatcacaaaatactgctgcatttgattttaaattttgcactgttggtttaatgcaaagtccaaaaggtctaactgttatagaaacaaagaaataaaagggaaattaattctgtacttttttccatgtgtggcaactttattattgtgtgggatcatattgaaagacttcactccttcgagattctaaatgtgaagcacatttctgctttagcctctgatgctcttgaatgctacacaagcttgcctttagttgaagttaattctcaatcatctacagattccataagatattgagacagaatcacataatttccattggtcttagggaaaaatgctgttgtaatattgtcagggacaccaaggcattagacacaatttttgtcatctcacataattcaaggaaagggtgtccctctagacaagtttgtctctctgtagccatggcaggctttaaagtcatggtgatccttcctgcctctgcccacagccactggggttacaagcgtttacttcatgcttagctctagacagctttactgtatctgtgcattttaaatgcattttcatacaagctcagctgtaaatcctgtttttatctgacactttctccaatatgattacttacaggatcccttttccttcaaggtgtaacattctgaattccaatgagataagacatttttttctttattgtttgcttctgattttttttctgtgttcattttgtgtgtttccaaagtggtaaggggagaacttcactgacaagtttacttcgtagaggtttagattgtgtagcctttaagattctttcttgtttggctttaattgacccatcataaatacagctattaaagtaagtggcaggtaatatcgaactagcttcatcttgttctttatgttcagagaagactgcagaagcattatagcaccacaccttatttacgtcctcagagtacaatgtgcacgctatttttacacatctcttatttccatgtttctttcatatagtattgttatttcataaactatactttatttgaagatgagaatcacaccttcttttatattttattcaccatcaatttcattatcaagtgctcagtatatatcccacaaatgtatggcaaataataaaacaaactgtgactgtgtaagaagccaatggttgggaataaatgaatgatttgtccaatatggtaagaaaagatttaaataaaatgtgactgtttagtaaagagctatttggaagttcaaatgagatgctttttcactgttcctgcatgtacctatgcctttctccctttttgtgatgtatgctgggtatgccaagacattatcacctgttctaagatagtgacaaagaaatgctctttttctgtacatgggaatcactaactgaagacagttgtattgacggttacaatgtgggagcattgagatccaggaatgcagctttcagcatatgaatgagtatacgtacttgagtgactttcttctcttgtcatcttgcctattgccttaaatattaaacaatgctgctgatttgtttcctgtagttccttgtctgtttttttaaagaaataataactcaatattgcatgcactgtggagttttaaataagatccacagcactaagatttaagagagcacagatgtaatatgctttttagtcgtgggatccaggttatcaacttagaaagtagatgagataaacctagaagaaatgaacttccatgattatctactctcaatcagaaccatggtatagatttctatgaaatcttttgcagtagtattcttttactttttctgccttcgattttctggtttatttatataaaaaagcagcattaggtctctactagagacataattggttttgaccagtaaaagatgactgtgccttctaattgcctgcagttaatggtcctgctctttatcccacagaataatggaaaatgtcacatttcagtgttctatgactcattataagaaataaatgtgtgaatggtgtcaaaacacagcaacttgctgtatgtaaatgacaaagtacataattagatatttctaaactgaaaatatttgttcatataggctgacaagtacacttttctgtgccctaagttattacatcacgtaatcagggttcagtctgtattcttgcctctgggtggtggttcaggaagcaaaccaagtgaccttccatctgagctgtaattatcccatgtaagagaaaattcatggtttccttctctgttaatgtcagggttttgtttccttgagtctgtttgtttagtttcccccatggtgcagtcttccaaacatttgttatttctccttttgtgcaatttgaattaatgtgggtgattgtggtagttaaagtcttttcgctcccagttagtaattatccaatctatagtttcatgccaaacttagtgcagtggaaataggaaaatctgagattctcagaaaaaaaaacccaaaaacaaaaattcttgtataattgactacatctaatatgtagatatagttaggattaaaataaatttactcccaaacataccacagttctatattaggagattttactaatgcaactactaaatgtctgtaagcctctagtatattcatgggactcttgtctcttctatgaatttatagtcatagttgctgagaatttccattacttttgttagcaagaaagtatgccggagagtgatagttagtagataaaacatacaagcattggtcctttaaaaggataggaagtgttaaagccctgagtttaacttaattttgcttaattatttctttacatgtattatattttatacacaatgcactgatctttgaaatttttggaaagataaaccaaaacagtcctttgctgtgtttgcacagatgagctaggaaaagccatattataattgtaattataattcatacattcctttttgtagatctgggaaaggcagtgaatttaaatataacttttaaacaacagaatctctcttaaaattgctatttatgcacatgtatttagagacacacagtgaaattaaagtccctgggttcaacatgtaaaaataagtctgaagatagtggatttttataattctttcagtaactatgaggccttactatccattgaattgtagaaagaggtagagagatatgcgttgaagctcaactattcctactcagcctacctcaactatataacttctgggagtactgtgaatgttccataaacatgacaatgcatgaaaatttccatcccataatctagaggcgcctagaggaaacagttcctgtggaagccacaaacagctttgattttcatatatttaggttacagaaaatagagccacccagtcctgaaatccaaccagagcatctcaagctccaatagtctacaattctccaactctgtccttgagcaaataaccttaatttctaaaatctgagaattcattgagattacttttgtgagttatctgtcaaatctatatgtttaataaataggtccctatcattgctgttaaatgaacactgaattaaggataacttttcaataaccaatgttctaaaaacatttctaaactttagtattaactaagaagtgtgacttacggaaagatgatttttagaccttttaaaatgaaacattttataaggaaaatatgtcttgtgggtgctttgtttctcagttgtatttgcttgtgtttccttctttattcattatagactgaaagctcttcacagttaaatgagccgaaaataccattatgaaaagaaatgtaccacacttactcaagttcaagttttgtagtataaatctgggataatttcagagctcagaattccatggctcacctgattagtattaaaaatacatggtccaaaatgctagcatggagaggggactgggccatgaagttacccttatccaaggagctattggcaaattgctgggaaagggagagtcagttttttttttttaagaccataaccactggtaaatggaagtgagtatatttgggcagtacaaattggccttgatggaaaaacacacaagtgtgcatgtgtacacacacacacacacacacacacacacacacacacactcatacatatggtggatgggaatggaaggggcatccaggaaagttggggaaagggagtgagtataattaaaatgtacaaaatcctcaaagaattaataaaatatgataattaaatatgtatgatgctgtcaaatataaaaaatagagcattgtaaactcttctttctcttttttcatggacctaagatctttgtaatggtatttgacaagtatctgaaggggatgaagaatgcatcaaacctaccaacagattagttatctatatcaacagagaattcatttagaatgctacttctttcctgaatcattgcatatttcatcactactccactgttctattttatgcatgaatgcaacagccattataaagtatgaaaagctcactgtaaaaagatgagcacaacttgaatataattttaaatattgatcatattcccacttatttacattcatgattggctgatttatgagaaagagttcataatcttgggaatgatttatgaagaaatgatgacaggtccccaaatgctaatctattttggagttcagatgatgttgccatgcacgttttacacgtacggggatcgtttacttttttatgaattggaagattgtagacctaattaagtatccataagagaaatttcaatgtgctttccaagcattctaatgtcatccatttaaaacacaagagcaatggcaacaacaacaaaacatcattcagtgccttgaatggctttgtgaactcagcctatacttttttaacaacatagtcttcttccttaggcttctgcactaacagatagtctagacttggtagtagaactatgtaggtgaggacttaatgtaagagaaacagtttcacgtaggaagtgtttctcagcttttccttctttatgtctttttctgctttctaatgctttgtcaagtccccatgtctctacaatcagtcatttttactactgattaaaaacgtttctattgcttctgaatcatttttcatctggtgcaaacaccttaattagtagtattgataccttttagcaaatacccttttttttctgtataatacaggagaaacctggattgctgataatgaaggtgagaggcacaatagcaacagagttgtaggtggtgctcaggggtcatctctagatgcccgttttctataatagggtgacatactgcaaaatattcgtaatggttatcatcacatggatggattatcttctttttttgtctctattagttccatgtcctcattgttctcctatatcttatgtggcccagaattcagcatgtcactcttttatggaccactgattctatctctcaccatcatgaatcaagacccagtcctgcttaaatccacatctgtaacaactctcgatctagtctgatactacttgaaaaacacacactatgataactgttttgttttaaattcatgactattggtgaccatctacagggcaataaagaaactattcatgtagttgagagatttatgcatgttcccatatggaaagaacctgaaaacagtgcctaccacatactacgctctcagtctttccctctttcttcttctctatttcttcactgttacttctgctttttctgttattattatgctaatttctctaagtaaagtatttcatgattaatttctcctggagtactgagtattttcttgctttcttcatgcagcaacctgacaaatgtagagttcactcaggtgtgatttaaggaggggctggggagattgcctgtcggttcgtcatggaagtggagtcaactgtatgagagtgattgtcagaaggtctggataacctaagccacaacaaaatcacttatacactcatctccatagatacttgcccacttatatctatgtttctatattctgtcctgttttgttttatagatcaatttccttcttcctacctaaggtcaacttagattgctgcccagtagtattcaacttcatcttatccattcagaaattgtttcagattgtatctgtctctctcatcaaatttacttctctaccatgccatacccattagcatgcacaaatattaaatctccctatttaaaagataaaaatcacccatttattgcatatttcaccagcttgtagtcaatttgtgcaagaaaggctttcagagaattatatacctcttgtcttcacttcctatcatttcactctcttccattcaggctgccattcccatccttggcagttgctgtttggaaggtcacacattatctcctcttttctaaatctagtatctggttcctcatgccagctctcatagacaagctgacagttcaccaatccctcctcctgaaatcactcttctcacttggcttctaggacaccacactctcctaggttccctcctacctcgcaggctgatgctttgatgcatcccaggatgtggttcctgaacttttttttccttgttacatttatgctctaaatgtaatgctctcatgctttcaaatattggtgaccccagcctaataggcattctgtgtaatatacaatcatatttcctgcttcttccctaccatctccacttgaaattaaatagtgttcttcagttagtagttctaaaggaaaatggtttatagcctatccataaatgctctatgtccatagatttcccgatacctataaatgataaccctatccttgcatcaacagatcttagtttttctctaaatatatgcagtccagaatcaaatcagttctcatcacctctacttcctactgttgtagtatatccttgcactcctgtatgtttgtaatagccttctatttagactctgcacttccatcttacaccttttctctctattctccatgtagtcacccctttcaaatgtatatttgactagatgtaactcctatgttcagattactctaatagatttctctttcccttactagctaccatagtccaaccacgaccatttctgtgaccagaccctcctaatgcttatcagctcccatttcctctgttttgctcttcttatattggccttcttaattctctgtaagatcctctcacctaagtatctttttaatttgatgtgcgagccacttcaacatttcttctttagtgtcattccgttgtagcctgtatataaaggaatcaccaaagaagtttcgataaatctaaaggtagtgaaattgaataaatgagattttactctgtactttatcccaggaacttaaaagtatactcagaggcaattaaagggctcattagctgagagagatggagagagagagagagagagagagagagagagagagagagagagagagagagagactatttaagtgaatgatcaattctcttgaacattttcacctaaatataccaatcttatcttcttgacatttgtgttcgatttgatgctgacaataaaaacttgggaataagctataatttctgcatccatgcatattcaggtctgaaaatgaaagaagactatgacaagtttgcatgtagaacttcccacccacacatttctttcctttctgattctgacacttgagcctttgaaacagttcccatgagcaatactgggattcagactatttagatctaaaggaaaaaacacaagatcttctgcttacatctagcacctggaaacctcttggaaaaggggccgaaatgtaaatctcgctgttattttttttttctgcatacaggagaaatcctaaagtattttagggagaaggagaagactttagagataatcaggacaaaagtgagggaggaaactcaaattcacattgctaaagaggcctgttttccctgtatgcttaccaacttaacaggcagattgcacaccattctcatgcaaaaggtttctcatggacaggcaagctaaggaaggaaacatttgttgaataagaaacacaaatgtgctgggcagatagattagtgcttgcattgtaagcatgaggacctgagaaatgatttccagaaactacttttaaaaggtcaggtatggggcaggggtattgtgcacttaaaaatccaaatactgagaaagtagaggcaggtggatccctggactttgctgggggctagcctagcttacttgacaagttccaggctagtgagagatcccaaaacacaaggtggataggtcctggggaacattagtagttgtcctttgcatgtgcatgtacactcatttgcatacagtataaataaataaaagaagtgctgttctagtactccatgattgtaaccatagcactcagaagctacatggaggtaggaggatttgaagttcaagatcattctgtactacataacaagttcaagtacagcctgagctactggagatcctatctcaagcaaataaaaggatagccatataaagtagattaggattataatgtcatcatttacaacctggtagcaggagtattaccacaagtttgatgccagcttaggacacacattgaattccaggccagcctaggctgcagagtggaagagttaaaatcttatctaaaaagcagagggataaagggagacagggagggagagacagagaaggagaagagaggtgaggtgagagaggaggtgggcgaggggcagaccacaaaaataacaggttaggcagagtttagcaattgtattaaatagactagatctctctctgtgtctctctctgtctctgtctgtctctgtctctgtctctgtctctctctctctctctctctcttcccccttttgttgtatgatactgaagcatcctaagcctacaagagtgcactccctttctagatttccagatctgtctacaatatcctttcttaatgaattctcagcattgtgggaggccattctcttctgattctgcctctcctcgatgttctgtgaaggtagatatattctcttttttactgagctttcaagggtatgttgatcatctcaggactctatcctaaaagatgccacctggcattctgtttctcgcctccatttccttgtctttttccctttgacagacaagccaatggaacttttgtttccttcatttttcacccatttcttaattattcaacctttttatttttaaattacaacttctccccttatgaaaacccttacattcctcttgctaaagtctgctatggttgccggtgagaatccacagtttctttcaggacttaacttttttttcttctgtagcactggcctccattggtcaccttttttcaacaaaaccaaggcttgtcttaattttcctgatactacttcctctcttctctgtaccactagttttctttttgcttactttttcttctatacctccttaagcatttggtgttttctctacctccagtttcccatttcagtatttgtcttttcttttctgtcccctctcttcattaataaatttatttctgtggcttcaactactggccatataaaggcatcttcctttctgaaagccagatttgtatagactacaggccactcacacatgcatgaacacacacaaattcctgtattatatagcatgtatagttttatatatccatgtatatttgtgattactgtgtgcatacaatgtttgaaagctgctgtcttcaaattatattacctcatgctataaaatattcttttaatttatcattttaatgactgactagttggagtttgtttgttttcatttatctgactatcaaaattaaaatagtcaccagtaaagccattgtttttgtgtctgaaatagaacacaataaccttctggcttaccctatggcaataatccggatgccctggggtttagacagcactagcatcattaataaatgatgcatactatttactttcaaaattcctggagtagttaagagggatctgctagattatatgagtttgaaacatggctgaaatgcttataaaattcatgatttgtggcaaagaagttgatccttctctcttttagtttcttcatgtataagatgaagataccaaaagtacataaattattggattgttaacagtatccagggagctaataacaacaccacatattgtagtgttatacacattgagttagtaaatgtttgatattactataaactgtgtgagtccagagaataacatgctgatctttggccagtatgtagcagtttttaattctgtggaaaccatgggaaacacaccttgcaaatatttgtattttgttttaaggctgaattaactagatttctataaagtcgcaaagtataattatttacagaggccaagtgatccacattgccacagtgtaccccatctggcagagctcatgactgaaacaaacaatttgaaaggaaaagatcaaaagtatcatcaatttctcacataaaatcacgactgaagagagaaaatctggaatggaatgttgaaactgctcctgttgggagaccctggtctgcactctatctgtaaacttactgaagggagagcagggcagggtttcccatacagagggcacaggctactaatgggaactcaatttcaaagccggaatctacgccagaaatctaatgcttcatgaaaatttaggtgatcttctctgggaaagaaacttatcattgatacttttctctagttagttattgaactgcctgtattattgatgttagacataaattgtttcaaatatacctcctgttttctttttctcatagacaaacacacacacacacacacacacacacacacacacacacacacacacacacacacatacatgcacacaatctcacacatgcatgaacacacacaaatttctgtattatataacatgtatagttttatatatccatgtatatttgtgattactgtgtgcatacaatgtttgaaagctgctgtcttcaaattatattacttcatgctataaaatattcttttaatttatcattttaatgactgactagttggagtttgtttgttttcatttatttcatttggttttgtgaaaaaaatgttcatgtcaaaagtgaatgatattcctgtctacaatacgcactttgatcagcaagacaactattagaaattgaacagttaacaatcatctttttcttgcaagtcatgtatgcctttctacctacccatatataatagtaacatatatctaaaaccataagatttgtagtatttctacattgatttccacatttggttgctagaattacattgtgagcttagttgtttgattattgctgcatccttacaagtacataaatttgtattctgggacatgtttcctagagggcataaaagaatcgattggaagaggaaaggttaaaatgtgaagtttgatacagaatcttctgaagccaatcaatctccttttcagtacatctccccattttccactttcttcactttattttagtgtgtttttctaaaaatctttggtcaagtattttacatgtttctcagatatatcatgttcctcagtttcttcatgaattctaacaaaaataaatcctctttcaggaatgcaaatgtgatagccactaattctaaggtgaaacattcttatatgttggatccttattaattaggcttattgataatacagcactacaagcttttctcaagaagacaatccatcattttgttgaactgttctgagagaatatagactgctgccatgcttggaattgtacgggccagtacattattggctggctagctttctttgtatttccttccttccttccttccttccttccttccttccttccttccttccttccttccttccttccttccttcctgtctgtctttccagagttcttagtccttctgccactatttcttttaataggaggcatttttttctccaacttatgtggaaaacccttctgacatttcctaagtgccaagtgttctataactggccatctgtggatacttttgtttcttcaagttattttttaagcccctacacactaatatttgaagatcaatgatctactagtctccttaaaactttctgctcttcagctgaactgcattcctttctttttcagcaattcctcttaaattcatgtaaataagataattgcattaaaacaaatgatgtatcctgaggagacatgtgcagatatcaaatgcataaataacagttcaagtcttacaaataatttgcaatatctttgagctttggagggccctggccaataaaaaataaagttaaggtaggttttaacattgctgtgttcagtgacctcatactagctaacattttgtctcattctctatagaggactacatgccatagcagccttcatacttctctgatcaatcctaccagttgttttttctagttgcttcttcttgggaaatgtaccacatgagagactgcactattgagccaaaatgggctattgagcagacataccttttttatttatccatcaataatgctattgaagtagatactctagtcttggggagatgctaggtaagaccttaactaaactagtagacaatcaaatgagacaaaagaatatcttaagagtaaagtgaatcaaataaaaggtgctatgttgtgtgctgtgattctggaatgatgttgtgtgaaaacttaaaaatacaagctacattaacaaaactttattttagacattgggtttataatttatctaggtgacccaaagtaatctttttcattctaattaaagaatgtctgttgatgagatggtttatcccacatgcctgtgtatttacagtatcctcacttataagagagtgagagttactaaggatgattcatttgctatccaatatattgccattcttaaatccttaaaactttagtggatgttgtatgcaaaatttgaacttaaaaatggccattttagtttttgatgaggccatattgtacactatgttatgatttggctgctttgtagatttttcttccctagaaatatagtagatatattgccatgatatatgtataaataaaccagataattttattgagccattgaactcaggattgattagaagtaattagtgggtagaaaactgtgatttatatgtgtagaaagattttaattccagcctgccttagccttaccatatttctaaattcctcttccctgactgaggaaatcagaaagtatttgatcatcttaatatttacctaacaaaatataatttggaagattaattcctgccctgaatactatgttacacaatgcaaatctccaagagaaatccagttgagggaatttatactcttgaatagcttatgctgatgtttccccctccattagcccagaatctagcctttggggatggaaagggattcatcttatctaagctactactccttacaaagcacaggtagtttacaaaccctgaataaagctttggaccagataataaaaacggaaattccaaagcgtatagccctctagagcacaggtctatcccatctcttatgttgcctgaatgctggtggaaagcacctagcagctacccagtaggcatcaaagtctctaaagaacagttgatgcctctttggaccagagagaatggaagcttgccgaaatccattccctccttaatgattatccattagcacactgagatttttattgcagaagagattagaaacaattagcaatgggatgactgaagagactctctcagcattcagtgtttacaagcatattttgaacagactcaaaatacccctccccaagtcaggtagatgtaccacctcagctgattctcatgttgttcctctctcatgaaaacatgcttcactcaatcaaaaaagggattttctgcataaagaatcaatatatattgctgatttaatttcagatgctgtttaggagacattgtttagtaagctaattttctcatgctgaacaatatgtattaaaatgatggcagaagcgcattgtgaactcagcttttcacttagtaagaatatggaactatattaaccactgtggaagcagttgttcattgcaaactaaaggctttggggttcttattttacgtgtcattacctatcgttgtacctttgtctgaaaagatccattttatagggaaaaataatgaaattaaggcaacaatggatatggttttctcagtgctcagggtgagtcattcagtgctaggcccatagaatacagggggtgccatcaggaagtcatgcatttcacctcttctaaaggggaattttcttattatgttccttttatatgcttgcataaggcttcatttaaatgacaatcccctcgtttcttatattaaggcatttgacttttttcttctgcacattcatgccattgcctctaaacaggagaaaagtttggtaaatatgcagcttagaatttcactgaggatgctgctttattcttccccaggaccaaggtgataaaggttgaactccactgctaaactttgcatcgcatttaaataaatagtctcagcgagactttctcatgaacattttcacagcttgattctggttctcattatatcccaattattgaatcaaataaagcaaaaacatcccaatagaatgaaacacatgaacatgatcaactttcttggaaaaggaacaaattaatgctgatcttcaactattcctgtagctttagtaaaaaaaaaaaaaaaaaaaaaaaaaaaaaaaaaaaaaaagttgtagtaactcaccctttcttctttttttaaacaaagtaatataagaaagataaattaattactatttaaaactattcactaagatagcagactgtgaaaaacagagaaagctccaaacaggtaagcagtacatcctggccttgctagtataggatgcacataaccaaaaattattacatagagccatcaagatgactcaggagctaaaagagtctgcctccaagcctgacattctgaggttaatctgtggtaggaggagaaaaccaattactacaagttggcctgtgacatcaacatacccagcatatgtttgtaccctcacactaacaaaaataaaaccaaccaaccaaccaaccaacccaaaccagacaaatcgatgttaaataaagatgaagtaatatggcatcagtagcaccctcagagttcatagttaaggaatgtcatttctactggagttacagagctccaagtggatcagtgtaacatcatggaaaattgggtccttccttatttccagatttctctataagtgaatagaatcagagtctacagtcatgtaagaggcacaaaacataccatgacactgtatctgtgaatacagggcatttgaaaggatgtcatttgaaggttatgcagtttcatagtaaacttgtctagttcttacttagtattcaaccaaatgagaagaactgtgatagtaggtagcaagggacaacatgaatacatattaggcaagtaaccagtatatatctcagctcactttgcatcagtttattagataagattttcccagtaaactattgataacagtagtaaacttctatataaaaaaaagaacaaaacaaacaatgaacaaagaaccaaaccagggtatgtatccaatgtttttgttgaatttgggaaatgtaggccagtatttggggaagtttcttgactatacttttccaaatgagatcacaccatggatcaccatgggcagcctttatattttatgaagtgacttttaaacagagtatattcattaccctgtaatctttataatataaataacatatttatattctaatttatattatatttaattatattatataaatttatattataaatataataggtttcaaataagatgcattactgagtacctctagaatgtcttatctaaattgttggcctaccactttccatagacaagatagaaattattcaaacaatatatacagtgtaaaattatttgagccaccactactagtttgtagtcaaggaaaggcaatagaagatcacattcaaaggagtgggctccttttacaaatgttgttggaaaccaacttgttgtgactcactcctttaattccaattctcagaaggcatagctgggtgggcctctcagaattgaagaccagcctggtttcatatagtgagttctgagaaagctggggctgcagagtgagaccctgcctataaaatcaatcaggttgtaaatacagttaattttcagttctggttgtaggaagccaactctaagattgcaccagtttccggtgtgcctttgtcataaacaacatcagcgcaggtataagcccgaatctggcgccaacccctcccaagcaggtgcatgcaaattaggtgcctgcagactgaccaatcccaggaggacacgaagcctttccctgtgctggggtgcatataagcagatctccctaggttcccagggtccccgtagcagcatctatgtgttcctgcaataaaggctgttgagaagaatccgaatgtgttgtgtcttccttgccggccgaggtgggcgcaacatctggtgaccagtttaaagctaacaaccaatgtagcaccttgattgatatataaatattcaatgtctttacaaaattaataaaaaatacaggactgatgaaaacaataatagttggtatgtttataatggccacattgcagcattttaaaagtctcttcacaaaacatttttgtctcatttctttgtaagatattattgaaatgatgaatatatgtcattcaaagattcaaggtgttactctcactcttccctttttcagaggattagagccataagaagaccaacattcaagattatataaggttgctaggaaatgcaagcctgtatttcccccatcagcttcagttaagatcctatattttgacttgtatcgttgaggtgtgatgtgggcggctttctttcaacttaaagtatctgtcagaatatgtgagagatgaggatttactcacactttaaaaaaataacttcttctttaaccacaaatttgagaaataagtcaagctgtgatcatgtaaccttataaaataatactcatcatgatttaatttgtaagtgagaaaggtcaatatcattatttcattacataagctagaaaacccaatgttcaacacattctgtcagatgaagagtgtttgttaaactagtgacagatccaaaggcctcttcttagaattcctgaatctaatagacaccagacaactgaaggctcagttttagacaaattgaaaagttattttatgcactgccatatgattattctttatattcataaactgaattcgtatttgtcattatttcaacttcctagctatctgccttagcctaagtgaatcaaaacggtttaattcaaaaagtagaattagaataattagattaacgccttgctttcatttaagtatccatcataaaggaaatgaggtttttaggattcattctttgttttttttttttgttttttaacctgggccatgtaacctagctaataactgtggtcatgaaggctgtttctggctttctttaagggaaccttgtttggtgtgacaggttcacattttttttttgctccttcagaaaattacttgagtgcaaaagacttatttttccttctaccctagcaaaatatatgtcttccacgtgagcagaatattgtcctggtgaaatctcactgttttgctagttgcctttgtttccttacaatttttccattagaaatgggagcatttattttattatttcacatttcatgactgagcctcaaggaaagaaatgaaatttacactacagtaattaagaaaggagcagagctatcaaagagctgctttaatgtggtgtttctgattgtgatttctgctgtctgtggagtaatcagatatgggactggttgtgtttttctctaccaggcacaattctgggaaataaactgaatttctgtctgggctactacagacaccttataaaacagttgcaaaaaaaaaaaaaaaatactggctctttagagcaaacagacgaatgtccatctttaacttctcctgctgatatgaagttattgttgctggttttagtgagataaaggaacatggaatgactgatgttatttcaatagtagatgtagttatacatgtccaatctcttagtgttttgtctatccatgatacatgagaccccagatgatagaactttaaagaatttaactaaatgtttccatttgtttctaagaatctggtattatagtactttgcctagaggcagcttgtagatacatgacagctaattagctcggttcttgttaaaattgattccctataattcttaaagaaaaaaaggccttgtttaagaagaacggtgtgggaattgaactcagagaacacaggattaagctatgcaggatttgcagccatgtttttaaaagctccggtgggattattaaaaacaagagattattacattcgttccccattccaattgaggaccttacacctgagcattgtatgtagctggcagttggttctttttacttccctccttaagatgctttgtcatgctctgacatcagcttactgccttccctggtccctgtggaggaccactgctggatccctactgctcagcaggatacctcaacattttatgcatgtagtatttgtttagtgtttagtgaacgaatgaagtattctagtgtcacaatgaatgaatgacttccacaaagaagttccccaaacgcaatgtactttctccagtttagaaattattgaagctggagagagatggctcagctgttaagagtactggctgctcttgcagaatatccaaattcaaattcctaaccttacttggtgatgcatatttgcctgtaacttcagtccctgagaatctgatgtcctcttctggtctcaatatatgccaggcaaacacatggtaaacagacatacatgcagccaaaatactgataccacctaaaaataaagaaaacaagacatttttcattatcaaaagaaataattatgatttccccatcatcctgcaacattatttctactaattgtttaaaatatgcttaagacagcagcatctaaaaagtgtgttgcttttcaaccagctaatgcccacagctatcaaaccgggtagcccttctatatagcatatcttgtcaaaattagtctcctgagacaacagatggccgcgaatgctgggaactgaatctctttggtcctctgcaggagcagcaagtgctcttaactgctgagccatctctctaggcaatctctccaggtctacccatcagcatagcttaagctctgtgttttcagttttcccttgtgttattttctcatcaatccagctagtctcggggtctcatgtttccctaggtcaattagtaacattctaaataaacatggctcgctcctttttaatctctattccttctaccactttctagagggctttgtgcagtttaccatctacctgtttcatccaaacatttgttgatttaacaatcccttggttggctagtttttgccacacagtgccagttccttctaaatctgaaaagaaacagattttaagctgcttattgtcacaatgtacctactccagatccacttcctatcaatatagggccactttcaaaggaagacagatgtagagtaacctgcctgtgacagtatttaaagtgaagtcctctaggaaagaataagaaatccctagacactaggtatacattgatactgagatatactgaaatgaaacaggttttggagacctaatcttctcaatggactaggagggtgggcatttctagagaaatcttagtctgatgttaaaaagaatcttaaaggcaaaggaccttaccctgttctctgggaatggctggttaaggatatggagaaaaacataattttaatgcctgccaccaccaccctactttgagaaccctagaagtttaaattttccctgaagtggacttgatgctgcaggcaagcatcattactgccatggcttatacatgggctgaagtgattctgttagcagcattcactgtgctgaaagtttaatttcaatgtatatattgctcctgttaatgggaataatgatctttttgcacatgtgcacatcctgttttctattatctactgtcctttcaacctcaagtaatcaccaagtcttggtaggagtgtaaagtagtacaaccattgtagaaaacagtgtgcagattctttattaactgttatttttcctcctgttatgaattgtaatgtaaatatctaatatgcagaatatctgatatgtgacccaaagggttgtgacccataagttgagaacttatgagttgtctctacagaaacagaatatgctgatattattttcaggtacaaagtacttgtcctgtggtagccagcatagtaaacatattgccctctgttcctacacatgtaagcatttaactaagaaaatcaagtttgctggacatggtgtgactcgggcctttaattccagcacatgggagaaagaggtaggcagattctgtaagtttcagtccagcctggtctagataatgagttccagagatatatagggagaccttatcacaacagagagagagagagagagagagagagagagagagagagagagagagagagagagagagaataagaaatgcctcattatgaactctgtggctttttataactcttaacctacattatctccccaacaactttctagtgaggacacttttcattctttccctgtgaaagataaagaaactgaggcccaaagtctgaggtccttgcttaaactcaattaaattttaactgccactctcctactccctctacaccctgtttttataatctagacatcgtgatatagaacataaataaagaacagaagcaggtatagtacaacagcttgccatgctgtttgccattgattcttcattaggcattattttgtttgccttttctccagctgtgagaatcaccaaggcaagacagtcaaagacattaagaaggtctgtcttaaaaacaacttttcattgaagaaacaattacaggccccagagtgcttactgcctttgcctgatacaagtccagtatccaatccattgaattcaatccattagaaattactttatatcttccaaggaacacacccaagcttcattatattagatcaggcctctgaatctctacttctgtctgtggcatggaagacatgtggttctatttggttacttttgagtccagttatcaccaaggctggcattccatgcttatatgctcattgacctcaccatgacctataaagtaaatgtactaacatgttctgtcactcaattttgagacatgtcctagtttgttttctattgctgtcagtaaagtcatgattaaaagcaacatggagaggaaaggcttgatttgtcttacagattgcaatcacacttcatcactgatagtattcaaggcaagaatttgatggcaggaactgaaatagaggcccggaaggaatgcttactagcttgctccaggcttgtgcaacttatacattccaagaccacctgcccagaagggacatggcccatagcgagctggacactcccacattaatcatcaatcgagaaaattccccacaaccttacctacaggccagtctggtggggagcatttgcagtcccctcttccacaatgacacaagtgtgtgtctatttgaaaacaacagcagcaccacgattgaacagtgtcaagtaaattgataagatctacactatgttgtaatttagcattttactacagttatagtttatctgatgttaatgaccagccatagagtagaactctacctttaaccaagtatcgtgggccttttttctgtcggtcacaatggaattgttaagaagataggattagctcaaaccaccccatccatattgctagaagaaaaagaaaaaagcccaaatacatttattcaacactgcagtacagcaaaaccaactcccactgaaatgagtcagaaatgtattcataaaccactgtacgcatattatgccttaaatgatggtacagtggcctaaaagaagtatagcaccttcctaagcatctaaattactactaggctatgactcaggtgcagagaaaattgaacctatttttgcttattcaaaatacaataagcaattgtggttaaatgctcctttacaatggggtttatcttgctatgaaaatctatatatagcatgcaaatactagaatatgtatagacacctgtccttaaggaactgctcctttaacatcaatctctttgtgttttgattgaagttacatgtttgtacaaaactaaacatcccaattataatagcttgatagctgtttgacttacaatctctttttggttctacaaaattggtaagtatttaccagtgggcataacatgtggagcgccatcaaaactgaggtctgaaggtctgtcattgttccctcaaaatcttcatactgcccttattttctcacttggcttatagtctctctgttcctcctttctttattattgttattattattattgttattatttttagctatcaagtttccataagcactcttgaagttgctctgaattgcagaaattataaagtcagtgctatcattgtatctgtgttgcacatcatggggcatgtccttcagacaaatgctgagaaggcacatgcttagcttcaaagtattacatgtcatgatggtcagaatgtagtttagaaaagccagggcatacatttgacactttattgacttgaataaatagcaccgtcataaaatgatatgtagaataaacaaacttttgtaagtcagacagaggtaataccagtcattctaaaaaaagacaaatgataaacaggtgttgtgttcatcgaaggtctggccctctacttaattcacacactgtaattcttcccaattcctttatgagttaaggacctttatgtgattttcatagaaataggaaaggtaaataagatcatctgaaagtcattgctctgattggaatgagtgcatgcacactttgtgaaccattggcacgaaagtgtaaaggaacaactctgtgtttcttttcaaaggaagaggataggatagctatgatgttcatgaggccaaagctaatagatgtttcacagtaaaactctatctcaattaaaaaacaaaaacaaacaaacaaaacaaaacaaaacaaacaaacaaacaaaccaaaaaaatacaaaaagattaaatacaagtctactgtgagattttactgttttagtacccctggttatctttaaggtaatatatacaacgtatttgctaggaaagatttttcatcaccagccatctggtaaaaattagtctgagataaataatttagcttccttctgttcagatacagtttcactaccctcttccttgacgctgtgaaaagtcttcagagataatcaattggaaagtgcttttgcattccagccaaagctgagcctgaagttttctgacatgctgacatttgactctttcttcccctgcccccctgggctctgcaagaggatgatgaggtgccaattattagcaaagctcctccaaagaatcacatacctgttggctgtctctgcacaagcacactggctgctaaatcacagactggggaagcatgacacagggcagcctagctattcaagaagtgcacatcattttttttttttaggattaaagaataaataatgcagagcatatgaaagaaatgtagtagtgattagctacatatttcctgtgacccagggagtctacaaccacagtgactatcctagccttaaagaattgtattccatcaataagagatttttttccattcatcagaggggaaaaattatctgccagtttttgctttggccttatttctccagtacagagggtgaagagacatatcacattagagctgtcagagagcaggtaccatattggtgaggaccaggtaggccaggccaaggagtttagattctatcttgtgggttgcagggagtcaggaaaatattttgagcaagagagatataaaacaataggactttatttagtgcatgtttagtaaaaacctacaatgataaaatatattaagggagtggtttttttttatttcaaacaatttttttatggatctgttctcagcaaggatattactggaagattcatctctcctgactgtctagttcggcctttatagcatgcagcttttcagtgccagctgtaaaagaacaaagtaagaagtgatcctgtggatttaattgtgaagaaagggcatatattgatcatgagcagcatactggtagctcaggaaatcattttaaagggtgactgtaaatttgtttgttcgttgagttttgtgaaaccatttctgttatataattaccttaaggtttaagtgctccttgcaaagataatttatgcatcttgaattcacatgcaaatgctgtaagtctatactgttaaaaatgaatgctgaaaatcattctaagtaggtaatagttctccaaagcttataaagcactaatcatttttattcattcttagagtgaattttattttattgttttcaactacagttttacttggctaacagatatttgaaattttgacttgcatattttgatatagaatatcatttgcctattttgaaaatttaatatcacaaagcactttttacagacatcatatcaaagtaaaatgttgcagatttaagagaataaagcaagatattttaacactgagtaactaggacttctgtcatgagtacgacatacttggtctctacagagagaaagcaggtaatcagaggtgagacttaactgcagtgcattgtacatacccatggtcttaggtgttctaagactcagcaacatagtgatggcagtttgcagcttaatgcaacatagtgacacatctaagcatttttatgtgccttgtggaaatataatataattcactttatgatcgtgacattaaggtttcaaaatgtcttgttttaattgacttttccatgacgttgttctaatacatagttttttaaaaacctggttttcttgtttggtttgtttttagagatgaagggatattgcataaaaggatatcttccagaagaaataagattccttgtatatgttgttcatctgaacatgttaactgaatcctgagcacagctagttcttgtgatcaaagatttctaccaatatttgtcaatggataggagaaaacttattttcctttctactctatgaaaccttggtgccacaggatcataaacttaggagaaacaaagtcaacatagtgttgacttccttccttccttccttccttccttccttccttccttccttccttccttccttccttccttccttccttccttccttcttcttcttcttcttcttcttcttcttcttcttcttcttcttcttcttcttcttcttcttctttctttctttctttctttctttcttaatatttttttttattttttacacttcatatcttattccctcccatccaccctctaactgttccacatcccatacctcttctccacccccctgtctccacgtggatgtccccaccccccacctcacctgacatctaaactccctggggcctcaagactctggagggttaggtgcatcttctccgaatgaacacagacccagaagtcctctgctgtatgtgtgttgggggcctcatgtccgctggtgtatgctgcctggttggtggtccagtgtttgagagatctcggggatccaggttaattgagactgctggtcctcctacaggatcgcccttctcctcagcgtctttcagccttccctaatccaacaacaggggtaagctgcttctctccattggttgagtacagatatctgcatatgagtctttcagctgcttgttggatctttcagagggcagtcatggccctttttttgagcaccccacagcctctgtaatagtgtcaggccttgggacctccccttgagctggatcccactttgggcctgtcactggaccttcttttcctcaggctcctctccatttccatccctgtaattctttcagacaggaacaaatgtgggtcagagatgtgactgtgggatggcaaccccattcctcacttgatgtcctgtctttctcctggtgttgggctgtataagttccctctccctactgtcaggcatttcatctaaggtccctagctttgattcctgagagtctctcacctcccaggtctctctgatgcattatgggggatccccccaacctcctatttcctgaggttgcctgtttccatcctttctgctggccctcagggcttcagtccttttccctcactcaatcagattcccctttccctccactttccctcccaggtccccctctccctccccacttgtgattgctttcttctctctcccaagtgagactgaggcatccttatttgggcacttcagcttgttgaactttttgagttctgtggactgtattttgggtattctgtacattttatgactaatatccactaatctgtgagtctattacatgtatttccttttgtgtctgagttacctcactcaggatgatattttctagttccatccatttgtctgcaaaactcagaatatcctcattcttaatagataaatagtattccattatgcatatgaacgatattttctttatccattcttctatcttggaacatctgggttttttccagcttctagctatcacaaataaggctactattagcatagtggtacacgtgcccctgtggcatggtgaggcatcatttggttatattcccaggagtggtattgctggatcttctggtagaactatgtccaattttctgaggtacctccaaattgatttcctgagtagttgtaccagtttgcaatcccaccagcaatggaggagtgttcctctttctccacatcctcgccagaatgtgttgtcacctggggttttgatagggcagaggaagcttaccagcaggaccacttgctgagttcccttcactcttaggcccctggaaaagtttgagactgaggcctcttgcaccctaactgctcttctgagctgggaggtgagcttgcagagagcagggctccatgcttgggcagactgagcatgagaagcccagagtgggcagattcgtccctcgccagagcttagactttctatttcatccaacttttctctgcgttctagttctctctgtgagttccttaaacatgcctgtgtgaggttgcctagattaatttcaatttcattcttttatcaactcctgagggtatacatgagcagtcactctaaaatctctaggctacaggagaattcattggagaagaaacccccaaatcagttgaaatacttggttgagatttttcaatagaagaatggaccatttcttgcatggattaggagaatgttaaacaggcagatttgcatgaggtaaatgcaaagctgctccctggtgtggaaagaggcagcatgggaaaaggctgctttccttgtttgctaatctgcattaagactttgccagggcctagcaaacacagaagtggatgctcatagtcagctagtggatggatcacaaggtccacaatggaggagctagagaaagtacccaaggagctaaagggaactgcaaccctataggtggaacaacaatatgaactaaccagtaccccggagctcttgtctctagctgcatatgtatcaaaagatggcctagtcggccatcactgcaaagagaggcccattgggcttgcaaactttatatgccccagtacaggggaacgccagggccaaaaagggggagtgggtgggtaggggattggggggggtgggtatgggggacttttgggatagcattgaaaatgtaaacgaggaaaatacctaattacaaaaaaattaaaaaaaaaaaaaaagactgctaccttcctggggacccaagtctagctttacagatcaagttgccttagcatgagggcctgccattggtcactccagctgccttacactgagtccagcttcctcttacacaagctgcttccctgcttgggatttctggcacagttgaaaggtcctgtgccaaagctattgtgatctgtgagcatctttcatttcaaattttcagcaacacacacatacacagtcacacactcacacacatatactctagagagtaattttcttttaccaatctatcccaaatccattataattattatctttattatcattatcattattaagctgtcccatacctgttaccagaataccataacttttcagacagttgtagaaaagtttaaaagtaggcattgattaaagataaggtattgttagatttttttccttattgttttttattactcagctatattatgaaagaagatccaatgacatggcagtgtagaacaaaagaagtaagatactaacgctgtacttcttgtagcatagtaattaacatgagacatggaaaatgccatttggcccattagtactagattatttcagaaataccattactaccatatgtgctcacttgttcatattataataattttaattttacaatcttaaggcttaaatggcaagcttgcatattgttacctttgccatggaatcattgaaagtgggtctcatctgtacaattaatatacggcattgaccccacacagaaatagaaagggactcctctagtctacttgcctttattgataaccattccttttctatagcagtttctggttgacagtgggatggacagaatggtgtcctttatggcttattctgcaaactgaaagtgaagggagggaaaggattccctgagcaccagcatgtgtgctagccacttgccatgccctttccatcctcgaggtaaagcacatgatgtagttcccatcttgtaggtgcaaggcagaaaacacattagttgctcaaagtcagaaagctagagagtagaagcgggcagatttgatcagaagttttctatgttgaaaaggcagagaacacataggaaggaaggcaatcctctagcagatgttaaaattgtgtattaaacatctgatttaatctgttttttttttccctttggtccattatctctttattttgccctagctatcctggaactcactatgttgaccctgctggccttaaagttacagagatttatctgactatctttacctcctgagtgctgggattaaaggcatgtgtgtgtgtgtgtgtgtgcgcgtgtgcgtgcgtgtgcgtgtgtgtgtgtgtgtgtgtgtgtgtatgtatatgtttgtgctactcaacaattagtgtatgcatgaagtgttttagaatcgagttgacaaagaaatgacttgctctggcaagatgtctcagtgaataaatgtgcctgttatacaagcctcgggaccttagttcaagttctggaactgcttaaaggtggaaggaaagaactgatgtctgaaaagatgtcctctgagctccacatatgcaccatggaatctgtactctctctctctctgtgttaacagtattaatatttaatttaagaatataattacttattaatgactgcttctatgcttgttttgttgtttttcctcactttccaggtggatttttttttcagtgtcaagaaatgaagatcaaagctaaatgctattaagattaaatcaagggccatgtgatggctcaacaagtgaaggaatttgccaccaaccaggcctgatagccccagtttggtcttcagaaacatgtcttgcaagaagaggactgaaattcttttcttttcttttttaaaaagacttatttatttatttttatttatatgacagtgcactgtcactgtcttcagacacaccagaagagggcatcggatcccattacagatggttgtgagccactgtgtggttgctgtaaatggaatcatgacctctggaagagcagccagtgctataaaccactgagccatctctccagccagaggactgaatttcacaagttgtcctatgatctccatatgcacacacacatatacaataaataaaagaaagaatttgagaatgttttacaaagtagcagcaatccagtgtctctctgtgactctattttagttcctccatttacagagaggtctttgtgctctgtcctctcttaccaggctctgtgttttcagtaggatacacattgcagtaatttacattctgcagcccattgctcttgcattactctcctacctgtgcaagtgggattataaggaatctttttggtaaagctttgaagaagcagattcttagttattctcagctatactctcctgcaaagacagactccatgcaagttaacacaacctctatccagcacaaatcaaaccagtgattccagaagtttcctgaagtatgcacacattctttacacccaccttagtgtgctgttcattttactaggctatcctcgtccttttcagtttatatagaagcacataaccttcatttccctgctggtttgttggatctttgcgaaatttttcagaactcctaagctttaattttcagtcaggagcttacaaaaactattttaaaagattcaacctactaagcttgcgctcctgctgactacaagtccctcagaggtcattattttgcaaatggatttagatcacattctaaagttattacagagaggagcactgccacaaattacagagcaccagatatcatagtaaaggaaggcttaaatagggcatttgatgtgtagaaaacattcttgatactatttctttaagacagtgtcttgctgttcatttttagctggatagctcaaggtgggttcaaaccatggcaagtcccctatttaagacttccaagggctcaacctaccagcatattccagcaggcccatctaatccctgatacttttattcacctttcaaacatgtatgttagggcctggagacatggctcaaccactagtgagccagtgctcttttggaggacgtaaatttaccagcactcatgaaggaaaactcacactgcctccaattacagcttatgagccatagcccccaacacacacatacacaatttaaaataaaatgtatctcttttaaaaaccatgtaagtcaacactgatagcttgtggatttactcctcataatagacacattttaatagatgactgttctttactcaattaaacaaatctttctgctgatttctgttaaacaatggagtcctttattaagtttaaattataatgttgttttcttacaatctgaaacattttttctttaattgattcatgtttttacaaatggcaaaattccatccttttgatagctaaatagtattccatagtgtgtatgtgttccacaattctttcatcttgtcttcagctgataagcactaaaggtatacccttttcttcactactatgagttgtgttgcaataaacatcaggatgcacatgtatgccatgaggagtactggcttcatttccttttaatgtccttttggtagttaggttgccagaccatatgatagatctattttaagattttatttattattgtatgtgtaatctgtgtgtttatgacatggggggagctgccaggatgtacatttcaaggtcagaggacagtttttaggaggcatttgtcttcttctgccacagattccaaggacgaaaatttatatcacccagtgttcatttccagtacttccactagaggaaccatctcgatggactttaaaagaaaataaggagcatccatagtgttttctctaatagctgtactaactaatatttgtaccagttgtgtgttggagatctccatgctgcgcatcctcagggttgtttgttatattatgtctttgtgataaccattctaccagagaggaatgtgaattacattttcctgtgcctgctaactagtgatgctgagcactgttatatatttattgaacagttctgtgacttctgagaaatgcctttacctataattcatacatacataatctcaatatcatcaacccgtttttcagatgcataatttgtaaatgttttaatccctattctgtagggtggctcatgttcactatctccttcattgtacagaaggttcatgtggtagaatcttgttgctttttgcttttgtttattctacttttaggctaagtatcaaaaaaataaaagacacaaggtcaataaagcacaagaaaaacataggactaaatcatttgtttcatggaccttatgccgtttttgatacttagccttattttaaggtcagacaatatagttcttttaaatttttctctctcattggcttagattcttggagaaggggtgattatacagttctatacaaaattttgctgcttatcgacttactcatcatgtcttgagcagcctgctttcttatagaacccagaactgccaacccaggtatagcaccacccacagtaggattacccttccctgctcaatcattaattaatcatagggcccccaatggaggagctagagaaagtacccaaggagctaaaggaaagggcagccctataggtggaacaacaatatgaagtaaccagtacccctggagatcgtgtctctagctgcatatgtatcagaagatggcctagtcggccatcactgcaaagagaggcccattggacttgcaaactttatatgcctcagtacaggggaacaccagggccaagaagagggagggggtaggagagttggggggagggtatgggggacttttgggatagcactggaaatgtaaatgaagaacaaaaaaaagaaaatgccatacaggcctacctggctctgtttttacattttaataggcagaataatccagtgcatgacacagcttggtagaactgcaagatacagggtaaccaggacaaatctgtaagtgaactctggaactaaaacattgtatgtgagtcctcattgatagtcctagtattgtagtttttattgatgaactgtaggggaaaagcaatattttgctgttttgtgaagccaacctagggtaaattaaagtacccatgaaatatcttggaatataaaaatgacatcaagaaattttgttgtaacagtatgaagcaaaaactagccctatgtaatattgttaagcataatttgcatttcttttcaaattcttgctaattatcatgtgtacttttaagtccttttgtggcatggaatttcacaaggcccatttaaatacctctctcttttttagtgctgtggaatacagcactgcagccatttaagcctgctgcagacagaaatagaaagaaagaaagaaagaaagaaagaaagaaagaaagaaagaaagaaagaaagaaagaaagaaagaaagaaagacagacgaaacagtttcctgggaaccaagctttgaggagaacactaatgcaaagtataatttatctgtagccctaatttggggtagaattatattctaatatattattaagatacacataggccaatcttattccttgaaattgatcccagatgaaaaggaactctgaaaatgaaagaatatatgttgccctggccttctggtcatttattatcagaagaaaacctatattagagtttcattcatatacagcttctcattgaatcttctggcaaaccataataaaggtgataggactggtaggtttttttttttcatcatttcacaagaaaggccaatgtaattcaaatgacattttagatatttggacactgagagacaacagtgtaattgtgtgcctatgtctttgttgcagggagttctctttagtcttattttcagtgtaagcattgttttgtctttataacttattttttaaagatttttgtaaactttgtgtgaataagtgtttttgcctgtgttaatgtatgcataccacatgtatgcttggtgctcacaaaggccagaagaggacattgggtctcttggacctggagttacatatagctgtaaaccaccatatatgtgtgctgggaactgactctgggtcatctgcaaatgcagacagagcttttcactgctggtacatctccccagatacactactttgtcttttgtcttcttccctcccactctccccttctaagttttgaaaattagatttatcaggcttaggagatggcttatttggtaaaatgcctactatataagtgtaagaacttgagtttagatctgcattgcttgtgcaaagtaagtagacacagtgtatagttctaatcctagcactggagtttggtgataagaggtgaatagattcctggagctcagtagccaagcatcctgatgaactataggtccaaaagagcctgtttcaaaacaactaggtagataaccatcaaagaagacacccaacatcaacttctatcttcccctataaatacctgaaccttcaccaatcagcacatgtgcacacacccacacggacatgtacatacaacacacatgtacatgttctctctgtctctgtctctgtctctgtctctctctctgtctctctctctctctctctctctctctctctctgtcacacacacacacacacacacacacacacacacacacacacacacacacacacacgattcatctcttggcttctttcctcattaatcactttctatttctaccctagtaggcaagtctgtcattcttgtctatcctatgaaagagccttctctttattaggaaggtgtcatgccagaattaacctttttattgagtttttacaggcctcaaaggtctcaccatatgatagtacactttacatatatttttcatcacttatgagtaggtcatctgctgtaaatcaggtgttatatgagaactgctctcaatttctcttagtccagcattttttttatcataacttaatgtatttgtttggcaacagaacagaaagcattgattccctctttctcaacttctttcttattatgctttgaactcagtaataatgaagtttatttgcctcaaatattccctgggagagaacatcaaagctctgaatataataattagtcctggattttgggatcactgatggaagggaggtctatctagggaatataggtagttaccttgccaccccatgagtataatttatatcttgaaattccatttacttataaaagagctgaaactctgatttaaatgtattcctgatgttcggtatgcttcagaatcattgacatatacaaatcagacctgcttaaataacctgcacattttaaatccagaaaattaattatcattagaacatggctcaggattagatgaataacccttggtagtgacagtaattgctaacctaattggaggattagtccgctgaaagtgcactggcagatagaaggggaaaagaggtcactggggacattgaagagaaagaaaaatcttttaaaaatgtttataggactttttgggggaaaaacatgtttcagggatgtaaataatgtttctgttgatgtccatgcataaatgtagaaactatattttctgtgttctgtactccctgctttaaaagtgtcacatgttcattaaacaaaatatattgaaaagcaatagcctatgctagaatatatggccttgatgtaacaaactcgtgaacagtgaagacattcttgctatccaggtttaatgttaccagtttttgttggaactacttcagtagacaattttgcttccctagatccaagagtatctatgcagcctacctaaaaatatgatgtgggggctaaatgtgtaaaaaggacatttacagtctgtgtggcagtcctcaaagcttccgatcctgctgaaatacagactcacatgtcccactgtcaccttgcagtggtataacagcttacacttcaagagcacagtgcgggtagggggatgaaaactctgtttgccaaattacttattttaattagaaaggtatttaatcttggtgtgtctgctttaatactggaaatgtgcttatagaacctgcctgacaaatatacacagagatattaagctgtgttgttttaggccatggttcctggtagtacagctataagccttactagcctcactttagagcagctactgttctattctaagcctcctttgagcaaggctccaactcaagcaggtcaagcatactgtacagtacccgtgctttgccactgtgactgtagcaacgaagccagagatgcttctttagactctaaaagagaatagcagtttaaaccagtctcaagtttttggttcttggatagtgtttcaggcacaccattagatcttggggctatgtgcgcatgaatccaggatgacctgtggtgccttaaaagtctatattgagacattattgcccaaatttctcattccttggctaaaatatgatcatagtaaccagttagtgtagattccatatagttaaaaagtttaacattcacaaaaagaaacaaatctggaacttgtaagggaatcgaatagaaatcataaacacagaagatattggagacaaaagatttcatgaactaaaataaaatttatctgaaaaaatatatatgagtatgagaggtaaacaatatttaggaaaaataaatgtgttaaaagttttaagatccaaagtcccttttactttatactcatattaagcaattgttaggaacgatgtaaggactatgcgacacacattagttcatacacctattctagtagcagatatttatctactgcattttaaattcagagcacagctactgctgtcttcactctgtgcctcttttgggtcaagaccaccatggtaccttctttcaggtcatcagtgagcaggcatccacaatcaagcaatgtagatttgatccttgatgtacatcccacctcatctcctcaaaatcggcctttcttggcttgtgccaaatataaatgccattatttatattgctgatgtgtcccgaagagaggcaacctcacactggtcccttttgttgggctcttcagagtaatatgggatgctcaatatttgtgcattttattagaatcaagactcttctgtctactcattcaaacataggataagaatgacagtgtcacatacagagaacagaacactcctttggttgcttcaaaatgcttttttttggccccattttcttctctgctgagcatttgagtccaaatttagtaggaatgactaagaaatttccaggatgtgacagagtattcagttcattgagtccctccttgtcattttccaatagttgtaactattgccaagatttcctcttaacatcgtaggtgccacattattcttccttcagagctgttaaatcactcatgcaagatctgtccatgcaatgacaacctccttataaatatagctgattttatactatggtataaaggaaattccctgcagacgttttgaaatctgagtctaataagtcatgtaaatttcattatttagtctcaatcactgaaatccagcagtcacactaatcaatgatccaataatcaactggtcttcaataagctaggtaatgtgacctttcattgctggggctggagatagggatagcactgtatagatttggaaatacaagttcacagtcaacagtcacgagtataagtcatgggctgttagtgacctagatagagcctctgggagtcaatatagatttaatcagtctgattgggagaaatcacatataattcaaaatgaaattatatttaaagtagaccttgtgcaataaaaggaaagctatcagacacagaaagaaaagggtagttactaaactaatgaatgacattaggaaagacatgtgtggttaattggtggaggattttaaaggaaacatccagtcgttatttgtatattttataggcaaggtgaaatcattaagagttcatgaggaagagaaacttattttagaaacgcaaacatcaggagaacaaggaagaccaattaggggattctttgaacagtaaagtcacacactagagcactggctataagtaaggaaggcgaaggccatgggatcacaaagcagagagcacaagagtgaatgcaaatgtcctctgggtttaagtgtgagcaactgaaacttggtagattctagatactaaaagaaaaatgaagggataagtaggggagacattaagttctgttgacctgcatttcagctattctttttttttttttttctgttttgaaatctttcccttccttcgggactcagaaaaaatgatctcttttgtcaatgagaatatcctgagtgccaccattagaattaactctgacgtcatatatattgctctagctatatgcccaacccttttagatactgagtaagttaatgggatgcattaattacctattattttttaagtatcattcaaatacataattgaccatctgaaaatgtgtatgaaattaatggatacattctaccacaaaggatgttaagcatagcattttttcaaaacctgacttagaatatgcattgatcccatccactcattctccagtcaggaatatgttgtttgtatggttgaacagcgtcatcttgatcaactggatcattaaccagatttacttgcaaatgatttctgactttttatggaaggaaaacctactttctaaggatgaatactttatccaaatgatgatttaattcacaaagaactccagaaattttcctcatccctagagaaaatgtggagtttttttttttttttcatcaaatgtctttgtagacattctttggctttctctgtgttgagaaaaccccacaaggagaaattttcacaacccataaatagaactcttttaagtttctgccatgtgacagttgccccagaagtacatttatgctttagtaggttgaatttgttgactcctaggagagctatggtgtgtatctacactaaataaaataacccccaaagatattctggccaaatgtgttctgcagagcaaaaaggggcatctggcatattattgaatgtcgtagtgtttaataaaaaagaaaataaaattacctgcatgctttcttttcaaagaaatgcagagaaatgtgtttctccttggctaaagtaacttttagatacttcagatgttgttgctcagctggcatgtatgatgagaataatattaaatatgaaaatggaggaaggaagaatcacagagatactgtgtagaaagagaccagtggcctagaaaatatgcataacaatggttctttaaaacctaggcaaaatgatcaactcttgttcctgataacctctcaactcaacaaattaggggaaaggtctaataacatcaactttatatctgtgctccaagtgccctctctgctactccatggattacttatggacttaaatctgcttcttgttttctctagctcagtaatggccactttagtgtatgtttattctatgttgatgtgtgtccaaacacgcagcctaaaaggatggctgacttttgtccttgaagcagtctgtgttgggtagcagactttcatttgaatgccccattctaaagaaaacatagccaagtccaaatcaagaaaatcacactccagggttcaaagaactctgggctgtcctcttgtgtttgtagaattagtgtgaattccatgatatcatattggtttgcttgtaaatgttactttaaggaaacactgagtttacaagtaaattctattttgaattaagatacaatgagctgaaaaaaatctattttctttaccttatggtgaaagtaactttcattgtagaatcattttagaaatctaggcaaccttctttgtaacactgctttgaaactcaggcaactggcaaccatcatacgtgataacccccaaatccatgaaaagcaatcacatggttagagaaaagactcagcaggtaaagatccatgccatacaaaacctagagacttaaattctatcactggaacctaaataaaagtgaaaggagaaaacaccttcacatggatgttttctgacttccacatatgagccatgcacatacacatctaacacacacacacgcgcatgggcaagcatacacacacaatagtaatataagaagtaaatgcaaaactaaatgttcattttcttttatttatcattgaaaaaatcaaagatccatatgattgctttatacttatctttccaatctgtttactcttgagttagtccagcagcatacactgatgagtcctgcctaaatcttcccattacttaatgaaaagaaagccaatcactaatcagaagaatattctcttaaaatatcatatgaattgcctttgatttccaatgataataatttatcctattcaaatagaatacccttcatacaagctttaacctagtatgttctaacttccagaaaggcatattctaattattctacttgaaattcacacccatataagtattgactttcattgtttatttacttttattgcaggaacatttcacacctgagtgcaaattcaaagaatcagtgtttgaaaattattacgtgacatactcatcaatgatctaccgtcagcagcaatccggccgagggtggtatctaggtctgaacaaagaaggagagatcatgaaaggcaaccatgtgaagaagaacaagcctgcagcacattttctgcccaaaccactgaaaggtaaatttgaaagtttatggattctactacaagaaaatactaatttaaataatttattctcatgcttttgaatgtaaaatgtaattcttccatattaaagcatatatccttaaattttcaagcatttcacagcactaaaaaccatcaagaccaaactgtaaaaatcatacaaacattcagtcattgagagtagtatccactctcatcttaatttatcccatagtgaaaaccctaaagtataccaaaatagttatagaggttaaccatggaggttagaatataacctttattggactactccttggtcaatatagtcctaagaactttcattcatagtttatgtttgttcgtttttttgttagtttcaaattaatagattaaaaagagaaccattgttttatagatttattgttttaatagattaaaaagagaaccattgttttatggtttctactgctgtgataaaacaccataacctaggacaacttgggaaggaaattattttattgtacactaccacaccacaacccatcatccaaaggattcaggacagaaatgctacaaatcagaaggtgatgtagaggccatggacaagtacttcttactccttgcccagcctgctttcttatacaacccagaaccatcagccatgggtggtactgcccacagtaggctagacactcccatattaatcataaatcaaggaaatgccccacgggcttttctacatccagtttgatggcgacattttcttacctgaggtcctttttcctgaaatgattctgccttttgtctaattgacataaaactagccaccacaattgactcctatcatcttgatatacaaacacatcactattcttctagaacctttcctttttcctttgtccccaagatgtcatgttgatattagtatcatagtataaagtcttccaactttaaatagtcccatggtctttaaaatttcaaacattttaaaagttcagtctctttacaacatccaacatctctttcaagttcaaagtttctctgaaatatctaaagtctctataatattccaaagtcttttcaacaaaatgtttcaagaaacaaattacatattttcttactataacaaggaataaccataggatagtcacaattcaatcaaatgaaaagagatattcaagaatgggaaaagttcagtgtttgatgtttgtggcagaagtgccttggaagcagcccttctccagccttgctatcactcatagcatacatagcttatcttctaggctcaagccagccctgctctacagctgctgctctccttggtgggcatcaatggcactgtcatctccaaaatgtggagatctgtactccaccagcactgcgcccttaccagtagcctctcttgggctcctctctttagggactcttaccccacacatgctaccagtccagtgtctctcaatggccccttgagtcttaggcattcaacatccactgaggctatacattcaccttgcctctcatagtgcaaagccttagctgctgtttataaatcttccatgcatttaaaactactaacacctgggaaagacacagcaattttggctgccagcaaaaggtaccactttggccaaccttggaccatagctctgggtgttgaccctaaggaaacccttcccagaagatcttgcctcagttgatgctactatcttcttaattacatttgattctttagtcccagttgacatatatcagctatcccaacaaagcaaaagttaaacttcagtggatcttaattcaaaatatcaaatgaccctatagagttttccaggcactctaaaaacgtcactcggaaaattcacaagccaggtctccatcatgtgcattgatttcaggcctatattatcttttgttcccatagcatctcactaagctctgaacactcagtggcttttccagcccaaatgttccaaaattcttccacagtcctccctaaaacatgatcagatctgccacagaaatatccaatgacctggtactaatttctgatttagtcaaggctactttcgctgtgataaaacaccattactacaaacaagttggggaggaaaggttttattttgcttacattttcacatcacagtttatcaacaaaggaagtcagggcaggaacctagaggcaagaattaaagcacaggccagggaggaactctgccacttactggctagctcagcctgctttcttatcacacccaggaacagagcaactcagtaccgacaccctacacacagtgagctggaccctcccacatcaatcaagagaatgctaccataaacatccgtacagtaaaatcttgtgggggcactttcttaattgagggtcccttttcccaaataatactagtgtatttcaggtggacattaaacagccagaataactattaaaataaaactgggagatggtaatattagagggagacatagataagaaagagagcatgcaaaccaaataggagatgacagtagagacttgaacaactacccatctccttacccacacgtgcacacatgttaaaataagtgtcacactgtgttttacagctcattttttggagccagaatacctgattcaaacttcagcttcattgttcactaaccagatggttggattgtgtgtgtttggtttagtcgtttgtgacagtttctcaactatgtagcattctggtcacaactggtttcaaaatcttggtcatctcccctctgctccccaaatgccagaattctagacatttgtcaccatgccccactgttaaccaaatgatcttgaaatgttacatacttacatgtgcctcatgattgtcagttcaatataagaatatccactgtgttgatggcccatgcctgttatcccagcacttagtagctagcataagagaggccttagagtccagtttgggctacctagtaatgcaagagcagcctaggctacagtcagaccttatctcaaatttaaagaaaaaaatgagtttttatattatatagatatagcatttttacaagcacaaattgtgatgtacatggtgagattaatatttagcatcatgtattctgcaagtatatgagtatatgcaagtgccgtgatttatagcccaacaataataattgttaccacttattgtactggaatcatgcaaatacttttcatcttaaagttttattttaagatatgatggaaatcaatgttttaaagtgtgtaaaatattgatattaagctttcatagtattttatagattatatttaaacttctgagagctttattaaatgtgttttcattaatccttgcatataacaccgtgatagaagttaggcactaaattcccttacatgggactaaatgaggactagaattcactgaatctagtctaatgcactctgccaagtacttatttgtttgtcttagtaagcaaaagaaaatattttgatctgttttgtctttgtttcttttcagttattaaaaggaaatcttttgataaataaaaatagtttattgtgtttaagatactattataaaaaatgtattcactgtggaatggctaaggtgagatagctaccatgagctttgcttcctgcccttagaagttttaaagtgagaatacctaagatctgttgtagaatttttgaatactacaatacatcagtgtgtccctttaaagccattttccaccatctctgtgcttttcagtggccatgtacaaggagccatctctgcacgatctcacggagttctcccgatctggaagtgggaccccgaccaagagcagaagcgtctctggtgtactgaatggaggcaaatccatgagccacaacgaatcaacgtagccagtgagggcaaaacgagggctctataacagaaccttacctt

SEQ ID NO: 813 - DNA, 79 bp, mus musculus
gtgttgtctggacatcaaatgactgaattgctccccacccctgaagaccccttccataatgcactgacctgctcagccc

SEQ ID NO: 814 - DNA, 78 bp, mus musculus
gatacaatctaccatcctttgggaagagagtctcaatgagacctagggaagactgctaatatgggaagatcatcctca

SEQ ID NO: 815 - DNA, 36 bp, mus musculus
cgtactgcagtacctccaggaatggtgcaccccctc

SEQ ID NO: 816 - DNA, 140 bp, mus musculus
tgtgcggccggaggatgggagccgaggcgcccggcccccgccggagctttgcgtgcagtcacactcccggggcaccggggcagcctcgctccccccccccccccacggcgaggcggccactcacctccgtgtgggctgca

SEQ ID NO: 817 - DNA, 496 bp, mus musculus; identical to SEQ ID NO: 56

SEQ ID NO: 818 - DNA, 548 bp, mus musculus; identical to SEQ ID NO: 57

SEQ ID NO: 819 - DNA, 17428 bp, mus musculus; identical to SEQ ID NO: 483

SEQ ID NO: 820 - DNA, 14220 bp, mus musculus
ctggtttctcctggcggcggcgttagcgacgaagctgcctttggcagcatgaacccgctgtgaggcgcaggcttcgcggcgcggggggcggggggaagaggaggacgcctcggcgaagttctccgccatgaacctgaggggcctctttcaggacttcaacccgaggtgaggcggttatcccggcgacgccaggttggggcttgggttcgggtagcggctgggagcggcgcggcggccaaggcactgcagtctgagcacccaggcaccagcctgaggctccttatggctgccagctgctctcgggaaagctgtgttggcctcagagtctgtccatccgcttcttcctccgcaactggtaccaacccgccgtggcccaagttgtcgaggttggagaagtgtcctcccagagggaagcccattgatctccactcgtcctttttcattggtatttcaacttctctgtctcgatttattttttcttatttttcttctcaccgctccgcctgcccccgttttctatgccagggccatctcacttgaccctgacacccccagccaccttcgcacatgtttcctctagtttcagcatttgggattttccttggatttatgcctgtctgccgttcttcgcttatttgtcaaactgatgtctgagatactgaaattttagagtcgttgccagggtatggtaaatcttacataatgcctttgggggtgaacctgatcgcctccaacgcattttcttagccttctctatgtaagtttattcgcaggaagtagatattgccctgcttattttccagacttgaaatacctagtgggcagtgtggagaaaacactggctaaagtatataaatctcggtccttgcacttgtcaaactgttgtaaaagtgttccctctgcggcctgtgagctcccaaagcagaaaccacttcctggttgttcccttgcacatcacctcccacccatctgtcatatagtagacacttataaaacgtctttggaactaaactgagtcaagactgaggttgggcagtcaagtgattctctactttagtaagctgcaagaggagttcatttcactgatatttttcaagtccattactatttaaaaggaatatctgctcattttatttctaagtggtaagacacgcactcaagtaagctagccttcctccgtacgtgaggtcctaggctaggcgcttgcaatgcttggccgtcctagcctggaagcaatgggaatatgaacagataagtagctgtattgtgcactcctgaggatgccactttcttggctgtttgttggagacaaaggaactggggagagaagaggggactatttagagtgcagtctccttaagaatggtaaaattttaaaatttaaagcctcctctggcctgggtgctcttactgtctttgtgtttatagtctggccttgttccgtggtcatcatcaatggcattgagccttcttaacggagaggagttcatttagaggaactaccacagagccaaccatagcttttcttctactgctcctggattagggtttgtctataggacaactgtgttggtactgaagctggacaggtcttgtgtattttcattgtttggagagagtgacaagaaacagaaatagaggctgaattttttgtgttcttgggtaactcacttatctgtttcatctgtagaatgagtataattgctcacaaggctattgaacctgaattaatggctgattgcacaatgtgttacaaatagaaatcgtttattatgggacagatagtccagaagctgcaaggtgatctcccagttatctaagagttgtgaaagcaaaaatagtggtcctctgataacacccttagccagtttttcctttactttttttcccttccaaatactaaagtctaaaatttataatgagatacttcgaagagatttataatgatcatcaacacatttatttgtgcttaaattctaagtggaataaaatgcatctttccctgaaaaaattaaaagtcttttgtaccccaccattgtcctggttcaatgtcattagtgggaaggaagagtgttaccttctagatgttccagggatacaatggccaggtgatattaagaagtagatttttcttagctggcgatgtttcataaactgtggatgatctagtttataacactgtatcttaatcttgcaccatgctgacgaaagcctttcagacatctggagagcaaacttgggggggggtgttgacaggaaagcaccctgtgctaagacctcagatctgtgcttttgtctaattatctgtttctaattctgaaccagttcacacatggccctcttacttcaggactttatcatgctctgctcatttaataggacagctccttctctccttgattcaggtcccatttatcattgaaatatctgttcatttggtagttgctgaagtaagttgttctggcttcctcaacctggtccattcctccctgcatgtacaatctctgtagaatatcatagtcttctttagaggccttatctgtgctcttgctctttttctctgtttatttaattgatatttctctctcctactgaaattcaaaccatgtgaggctaaacccatagcttttattgtcaaaatttatatccatgagataatggctggcacagtattagtgaaatgaatgataactcaccctagcctgtaagaaccgtctagagctccttcttgtcaatgactgctttcttgctggtgtatgaactatttattttccctctctcttcctgtgccccttcagagtgtaactgttgtattgacaagctgggaaagaccttaacagtacgcacagggcaatgtgctttcttgactctggggaccattacagcaacagccattggtattgtctgctggctcccacaccatgcactgtgactccaggcctcctctcataccttgcaaatcttagtcactgagaattcactgcagtttgtcagttttctagaaatagtagtgacacagaatgattgaaaagtgtttagcacccagctgtgaagggctgatagctgaccctatacctatttccatctaccacagatctggttgatcacgaacttcttttcagaattgccttttagttacaaagttaaacttattaaaacatactgtgtctaccaagaatccttcttgactgcctgaagcctctaatagcttgattgactaaacagactattagaattgactaaacagaattggaaaactgattccagaatgtccctaggaggtggagatctcctccacctttaatacacggctttaataggcaacctgactatatcacaaggccttggataaagttgttatttgttagagaaggcccttcagccgttggtagccatactgcattggaagactgtgagaactctgtttagtctaccagctcattagcagtggactcctgatgggagggtggtccatctcttgggtattctagactggaacaatgagtaagaaatgccttactgggcttgtgtatgtggacatgtaatactaatgaagtaaattatgtttgcagagttcctgtatgctccatcttaagccattctttagtctttgtaagctgtgttttattttaattttttggggaaatactaatctgattgctggtaacctttcactaaaggcctctgcaggcaccaggtacatatgtggtatatagacatacaggcaaaatacccattcatataaaataaagtaaaaaatcctgaaaataattatttaaaaagaaggatgggtatgtactgcagaaaatgtgtgtagtgttttaaagataaatgatgttgagcttagggtatagttcagtgctatggcacttgtacagggcattaggtttgagtctccagcagagtaaaaatgacatcgtgttgattactccaagtactccttaaagattgtatttttcaaagcaggccactgatctgtcagtatgagtgtagtgtcagtattgataatgaattactgtgtgattgattgtacatctgttgttgggaaatatagagctactggttgtcagaatattgtcttgacttttactgattaattgttgttaatggctatggcttatttgcattcaccatgtgtcaaccctcacttggcagtttggttttcagtatccttactcttaacaatagccctacaaataagattgcagccacattttattttattttctaatttaaacacattttaatttattgattgtggagatacatatgacacactgtgcttatggaggtcagaaaacagctttcaggagtcagttctcttcttcctgcatgtgggtcctcaagttatccattaggccagtggcaagcgcctctagctactgacccatctctctggcctcagtttcattttagagagtcttggagttctctaaagtcatacaggcagttatgaaccactccaggattctaatccaggtcaggttccttctgaagttttttgcttcatccttcatgccccttcctcctgtgacagagtaaatccagtatactgaggagccattctagctagtttttggtcacattgacatcagatagtcatttgggaagagggaattacaaatgagaaaatgcccctcagcagattgcctatgggcaagctggtggagcagtttcttgataaacaatccatataacagggctcggcccattatgtgccactttctgccctgccctggctatgactttctatgattgctttgcttagtgatggttcataagtgtacatggtgagtaaattttcagataaaagtactgaattctaggtgtaggtgctgtagaactgatactatatgatccagtagtgagaaaagtgatcaccaaataaacgtctctctttaataatcctacagaaataatcggtagaacacttattatttccatcatgtttccacttaccgttatcttaatgaatcagtatacgaaatcagatgagataaatgctgtaaggatggttgagtgtccatcttctttacaatgatttgtttcctctgcattttgtgcatttgtatatattttttagtcagatgctcttaaacatttgtaccttaataaaacaagttaaaatttttactaaaacatttttctgtatggtaataaagttttatttagcctaagaggtgcagtccttttaataatttgtgaaaatatccatagtttgtcagctggagccagtctctaaagtcataaacagaagtatgtcacttaaagtatggtatatgtgtacggggctagcttacttgcattcatatagacctatatctatactctaggcaatagattttactggagaaacccaatggctctaaaaagagtccagctgtattcatgtaatttagaacttttatataatttatatatagtttttaaacattatttagaacagtttagaacttttatagttagagttttctctttggtgagtatccatatgtatatgtatacacacacacacacacacacacacacacacacacatatatatatattttagaaaggacagtagcttttatgcctggcccatggcacattgcccagtggtaatgcacttatgctgtgaagtcagatgtggatgatataactccattttaaagatacatctatggtttgaatatagaatcaaaattttgtgttttggaaacataattctcacattagtatttttagaaaaattactattttaattttgtatgagtctcttgccttcatgtatgtctgtgtaccactttgcattcaatacacacagatgaaagaagagggcataggagaactggagtcatagaaggctgtcagttgccatgtgagttctgggaacttaagctgaggcctctgcaagaacaaaaggtattcttcactagtgaggcatcttttcagccctttaaattaaaatcctaatggcaggagaggcaacttgagagattattaggataccatatacttgtattttaaaatgtcagcttcagaagcaggaaaaaacacagtaatttcatatatcttgacatctgggtacaaaattatttcatactccatgtgatgaattgggaagaagagccagtctacagtagattggtaaagcagtggtcaagtggaggaaaaagcactgctgtgcccaattttcatgggattggaataatttaggagaactaacaggtgagcctgattatttgttttagggtctctgtttctccaattgcctctggaaccagttccatggtcaccacttctctttttcctactgcctcaggcagatcccatactttcttttcctagctcccatctcactttgtccatactaccatttatacaaatgttacaccacattataactgtggctttctgtgtagacttctatcagaaaacccttggaagcaggagacttaattactcacttttgttttctcaaccccaatacagtatgtgttctacatggaacttttaaataaattgttatggaattagtgagtgtaaaatgtatttttaccttatcttatgtgagtattttgccagcatgtgtgtctgtgcatccagtctgtacaggatccctgcaatccagaagatgttgtaccatctcgaactgaagctgtagtcaatcattaactgccttttaggtcctgaaaactgcacccatgtcctctagaaaagcagctagtgatcttaactgttctcatctctccagcctagaattcatgacaagtctatgaactaaaatgtttctgttatttctcctcatttcactatcagatatttgtttaaaatgaactctttttcacattttgctttccttctagtaaattcctcatctatgcctgtctgctgctgttctctgtgctactggcccttcgtttggatggcatcattcaatggagctactgggctgtctttgctccaatatggttgtggaagttaatggtcattgttggcgcatcagttggaactggagtttgggcacgaaatcctcagtatcggtaatgctgctttataaaacccactggtctatatcttaagagaacaaaatcttgatggttctcactagagataacataaagtcaatttctttctatttgaacttttatgagaactgcagtccaacaaatattcctcatcaggattttgaaaacatagacacttgttatgtattttcttacagaacagtgttaatctggatggtttaatgcctagaaagcctacaggcgtagcaccagacacccaaatatagaattgttttgccataacagactaaaaagcacagaaacactctgtatctatagttctctggccatgtctaccaggcatctgacttgggtagtttacatttagaactaggctttcctttctcctgctcctctattcctgttagttatgccagggagtgaactcgggccaaaggctatgagtccctcaggaactggagactgaggtaaactaagaaccagatgttaaaaaccaaggtagagctttgggagtcatggaagttgtgacaacctagtgtggctggattctgtgggagttgcatcatttcctttctcaaagataagggacgagagaaaaggagtggaaagagtgagagccattagacatctacagcaggaagatgagtgcaggtattcctaataggacagtgagatacaaacagctgttcatgtgaaagaatataaaagatggggatacttcagctttaaaaattcttgatttaacaacttttaaaagatgctatagtttatagactgtataaagtgcatatctcataagcatgtagaactttcaaagagctccacacaacaaatactagcaaatgaaggacattaatgtgtgaatatgtcttttctttttccctctgagatcataatatgccaggcagtagtggcatacacatttaatcccaacacttcggaggcagacagaagcagataaattctgagttcaaggccaacctggataatagagccagttctaggatggccagggctacacagtgaaactctgtctctaaacacagagagagggtgggaatgaataaatgaataaatataatatttgaatacttatttttattattattcatatgaatgtatatcttatgtatgaggatacccatggaggcaagaaaagggtgatgaatccctggggctgagttataggtggctgtgagccaccctaatgtgggtgttgagcactaaattcaagtgttctacaagaatagcaagcagtctttaccactgcaccatttctccagcccttatctgtggttttatatctcttgtatatatctctctttttcctcccctcccctccccctcccctcctcctcctcctcttcctcctcctcctcctcctcctcctcctcctcctcctcctcctcctcctcctcctcctccttcttcttcttcttcttcttcttcttctgtgttttgtttgttttgtttggttggtttttttgttgttgttttggtttggtttttttggtttatcaagacaaggtttctctgtgtaacaggcccagctgtcctgaaattcactttgtagaccaggttggcctcgaatgcataaatacccacttgcctctatctcccaagtgctaggattaaaggtgagcgccaccatgcctaggttttatagctctttttttatgggaaaaattcagatatctagttcttgtttctcaaaaaaacattcactaattgattcttaaaagttatatgtaccttttcctcggttttgacatttttcaagtaagaaaaacagttgtgtttgtggctggctggttgtatggtgtgcacaaacacagttattcccttgtgtgtggtattcagcaggatgctagtgaagtctacaggaattgcctgtaaccttcttttctctttgttctagtctctagaatatttatcacccatagggcaagcgggtcacaaatctttatctgtattttttaaaaggtttatttatttattatatgtaagtacactgtagctgtcttcagacactccagaagagggcgtcagatctcgttacagatggttgtgaaccaccatgtggttgctgggatttgaactctggaccttcggaagagcagttgggtgctcttacccactgagccatctctccagcccccctttatctgtattttgaatgaacattataggcctttcaaatacattgtaaacatttttcattttagtttattaatagtttatatttatatttatacagctaattaaactaatatttgagcaaaacttttaactttctttttaatttacaggttttaattcattatcatactaaaataaagattaataaaagttattttattttatttgcatttaaagtagcacctaagaagattgccatatcttattgaatgtaacctacacttgcaggtgaagcgagaattatatttatagaattgcatgaaatatgatttgtctagtttttaattcagtgagaagtgaggatcttgagatgtggcagaagtaattaatacaataatcttagaagtaactgatagttgattaaagttaggaacctaagtgttcctgaatatttgcaagattattaaagataggtttaatttagctttttacttcatcttttgttttgcatatttacagttgaaagtcagaatgggaattgacttggcatttgctgtgcactattgtgggcacttggactgaggattctgaatgtgtttttttctttctcttcttcttccatccccctttagagcagaaggagaaacatgtgtggagtttaaagccatgttaattgctgtgggcatccatttgctcctgctgatgtttgaagttctggtctgtgacaggattgagagaggaagccatttctggcttctggtcttcatgccattgttctttgtttccccagtgtctgttgcagcatgtgtctggggctttcgacatgacaggtcactagaggtgagatttgtgttttactataatgtcagtcccttacccttcatcaggaacagactaatcattaactctagattgtggtttacaagagaacaaagaccttcagctttctcccagtgtcctgtctaataagctacctgtgtttgtcaatcctgttaagcaaccattagcatagatagaaacatagctacaaagagagagactttagggaatgtatccacatggttgtgaagctggcagcctacatctatagaatagataggcagcctggggactcagcaggagttgaccctctaggttgcctaaatttcctcctttccatgataaagcctccaactgtttgaatgagggctacttaccctacagtatttaaaaacttgatgctgtcaaagtaacacataccctagtatttaattcgatatcttggtaaaatagtccacctgaattgatacataaaatttaattgtctcactacctcataccctatgctgtcactccttagctgacctctagttgccttatcctgatttacccatatatttattttttaatcaagtatctatatatgtaagctctttaggcccaagaagagaacatatagaattaaattaaaatgctaagactagtaatggtaataaagaaatcaattgtggataatatttatagtatccttaatctgtgtcaaacatttggatgttcacctcacaaatagcagcaacttagtaaatatttacaacagcctgtgagagaggtgcagttctttttccaggcagacaatttattcatgaccacacattaaggaaaaaggccagaattccattttagtcagaccaaatccaaagccagagcaattaactagaaaggaactgaagccacaaagcaatatactagtagatttagaggagaatgggaagcagtagagggacctcattcaggagatagtgagctcacttggcgatcagttcaatgccaggtgcttctaggagagccatgtggcaactgcacactggacctgttattcagcagtacggctagcttgcaggcacatttcagaactaatcactaggcaatatgttaatctgcagtgttgctgaaactttcctccaccccagggagtgtgaatgagtgtgtgtgattcagtgaaagggatgtctgtctgaaatgctacaagtatagccatttacggagtggatagaacgggagcccaagaagaacttctctgagtgctcacagcatgccaagactggacaatatgactcttgaaactcagttattagtacaagaaggaaggagatccaccttaaaatgctctcaaaatagcctagtaagatgtagataaaagtattctgctgcctattagtattgagggccttggtaaataggagttgttggtagcttagaatggaagatgtggcaatagggccttatgcagttattcttgcctcacaaagctggaatgtacccaaaaagtgggttaggccaggagtgctgaatcacaggagatgtgaacttacttgtatttggacattttgggtttaatgggaaattggcaattagtttctgattgggaaagggcaggagcacagtcaggattaatgctgcaacaccgaatctacaactgttggcttaagctgactaggccctcaaagagctagaaaagaaggcgtgggatttacggcagagtcctggttagaagtagaagcaagttttagggtacctataaatcagctgtatactgattattagcagaagcagaaaggaggcttggaggaaatctattatagattgccccttttgtctttcttctttcaaaagaaggtcattatccggccaacattcaggtcttaacaaaacagccaaggcaccaaccagccttaagaatgaaacaagacacatgtgtgcaattcccctcatcaagaccccactgtgcatttccgttgctagaacagtcagaagcttccagcatcatatcattcaagttttacagtattcattgcttaggagtatgttaaacgaacaaccactatgttcaatgcagcttgtttaactgattctttcctttatctttagctagaaatcctgtgttcggtcaacattcttcagtttatattcattgccttaagactggacaagattatccactggccctggcttgtacgtagccttttaaaaatcttaaacaaatcttttattataaaagtaattcatatttgtgtcaaaaaatttggaaaaaaaagacaagcaagcatgagcagcagctactgatcacagtaccaaccctgggagctgacatagtagtggcctttactcccttgtacatggatagttgacattcatttctatccagcttttttattttaatataacttaagcatttgttcttaacaaatatcattgtaaagatgacacataaggcttcattgactcataagttgcatttatgaaacatgtctaaatgtttcagttgctgctcatatttgtgatttttaaatgtgcccgtttgtatatctgtgtttaagttttctaaatttgtaacgataccctacttatatatgtttatgaagaacagtagaacctttcattttgtgttttgaatatgtaataatcaaatcagtttcattaccatattacctcagatgtttatcatttattcatgcatggaattttcaaaatgctattctcttttagctattttgaaccatttaattattatcaatcataattattctgatgttctaaaaacattacaagattttatttttgtctccaacctctggtgtatttttgtgtataaaaaaaaaatccttgtttactattttaatgttttcttagaaagtattcaagaaaatgtattactgagttatagataatttttaagtttttgatattttattatttttatgtgtatggatgttttcctgaatgcatgtcattaaaacctgcaaatcagtgaaacattctttatacatggcaccaataatatgagccatgagatgaaattataaagttagacttcataaaataaaataaaataaaataaaggaaaagacaggtcactgactgaggaataggttttgcaaatatgtattaaaactttgacttctggcaaatagcacagagtcaataaaaaataaggacttactcatgtgctcagacccacacagacacacacatacacatagataattgagggagtcagtaactggtgttcaataactccgagtgagaataaacatacagaagtgagtgcttgagtaagtctgagtaaaggatatgagagcatatgtgagcaactgaatgagagggaggagggcgtctacaagggaatgccagaatagggctgtgggaggaagtgtgagggaaagttgacagaatgagaatgtagcagcgaagaataattcttagaggagcagctagacagagtgagcacgaggactatttgagtaaggaagtgtgtgaatgagggccatgaagaggtgaggatggatatgagagtaagtgtgaagaactgagtgtatgagagcgaggagtgaggaagatgcaagggaggaaaaggggattccactcttctggattacatacgtggggactcagtgggggtaggagagaggagtacatgggcgatcatgggtgagggagtgagcggggtgacatgagtatgtgaggggcagtgaggacatgagtgagcaggtaagtaagacgtgtgtatgtgtgagagtgaacatgtcagtaactgagttagggagcaagacactgcgagtaagggagtaggaactgagaatgaaggagtgtgtgagtgactgagaggcaggaagcatgggaatgagtagatgacaaaatggggggcttgagactgagggagtatattcagaagaaacttaaaatatgccgtgttggaggaccagatggcaggttgttgcttgaatggaagacagcctaatgacattatttcctgcatggaagtcctctggtgaatgtggtgtttcccatgctatctccatgacagtcctggacagtaggactgtctgtagtcctgcttccccttgactacctgaacagagccagcaaaatgataaaggcagctgccagagctgcagggaagctctcaagacatcgtgtttctactcctctccaggttgtgtgtgtccctctgtggattctcatgtccttcttgtgcctggtggtcctctattacatcgtttggtcggttctgttcctgcgctctatggatgtg

SEQ ID NO: 821 - DNA, 252 bp, mus musculus
ctcaggtctcggccctctacgtggagccgcgctcggcgggcgcccccaggggcagcagcctggcggctcggcagcccctggccagatgttccgcagctgcggtagcgtggcgagcgagaggcggctgcgggctctggcggcgcgcgtcccggcgacggcgggaagggtgctgggcgcgccccagcccgggagcgactccgcagggagcggccgtgcggctggggacagaggcgcgggcaaagttcgcgggaa

SEQ ID NO: 822 - DNA, 341 bp, mus musculus
ggcaaagttcgcgggaaggccgggccggacacggtgcgggtccgcgggctgagccggtggctctgcgtgaacatggccgtcgcggagcgcccgggggcgggggggctgggggcaggtgccgcctgcgcggcggcgggaggagtacggttagtgcggactcaggcgaggccgccaagggagctggcggcaggctctgccgcggtgctggacagcattcggggccgggggcgctgccgcgggccccgctgcgcggagcgtcatggctgcacgggcgcctttgttatcccgaagagtgcggcccgcgtcgggggcggggaggccgggctggcggctccgcgccc

SEQ ID NO: 823 - DNA, 4137 bp, mus musculus
atggccgtcgcggagcgcccgggggcgggggggctgggggcaggtgccgcctgcgcggcggcgggaggagtacggttagtgcggactcaggcgaggccgccaagggagctggcggcaggctctgccgcggtgctggacagcattcggggccgggggcgctgccgcgggccccgctgcgcggagcgtcatggctgcacgggcgcctttgttatcccgaagagtgcggcccgcgtcgggggcggggaggccgggctggcggctccgcgccctcgggctgcccgcgtggggcggggcggggcggggtgggggccggcgagcgggcgacggtggcggggcccgggccgctttgttcaccgccgtcgccgcctgcgccggccgcgcgcggatcagccattttagtgagcggggctcggaggcgcggcgaccgcgactgtcgcccgccgggccccacgtccccccccccttcccccgcgccgccgccgcccccggcaccgcgctcggcccgggggtggcagcagcggattttacagacactttctttcaccccgaggctttggacaaaatggaaggtgaattatgggtgtccggagcaacggggacgtggcccgacacgggctgtctgctgccggcctggacgcccgggtgcgggggcccgccccacccgggataccgcggctgggctttaattcagccccgcgggcctttgatgccaaggggaatgctttagttttacatgatgaccttgggtgtgggaaaaggaaaagatggcgggaagcgggcgggggtgggggggacagggaggatgacacgccacagctgcattttatttggaaactttggagaaagtgttcctggttagacctgcattactgcattacacaggggaaagactggtccttttgatgtcccttcccccttttcctggtgaagaagtgacaggtttcaagtattattatgaagatacctgcttgctttacagatcacgagcattctaaaaagccatttttataaagcagatatatcagcaaccctggcatttcacatctgtttcaatttacgtttcctttgatttcccatttaaacgtaagaattaaagggacaatcacctagctgaaatgaattctatctcctgttacctaccctgtctacaaatgtgtcttcccattagttctttatagacctttgattgtagaaactacagaatagtagcagttcagtaatgtgcagtgctcagcaccccaccttatgttatccccatttggagaacttagtgatcgctctagagaagtaacttgtaaaccagcgcgcttcatgctggtcaaaagttaaatgacaagcaacagtgaagctgatttcttcctccgcctagcctactgctgccaccggtgtcaggagctgggggacgagaggtcctactgagaaccttaagtgggctttgcccttggtttctcttttacttctcatctgttcttcatcgtttttttcttctctttgtcttctatgcatacatcagtcaggatggctaaaggtgaccccaagaaaccaaagggcaagatgtctgcttatgccttctttgtgcagacatgcagggaagaacataagaagaaaaacccagaggttcccgtcaattttgctgagttctccaagaagtgctcggagaggtggaaggtatttgggtctttgactcgtaggctagtgcttgcatttcacatttgggatttgctcacttgcacatttgccccaattggttggctggtttttttttctctgcattaaaaattaagtacagagcgtttctttcttcttgcaagggggttctatagcttccacctgaattacaaaaccattgggttccattgcatctaggaatttaataaattctgttttttgcagaccatgtctagcaaagagaaatcaaagtttgatgaaatggcaaaggcagataaagtccgatatgatcgggagatgaaagattatggaccagctaaaggaggcaagaagaagaaggacccaaatgcccccaaaagacctccgtaagtgcctataggatatggaataacagttgaaagctttccttttgcttgaaagaaccttaaaacatggtgagacagaagcttctaaatactccactttggattcagagcttgtctatagttaagatttcattgggattacagaggtagccacctggtccttcctacttatatacaccagagcccttagttgtattacttttcctttaacaagcaattggaagagaaagacacactgtactttgcatttagtgaatgttctaaactcttctgatgtagcattgaatgcagtgattctatgcctgagaggagaaaccatggcaagaagtcgttatatttcctggtggtttatttatgcatacctaccttatatgtaaacctagcacttgggctggacaattcgggatggaaattttaaatcgggcttgtgttacatagatagctataagaagaaagggggtgtatagactctagattttttttttggtacgtactttattgatttatataaatttctgtccaaaggtctggatttttcttattctgctctgaattccgccccaagatcaaatccacaaaccctggcatctccattggagatgtggcaaaaaagctgggtgagatgtggaataacttaagtgacaatgaaaagcagccttatgtcaccaaggcagcaaagctgaaggagaagtatgagaaggtaagggacggggctgaagctttcctgtgtggtgctgctctgctggaggagactggccggtgctcaccttggtgctgaggtccagttctccttaagatagcaatgtgtgctgataattttgcttctgacagttctctcaccctcccctcattaaaccccactcctctatttaaaactagaactgtaaactgctccctacccttagtggaggaaggctttgagttcttaacatgactgaaagaacacttggaggcccattgacttgaaaatttgaatgatcaagaaacatttacatatggaaatcattgccctgtttgctttcttaagcaaccctcagcactaagagctgttagagtttagcctctcttttcccatgcgtccctgttccttccaggatgttgctgactataagtctaaagggaagtttgatggtgccaagggtcctgctaaagttgcccggaaaaaggtggaagaagaggaagaggaggaggaagaggaagaagaggaggaggaagaggaggaagatgaataaaagctctgtctccttgtgaataccttagagtaggagagcgctgtgattgacacatctcttatttgagtcgtgtctattgcccttgttaggtttaattacaaaatttgatcacgatcatattgtagtttctcaaagtgtcagtggtttacatgaagtggccgtgggtgtccggagcgccctgaaactgtatcaaagttgtacatagctccaaacatttttaaaatgaaaaggcactctcgcgtcctcctcactcagtgcactttgctgttggtgtgacaaggcatttgaagatgtttctggcattttgttctcaactcgtaaggtagtgttaactatatggttattggctagcaatcctgagttgtcaactgtacatatctatagtttgtaaagagaatgaaacaacccagacagattcttgatgctccttgtttggcgtggaggctgtgaggggaagatgccttttggagggggccgtagctcagggcgtgcactgtgaggctggacctgttgatactgcggtgggcatccatttagcttcaggttgtcctgtgtttgtatatagtggcatagcattctgctgacattcttagttgtggaaaggggggaggggtcggccggcatgagaagtgtttggagttttttctttagttaagtgcagtaggtttgaaactttttaaagaaactgtaggactcatcattgtcagcaaagcaaagaactactgcatcaatggaagttcaagaaccctctggacctaaacgcaatttgcaacattctgttattttttgtatgtttagaatgctgaaatgtttttgaagttaaataaacagtattacatttttaaaactgttctgtattacaacggcctaaa

SEQ ID NO: 824 - DNA, 3427 bp, mus musculus
ttggctgtgaccaagaacaagaagctccgaaattctggtaagctgcccttattttccctacctcgtgaatggcaagtttgcaatgccctctcccaaattctcccaagcctgggggtcggtgggggtgaagttatgccgggttcccctaaacttcgagattcacagtgctgggggagctcagggaattagcgtggggcagctgaatacaaagcccaggttcatagggtgcgtgtcagtccactgactcctgtcccgtcggagaccgggcacggaggaagtcgccacaggaacggagtttggctgccgccttgggacagtcggccgaactggacatcggagggcggccccgcagtagaggcagtgcgggccggccgaactgtctccaagagagcagcgcggttcccacccgctttgggaagttaagttcgcgggcggccgcggcggcgctcctgggagcgcaacgccgtggccgcctccaagtgccgcggatcgccgctcgccgccgccccaagacttccggatcgctccccagcagcggagtgcagaccccacgcccgagtgtctagcagagaggtctgagcctgccggagccgagctccgtctgcccgtcccacgcgagcggctggaaccggcgggcgacgggctaagacgctgcaggcggtggcggcggcgaaggcggcggccgtggacgttcggaggtctgtactggggtgtccggaggacgggcgcaggagctgagtgcggcggcgggcgggtggaaggaaaggcagaacgaggtaggaatggtgctggggacaccaagaggaggcaaggggctccaactgcaaagcgctaggacttggaaaccgcaaaccctactcccctagtctccagtccggggccgatccgaggggaatggcgcgggaaggagctaggcatagagacttgtacagggtttggctggggaaggggagtgtgtataaagggttttcaggatgggcgggagaaggctgtggataagggggaaaagggtggagtagcccctaacacagctctctgcctgggagagggtagggtgatggcgccttgggtcttcttttccaagatttaagtggttgggagagtgttcagatctgggaggattgaaaacaatgtagcctggggctggggaataagccactgcgcaatgtcttagtgaattgcttggtgggggacaagtttaaaaactcagcaacagactcagtccttaaaatttttctttcaaactatgttgagtgcttctgtttttttccttgtaaccctgcagcggagccttggaccttacctttcactcttgctaaggtgcccaagggcagatccatggagacccagttacccggggagttcactctttctcctctccttttctttcttttctctttatttctgaagtgcaaataaaaagtttctgtggttgttgtgggtttatttttaagatgtatgacctttctttcctatttttctttaggaagttcattactttgagggaaaaccctgaaaagaaccccccttttttgccaaaagcacggagggcaagtcttggtgcccctttagaaagccctcattttctcccagcctggacaaagtgcagtattttgccaaaccaaagctaattagcaaggaggtgtttccaaataaagagggccctgcccttgcacttggcctctttcatctaggttttataaaaggtttttttaaatgttgctactgttctttgaatggggcagggcaggaggcaaagtttccccacagctgctgtcctcttcagcctggcaggctcctgtgcttaagagaggagtctgtgcagggtgctttgtgtgaggccagaggtgaatctcatacttgcagagatttctcctttccccttgtctcctttttttgacctctgccttgatataacagggtttctgccctcttcaccggtttactctgaaggtagctggggagtggtaagtatttcacctggttgtcagatattaacgtttaatttccttgaacaagtcccgaagaccttctcaggataatgtcttttggtaggtcttccttcttaaggaagagtcctcctcctcctcctcctcctcctcctcctcctcctcctcctcctcctcctcctcctcctcgctgtgttaattgtatttctggactccatctagctccctctcccactctcccttccccacctcttccagtgtggaaaatgtggcgcagttgtatttctctaaaatggcgtcagcaggactctgtccccacccccacccctggctctcatatctttctcagatgacaccgaaaacaaacaaacaaacaaaaaaaccagtggcaagcacaggtatcctaaacttgctttgtatcagagtcacctgggacttgcttgtaaataagaaagaagaggaaagaaagaaaactggcattcttcaaaagatttctaagttattgcccatccagttggctgtttcctccactttttgtgaaaggtggctattcaaatattaaccactgatttctctctctccctctttttcttctccttatgttttccaggcaacatctttgtggccagcctctctgtggcagacatgctggtggccatctacccctaccctttgatgctgtatgccatgtcagttgggggctgggatctgagtcagctccagtgccagatggtcgggttggtcacaggactgagcgtagtcggttccatcttcaacattactgccattgccatcaaccgttactgctacatctgccacagcctccaatacaagcggatcttcagcctgcgcaacacttgcatctatctggtcgttacctgggtcatgactgtcctggctgtcctgcctaacatgtacattggcaccattgagtatgaccctcgcacctacacctgcatcttcaactatgtgaacaatcctgcctttaccgtgaccattgtctgcatccacttcgtcctccctctcatcatagttggttattgctacacgaaaatctggatcaaagtgctggcagcccgtgacccagctggacagaatcctgacaaccagtttgctgaggttcgaaattttctaaccatgtttgtgatcttcctcctttttgcagtgtgctggtgccctgtcaatgtgctcactgtgttggtggctgtcattccaaaggaaatggcaggcaagatccccaactggctttatcttgcagcctactgcatagcctacttcaacagctgcctcaacgccatcatctacggtatcctcaatgagagtttccgaagagaatactggaccatcttccatgctatgcggcaccctatcctgttcatctctcacctcatcagtgatattcgggagacttgggagacccgagctctcactcgtgcccgtgtccgtgcccgtgatcaagtccgagagcaagagcgtgc

SEQ ID NO: 825 - DNA, 3427 bp, mus musculus; identical to SEQ ID NO: 824

SEQ ID NO: 826 - DNA, 3427 bp, mus musculus; identical to SEQ ID NO: 824

SEQ ID NO: 827 - DNA, 3427 bp, mus musculus; identical to SEQ ID NO: 824

SEQ ID NO: 828 - DNA, 4172 bp, mus musculus
agactgtcaccctgttagccgccgctgagcctccgctaactacccggcgcctgctgctgccctcccggccacgccatggagcgtcttgataaagcagcgctcaatgcgctgcagcctccagagttcaggtatccctgagttccgctgggcaacggtggccgctcggctctggcctggcgctggccccagggcaggcaggaggcagggtgggcttggggacgacccctccacgggtcaccgcaggctgatgaagaggtaaagtagtttggagcctgcagcttctgagtggcgggccctcagttcacgcttccttgctcttcccctccctgtttggctgctttgcagtcttcccctttgccaggtggctcttttgaggataggcgcccggtctcctttatcttggcgcttgcgagcccctacatcacatggttttttgtaaatatctagtgtgtgaatacagtggaggcaggctctgatgtgaggtcacttctcttgaggggaatcaattagtaggataaggactggtgactgaacagaaagaatgtgatagtaggcctctctgaggcaagggcctggggaagaagttagcagccattaattgacatcatcagatttttcttaattcttagtttggctgactacttaaattttaacttgagaagaaaaaggaagttgaattcacataagtgaattttgtgatccaagatcacaaaattagaccgctgacaggtctcagcagcccctagtcaggtataaaataagtcaaccaaatgacattcattgctttgttttatgtcactgatactacctgacctgatttgtaccagcagaaccaacaggtaaagtgagctatgactagaaactaagaagaaaatggtctaactgctaggggaaggtgggtaactgcttttcttgtaagttttttgcacacttaactttgactatcactcataggctttggatattttaggtggatattttgatcagtaacagactgcaaatgtcttccatgggattgtattatctagtgatatatcagccattttagtttgtatggatatgctccgggatgtttgtggagtggcagaaccttctgaaaatgcatttctcaaaatatttcactatttttaaatgggggataactacttaaactactgaagttataaaagagaaaagtcatttttttaaaaagtttaagttagagaagagtaagaatgtattgaaaataatagaccataaattaataacatatgaacatacagggtgtggggacctggatgttaatatatagaaaagattatatttacacgatggaactatggttttgttcacactaatatttttattatgttgtatcattttaataagtgtttataaaattatttttaagctttattgttttaaattgtgtgtgtgtgcatgtgcgtgcatgtgtgtatgtgtgtgtgtgtgtgtgtgtgtgtgtgtgtgtgattcaggttcattaaggaggtcagaggcattgttggatcctctgaatccgaagttaaagcagttgtgagctgcctgacatcagtgctgggaatggaacttgggttctctggaagaaaagtatgactgagccatctctctggcccatccttgtaaaaattataccagatagtagatacttaagagagataatttaaaaaacacactagttgtagtggcatagacctcttaaaactacctattgggaaatccgaggcagaaggatcatcatttcaaggcctgcttaggctacagaatgagttctaggctaacatgggcaacttaatgaaattcagtctctaaaggtaaataagaagagcttgagaagtagccacatggtagagcatttgcctaacatatatgtagctcagtaatggtagaatatagtagaaggtaatacatttaggtaccaagagataatcttagaatgttttcttctaccagtgtactgcccatgacaatcaatataagagtaagattttatttctcccacttatacaaggactgattaacccagaaaacttgctaatacaatgtagttttatgagatataattttcatgtatattagctgtttaaacttaatagccttgtgtctgctttattgtaatttgacatacagttccatattttctgcccctatccatagttgccagtgtttattttttctatagatttggtcatttttaatatatatatacatacatacacacatacatacatatataattgtggaatatgactaccttgattgtttgcgcatatatacacccaccctaacacacatttcactgtctctctctttcacacacacatacaaattaagaagtggctgcgtctgtctagaatacttagccatgactggagtgtctagacggacttttgtttgttgatggaactttttactgtcagatttttcctcttccctgtctatcagaatagtttaaaatacatttctattttctaggattttggttgatttttccatcacacttttaaaaagtaatcacattaaaggaaacacaattgtttaaatgatgaagtattccaaaaagaatgccttgttttttgtgaaaatgcatttctctgcaatttcagactagcttcaaattatgcaaactaagcagtaatgctaactatgggttttacatctagtctttaaaaaacactgtgttctatacccttcctatcatcatactttggctcaaaccagaggactataccagaaataaaccagaaaagacagatgtattctagaatcaaactgattctattttcagttgtttaaatgatgaaatattcaaaaagaatgccttgtttattgtgaaaatgcatttctctgctttatttggagtctcctggaatagccattaattgtcttcttggtttactctcaccctgctgtatgttctatgaagccctaactaggtgttgaatcagtttgattctagaatacatctgtcttttctgctttatttctggtatagtcctctggtttgaacagaagtgtgtatagtccttggggaggagctgtttgattgcaaatgggtttgggtttttttgatataatgtttagaggcttgtgtgcctgcatatcaatctcaggatctgacttgggtgcacacatgcgcatgcttgtctctttgccgcgttctggattgcagaagctatttgctcagaattcttttatcttcaggatttttgtatttggatatggtttgtgaaaattgtgttcactttcttccagaaatgaaaactctttagctgcaaccctgaagacactgctgttcttcacagctttaatgatcacggttcctatcggcttgtattttacaacgaaagcttatatatttgaaggtaatctttacgtactttaagatatttttattttctaatttattctgagcttttatgagtccttttattgtaaaacttgttttcttcttccttttgtgtaagttaaatatgtggccaatgacagtttgtatgctttggttggctgggtgtggtgctgtatgcctgtaatacttgggaggactgggctacatgagaccctgtcttaagaacaaaacaaaattttggaggatatttattacttacactgtattgctttaaatgttttgcacaaattcacctaaagaatccccacaacaatactctgaattaattagaagcatggtacaaaaagtgaataattgcaatctgcactaccagtggaaatgggcgaagaaaagagaagagttggtaattagtaattccgacttttgtgtcatgagcactgtccttccatatggcctgctttgctctctgccttagggtacaggagttttgttttgttcctgtatactttggaactgggctccacgacttggttgtagttttctgtaatggtgttcatcacaaacagaattcttaggttttgaattttgtagtttggtaagtaataagtgtgtaataaaatgaaatattctcttttcttgataggtgcccttggaatgtctaatagagacagctatttttatgccgcaattgttgctgttgttgctgttcatgtggttctggccctgtttgtctatgtggcctggaatgaaggctcacgacagtggcgtgaaggcaaacaggattaaagtgacatcaccttttgatagcatgaaatttattttt

SEQ ID NO: 829 - DNA, 4172 bp, mus musculus; identical to SEQ ID NO: 828

SEQ ID NO: 830 - DNA, 5836 bp, mus musculus
gaggagtgaaagttggagcccaacaaaaccctccacctcgctccgaacagccagacctgcgctgcgacctctacacaggtggtcgtgccaggcaccgccgagatgttgcctaaagttctcctgatgcttctcaacatgttcctggcccttcagtggaggtgagtctccatcccgggaccggggagccttctgtgcccagcaggcttccgggacccccagggtcccttgtgaccaaccaggccagcctggtcccttgtcccttcgacgcatgctaccctcctgtgggcccccctgtaggacgggcgtccgggggctgaagacagggagcccgggcaagtcaggtgggaccatgttcggtccattggcgtcgtggactccggctggccctcaaagccctggagcggtcggccaggaagcaagagcacctggttccctatagtagactgacgcaggaagaggggaaagggcgcgcagaaaccgctggagctaggcgcttacaactcagggggttgtgctggggactttgggaaggtggcttctgggctgggggtggggggagctgaagtgcctcgaaatgttttagtgtttctaatcgattcactcttgctcacattttttttttcttattcggagcgcctgctagtaccaggcacgatgccaggcaactctgactttacttgcttcccatcccgttgctcgttttccttccagtctcagtcaggaacctgagccttagttatctaagggctcccaccccacctacctccccttccccttctcaccccaaagcaccctgcttggtcttagggacagacctgaatcagaggccaggaatgtttttcttttctgaggtctgtggtttgtggcctggatttctagccccctccctttttttctgatttctcttgagtagccagcctccctccctaaaacccctgagcccgggcctttgtataaagggtgtccctaggacttcttggcatttagggtggaagatggttgttttgtgcctgtgttttaattggaagctgtttcttgtggggtgtgagctgtcacaagtttttaagcttcctgatctgtcgaggtttctagaagtctccatggcattgggcttgtgtcttttcatttgtttgttttgagaaggggcaatgtgtcttctcaacccaggttacatagcttctcagggaggatgtggatacccggtggctttctggtaccctaaggtgaggctggcctcagaagggtcttggtaaatgtttctaaatgtgtactaagaatttcttgctattcatgtccatttagatggtatttttttctgggacaaaagatggccgaggataaaggagggggcgtgaagaagaagggagggctataagagggaaaaacagcccatccggccagagtggggggggggggcatgaaactgacgtgctcacactgtcagcatggcaacctgtgatgtcaggaaaggggaggcggcagtggagtgtgttgggccaaacttcaatttggttcatgctcagcttcaaatcaggtgtatgattttgagcatagccctttcctcatatgggctcatattgtttgtccatcaataaattttaaaggccagcatattgagaaagaaagccagggtcttcctcaagttcttttgcttccctctttagctagatttggaaggtggtagtgcagagcttcagtctcatccagaattatcacatctggaagactgtgggtgtctgaaaagcttccctggaaaatctagccttgaaaaagagcttggtggctttttgatgatgtgtatgtatatccaggagcttcttaaccccaaaggtctcagggtgtggctatttgtttgtttacactagcaaaatcaaatctaagaatcaaagcaacctccactccccccagatccttttccttgtaggcctagtagaggatctctggtcccttggggtgttggcctgggggattagcctctagatgcctaggagatctgaaaaaccttaggaaagaacacatcatctaaatatgacatttgaagatagaaatgcttttcccaatcctagtctttgcttagcccagtatgggaattagccatttcagaaatgagaaatggcaacagcttagcctatctatatggcaattatactattctaaaagctcagaacactgcagaaaaacaaaaacaaaacaacaagaaaaaaccccaacaatttgatgcccaattgccagtcccctggtctgcaccacaggaacctgctcaccttaggctgctgctcttattttagggattaagttgcctggtggctttaaagtaccattttaaaagtgtaatacacaaatatgaaggtatagcaatcataaatgaacaacagctcagtgaattttcataaagtaaacatgatcaggtaaccaggaccgagatgataaggaaataattgccccacccccaagtgtcaccaaacttaaaatcctcctagaggaaaccactctcttgcctttcaacatcaaacgttaattagtgctgaaagttttttccaacgcttttaattgtattttttcaagtatatgtagcaaactgaatatccatatagccaccatcagcctgaatattaataaagtgtgacttgttttctctgccccctacataccattctttcaacttagtttttttaaataaatgtcagacatcatattattttgtatataaatattatagtcgttaagggcttcaccagtaaaaatagttaagaattatttgtttatgctctagttccacggtatctctatgatatggttttctaattttattgtaaaaatcagaacctgactgtgattcatatattatgggtatgtatgattatgttataatgcctttttactgaattagaacccatatacagaaaagtgctcaaataataagcatacaactgatatgtcagaaaatgaccacagtgacacctttcatcaccgctgctcataccctagggctgtcaaggaattccatatatttgcagatggatttctaaagtgtgtattaattattattgttattgttattattattattagtagtagtagtagtagtattgctgttttcattattggtcctggtacccaagatggtctcccattggctagccatttccttgttgaaggaagccacaaagtgctgctctgtagtctgtcttcctctatgtcataaccttgattatattataaaaccatcccagaatttttcagtcctatatacttccaagcattcctcagcagtcctgggctttggcctgacccttcctctcaggtgccgtggctcaggcatatgtgaggctaaggttagtaacagcatctgattggccagagttcacgaaaccatgcacagctacttgctttcacatgaaacagcctttgaaaatttagtcatttgttattgaccatcttaaaataaagaattatgaaagaattgcatataaagtctccaaagagcaataaaatttaaaaggaattatcaaattttatcagttagtgcctcctcgtttactatgaccccccctcactaattaaggcttgtggtgtaaatattttgtttttcttctaccccaaaaggcatcaaccctaacccttaatgattgaaggttagagcttaattttttgcttttatattctagggttggacctcatgttaatctggagaataaaccccctgcccaagataaggtagtctttggccctcagcctcagcctgtgccacagcctctaactccgcctgaatctcctgctggagatactgtagtcttcggccctcagccccagccccaggctgaatcccctggccatgatgatgtagtctttagttcccagccccagccgatgcctcagcctcagccgatgcctgagccccagcctcagccggagccggagcctgagccgcagccgcagccacaaccacagccgttggctgggcgccagcctctgccccagcccctgccttggcccatgcctcagccccagccggagccagagcctgagccagagcctgagcctgagcctgagcctgagcctgagcctgagcctgagcctgagcctgagccccaaccagaacctcagcctcagcctctggctggccgtcagcctcttccccaacctctgccttggcccctgccactgcctttgcccgagccccaacctgagcctcagcctgatccccaacccgaacctcagcctgaaccccaacctgagccccaacccgagccccaacctgagccccagaccccaggccaggtccaggctgggcgccaaccccgacccagacctcagcctgagccccagccccagcctgagcctcagcctgagccacagcctgagccacagccacagcctgagcctgagcccgagccccagccggagcctgagccccagcctgagcctgagcctcagccggagccccagccggagccccagccagaacccaagccggagcctgagccccagcctgagcctgagcctcagcccgagccccagcctgagccccagcctgagccccagccagaacccaagccggagcctgagccccagccagaacccaagccggagcctgagccccagcctgagcctgagcctgagcctgagcctgagcctgagcctcagcccgagcccgagcccaagccggagccccagccggagcctgagcctgagcctgagcctgagccggagccggagccggagcctgagccggagcctgagcctgagccggagccggagtcggagtcggagctggacctggagccggaaccggagccccatccccatccccatccccatccccatccccatccggagcccgagcccgagcccgagccggagcccgagccagagccagagccagagccagagccagagccagagccagagccagagccagagccagagccagagatgaaatcagagccccagtcccagctggagcctcaacctagtggaaagaagcttccagcaaaagaaccagaactcactgttgattgcatgactgaacgcccaggtgggaaactgacaagagcttctcgaatccttaacaccatcctgagcaactatgaccataaactgcgccctggcattggaggtgagttaatggaagaaggcctcgtctgataaagaaaaagcaggttttctatgtagttgtaggcaatgagtatgggttatagatgaaggtaccacatacagataggaactgctgtggattcaccaggtaagacacaatggctcctctaggttaagaatgccatggaccttggtcaacacttttctattctattgctctcagtttttccaattctaaaataagatgaatgatttgaagatatatacctagcccttgtagtccatgagctgggactttctatagaagaacaaaggaaataggattggccctcttccctccttcgatgattccctgtttgatgtcatgcctttatgtgacatttaccctgtactatgtctatgtcttacagagaagcctactgtggtcactgttgaagtcattgtcaacagcctcgggcctatttccaccccagacatggtgagtacagaattttgatgacagtttttttctagattggacaccaagggtgccacttactcttgctttctgctgtttgtgttactaatccagcaggtagggttttgttgtttgggtgttcaggtgggggttttaatcacaattgacttgagaacatgaatggaaaaggtaagtcttttgctgcctgaagaggacctttgggattttgactctaatcttcagtttttcattcaaataaaaacaataaaacaactgtaaata

SEQ ID NO: 831 - DNA, 291 bp, mus musculus
gaggagtgaaagttggagcccaacaaaaccctccacctcgctccgaacagccagacctgcgctgcgacctctacacaggtggtcgtgccaggcaccgccgagatgttgcctaaagttctcctgatgcttctcaacatgttcctggcccttcagtggaggtgagtctccatcccgggaccggggagccttctgtgcccagcaggcttccgggacccccagggtcccttgtgaccaaccaggccagcctggtcccttgtcccttcgacgcatgctaccctcctgtgggccccc

SEQ ID NO: 832 - DNA, 44205 bp, mus musculus
gttctcgggcgggcggagcccagtccgtgcctcttcgttgccccgcgcgcttcccactgcgtaccgcttcccgcgcccgctgacgcggcccggctgggttcagtgctgcccacccgagggagcccgcgcaccacgcctgtccgaccctctgcccgtcacacaagccgggcacctgtaccaggtagggttgttgagtcgccgtcctaaagaagtggctcgaccaccgggaggctacaaggagcacccagttcgtgtcctcctggacacaagccagggcctcagtttccctaccaataattcatactcgctccaagcatccctcttcggaatcccgtcagggaggcagtgccctcggtttctgcttttcaccgcgagtgaagagacaggcaacgttcctcagagtgtccaacaaaagcaggtggctctctggctggtctagtccctctgacctactcatttgtggatgagaccgattgttagtagactgccagcggggatggggcagggtgagcctagaattggtgtgttgcaagcatcacagaattccacatccttagtaaaatgtgcccattttatagatgaggaaactgaggtacagaggcaagcttactcaataatcccctcactggcctggagcccagagcaaagggacttaatggtggtttgtgatagacatgtactggtcactgggcgacctcagggctgggaagggagctgctcatactcagacagaaggcgccgaatcaagtgtcactgtggtgttatcagcgggatctgctgtgcacagtctctgtaactggattgtttgtgtgggagcaggggagagccaatagcctcatcctctttgcaactgcttagtgatagcttggcctctgagaaaggttggaaacgcagatcctcctgtcggccatgccacttccttctgtactgtggcacctggcagctccactgagtaaaaggagaagcctatcaggcccaccttcccctccaaggctgtggagtctataaagtatgttgggagttgtgttctccacaagccattggtactgactcttgacattaaggtaggtggtgacacctgctcttggtcttgtcttgctctcatggttctttggatttctagtcatgggcaggaagcaggtttccacaggctgataaacctgaataatggtgaggggctctgaactggagagctgcagtaggaagcttatgaagttcttattttcccatggcctcaactggctcttctgcacaaacagtgccagtttgggtgggtgccaacagatctccagggtacaggtacaacttactggaggcctttcgagaatgtgctgtccatcgccttcagcccactcactacaagattggaaggaacagaaccatcccatcaattatcagtgctgaccgaggctgtgcactcagtggagcagaactgatagaaggtgcctaggtcaaagctaagtacacagcagatgctcaaaatctgttccttttcctcctctgggcactcatgagtcagtgacaaacatggctcatgaccacagagggtgctgcagctttgaaggtgaaaagtgttagcctggatcatggatgcaacccaagatggaaagattaggaaggctccctggaggagggaacctttgaaagttgagcaggtcaagagggataggagagaaatcagcccttcattttaccaagaagtctctagagataggttactccagaaagagctgccatctggatggtaataggacaaaaccctcccaacttagtggtgagagtagtggtcccaggaacaactagaatgtagcaacgtccttcctcaaagtgctttaggccttctaagacctggtagggcaggaactctggtttcctagcgctcgggacctggttgaggtgggcactggtacctgttccctgaactgtgttcagttgtgtgccaagaaaacacccccaattttggctttgatgcagaatcctgtttgatgaaagccagaagcctgctcttctcctttctcattgaagcctccatatgtgatttatccctttagtttagatgttgcctcaagccataccctatattgtgctgggtcacacataacacacattttctttctgcttgctaaacactgaggcccccttcattgccagccctatagtgacatggaacaggatcattgatgggggtctggggtgtggtgctgggagaaacttctcgtattacactacagactttggacacccatggtgggtacttggcctgggtgcagacaacttgtctggcttctttctcccaaactaggccccacttcacctcttgctcccacggccaatgaggaggcaaataccatcctaggttaaacactgtccttgtatcaaggtgcttgaatacaaggtgggaaatcaaaaccataagaggttgcgtggtatgctcaggcctgtccaagtggatggttacttaggctgggctctgaactcagtgtggcctctgggcctttctcttacccatggtgctggaaagatactatcttcactgaccacacaccctgctacgggcgatctgttggatagttcctcctcctgatctgccgtcagttcccttagcacacggccctggtcctggtatcagctggttctccattggcatagctggtgtcagttcatttttcccaaagagaaactgaggcacagaatggaggccctttaccttctcttgtggatccacgtgaaaacatttggcaggtcttttcagctcactgtccctgctaggatgaccaaagtaaaagggtgtgggcagggaagagggagggggtctgggtagaaaagaagctggaaaacgaaagacccagaggccctgggcatgttgttctccagggcttatgtgcaaacttaaactcagaggtgaggagggtggacatagagcagttttttttaacctacttgttaatgcctacattgtagcccctcttcttgcacagctgcccttgaagttactgctggtggcctggggaggctgtggagctctggagacacacccaagattcagagaagacttggcccctagggtcagtagtgagcaaacccaagctactggtggtggctgttggtggtccctgtctttggttccatctgtgggcacacatcaggcatgaggttcagcccccttgggctgtgatccctgtggtggttggctcagaacaccactttctgatgactaagtcactttcccagagagcttgatgtggcagaaggttgctatggagagaggaggccccaggattccagtcacacgaatggggatccctgttgaaaatgctgacatcaggcattgcctggtttaacctataaagagaaaaaacccacaaaaccctaaaagcagaccttgtttcaccatttctgagcatgcgcacactcagctcctactcattctttcatagtttaggacctggtccaagggcacatccttgggaaatgcagcactctggcaggggcctcggggcctgtctgttttcctctgattcttgtctatctccccagcacccagccctgactgttagctttctatggaagcttgttgcagaaaaggaaatgtgaccttgggcaaatgcatacttctctcctggcttccatatttttatcccaaaatgggggtaattgtagaagcaagggtggagtgaaggggactttgggcttgagatggacagggaaatacaagagagtatagagggattgatggggagaaggctgtaaagagaaacatttttttttggtgctagaaaagctggtgggtagttctttttttcattctcagtagaggatcactttcaagatgggcaaaagcaatttgaccaaaattagaagcaagtggggctgagctcctgggatcatgtgtgctccggaaaaggtcaaacaggtggcagttgtgaggacttgggatacacatgaaggatggaggaaggttggttccaggattcccagcccctttgacctcatgacatgtccatctgtagatggatacagcatctctgagcgagtagggctggcttgagactttagatttcagtttgcagaaataaccgttgtgatgtagagatatgagagaggtgcctaggactgtggaggaaggcataggagttcctccgtgccctttcttgtgggatagctgcagaggtaacaacaatagtaacaatgtaaatagctcatatggggaattggagccaaggtcttgttgggagcaagatgctttccactaccctcagcaggctgccctcatccacatatctcagggcatatctctaagagctcttcccagctgcccttagtggtcctgtaggccaaggtacccctgaagtctctcggcatcttcaatcatttttaaatacatctctctgagaaccagaaaatgaatacatgagagtcaggggattctaggatcttagaaatggaagatagctaagagaaccccttcccccttggtgttgcagctccctaccccattgaaaaggacctggcctgcctcagacatcttcctcccaggattccactagcacagacgccaagaagtctagaatctggggtttggggatgggatggtgggaggtgaaattccagactttcatgcagaagtcatttacctgtaaagcacatttacaaataccactccctcccaccatgcttgctttttttccatattacattttccctctgcaacccaagtctcttccaactctttttttccacgtagtatacctccttcctgctgccttgttggcttgccggcgggagccccagggagtagagcattgcagacaggccacacactcctgccagagaggcccagccctcaattcctgggacctgtacactgagcagcagacttaggagctcagaccagagccagctgctgctcagcctttgctctggcagagccagcgctgtctaaggtctctaaatcacttgcatagatcttagtccctcctggaccagtgatagtagtgtctctgctagctccttacggttggaaagcaatccatctgctgactgctgctgacactccagtgcaggacagtgagaatccgaatgcccagggttacaaaacctggccacagggaacctgtttcacaaatggaacatttcatcattccagtcttttgggcctggaaagagaatcaagttggcagcatgagtggtagtttaggtcagcctgggtccagtttgtgggccaagtgcattccttgagaagggattggactagtagagctaagtatgcggaatatgagtgggggtgttgaggttgtggttcctaaattttagcatttcttggcccctcatcctccgggtcaagtatacctgctcatccttgcacttccttatgaagcctctagagggagactgccacagccgagattttcactactgtgctggccttccatcacatacaaagcagcaagctcttcttgggctccattgatgagcagagaagctgctctaaagcctctgctttccccacaggggggaaaaacagatataagggcttgggtgcattttgataaaagggcttccttaaggccatccttgcatctgttggcataggttggattgggcaagaagggaggagtggaagtactctggccaaggagctacctaatctgactggactctggagctcagaaagtttggattctcagagttttggagctcaaactaagctcttgcaggacagctatagaatcaggggcctgtttcccttgcagattttgattttttttttcaagtttggtcctgcacccatacatggtggtaagggaccaaggtgctgtgtggggaggagggtttgctcagggtgagagcaagtatgaggatgctcttcccacagaccaatggactctctgaggctgcccctgatctcaagcagtgcccatccaagagattagcgttaactgcagccttcatccatctttgatgagtgaagtttctgggagattgaggctgctctcagggcccctgcctggcaaagccagagattgatgatccctgcaaaaggtctgcatgcttggagaggtggagttgggcttcctctcctctcctctgcataaaatatcacagtttatctttgacagtgaagctcttctccctcctacctctacctcttacttgttttgttttgttttgttttgttttgttttgttttgagacagggtttctctgtgtatccctggaactcactctgtagaccaggctggcctcgaactcagaaatccgcctgcctctgcctctcgggtgctgggattaaaggtgtgagccaccactgccaagcttcctcttccactcttacttgtactcagacccgtgcctagcacaccaacatggaaacaaaccccatcacctataccttaggcaccctctcattgtcacaccacactaaaataaaaactgatttttctcagttggtggagtgtttacctaccacgaagctctggatttagtccacagcactgcataaagcaaatgtagtggtgtacatacatattcccagcacttgggcaatgtagacaaatggacaaaaaccatcacacttggctacatagtgagttaaggccagcctgggaaaatgaatagatggatggatagatggatggatggatggatggatggatgccagcctgggaaaatgaatggatggatggatagatggatgccagcttgggagaatgaatgaatgaatgaacgaacgaaaacaaaataatgttaaaggctttgcttctttctcactcccagttaatttctattgacatctagcaccaatttcagtttctaagactgggagcaaatttggggtatcttgatctggctcttccagtgagctgccctagtctgcattctatttcagcagtgatctttttctttattgtttctcaatagagaatctgaaataacccagactggcttgaacttgctgtgtagccaaggatgaccttgtacttctgatcctactgcctccacctcctctgtgctaagaatgcaggagtttaccatcgacctagttgtgtggtggtgagagtggaacccagggccttgtggatgctcaacaagtactgatccaactgcactatatgcctaggccctttcatgtttactgttactggaaagagaattgtatttctgaaatgtagtcagatctgaggggaagctggtgatatggaagcaccagccccagttctttctggcacatatccttgatcctttgcctgtattaggaaacttctagacaacatggctattggatctatcaaggggaaaactcacaagttctgggtttaatacaaggcctagcatgaatgcagctgctataatggggatgaacgtcacctgcttgcccagttcctctgtggaaaccagtggccacagtccctggggtcttggaaaggagtatgtccttgaggtaccttacagaaaataagttaagatagcaaaaataaaaaatggcctagtacaatttgagggaccaatgggcggcgcatttgctttcatgcaagaggagagggactgtccaaggttttcatatttaatagcatgaaaagacctagggctgaaggctcaggctttagtggtctgcatacaaacactgactgaatcatgcactcaggctcatgtagtcactacacatttctgctaggatgcagacaattgagtttatgcaaccataagagcaactgaacactgatgtggcagcttcagtgccataatgaggttccattcctggcatgtagaaggttcagcctgcctggactgctcacttggtagtttatgggagagcaggctcttgctgatgtggctaatttagtttggtcttggcctccttcccttactcttttagtgtatccccgatttccacaaaaacatatccaggtcctgccagttggcaccattactgaactggtcaaagtgtagccctggagggacccaagggggtggcagaccccagggagaaaggtctttctgccttatcactgccagggccttgctttttgtcctgttcacacctctgaacctcccagactctctttatgtccaaaggagccagtttggttattaatatatccaaaatatccaaacccacagtctagtcctttcctcttcctcagctttgggtctctcagcctggcgaacagattataaagaacctggaacctgttgactctgaccagtctcctcagctgatgccgaggccactccttagcctttggtccctgtgaggaaacaggatgaggagccaacctcaaatagggctgcaaatatccactttgtcctgcactggttggagaacactagctgagagcgtttcctccagctttcccccagcaaacagatttaaagtcactatgacttggcttatggccagctgccaatgatatgcctgactttacagcagtccagaaatgtagatcgtttcactttcatcttacaggtgataaaactgaggcaacccagagagattaactgatttgcccaaagcatgacagctagtgtaagaaagatgattgagtcctaaagctgctggttccctgaacccttgccctacctccaaatctgcctgccctcaaaggtggtgtgtctgaaatgtgcttccttcaatcctactgtctggctcagtgccatactactctccatgacactgttggaacttccgtattactacctgctcccttccccagactctttccattagcactctctgtgatccacccttaataactgactagaacagtcagttcttgactacccacatgttttcatattctccaggtgagcagccatggctatacaggtaggtgtagcacccacggtggaatgtgtgcttagtccttgatctctctcatacatttggaattccaccaattcttgtcacccctgatacctgaaaggaaacctgcatgatcttggtgtgctccaggttcatttctcttttatgatgccatatgtgagactgggtgctaggctagagaaaatatatttatttacttctagagactcaaggccatagggggtagcatcgccttgattcaagtaaggatctcatggctggtggcattacagttttgggcaggagaacctgagtttgtgagatggaaagccagggagaaaccagagctgggccagacttgccttttgacaacaaacactgatgagaactaaccagtttctctcaagacattaattccatcatacagaagctctcccaattatctatccaaccttattttgtgtgagggagtggggatgggaatgggtatggatgtgtgggtaaaggggctaagtatggatgcacatgtgtatacatgttcatatgcacacgtcaaagtcagaggtcagtatcaggtatctctatcactgtttgccttattttatgagatagggtcttctagactggctggccaccaagcctcagggatcctcttgtctttgccttcccagtgctagagcataagggtgtgttatgatggccagctctgactgagtaattttcccattcccccaaatttcatttcttaagtgtcccctcttaatactgccatattgggaccaagcttccaacacaagagcttttaggggacaaaccacatccaaactctaatggtgacccacaagccattacaattcatgtattgacagatttgtctttgtctttgttcccaggagctcactgaatccactaattaaagagctgaaagataaacatcatgagtatttcttccttaggaagtattgggaaaggtgagcctgggtgccatgtctgcctgaattatcccaggcaaacccctagagggcttatgcatactgcccatgcagctagtggatgacctcataatgggtgggctggcaagagccctgggtctaggggctgtggttccctgtataaagctcttagccttgcctctgccagggagaactgtaccatctggtgaagaggagcgcaataatatcctaagacagatgaaagtacggactacactaaagggtgaccagagctggatcaccaagcatgatgactctgaggatcataccatgtaagtccaggacagaaagccagaggggaaggctgcaatagtgagggcatgtgacccagcccttcctagggatgctgaggacattccaccatttacagctcggtcaggttgtgtgtccactggccagccaggcgacattaaaacttgaaaagctgtacacagccacaaatatcgcaatcctatgtgctgagaggcatgtgtaaagtgggtcaggaaaggggaaggtgaggtgcaatggcggtacacgtaaggctaactttgtgatagagccacaggagtggtggtggtgaggagcatgggagccactatcttcagggcctgtctttctgcagagagccactctcacgtcacaaccgagccacatccttctcatcagtcagagacgaatcaaatgccaggtaagaggtggtacctagctgactcttaagtggaccccaggaactcttctgcaaagaagtgtagatctcacagaagagatctacatgagaagggcatggaggacctttaatgagtcatttgtaatgttctttgaactttccttttagtgtttctggaacttggccatctccaagaatctgctaagaacaaggtttataggagtgaatggtagagttctgtggtactagtagacctgcccagagcactcatatgctgaatagaacaactcttggctgagtccttgtcatcttgctttctgctttcatacttccattgccacttgggagtgagtgcttcaaggaccagaggaggaaacattctagaggagtaggaagggaaggccatagagatttaccttccatcagaacatcccaggtttgggtcagcctgggctctgaccaaaggactttcagtctgatccaggagagaacagattctgcagtaaatgtccagccataaagcaagcctggcctggtacctgctgtaggttaggctatgctgagcatggctgtggaggagtcagacatcgcagtgttcctggaagagactgaaggagagataggtggagcagagtgggcacctggtcacagtattaggagatcagctgttgtagttggaaataggatggaataagtggtctgaaatccatagtaaggccacgattcccttgatgtctccttttttcttgtcaggtctccaaacgcaagggctccagctggttacataatccggtaagtgacttctagaccctacctgcatcctcatgccactagagccactagagccacacccagacttctcaataccttctggtgtctcttgtaggggagtgttcacccgaacaatagatagctcttctcactcccagcatcgcccctctaagaccaacggagctccaagaaggtacatcctggttagatagtcaataggaaggttgggagagccttgtccagaaccaagtctgagaaagggctagcaaagtaataagagaatgtcctgtctggcttattctcagggacagaggctgggagagggagatcctcacccagggagagggactctggacagagatgtggattgtgcccacacatcttcattttacttaccccttgtccccttggtctcacagcaagcaccttgcacttgctgaaggcactgagccatgcgcttagttcacctttccagtatgacaaggcatcatgttacccaaacaccttgataccagtcaaaactggggcactattggagaagatatggaagagagcccagtgggttcttttctacccagttgggtctgccctattcagaatgcctggcccctatcctgtctctcttgggctgtgttggtaaacctagaggcaagaggggacctgtggttgggcagatggaaatgacttgctcttctagtgcttctgggcagctgggagcagctaattctggtcatcctcttcagtcgtctggctataagatgactacggaagattataagaaactgtgagtatacagtggtgcccgatactggacctactgaaggcaggtagacacttacctctgagcacaacctggggagagctattctagtggcttaacaacccctgccacttatagatgtggcctggagcaaaggatgacaaaactctagaaaaatgaatgctcatgcccaataccctccttttaggaggcaaagactgttggaagcttctggaaggagcatatgcgtctagtcagtggaccatgagccatagctatggggggttcactctctgggtttcctagatgaactcccttccccattcaggtctcaggttcttgggctgggctgggctgggctgagctatgctttgaggcatgaattttcttaggttgccactgtccccgttggctattggtgtgggtattttgtatctaaagctgagcttcccttgaggttccttccaaggaaccctagactggaaggggggttctagacagatgtctggattgtgccagtacttcccagtagtccacatcttcatacagcttattcattgcccccatcatcctgttttatggcacagctggcagtatttctagggaagtagtgaaactgcaattggctgagggtggtagcctgtagcagggaacaggaaggacatggaggaaaaagagtcatacctgcatctctcccccacagagcaccgtacaacatcaggcgcagctccatatcagggactgaggaagaggaggtgccattcaccccagatgagcagaaacggaggtgatggtgtttgttatgggcatacccatgggcagggcaggggccagagtcttcacagattgctgaaaggaatcatacaagccagagtacaaaatgcatgacacataaatcatgaggacaccccatgtctttccaggagtctaggaactatctctcagtgctaggccagctcaggaggcacttctgagaaccttccagggatagaatctaggaaacacaggtccacaaaaaaaggcttatgtgcagattcaaaaggtcccagggaacttgaaaaatatgcagggcaaagtgccctaggaggggcgtctgcagtgttctttgagttcaagaatggatccagaatttcaaatgccctgtgcttacaaagaaggaatccagactaaaggccaacatctgccaacccatatgctttaggaagcatagtgacaaccccttgctaaaggccctgtaagggtgtccattctgtgcaaaaagaccacagttgcacaaggcctgaaatctggatagtgcaagggacaggcaaatgaataagctctgatggtggctcctactgaatgctgttctgtcacctgcttaagtgtgtgaatttagtcaaatcaccagagcagtggccaggctcagtcagtaatggagtatgtcggcacctacttgcctgggttgggagagtcaatgaaccattgtgaagatgtctgcattgctgagcagggcacatgctacatgctccctaaggaagtgtccttccctccatgtccattgtccctctgaatagttcttagagcagtgcttccccatggtgtgctcctgagtcagacagtgaacatcccaagctagactgacagagaggctagactgacacccatcaaatgtccccctttatactaccccaggtcccaggctgcacttggtgttctgaggaagacagccccccgggagcactcttacgtcctctcagcagctaagaagaccactaggtgagttgtccaggaatgagtccctgtgagcttgagcctgccttggccactgctgactccatgttctgggctccttctttttttcttggggcttcagctttcctttgactggtgaaagaatgagttgaatacctccatgagaattctagcttgagctccagggttctcagatgcacttcttagaaagataaacagactaaaattaggtaaggtcctgagagttggaaaggttcaggcaactggaaatgttcaggaccctatagggatgggggctaagatgacacctgcccttgaactttttccaacatgttccccattctgcttcctttctagcagtccgacccaggagctgcagtcgccattccttgcaaaaaggtaagtatcagtcaggaaagccagatagcaagcctgctgtcagtagggatgctgggaaaaagaaggaagctctctctgagcaaagagagtcatgtgatgccaactccggcgtctttttggaggccaggcaaagacctaggtaactggtgacacatgtgtcccttttagccagttctgtgcagttaggagcctggctgagaaaatgcttttgcttaggggccttagcaaatgtcctcactccttccacaagctggtaggcaccaagaaaccaacatagcaagactccttgctcttgccctgccctgtgctcttctatcacccagacctaggaccagaatcaccaagagaaactccatgggagctgactgtgatgttactgattggtcctatggggcaaacagggtgaaagagggaatgagtcctatgtcggtagtctagttgagtgaggtaagggtctcattatttgacacaggtcaacatctctagagatgcaaacaggggaagatgaggtcatactaaattagggtaggccctgaatccaatggtagtgtcccttcgagaccaaggaaattcggacaccgacacaaagaaaagtccacatgaatgaagacagtggcctaaactggaatgaggcaaatacaatttgttccaaccctgccaacacctcaatttcagatttctgacctccacttctggggttttaagccattcagttggtggtaccttgttctagtagccacagctaagaacacactattctctgttactttgtctatggaggagcaaggtgctgccaacccccgtacctttcactgcttattgtattttagtcagctactgtcatgtcacacagcagtatatctacttctgggcctttgcagtggctaggcctggggcttggaccatttggagtgcctgttccttgttgactttacacctacagcttaccctctttgcatctctcaagaacgtatttctaacgaagtcagactcatgggttccagggactattccaatggttttatagtcacctgactcatctggacactggtgaaagcacacccttcaaaggccaaaaagcaccaaggtaactgagaagaccacaggtgccactttttccgcccacagggttgatgtggtagatgaggacgtccttcctgagaaaaaccaggaaccacctgctctggcaagacctgatcctggccgaagcaggtaatcagtcactccccttgggctgtgagagactggccactgcagcagtagcaccccagtgttaagcttgcacccggacttctataacttggccaagttcagcctacctgggagacacacttgtctccaacacttctcacatctgccttctttgccagtgtggatggaggtaggacccaaatatctcaggacattctaattgagtgcatgctaaacatgcctagcccctctggaagccaggaacatgtcaagaatcatctctagtatatgagctggtaatatggcttctcactggcctggctggctggctctggcagccagggaaggtctagcagtggggttacagtgcagggctgttattttcaggctgctaccccaatgacctttctaaaatgtcagattgactgtgtcaaaccccttacctccacttcaagcccatttgcagcttccccttaccaggcacatctgctagaatgcccacctagaagccccttcattgcctgagagtagcctagggttagctctgggtgggagactggaaccaagaaggcttaaggacgaagaaaagatgaggaccaggagggagaggtatgggtctggttatcacactgcagggaggccccagaaggaggacgcccaaagatgctgacacagagtgggaggggaagcctctcctccccccacacattgcccaggctctcctttggcctacagctcgacaaccgagaagattgcccatcggcagattacaccccccacagcagaactccacctggtggccccagacctggaagccctgaggtactgaggccccattgctgtcctgtctctctttagcctttctcaacatgagagagaagcaggagactggtttgtaacaggtgtggcaaacctggcttctccatcactatcttatatacatttaaaataattatataatgaataattatgcaatgtaattttgtgaggtcaaagacctggccttgggatctaatcatgattgggacttcctgggcaagaactattgacttcatctgatgaaggagacagatagatgctaatatgaacgagatcagcctataatgctggccatgccatgtacctccatgccctcagaaagtgacaagactggtcagcagagctgggtggggtcaatgtgtctgtgtaaccctttattaaaaccagagtgttaattatgttgcttataggacaaggcatttggaactgggtggagttcttgggtctgcctccatagttcacaatgccacagtgccctgtgcttggtataagaatggatgaaggggctgcatccatcaaggagcacaaagatccaagctccttttccttggggtgggcacgcaggagacaggccagctctatcttcaaactctgtgtcatctttcttactgtcccccctcccccatgctgccttccacacatctacctaaattgatagcatgaaagaacagtgagtagcctagcaggttatgcagactgggaataacacagaagcatgaatgtttcaaggacagattgggggggggggataaaaggagaccagaaacatgtggccaaggaagcagaaggtttcacaggattgagggaagagagatggtaagtctgggggaagagacccactggtgacccaaaataatgctgaaactgacttctggacttggtaacaaagggctcctgatgacctcaggactgactgaggggttaggacaggaactcagaagaaagccttgtcacttgtggaacttggaacacaccactcaggccttctgagcatcaggtggctcatctggaaaaagggcatgtaacgatactgaagtcgatgtggagaattaatgtgtggaaagttggaagaacagagcctggcccctagtcaacaacggtgacgaataatgaggatttgtgagttggtcagttcatcattagcatattttcagctctttcaaggcagctgtcatttaaggatgaggtaactgcctccatcagagtgtgggtggaggagtaaagtcatttcttacctccgcagctcttcccaaaaagccttgtgcactcagcctaaaggtttctggtagcctgggtccaatgttagcagctgacatacagaccagcactatactactgttgcatatctgaaaaggaagaagtagagctagagagcgtgggtctagggggagcagaactatatttcaccagaggcgcaccgactccagaccaggctatccctctcaaagtccttgggccggcactatgttgtcatttgggagccctagaaccccctccctagagtgaagtgatccctgggaatgagggaaggggagcttggatgaatgggaaaggttttgacttctctctctggcttactagcagcccagaattcctcgtgtcttgctctagtgaccattgaccatcaatgtggctacctccctctgagttttcaccttttgtttccattcttgtttgaaagctgttaaatctgaatagcaatgtttgcctagagtccactggaacttggattggctctgatcacaataatttagagaggcaaagatttctgctcccaagtcatctaaattacacgaggtcacagcctaatgaacgtgctgaaacaggcattggtgcaggaaaaaaaaaaaaaggtgagatgccagtgcttcccaccgccattaccagtaccacatcctttgcccatgcatgttttacttcttgttggattttcttcttctccagacttagccactactgaacccccatcattgactctccaattcctgcagaacaaatccaagtccctaactcatagctataggcccatccctcagcaaggaatggcctcgggtacaatgaatgtgtggggaaggcagaaaaacaaaaaacaataacagactaatgaatgacctaataatagaggaatctctgccttcttacaaagtctgccttccccacatactcatctgcataagtagcctttgtctccagggatgcctctgttttagtttggaaccatgttggaattggtagaactgtcactttttttattattattattgttggtctgaagagagctgaaactgctgaagggccagcccatcctcatgacctcctgaagtccaccccacgtggatccatcccttgaggacacttttctaggtgctttcccagctggttctcccagcagcaggttcattttctcactaatctacctagttgcagcgggtgcctggagacagataaagtaggccccacctcggtaatctctgttttgaagaggtctgggaaaggccattaggccagggactcggttctttgagttgctactaatgtaactttttgctatctttgcaggcatcagaaagatctttcccaaataaaccacaatgtgtttatccccctctttcaacttctcaatggctctctacttccttgaaattaagccgaaacccctgtctctagctcctatagttctgcatggcagtggggactccctatccagccttttctttctcctgtaccacagtgctgcaaactgtttcagagtgctattggctattgtagaagacatctgatctagtctggctctggtggctttcttttggactgttcattggcatcatccttccatttgttttacatgaagctaaaccttaaactcatttgcaaaataacatgaagtatctttctagatttgtaggatttagtgcagtctgttacagttatctcacttatactagtttgaagtttgattttgtatgtatatgtgggtgtacatgtgtatgcatgtctgtgtgtatgttcacatgggtatgctcctgtgtgtgtgtgtgtgtgtgtttatgtgtgtctgtgtgtttgtgtatgcgcatgtgtgtcaagaccagagatcaacttctagtgtcattccttaggcaccatacatcgtgttttgtgagacaggatctcttatcaggacctaggatttaacatgttccaaagcatagagtagttgaagactaatgagtgaggagactggatcagggccgtgttccatataatgaaattttatcaggttttaatccaaagaagaacggctgtggtttatagacttaaagatgaataggtatttgaattttaacaccacactacagtcaccttttacattaaatcatatgctgggaggtggtgtggaaaatggatctgtaagctacaggccttgttatgcacctttttttttcttttaaattttactaacgattagaactgaggaaaataatagctgatgatagctacagtatgttgtttttatgtactttacagttgcctcaataaccctgtgagatgggtaaatggggaaacaaacaggttaagtgatttatccaaaaccatacccgtggtagctgagagctaatgaacagcctcaaggagaaaccttctgagaaacttgagcaagctagttgatgaaatgtgtttgaaggctaatgtctccttccagctggtgtacttaatctggtgttattccccaagccaagaaagatttctgattgtgcaatttgatagaggagaaaacttgggtccacacatgtgatgagcaaataggaataaactctaaatctgccctactgcagagctcaggcccagatagtaacattgctctaatatttacccgtttgaaaaatcaaagcaaacatttctgatgacactgtttaataactggctatgtttggattgttttttttcccatttaaattaaaaaaattatatgtataagtgttttgcctgcacatgtatgtttttgcacaccacccatttgccacgtcagtggtggccagtagagagaggacagtggatcctcggagactagagttagagattgtttctagctgtatgtgggtgcttgtaataaaacttaagatttctaaagagtacacactgctcttaactgctgaaccatctttctagcccttcatctggggaaatattaataacaagagttcttgagatttttgtttaatttcctgaaggtatgtctccagcgtttttcttaagcatttcaatttcctctcttctccagtatacactggagatggcagctctcaatcagaggtttgtcctgcccacccctaccctcttgcgtcatacagtagtaaccgaagattttttgggttgccacaaccgagggtggcttctaaaggctaaaaatcatggatgctgctaaacgacctatagtgacaggtgatattagtgcctcattctcaacacacacagtattattatccagacaaaaacgttaatattaatattgacaagccttgctctagcaacttatgttcacttgggggaacacacacacactgaggagtgtgtcagcatagatctagtcagactgccgcagacaggcaccacgaatacggacgcatgcacccgtgactgcagcagatttctgttgcgcaggcagatttggatcgctcctgcggggggggggcggggagggaaggggggagggggcgcatgcgcatgagtaagctagccagctccagggtaagaatacacctactcgcgcggccatttcctgcagccgctagctcaggctgaggtgcccgctatgaaaggagagtacaaaatggctgctccagagaccagcttctaaggggctcctcctgaggcagtgctagctccagccacgagatggcgctggaggatcacaaatggtccctgttgcgccagtgcactcccgttacccatccccctactagtaatgtcagagggcggttgactacagtagcctacttaggagtgaccaaacccaaggatagtcccctttcctttgataaacagtggttgatgggcttgaggacagacccaggtgacaaagttaatgtaaatgtcagaagccttaggagctttacccagtgttcatttgattgtgcaaagtggactaaatgcagggattcttgagcttgaatttaagcccaaggtaactttatgggacccttggatcactcagctcttacatgaacaataatggaaatagtttccaccatagacagttcaaagagttaaatgggtttacatatgtaaagcatgcaggacactgaggagtgtgtacaaaatattatcaaatgctacatttattctttattttattttattttattttacttttaatttattttttacactccatgttccattccctgctccccccatccaccctccaactgctccatatcccatacctcctccccaccccactctgtctccacgtggatgtctctaccccaccccacctgagctctaaactccctggggcctccagtctcttgagggttaggtgcatcatctctgaatgaacacagacctggaagttctctgctgtatgtgtgttgggggcctcatatcagctggtgtatgttgcctgtttggtggtccagtgtctgagagatcttggaggtccagattaattgagacttgctggtcctcctacaggatcgctcttctcctcagcttctttcagccttccctaattcaacaacaggggacagctgcttctgtccattggttgggtgcaaatatctgcatctgactcagctgcttgttgggtccttcggagggcagtcatgataggtccctttttgtgagtgctccatagcctcagtaatcaaatgctacctttataaaaccttcaagatagataaagttctgccaatttttttttttgttgtttattcagtcatttgatagcacaccgtcttacctttttccttcaaagttttggtatcacatgttaaatctaagacttagattgttttcttctttgttgtgttgcaagtgtggattttttctagtttgtatttgacacacgaaggtgagtgttagacatgtactcagtgctggcaactgtggtcaggcagcagattacattgcgtagaaagtggcattgtcttcttgtgcagtatgtagttaggtcaaaaattggcagtggttgccttaagctaccagagtctgtgaaggcttcagagaattcaacagatatcacatcctatgggcctccttctctctccccactccagtttagcagtagctgaggccgagtggcaagaaattaagatactcccttcaggatgttatagtgcacagaaaggcatcctgtgagggtttgaccaatatctttttcatgacctataaaggttacagctgaaactgcagttgccctgcttcaaggcccagggtttccccatattgccctgcctccgagcggctctttctgaagaaccttgcctctgtttactcagcactacttcctggcagagctggaaccagcagaggagtttagtatcctcttacctgaggctgaaaacttcaattagttttacaacctagtccctgaaaagcatggccatcgcacattctttttgttctgccagcttagagcctcccagggatggtagtcactgataatgggtttttattctgtccttacctcaggagttcccagagcactgcagggaggttctaagatgataaaataaagagacaggagtagtgatgagagatgagtgcaacaccttctactgtctttcctgtggcccccacctttgagaggacattgcagacaaactgaggaagacataccctcctcgatggcctcagatgtagctcgagctgtttatgtcagtgcggtagcttgtttttcttactccaggccactgcctgggttctctgaatgtgctcagaatgttgataccctggtcctggggcggtgttgactgctttctcgggtttgagatgttggaatgggactgtgatcaacataagaagtctgcatgtttcttggtgcatgaggcaagaggcaagtctgtttcccagagcgtacatggtaagctgctaggtttgctgaggactacttttctttatccagtggtggtgtcaaagtatgacagggagcatgagtgacacggactgtggggaagagagaaatggaatgaaaaagacaaggaaggaccacgcttaagaaagcaaaagagagagtgaagacagtttgtgtgtgtgtgtgtgtgtgtgtgtgtgtgtgtgtgtgtctgcacgggaatgatggatactgtgactgtaacgaaaggtaactgtgaagtatgggcagattttcaaacctccgctctcatttgtggttcggagattttaaagggtacataaaatcaatgacataaaattagaaatggaaatatctaggggaacaaagggaattagttggaggtgtgtgtaaaatgagagtcaaggtatatgggggaaatatgttcagtgtacaaaatgcttgttttaaattgtccttatgtaacataacacagtgtaccaggtacaataagagacacaacaaaaacattttaaaataaatttttacaagaacagcctacggatgcaggagaaagttctgtggtgtttgggggagtgaggttgaacttaggtttgaaggctaaggaagatttcccccaaacgacatgctaatgaaggcattgcagattgaggaaaccagagacccgtcaaagagaggtatatggtgagtgtcttagggttttactgctgtgaacaggcaccatgaccaaggcaactcttataaggacagcatttaattggggctggcttacaggttcagaagttcagcccattatcatcaaggtgggagcatggcagcatccaggcaggcacagtgcaagaggaactgagaattctacatcttcatttgaaggttgatagtggaagactgacttccaggcagctaggatgagggtcttaaagcgcacacccacagtgacacacctactccaacaaggccacagctcctactagtgccactccctgggctgagcatatacaaaccatcacagtgagtgtaaatttagagtgactataggaaagaaaagctaattggtgcccttgccaggaagccctgaaaggaaactaagcagtcacttactcatgagctggtgactgcaaactatattctgaagagctgaaggaccagcgatgcttttcaattaggagaggagttcaagaggagttgcaggactgtcaggccagggaggtgcacagcagcacgaggcaggtggcttgtaccgaacctgcggctcagactgagagtgacctgataaggctgcaagggttgctgactttaactaaagacaatagtgatggaaaagtagtacccagggatgcttccatatttctgtttggggtgacaggctggatgttgaaaggaactagctgaggatgaggaagttagaggagatgctgtgcagatgtgacaatattaaggtcattgggccatgttgactctgaagcgcctgtaggagacctaggtgacaagaagcccactaggttagagttgagttaagatctgaccactgactagagacctgagggttgtcagtttatagatgacaagtgagaggagggtataagagcagtctggaagccagtgcatagatacatccctgagggactggtgcatgaagaaggaacataactctttctctaaaccaggaacatgcttggcataagccatgagcttgtgcaagacctcctgaccccaactctccaattttctttatcttctcaattgttggtggtttaacttaggacactttcaaaactgcttgctttctgggaattggggggctgcttgcctcttgagatgggtctcccagtgcccttgggaagtaacattcagattccagaggtcagcaagggtcaagcctctgctcttctctgtatatgatatacaatattcattctttctcagcactccagattcttgtgaggagaacaatgcagcccccaagatcatcaaggaaatacctggcaccctacaagatggacaaagtgacccaactgtggcttctcagcaacttgcagatctcagcatcctagagccacagggtagccccagtggagccgagcagcaaatcaaagccgaggactgtactaacatgtaagagcccacactaccttcttactgccccgtcgcagctgtcaggggccacgatctaggaaaaacacttacggcacttacagcacaagcctatttctcttcgcagctatgagaggctaaaaagcagaaggatttgagtgcaggtggtctcttggagtcatttgaatgagagcaccatgttatccaccaaccagttgaagtgggaaaactgatgtgggttggagttacggatatggggtgttttacaaccctattcatggggttgtaaggtctgagaaaagtagagcctgctatgaatgaggttattatagtattgccatcactaaagctgccagttggatgagttctttcactgttactactaccaggatggccagagaaggcaccagtgagtcaataattgacctctgtggtgctgacctaggcgtgtgtggcaactgaaataggctaacagcaggagtttgaggaaacaagggtcatacgttttctgtgagagtccaaaagaccagggggtaaagcagtaggaaatagtgtttccccttccactcttctgagagcaactcaggcctcccaccgtgtgagccttctgactcctagcctcagaagtgcagggcctgttcacaccaaggatgcttatataatattttctcaaattatagtatgattgttctccgttctattctgtcaatttttatttataaataaaatccattagaggctaggattaaatcagcaatcctccgtactctgtaactttcattttttacggcttactctaatgatggtttttaaatactttagcctctcttttagcccaccatccaccagaggtagtgggaaagaaaggatattgaaaataatagatttatttttaaaagttctttaaaacaactcttgtctatattgtctaaaaatcaacaatttaattcataggttaataatgatagttcagtccattcacaaacactttatagatagaccaacagtttaatttgatagagttgaaataagaaacacaaatgaacagagacagcgaggcctcagcctctgctcaagtcaagagatacccaaagagatgccaggaaaacttctcaactatgtctctatcaacaaaacgaaaatgaaccaagacacaagaccaacaaatgttatccaactagttgtataaacaagccaagtttacttactctgtcactgtctgttaagttgtttttatatgccctctaaacatcacgtgtcctgcaccagtcttgcacatgtgtctgtctcagttgacatcattttgtcaagcaacccaatacacaaaagtgacaaaaaactaacacaccaccaaaagcttcttactatgtttctctctcccaacaaatagagctccagtacacaatgtaagacagaccaatacgtgcatatggttaccaaagcagcctttctcttatgtctgcttcagctaaacattcccttacgagtctgtcttagtctttatttatttatttatttatttattacgtattttcctcaattacatttccaatgctatcccaaaagtcccccataccctctgtcttagtctttaacctgtgtctattaaaaaaaaaatactccttcccttgtttgccccaactaaacaccttccaacataactgactttttaaagaagccttaagttttcactccagtactcctttctttcttgggcttcctggcttcttctgccactgtcttgttctcacctctgcctttccatatctcagttccaagagtcttagcaggaatgaggatacagttggagcccagagagcgtactgttcaccagcagactccgcacactgtttttctgtttgtaataagccaagaaaaattatcttgtaatatgacatagagggacgcaggcaaagtgttattgacgaggaagatctgcagcagctggaaagaaagaccacacaaaaacaaggaaccaggaagggcccataagatggaccctgaggttgacaggaatggagtaaggggaaccggggaacagaaagtgggcttttgtagctcagggagaggagatcattgggaagaacttgggatgtttccttcccgctgggtatgaagaactctggaggcctcttgctacctacattgcaggtctgggggtcttctttttcttttttaattttatctcttcagtgctgctgttctctctctctctctctctctctctctctgtctgtctgtctgtgtgtgtgtatctgtgtgtctgtgatgtgtatgagacatgcttacccatgtatgtgtatgagtatgtggagaccagaggatagggtcaggtatttttatcagtctccaccttaataatgttttgggtgggtatatgtgcgctatgtgtacatttatgcgtgtataggtgcatggtgggtattggtgcgtgtatgtaggtcaaaattggcatcaggtatctgataattttatttttattgagaccaggtctcttgttgaacctggagcttgctaatttctgctactaagctagccagcttgccccggggatcctttcacggggcctacctctgcagtgctggggttataagtggctgctgcattgcctagatttttatgtatattctggggatccaaactccagtctttgtacttgtgagctacctagggaggggggtcagcatcctggatcagggccatgtgtcgcagccagggtgactgcctcctcaataatctactctccgcccatggcctgcagttctccagactttgatattgggtgaggaagttagtcctacaaaaagattgttttgtctgatttcttaactagcaaactagactgtttttccctgctcctccaccctggctgccacagtcccagtaacctgacgggcaagttaccaacaccaataccctagcctgcagtccagaattcagagtaaaaattggaaaatggcagtctcacgcatgagtcattcaagagcaatgataagggatttgcaccgactgttcccaaaacactggcatgcttttaaaggtcttgaagttgcaaactttggggttagggcagaaagttctatttgaatcaagaagtagagacatgcttactcttttttcgtttctttcaggctgatgagcccttcaagctgcatggtcactgttaccatctctgacacctctgaacaatctcaattgtgtgttcctggtgtctcaagcaaggtggactccagctcaactatgtaagaagggccatttagcaagtcttggtgtcctttagcatggggtttccttataatctccttgcaagtaaaggataccactttccttctctgctgttttctcttttatgtcttttccagctcctagcatcccagtagcaaatgcacagatagaatatagtccttagtccctcaagtataaattttacattctccaagcctattggcaggactgtaacatgctttccttctcagctcaacaagacgtggaacatacaaagctagcagatacaaccaatgggaggttttgccctctgtatgaaagccatggaggccaggctgatctctccacccctctttcactgctttccctgtactgttgaatacccttagcctacaagaagggatgcaattcaaggactccgctgagtgagcagtatgtgtaagatctctgctgattaggccagggggctgggacatggaaatgagggtcaagggtggggctacactgagccagcctgaagcaaaccttgtttctaacgcttgcagaggctttccaaaacatagattaaggttaatgtaggcccctggaacccgattgataatggagttggaagtgtagcaggtgaccgcttcagggaaggcatgagtgtccatgtacaatggcatcagcagcctgccatctgtctgcagcttcccctgcagcctggcttgtggagcccacttgcccctctaccctacgccttcattgagcttctgcatttccttcacgccgggctaggggcactgactctcctctgtgggccaggcccagtcctctagaatcttctagtacacattgctattttgctgtgctccttctacagcaaagggattctcttcgtgaaggagtacatgaataccagtgaagtgtcttctgggaagccagtgtcttcacactgtgacaggtaagaacaggtttcagctgatctgttgtcatagcctgtactaggcccagtactgccttcgttcctacatcctgctacctcaagcaggacttagtggacagtacctactgggtaatcttccagtaagtgacagcatactgcaatgctgcctactaatgcatgatttatggattttcagattgtctttctagttaggtggatagaaaatctagcccccatgttctttcatgctagatggacccactgaacccctgtttgctttctgatgctatgcaagaagttacttccgagacttttcagtactattccacccactcacactctagtttgtgtcaagttgatataaaactagccagcacaatggaccagggggtgacacacagacatattgctgttaagccaactggggtctcttgctgcaactggactgtactttaaccaataatagcctctcccagcctctcttcagggtctccagtcctgtcacatgctaccaagcccccaaagccctccagacttaccagtccatgccatgaaatctagtgccacctggctgactaccaagttcagctgccaggacagggtggagccttgggcacctctggagcagagtttctgagtgctaatgctgagggcatacttcacaaagggtttcacctccgtgatgctggtgatccccactaaattatcagttccagccaaccagcattgattatcccagtataggaaacgtttcatttgagtgctgcttgctccttgttattcacagccaatcagtctgtcccagctcatcaataccacagattcttaaaatataccaggcctccatagagtctttaagtgatcctgtgactgctctctggcacctcacaagccaggcctccatcctctgcattgttctcagctttctgaaactgaaggcaggagctgatgcagcagcccaggcggcactggagctgatgcagaggctgtgggggggatgctgctctctggcttgctctttatggcttgttcagcctgctttcttaaagaagctaagacaaccagcccaggagtggccccattcaaaatcggctaggccttcccatgtcaatcactagttaagaaacttccctacagccttttctataggctgatcttatggagacatttcccccaagtgctctcatctctcaaatgattcttgcttatatcaagttgtcataaaagtaggcagtatatctagattctgatttcttcagtgtataggctcctaaaagttcccatagtagtccatacacaaatatatgtagtaagactctactttttttctgctggtcaaaggaactgagggtcccactggtacataagtctcaagaatcttaccagagtgtcttcttcattctccatgaaagaactcctcaccaagaaaaatgtgcctccttagcacaagcttttgtaccaaaagtgatttctgatcacaatggtgatgactgtcagtgtagtcatatctctaattgtgtgtggccacaaggctaatgagaaaagtgtcttctatgtatgactatgataatgatgtggcccatgttgtgccctcttctccattacacttcttgcagtcccagcagcattgaagactcattggatctggcaaagaaagccccacatgaaggtactccttctgagaggtatgtctgctttcttgaacagaggtcttccagttatgtaggtgagagagtcctaaggcagacctccacatgggtctttctctgctgctttgaggcttttgatctgtttgcaattctgtcatatagtggaacactgcataaggtgttactaccccaatcgggatgtcacatatacggcaactgaagcctgcaaaccaagatgaaaaatagggcctgaaagagagcctaaggaggctcttgtcagtaagatagactcttcagagtcgaatctaatgattcatttgactaacttgcacttctgaatagatgttgaaagaaacaactacacaagagattggtatgtagagaaaaatgtttttgtttgtttgtttgttttattatcaagaagacggaactaagaatgcacaatgtcctagagccatggaactgatcgctagatgtcagcaataaaaggatggttttaaggacaaaaaaaggttatttttaaattcttggaataggaaagaaaagaatctgcatcagagagtgaatctacccaggttacagtgaggaaaaaaggggagaaggaataagttacaggaaattagttactggcagagccagaaatgaatcctggggcttgagtactaacaggttatagagatctcgcccctgccatatgtcttctcacttattatgagatctaacttactgtgctttacactcagaagccacaggtagactggggagaaagttaagatgaagcaaatcttaacagtgtgctccatttaccccaacacaaacgagtacaggagcttctatataggcaaggtgacagatgtcccttccattatgccagattactgaattctggacagtcacagatcacttggtaagtcatgttatcagataatttcatagtctgtatatgctactttaccaaaatgcccaaggctgggtatggtggcacatgcctttattcctgggactcaggaggcaaaggcaggtggatctctgtaaatttgaggccagcttggactacatagcaagtttcaggccacctagggctacacagtgagaccttgtctcaaaaacaaaacatacaaagaaggaagcacctacaatgacttatttacctcttgctaggccctgcgtcttaaaagtcttaccacatgtcatattgccatagtaaggacaaagcctctaacacatgactctctggaggatacactcaagctttgtaaaaaaccatggactgctcaggtgcctgagaattctacaattatataggagcaaatgacatatatcatattccagtagcatgacagatcaaataccatggttctctgtctctccattgttccaatattagaatctacattactgattcgtcactgggcttggttacaggactgggattctctccaaggacaagcccagtcacttgtgcacaagtgtacacaaagaacataggagaaacagggatgcactgagaagaggattctcagacaattcttacatccagagagtcagctataagccagcagcaggatggcaaggtgtcttagggtttccatagctctgaagagacactatgaacatggcaactcttataaagggaaacatttaattggggatagcttatgattcagaaggttagcccattatcatcatggcaggaatcacagcatcatgcaggcagacatggtactggagaggtagctgagagttacatctggatccacaggcagcaggaaaagagtgagatactgggcatggcttaagtatctgagacctcaaagcccaccccgagtgacatagttcctccaacaaagcctcctaatagtgtcacgcccttatgggcctttgaggaggcattttcattcaaaccaccacaaagggataaaacatcagtgcccatggcagtgctaggtcctggttactagtgacaccatggcttctgttgaatcacgtctacatctctggaagatagaactcctaatttaagcctgtaggatcagagaatagaatctgcttcggcagttcttgttgggggaagaaaagaaaagggaggaaaagcagagatgattctcaaaagtaaaaggaatcttggaacggaggatacaactgatcaagaagtatcttctaggactttagcatgagttctgagtaggctatacaatccaactaatcatgggtggccttgatagtaactagaagaaagggtgagctccatggtcccaggcatgtagaagaggctgtcaagactggtttaggagaatagtgacaagttgaaaaaccactttggcataggttatgctcccagttatagaacacagaacacattggaaatctgggaatactggcaaacctagaaagatctgctgcatcatatcagaagtgtgggaaccagcctgactgcttggtccttgtttccatctcctagaccaaccgaaggggtctgtacttactgtagccatgagatccaagattgtccgaagattacccttgaacatcttggcatctgctgccatgagtattgttttaaggtaagaaagaggtgtgagtattctgatgatgacgtcaaagagtgtgaaagtgtagaagaaactggatttctgttcacagctgcaaacaatctcagaggctcatcagcactgcgagttgcagaggagtggtgacagttccacatggctaataacaaaatggaggcaaaaaggggtggggatggggtctaacgggaatgaataggatggcaagaatgagaggatactggattaaattttcctagggcacatgtgaacatgtgaacagatgtcattgtaccccatatacagcaccaaaaacagataaaagaaattatttcgctcaagtcaagttgggtgaaacaatgagtttaattggggttaattacaggatatgtaacttatgacatagctataccaccaaagaaaagtagtaccctccccttagcaaccatgagctgcttatatattcttagagttgggtgtggtgaggcctcctgcatttagtaatatgcctcatggaagctacaatcttctttgtgagtactacaatcgaacattattgtgcctaatcttataaagatctcacacagttaatcacaaatgccatgatttttaagatgtgacatccatgtcttaccaggacaacagagttccacagcaatttatccatccctctgaatcctacctttttgtctactccatcttttttgatgtttcctggctcttggaaggttgtggtacaaatgcatgattattttctcccacgtagacctaagcactgtgctaccatgcctcagcaacagttctatgagtcggcagtgtaactcgttagaagtctacagtaactacctctcactgcaaaagaagcttccagatgaaaattaacagcagcacaatctgtagccatgaacaaatgtctatttaataaatcagtaacagtatgttccatagtagggcctatgcactccccagccactgcctttgatagggcatgtatgggatatgaattcccttccatgaagctggccttaaatccaattgtaatgttcttggttgcaccagtgcacatacctgcagtattcattgtatagcgtgcaggatccttatccaagtaaatctgttggtgacaattctccatcagcagcattttcttagccagtagccacttcagtcttctgtatccccagctgttagtagtattgctaggggtcaccctcatagactcccaggagcctcctccatcccaggtctctggctcatccctgagatgagcctccctgatttccattcttttttgcagccctcctctgccccacctctccccacctgctgcctcatttacctccctacccctcctcccatccagttctctccctctgattcacttccagtgtctgttttatttccccttctgagtgagattcacgcattctcccttggaccctccttgttatttggcatctctgggtctgtgaattgtagaatggttatcctgtgctttatggctaatgtccacttatatgtggatgtagatctatttttttaaacaagtgtaagttgtagcaaactaagataccaatgtataggtttttcattataagccttttattataactttaaagctaaattttgttacagatattttaaccatacctaatgaacttacaaatcctgagattttttgcagaaacgtcttacgaggtttttgtttgagattagaaagcaaagaacttagagagatagaagaattttaagagtagaaaataaagtcaaccttagagatgagaaacctttgagagtatagagcagaacaagtttagccagaagattttggggtcatttgtacagtggcaaaactcgttggaaaatataatgtgccaatctttggccattgattgatctgtactgaggccagactgtttcttgaaagacagcgaggttttaataaaatctctgagtccaagataaaagagaggatgggccaaacaagcccaggaggtcgtaaggagagagagagacctctgggggagaggaggcaaggaaagggtaagtgtagtggtgaaagaatttcaatccagggtgtccccaagcagaatgagagaactgtcagagagaaatgtatcaaatcacaaaggagaggcatccttttctacaagacaggagcccagtgggacaagaggagcatcttagcacaccagagtgatttttgtagtaatagtagacaaagcaggcaactttggggtgacatttatccagtagaaaaagacagaaggtagtggagaaaactgctgaagaggtgaactgggagaggctttgggggaaaaaaggagcatctttagtaaggaggtgcccacatgggcttaacaggtcagagagagagagagagaggtacccaggtgataggcatcccaggaggatttaggaggctccaggagccagagagaccaagagatgcatgatgagtgcacaggaggtatagcaaactacaggagccagagagacacttaccaagtagacaaggagagacaaatggttagagcaggtggagggaaggtgtgtctgaagtggagtctggaatttggagtacaatatggtagatggcagaatccagcagaaacaaatgatctatacatatcttaggaaagtcaaatcagcaggctagttcagagcggccaggtcccttgggaaggaattagtatatgctactcccatggtttcagcaccagatgaatgtaaaatgaggacatgacttctcctagggatagttgctgagaagggtttattgcagatatgagggagagaaccgccagaggcacctgaaagggtctagactgaactaaaccatgacaggggaaggacaggggaggctcaagagagggagaaaaggacagggtggggggaactaagagaggagctgtagaccaagaggccaagacaggaagctggagccaagagaatcaagacagcatggacccagccaggtgtggtggcacacgcctttaatcccagcacttgggaggcagaggcaggcggatttctgagtttgaggccagcctggtctacagagtgagttccaggacagccagggctacacagagaaaccctgtctcgaacccccccacaaaaaaaaagacaggaagggcaggtcctggagaggttttacacaggggatggagctaagaatttctaagaagaaccagaactctctaacatgtactaggagagcctggctgccatgtttgctttaatttgttataggtatctcagcaatgtattctggatttctttgatacctaacacttagcagtctaaggtggtcccttaagctttatggaattcaactcaaaccaaactgagatttttggctttaatatggaatttgaaaggaattttagaactggcttgtataataaagatattttagtaatcatgagtgttaaaagaaaaatatgacaagtaatcgtgggtctagcattccaagtgaaagtgacttttacacatgggaatttgtaatatcttaatataggccactgtcctcccctttgatatggaatctcattgttaggagataaaaatgaagtggcaagtcagaggaagagatgaacatagacacttatctcagaaagcatgtgtaactttgatataacctctaattttttattaatttaaattcattttagtgtcactgttgacattataagtttttatatataagttttacatcttattgtcatgaatgaacaattttatcattttgttacggatcattttacactttaattttaatgcccatttctgattattttacatataacctatggcttttaattaagtgcttaaaataaaccagtttaagatgataaatttctttagttgagaggaaatcttacctatagttagggttttgttttggttttggttttacttttgtaagttgaatagctacattaataaacataaaaccagctgggattgaagaactcatttgtttttctcacaacaaagaattctataaatcaagatactttaaaaacattggtggagaagttaagtacacacttagcatttcattgattggttaacttgctagattccagaagggtttttgtttgttacgatgtgaggtctttttcttttagtgagaggatgagaagaagcaagaacttgctgtttagtaggtcaaaggtaacccaagatgattgattaggcttttgaacttcactattccagcctctccacggcattaatgttctaagcagccaatcagatgtttttctaggagatctcattcacaaatcaatctagagagagtggtctcttgtcaagcatttgacagtgaagatgttaagatggtgactggattgctcacagctggcaagttgtgatgattcaaaagatatcccaggattttatgcctaagcctcatggtaaagaaatgtgatattatttgctaccatgggaaagactgaaaaggaacaagttaggacataaatgacactaaatgcatttaatgagggctggtttacaggttcagagattcagtccgtcatgacagagagcatggcagacacagtgctggaggagccaagagttccacagctttatccaaaggtagccaggagaaagacaccctcctcattgggcagagcttgaccaaagaagcctcaaagcccacctccacagtgatggaattcctccaacagggccacacttcctccaaggccacacctcctagtagtgtcactcactccctgggccaagcatattcaaaccaccacagtatgtgtgttgcgtagggaaaatatggaacttgtagcaccagtggaaatgcacctgcacctggctggtatctgcaggtgctgaggccctgacagatagtctggggaagtgcctgatttctaacattcttttttattataaaaggtcagggaaaaggaaggggtgatggtgaagcaggaatggaggtgctgtgctctttagactgcttcctgctgtctgaaggcattgacatctttgaggacccaagaaagttgatatgctggccaagtccagaaataacagactgtttccctcaatatccaggctctctgcaggactgtctgggactaggaaagtgtaggcttaattgaagcagtctgaggctggactacctggggctagctgctttggaactgtcttggatgtcttggaacacctaaagctgggaggatgttggagtatatatatacatatatatatatatacatacatggcagaagataaagctaaggagtgtagggagaatttttttgttaggtgtacatttgaaacttccaggcctaaggtcctggtagttgagggagggaagccccatgaccagggaaatggggtgtgatctcaccctcaggaataagtgaaataggcagatgcagaaacaggctgttgattgacagtatttatctggagtctatttgatgcaagagaggtagatttaagctgattacccaaaacttacaagattttttttaaggttacaaaagagataagtcttatatatattagcattaatgttgcttgtaatctatcctgaaatccatgctggagaaaaagcagtagattcacatctttgtgtcatagtagaagcctggggatatcattttgggttcaaagcatgaacactttttaaggcaagttcagggaggacagaaacctcccgtggagcagaagggcaaaagctcgcttgatcttgattttcagtacaagtccagatcatgaaatcagggcctttttcctctgtccagaaactgggggtatagagattagacagacatttttagcacagtaccaagtatagacttagaagacaactaaaggaaatttaaaatattgagcttgttactatgatatcattttgaagtgctttaccaaaactagattaatagcttaccagaacttcattgattaatgtatttcaaaagccgctgagcttttgaagtcttaatataacaatagcatagagggaaagaaatctgaaaccgttttcatttttataccttaatcactttcttatcacaattgaagctttcacatcctcagacctttttaacttgcatatatacacaacttcttagaccaaaaactattttcttagatccttacaacctaaccttttgtatccttagaccttagatgaactttacatttttttttctatctatctatctaatcattcaccgtaagacacaggtgaatgattactgagagaagttattgtaaagcaggttcctttaaataaaggaatagtgaaagttactttgatatctgttttgtgagtttatctcttttccgagtctggtaatgaggtaaattgtgtctagtcctagttgaagctccaggaaagtgaggcctgaggcctgattgttgcacctgaagagaactgagaaggcagctggggacttcttggttgctgccgttacactgacaaaggtgtcactagcctactcatcaatcccatcagacatatgagaaggatacattttacttgagcaagcaggaactacaggccaagcagcttttgaatctattaaaaatggcagacttactggctaacctggacagtcatcaacgtaggttcctccatggttactaggtgcagagtcccaggacagagttagtcttcaaccaccaggaccagaaaatcggacaaactttgctgtggagtaggaccttgggggtgggggaaccagcctggcttgtctaggcaaagcagtgcagtcaactccccagtgtcctgcgtgcccacagtttaaacagggttggcactaaatttcatcctcggctctacccagctcctttttgctgccccaagaaaagtgatgattacattggttagggccagtcatatacattgtccattttctgcatgcccagaagagaccctctcaatgtgtcagcaccattctaagtccatgttctagtctggtgtacagtaactaaaaggatagaaacattctgtaggaaatagaagcataattgatttacattgagggatactctgccaggagaagtaagttgggaagtagaagtatgcagattgccatcagaagggtgcatggagaggatgagcaatgagcttggggttgtcgaaaggctattctctccttcccgtgcacctttggctgcctgtagctagaagcctcaggctggagacattgagagttctggcaaacctggcacttcatagtctctttttactcaacgcccagggttaggaagtcctgccactgccattcctggggacacaggtttatgggagggattgggttaacaaaacctcccttcttctgtggggatctctatcacgttcttctggaccttaaacattcacagcttccagcctctcctaatcgtataggtgaggaaaacggagactgggaaagttttagtaattcagcttataaataaataaaagtcaagattttaacctgggctgatcatgaaactgcagcccctagccaggatgctaatcatcctgccagtgtgtgtgtgtgtgtgtgtgtgtgtgtgtgtgtgtgtgccatatagcaacactggatgtcttcctcggttgcttgctgtgttatttaagaacaggaatattagtccgagccctagaaatcccatgcctgccatcctagccctgagattacagttttgtgcctctacacccagcttttatatgagctctggagatcaaatctgcagcaagcgccatctccccagccactaccagcttacttttggtgctttattgtgtgtttatcttgctttataaatcacgtttaatatctgtgtttgcaatgtcttatctccttggaagtccaggatgtgccatcaactcacagctttgagtgctcacctccattttgcttttttagtgcgggatttgcaataaaccgatgggtgatctcctagatcagatcttcattcaccgtgacaccatccactgtgggaaatgctatgagaagctcttctaggtgagttccggaagctcataggagaagcatcccagagccgaattaaactaaaggagcaagacaaaaatttgctttggtttggacatgggttttacttcaggaccctgctatgcttctcagccatctaattagagaatctcaagtccttgtcctttgccctatgcttctttgagatcttaagtaatgtaggaacccctccccaccctcacctccacccccacgaccctttccaagttgttaaaagtcatagtatcttcctttacagaaatacctcacccatgtagaaccgcagctgaatctgttaaccctggcacacctgggcctattttgtgacaaggaaataaatatgtagaaagggagtgtttctaaacaaacatgtaggtggtatatggaaaaatctctacctcatttcagctctcaaattctagtaccagtctctgccatcttcaagcattatttgcatagctttaggtttaggcttaataaccaagatgttgactaaaagctctctctgggccagtagccagtgggattatcccaagtgtcggaacacaacatattttccctctctggttacctgaaggttgacttatctccaggaaatgctttttgtgctgggcttgggctcacaatcactgcaacagttacccatcccaaaggaccctggctgtaagggattagatacttcaatctcaccagtacctctatttccttttttggttcctccaggctgaacagaagctgatgatccccagctgtatttggctgtccagttgacccaaattgttggctcctcgtcacttacatcctccatggttccactgtacttctgcctaccttgtgcggaaggagcatacatctaagattgtgtagccatgatgttatgattttgtgtagccttttataccttaggaatatctcagttccttgcttccaggatgaatgagtccactttgacctccctgagacatgttttctaatgagtgcagatgacctagtatgttagacatgggtacaagtctaggtatcagcgtatgcagactttctgaggcttctgagagcccaagccaaaaaactgttgacgatccctggtagggaaattacaggcattaaatactaagggttggcaataggctactgtttagcttgtctattcactttgtgtgtatgtgtgtgtgtgtttaaatttctcacattttaaaaatagttaattttttgattgaattacatagcagatttaaattacctccttccattctcctttggtttttccagtaaggtatgtcagcacatgttggaaagtttacccaggtttaaatttgataagatacaatattaggaggcttctaccaaagggatatctgtgtctgtttgaattttgttagttagttaaaatctttaccctcagtattgctgaacttttatcctctgaacagcttttaatgtgtgtaaatcagggtaaagaaaacagatacggtttcttgagacttctgttcctactgtgaaatatttccctgaagcgtagtgttagaaatggctttgaaaagtgtgaaattcaccccatctctgggcttcttgggtccctccttgaaacactacggtaatttaattgctccctttccctctcctccagagtctttcacccagagacgaatttggcttatgtaacttctcaaagaaaagcttgctatccagtgaaacgtcaagtaggctctctgccctgatcgtgcagcattttgtgacctgttttctagtcctgaatctgtctcaaactaacatcaacttctaggttcccaggtactcaaaacactaccagttgatgtctggcacagcagaggcaggttcgtccctgcagtttgctaatatgctgctctaagtcaacctcactctgctgcctttgggctcagcattaaattggaagctccttgaaaggaaaaaaatagtcctcaagacttgggaatgcaaaattgaggcttctttgttggattgacttagaagatagctcttcactctctgcagactttgaatgggcttgttcttcctaccaggtaaccagagaagaacattctatttatttgactatttatctgttacctgaactctgaagggaagaaggagtacattgtgccacaccccaatactaattatgaactagttctttctcaagttcagctctaggatgggacttagcagagagtggccaataacatatgtgtgccaaatgaattagtaagagaaaactaagtcagtcccttaattatctaggcatttcagtgcaggcctcatagacaagagtaaaaggctctaaatcggatggcttccccacttaaaggtgtactctgccatttaaggagttttagaaatataaaatatactcaaagacagcttgtaaggctagtattgatttgaatccaaaacagcccttttgtgtcttagacacaaaattctgcagctaacaaagagagatggttttgcattgatttgcttctttttaattgctttccgtttttaattatccttgcttaatccacattaatgtacacaaattataataaatgttaagatgttacacagcagtattataacttcttttttaaacc

SEQ ID NO: 833 - DNA, 44205 bp, mus musculus; identical to SEQ ID NO: 832

SEQ ID NO: 834 - DNA, 44205 bp, mus musculus; identical to SEQ ID NO: 832

SEQ ID NO: 835 - DNA, 44205 bp, mus musculus; identical to SEQ ID NO: 832

SEQ ID NO: 836 - DNA, 113 bp, mus musculus
agtgcacttgttgctcttccagaggatccgaattcaattcctagcatccacatggcagctcaacaaacatctgtaactgcaattccagggaatccagtacccacttctggttt

SEQ ID NO: 837 - DNA, 4280 bp, mus musculus; identical to SEQ ID NO: 62

SEQ ID NO: 838 - DNA, 841 bp, mus musculus; identical to SEQ ID NO: 64

SEQ ID NO: 839 - DNA, 180 bp, mus musculus; identical to SEQ ID NO: 68

SEQ ID NO: 840 - DNA, 135 bp, mus musculus; identical to SEQ ID NO: 69

SEQ ID NO: 841 - DNA, 925 bp, mus musculus; identical to SEQ ID NO: 71

SEQ ID NO: 842 - DNA, 5286 bp, mus musculus; identical to SEQ ID NO: 75

SEQ ID NO: 843 - DNA, 7399 bp, mus musculus; identical to SEQ ID NO: 76

SEQ ID NO: 844 - DNA, 7399 bp, mus musculus; identical to SEQ ID NO: 77

SEQ ID NO: 845 - DNA, 8732 bp, mus musculus
gccgctccccgcgcccgcccttgctaccaggcaccttccgccccccgcattgctgatgctgctgctggcagacatggacgtggtgaatcaggtacgcgctccagcaccgtggacagagcccggcgcttgcagaaatctgggtggctttggccctcgaaccctgagaggtggtggcgaggggagcagagatacggtcgctggagctggggctggggctggggctggggctaggggtctgcagcaggcaaggggaaagggggaggtggagaaaaggagtgcgctctttgccgcagcgaaggctgtcctcactgccgcagagggggcctccagatgccccaaaagaactgtcgacctggagggggaaaagagagattcgggtctaggaagagggcaaaggggtagagaaggggaggggataatgaaaaatgactcggggggctgcagatgagctaggaaatagagcgacagaaggtgtgggggcggggtgggggagggttggcacccgcccctcccaaaaagaatgcaccccggtagatgacgaccctttcacccccggagcagatctagaggaggacgatccaattttgcctctccaaaaaaccccagactcctcgttctcagcgcatgtccagtaaacccatgcccccagctctttcccaccttaagagatcacctccgccatctccctcttcttcgtcacctcaaaatcggctttctccctaaccggtagcgacccctccccatccccatctcctcagacacaaccatcgtcatctgactcacctttaccactgcagacctctcccctctgctgttgtgactcaccttcagcacttggtgccccctcccccactctaatgaaccccatcttcttccactcaaccttttctccaatctgactcacctttaagcagttcagaccttccttcgctaactagtctggacccccatctattttctacacccaacctcctctgccatgtgactcatcacctcacacttcaccactcctgagccctgggggtggggggctgctgagaccctgatgtttactccgtccccaaagtgtcgtttttctcctcctcactccctctccatatgtcacccactcccggagggtcacatgtcctatccccagggatcattgcttggcagcctggcccctcacttccatccctatttcccacaccccttcccctccccactgtttttctcctcagctggtggctgggggtcagttccgggtggtcaaggagccccttggcttcgtgaaggtgctgcagtgggtgagtgtggtccgggctataggtgggggaagtacagggggagatggtggtggtgatgggctccagcaaaacagaggggtgaggcaggaggcgtcctactgaactggtgggtggaacgacaggggtggaaggagatgagggaattgggctccagagtaaggtcccagggatttaaggacagggaacagaaggctatgacgtcacataaggccgtgggtacccctgttgtgaagtgacagagtgtgacgttctacctcctctcttgaactaaaggaggaaaggatgggaggtggagcctgaagccctgactgctgaaagagagatgcaaaaccagaaaaatccagagacagccaaggagacagagtatgagaggcaggggacggtggtaatggcagtgctgagtaaaagaaatgagagccagggagctgctctcagagcaggaaaatgtgtaggggaaagaaaggcacacacagatataaggaatctcaaaagagaaaacagaaggcaacagacagaaggcacaagggagccagagaaccagagagaccttgtgaaagacttaacagacagacaagcagggcaagaaacaggcgcgggagggagagggagagagagagagaggggagagagagagagagagagagagagagagagagagaggagagaggagagagagagagagaggagagaggagagagagagagagagagagagagagagaggagagaggagagagagagagagaggagagagagagaggggggggagagaggagagagattaatggggaaagtgtgtatgagagaggtggagagcatgcataaaaacacacagatactgagagacagagatatagtgatcatgagagaaaggggaggggagaggagagaaaacgaatagaggaaagaggaggaaaggcgaggcggaggggagggaaggagaagccagagcacctagaggtaaaaaaacggagagacacagggaaagagaaacagccacacccctgtaatcagcttgtgctaggacccgatgagccctgattagaggggtgggggtggggacctctccatctgctactgtctgtgctgccccccctcaatctgtccagaggagggcactccctcccacatgcatacaggctcactacagccatccacctccctgctacccaaggtctttgccatcttcgcctttgctacgtgcggcagctacaccggagagcttcggctgagcgtggagtgtgccaacaagacggagagtgccctcaacatcgaagtcgaatttgagtacccattcaggtgtgcccctgccctggtatcctgagacctgggagaggcaggggcagggtgggtcagagcagttcttcccagagtcctttgcacagctcacacctttgaggccaccgcccctgggattacttcccgtgcaccgaacactttgctgtgtagctggcacagctctggcttctatgacaattggtgtgcaagctagacacagggtgtcatcctgtctgactatattctggcaaagggtagtaatagaggacaggaaataagtaagattcataagtaaatgacagggctggggttggagtctgtggtagagagattgcacagcaatgggttcggggggtgggggatcatggatgagagagcatcaccttaaagcagtaaatgctcaattaatattagtcactcggcacaatggcaagttcttgtaatcccagcacttgggagactatgccagaattgtagtgagttccaggccacccttggatacaaagtgagatcctatctcaaactaaagagggtgctctgcagataaaggcacttgccactgagcctgacaacctgagtttgatccctatgtcacatgtggtacaaagaacagacttccctgcaaatttttctctgacctccacacatgagctgtgacatacatgcacctacatacacacaggtatgcacccattaaatacataaaatgcaatctttaaaaaaaacgctttaaaataatattaattaacatcatttacttctcaaacagaccaagttccctctcctcatagctctacatcagaacaaagaggataactgcagatacagataaatactagaagcatatcttcatgcaggagttttgctagaaaacaatgagggtactatatagatgtgggaaatcaagggaccaaattagatgtccctgaaagttccccaccatgtaccaggcactatgctaagtactaggtatacatgagtaaggacaaactgcaagagtcactatctcctaaggatgaggagacagacccatggtttcacttagctttccttgactaccagactaaatcatataacagttagggtcttaacgtcctcatttgtaaacagagaaaatactgatgccctccaggtgacggaacattgccactaaggtgacacttgtaaagcacttggtgccaagtctgggacacgagaagtgctcggcataagcttgttaagtataagaattcagatttagggaagagttggaatctgggacttggggaacaccaaggattaaacggaggcccagaatgtcgcacactagggagaggaaagccagctcaagctatgagcagtgatagaaacaggaaataatagaggagaacagccaggagtatccaggttcacacaagccaggaagaaaagagtttggaaactgagggtatagctcagtggcaaagcacctgtctagcatgccctgggttgtacccccagtactttggaggaggacaaacacacacacacacacacacacacacacacacacacacagtggggagtgaagggtaatcagcagcatgagagccagccttttgagaattcacaaggtcacaaaagccttccatgaactccccctagaaccttccatgctcagaaccattgctatgcaaggacatcaacctgaggccagagctaggggccccagaccagttccattctgcccacacatgagcccccccatcacagcacagggaaggaaggccattgtctttgagtaccatcccagactgtccctcacacatcctgatccctcctatcccttctgtcctttcctatttcacagctgtttggcttctctgccacgcatgcatctgtcttctctctcaggcacctaaagcatgacatagaaaacagccaacatgatttaggagggcacaggatgcatacagaagttctgtcctttctctactagctgcatgacttcatacaagcaaatgcacttctctgaacctcttcctatctctgaacatttcacccccaaagccactgcgcgagaagccggcatgattccagatccttgggatctgtcagtaaaagaaaaaaaaaataggaataaggcctacctcctcataggtacagaaaaaaaaaagcaaaaagcaagatgaaaagacaaatcctagggctgaggagatagctctgtcagtaaagtgtttgcctcacaggtgtgaggacttgaacttggagcacagagcccacttaaacaaagcccaacgtggtggcccatgctagactccatgccagccagctcagcaagctctaagccagagagagaccctgtttcaaaagaggggggatggaacctgaggaacaagacacgaggttaaactctggctgtcacaaagcggtgcaacctcgtacaccccaacatatgtgcacctgcacacacgtgcacattcactcacacatggataagaaatctttcctttaaagtgaaatgcagaaagtctttgatgagaagctgatagttaagcaaagtctgaaggggctgaaagaataaggcatgaaagctatcttaaggaagagcacccgtccctacacttgatcttagccaaaaggctgaaaaacaatgagggaagaatattcctgttaaagaggtcagccagtgcaaaggccctaagctagagagatacctgtcactttctacagtgaactcagaggcaggagtacctgggctgcagtgagggaggggtgccacagatattaccaggatgctttcggcaatcaatggtacattgcaagtgctctgtgaatggccatttcctccttttcctgggacctcaaaacagtctgggatgctcttggccaggaaggtgagaaagggattccggaccacacctgaacacctctctctgcaggctgcaccaagtgtactttgatgcaccctcctgcgttaaagggggcactaccaagatcttcctagttggtgactactcctcctcggctgaattctttgtcaccgtggctgtgtttgccttcctctactccatgggggccctggccacctacatcttcctgcagaacaagtaccgagagaacaacaaagggccaatgatggtgagtccccacagctgattgcatgcagtgaccaaggacatgaggccgcaggggcccagctcatttggctcacaggccaaacagactcccagacaagccccatacccaagcagcccaacgctgatgctgctgctgctgttgctgctgctctctccaagactccatccacactgggcatcatagaatcatgggggacatacccagagcccacacagaatgccagactggcccacgtacctaaccgtaccaccatctctcacacgaccacacagactagatgaaaagaaggagtaccgaggttcactgtgacagtcatgcatgtcaccctgccacacagacaccgagtcctacacagagaggttctcacaccctcatcccagacatcaaatgacacatattcccacatgcaaataaaagtggtaagacacacttctcacagattcagaaacatcccacggagttagttcctccctcaacgtctgcacccacgcatcactagcacactccctctgtatcatagacactcacagacactcaagctgagaccttcaggtgaaaatctaataagcctcagagctgcaaaggcagaaaagaggcgagcctcttctaaatgaccccttccacaaaggcttggggtctgtaggggctcaaggctcagcagaaagccgtgcgttcactataacatcttcctcatgcctccctgcctaggacttcctggccacagcagtgttcgctttcatgtggctagttagctcatccgcctgggccaaaggcctgtccgatgtgaagatggccactgacccagagaacattatcaaggagatgcctatgtgccgccagacaggaaacacatgcaaggaactgagggaccctgtgacttcaggactcaacacctcggtggtaagccctgggaagctggccgggctggaagagaaaagctgggagacacagtctggcatgggaaacgggggagagagagagaatgggaggagagtcaggaggttggtccatgagggctccctggaagaggcacaccaacaaaagaaggttgaacaattataaccactgggataccacatatctgttcccagtaggagaacatgaggtctttcagattaggcggggataactgggcccagcccagtcatgccaaagctgctgaaattcagtatccttttagaattgatttccttacatgcaaaagaacaagatcttgaaatgttttcttacttgggcgccccctagcggctaaaaacagtctgaccatagatcctgtcacgtggcaagctctgtgacctacagctagtaacaagcctttcaggtatcattttgaacatgcaaactgaaggctgatgataggtcctgctccaaacatgagtatccactgaattcacagcacgtacacacacacacacacacacacacacacaaacccaacacaaaactacatcctatatcaatgttacagatgctaagatttgaagtcttttttttttcctgctacttgctgattgtgtaatcttgggtaatttagcctgtctgaactcggcttttaaatggacataacaagggctggagaggtggctgaacagctaagtagtacacacttgtagttccagcactggggaggcagaagcaatccgatctgagttcgaggccagcctgggctacaaagctatttccgggacagccagggctacaaaaagaaaccctgtctggggtgggagctaggaagggacagcacctcctgaccatgcagaggacccatgttcaatttgtaacatccataattctactcccaagggatttatgggcatgcagtgatatacatgcatgcatgtgggcaaaatgcttacagtcataaagcaaaaccttaagatcattttaaacacaaaataaaatggaggtattagcccaagtgtggtggtacaggcctatagttctagcacgtgggagcctgaggcaggaagactgctaagagattgaggccactctggctatatagtgtgagttgtaggacatctgaggctacagaggccttgtctcaaaaatagaaaaataaactaaatatgctaaaaaaataaatagaacggggatatcaactggaggtagtggtataggtctatagtctctgctactcagcaagtacaggcggaagatcaatcacataagcccaggagttctgggccagcctgggcaacatttcaagattgtgtcaaaacaaacagaataaaatgtaggtcttactttctgtccaaacatggattgattgattgatttttattttttactttttttattattattattttttgtttttctgacacagaatttctctgtgtagcccaggctgttctggaacttgctctgtagatcaccactaaccagcttaaacctggaactttaaggaaacttaaggtgctcagaagagggtgtaacatgtactaaatggcatatagaattttgcttttaagtatttcatataagctccatatttatttgtaatttttaattgtttttaaaaaataacatatacttagctgggcacatggtagcacatgcctttaattccagcacttgggaggcagagactggtggatctctgagagtttgaggccagcctggtgtacaaaaagagttccaggtcaaccagggctgcagagtgagaccctgtctaaaaaaataaaagaaaagaaagaaaagaaaagcatatacttagagccaaggatgttaatatatgcctgtaaacctagcacttaaaagactacttttaaaaatacttattatttttattttatgtgtatgaatgttttgcttatatgagtcacttgcattcttggtgcctgtggaggtaaaggaagggtgtcagatatcctgaaactagaattacaggtgtttgtgagccaccatgtaggtgctggtcattaaacttagattctaacctctgtgccattactctatgcccagggctaatttaaagccagattggcctaggtagtaaactccaggtcatccttggataaaaggcaagaccgtctcaaaaacaaacaaaacaaataaaaatctattt

SEQ ID NO: 846 - DNA, 7439 bp, mus musculus
tttgctctggtgctttctgaagatggcggcggctaaggacggatgcggcctagaaactgctgctggaaacgggcggcggctccacttagggattcctgaagcagtgtttgtggtaagaaactctttctcagcgtcttaatctgatattggagattgctttccagtcacttcccaggtctgggtcgttgggaggaacagagctaaagggtcccggaagggaatgtctggccttttgcctcttcctgcatcttggctttttaggcctggcgggcgatagctttgaagaaaggtagtccaaccccggcccagaagagggagcagggaggagaactgggtagctggagacggatgcgaggcggattggggcgtggcgtcccttgaaactgaccagttgctgcctgttgtcgcctaaagaaaaacaaaaaacagcagcaacggttattgagctcaagaccgcagtgatgccggagatgtagatgggtggacatttagcacagagagcaggcagagcagctgtttgtagggtgtgggtactgagtggcacccagtcagcttgagcacggccgtggtccgtttccttgggaatggaagcagactgctgagaaaagtaaacgttagcacaaacgttaagtccatgtgttcttgcttttaagaattgaggcttatgtaatgggcaaccggctgttattaggtttttgaaaccattttatatttgcttttagtaatactatttaagcagtttgtagacaacaaattttatgcagttgtgaagattgtgggaaatgcaattggaaggtttcatgtaacaggaccgacccaagttaaatatttgtactgaagcatataaaatcttagtcaaaatttccttgattcttttttggtatgtaccaaaaattatatatattctgtcttattgctaacattcttcaaaagaccctttttttcttttacttaaatcacattttatattgtatattttaatgtgctggtggaataaatttttatgtgtattctcaatgttctgtgcttttaaaaatatttttcaagtgatctttacatgaagtaatattttctgaggttcagaaattttcttagaaaatttgcaaaactttatgagggagttactgttgttcaaattttgtagatgtagttgatgaaacccagaaatagaggtatccagaagtagcatttgagcagtcaggagagctttagaacctctttggtcatgctctgctacttagaggtgaggaaattttgtgttatttctcctgatcctattataatgcctgatatataaggatgtaaatatataaatttccattctgtcttaaatataacccgatagcagtaacttcagaaatggaattaatgaatacaaactttatctgagggatttaccgtaaaataaacttttatttatttattttatttatttatttttttgagacagcccaggttggcttagaactcactgtttggattaggatggcctcaaattcatagtgcctgtcctgcttctgctttccaagtttgtaggttaaagacagacactgtgacaactggctgtaaaattttatggttaaattttataccaacacgatgtaataagcagtccaaactttatataattatcttgatgttccaaaactaatggaagtggcatgatattttaacaacataaaattctatgtctgagagtatttgaatcctacccaacttccatcttgctgcttagtcttgagtttctatgggtgacaatatttatggacttattttgaaaaataaaatatgtattcaattgaattaaatcagtaagaaaaatgataactttggcacacaatttgctcaattctttagtgactagggcacatgagtaggcagtgtgcttcattgctagcaattttcatatttattactagagccacatgagaaatgtataaagcaggcaagttcatgtgtcttacattaaaaacagaaaaataaagaataaattacctacataatgtatgtaaactgtccgaaatggtctttcttgaactttttttttctttttttgagacaaagtatgttgtccaggctgacaactttggatcctttcgcttctacttcctaagttctgggataacagacctgtagcatcatgtctaacttctctttaacttttcttctgccagtgctggggataacctagggccacctgtcttgtaggcaagtggtataccactgagctccagggcagccatctttaactctttatagttaggtttttaattaaaaacaagctttcagaaaagaaaaattagttctctccagtggagtctcactaggtatattagccatactaacgggtggattccatgcagggcagtaaatagacggccaccacaaaattaattcaatcgtattgttgtagactttttgtgtagtattgtttgagtatttttctccctcctggccttttgcctggatgctttcatttcagattttgtgtttttatggattttttttgtttttaaaattatggctttttgtttgtttgcctattttctaaagaaagagaaattggggagttggagaggtgggaggatcttggaggagttgggagaggggaagttgatcagattattttatgaaattttttcttcaaaaaaaattaaatgaaacaaacctttgaggaaaacaaaacttgttcttttacattttataaacaaagtagtaaaaatcaggtttgtaatatgaatttaaaacttcgtatgatttttcatattaaaggaagatgtagattctttcatgaagcagcctgggaatgagactgcagatacagtgttaaagaagctggatgaacaataccagaagtataagtttatggaactcaaccttgctcagaaaaaaaggaggtaatcaaaatttctacatttaaaaatctttactataattattaatgaatataagttgtatacactaatgaattttactctgatatatttatacatgcaaatattgtgcttagatcatattcattttccctgatgccaaccatcctttccttttactttagtctggtatattttatttaacatgataacctaaagttctgctaatggtgttgtaagtgacatattttcattcttactaaattattgcataatgttctatttctacatatatgcatagaccttgcatatatacctgtttatccaatcatctgatgttcttgattattgtgaataatgccacaatattagtatgcacagaacttcattactttattttctttggatatgcactcaggaataataaagctgaatcaaatagtgtttccatttttagtttttcaattatgtgtgtgtgtgtgctcatatgtatgcaggttcatgcatgccatgccacaagcatatgctcaaatgtgctatagtgcgcacatgtggaggtcagagaacaactttctagaatcattttccttctgctaccttgtggaggcagggtctctcttgctattatttttgccactttgtgtactcacactagctgacctgtgagcctctgggcagttctcctgtctctcgggcagttctcattttgccatgctgagattacagatgctagccattgaatcctgtttttttgttttgttttgttttgttttgttttgttttgtgagattcagaggttgaactaaggttgctcatcagtaaggattttgatccatttctctggcctcatttttatgtttctgaggagcattcatactgttttttttataaaaggtattataagttatattatgtaaggtaacattgcatttatattatataacagtatataaagtacccttttcctgtatatccttgccaatactgctaattagttatttttgagatagggtctcatgtagtgtagtctggtcttgaatttgctatgtagcaaaggatgaccttgaggtcctgacccttctgcctctacctcccaaatgttggagttacaggtgtgtaccgtactggttcattgaacctagggcctcatgtgtacaaggcaagtgttctacttttgagttatactgctagtccttttttttttttattttgaaataggttcttaaattgtccaggtagttcttgaactttcaatctttctgtctctgcctcccaagtatttgggatgatactgttttgactctagtgagatggaatctttgtagttttaatttgcattttttgaggcctaaaggtgttgaacattttctttatacatttattagccatttggtacgtcaaatcattatctacttagttattggattattttttcttttggttaagttttttttaattctttacatattctagatatcaatgcactattaggtaaatagttggcaatattttctatccgctctaaacttgttagtctactgattggttcatttgctgtgcagagctttttaatttggtataatttcattttacaattctgtattttgagctactggaatcctattgaaaaaattgtagcctatgtcaatatcttgaaatatttccctcatgtttcctgtagtagttttgaatgtcaggtgttgacttcaaggtttttgatgtattttgaattttgatttgttccttttttgtacagtgtgatgggggatatggttttagttttttaatatgtggatattcagttttcttagcaccatttattgaagagactctcctttctccatcagatgttcttggcatctttgttgagatggttttagctatatgtgtttatttctaggtcctttgttttatatcagtggtctctgtctgtctgttcttttttgtcattatgatttttttattcttattcatccagcattgctttttgttcaaggttaccttggtcatttggagtttcatatgaattttaggattgtgatttctagttctgtgaagaatgtcattggaattttgctgggcttaggattgagttcagagaatacttttggtaatatgaccatttttacaatattaattttgcccatccatgaacatagaatgaacatccttctacctttctagtatctttatttcctttgtttagtattttataaatttcaatgtagaagtattttaccttattgatcaggtttctgttgtttgtctctgttttattcatttgtggctattatgaatgggattgtttttatttctttcttagtgaattcattattgctgcatagaaaatctattaatttttgcttaaattgcttaccaattcatccatctactaatcaaacccaattcaatttatcactgagatcggatgagattctctttgttttcagggtcagatggctgaagacttagcagttgtaagcatcttttgatggagactttggggttctcttggtatagaatcatatggctaatttgatttcttccttttctatttgatttccatctattcttttgctagctaaaatgtgaagtactgtattgaggaagagtggcaagagtagatagagatctttgcctttctttttatagcccatgactgtctttattatctttgcatgaactggggggtcaatatttatgtctcagcttcacagcttggccctttctctgcctctgaagatcatatatatgtccatatcctttcctaccttgtatctgaatatgtgctgagtatgcatacctaaaacagccccatgtagtactacatagatgcttgatgttttcagacttgagatttaatatatttggatacatcttgttttaataattagctaaatgaaagtttataatcaaatgcagagcctgtgaatcacttctgcagaatgtgacctgttctagaaatgttaataacagggagttggacatatgaagtaaggctttttataccatgtattttatatatgcttagtattacatcttttttaaaaaaaaaagatttatttattatatataagtacactgtagctgacttcagacacaccagaagaggctaccagacctctacagatggttgtgagctatcatgtggttgctgggatttgaactcaggacctctggaagagcagtcagtgctcttaactgctgctccctacattttattttttaattttaaaatattttatgtgtgactggagagatggctctgcagttaaaagcaccaactgcttttctagaggacccaggttcaattcccagcatccacgtagcagttcacaataatctgtaactccaagatccaacagcctcaaacagacttacatggagacaaaacttcagtgtatattaaaaaaaataaaataaatatctaatgtatatgaatgttttgcctacttgtatgtctgtgcaccgtgtgcatgtctggtgcttgtagagatcagaattgatatcagatctacaactgggctatggatggttgtaagccaccacgaaggtgcaaggaattgaatctgggtcctctgaaagaacaacaaatgctctaaacttctttagtcccttaaatattttaattaaatgtttgtatccttatagtattttctgtatggtttattaagtatactttgttttgcaatgtttatcaaatcttttcttatatcaaaaatattattttaaataaaatttataaaatataacctatatttataaatagtttttaagggcatattagttgaaaattgcaatgctagtaagatgattgtgattttttttattttatttatttatttgtctttttgagacagggtttctctgtatagctctggctgtcctggaattcactttgtagaccaggctggcctcgaactcagaaatccgcctgcctctgcctcccgaattatttatttatttaatttttgttttttgagacagggtttctctgtatagccctggctgtcctggaactcactctgtagaccaggctggcctcgaattcagagatccgcctgcatctgccccccaagtgctggaattaaaaggcgtgcgccaccactgctcagcgtaatgtttatttttgctggtaaaatactttgttaacctttttttccctcctcacaggctgaaaggtcagattcctgaaattaaacagactttggaaattctgaaatacatgcagaagaaaaaagtaagtgtacctttgtttgcaggtataagcaaatcagcattgttttggcagaggcctgatttccttgactctttggttataggcatttcatttgttttgtagggttcaccctatctttttgagcatatgtagtaatgttaaaagtagtatactttcaccaaaaaagatggctttgtggtcttcccctaaaatgacgcctaattctaaggtcttcacttagattattttgtaaatttttaattagaaatgattttaggtattcttaaaatgttttattctgaggtagtaacatttaagagtgtatttatttatttgtttttattttt

SEQ ID NO: 847 - DNA, 213 bp, mus musculus
agggcggaggaggctggcaagaggggagggagcgctggctttagaagcacagctgcagagattcctaggggcagaagttgtctgagtgcttggtcggaagctgtagagccagatcagcgactctgcgacttttacgtaagtgctttgcagttccaagggctcgaggggagccggtttcctgggcgtgggtaagagtgggtcctggtgagagca

SEQ ID NO: 848 - DNA, 34796 bp, mus musculus; identical to SEQ ID NO: 5

SEQ ID NO: 849 - DNA, 113912 bp, mus musculus
ctctttgctcctggctccggctctagcgggtgcgcgcaggcgcggcttgcagctctgctagcgcgtagtagctgagcggggctcacggtgagtgaggcagcggtgcgggactccttggagagaacgtggttggcagccagaaagggactcgggtgtgtatggaagactttgacccggttaggggagactcgtgcagctttttcagtggcggggcttctcgaggttgccagcctccggctgcgtgtggagaggagtgagccgtggcgggagacttaaaggtgtgtaggagctgccgagttagaagaaagaagaaaggcgtttagaagctggaagtcctcacttgagcttggccaggccaggaaggttcgcttgagagccctggaaggtggcccagcttcaagttcagtccccctacttggtgcccccgagcggtgtcctagcttactcttttccttcctctgctttccctgggtgccgagttggcaggaaggtttcctgtcggtggggagaggatttgggggaggtgggttgttggcccggactgttgcaatagagggtgtggcgttcctatgactttcctttccccgggaatgtgtccctcttctgatacattgtgcctggacattttttaacaaaggctataactgttttgtaggctgtggtgggtgacagcggcggggggggggggggggcgagggtacgcgcgtgcgcgcacgtgtgtgtgtgtgtgtgtgtgtgtgtgtgtgtgtgtgtgtgtgtgtgtaggctcgcgcgcgcgtgtgtctgcaagcgagcgagcgcgcgcgtgttggctggcttgcttcagaagtctgtgttgccgccctagggggtggggaatcagtgtgggcctgaagttgggggaatttccagaaagacctagcaactttctgcagaggcttttttctttttactggtctgttgattttgagagtaagaatattccccataggaatgtgcctggttactattttgtgtgttcttgctctgtgtgtgtgtgtgtgtgtgtgtgtgtgtgtgtgtgtgtgtgtgagagagagagagagagagagagagagagagagagagagagagagagagagagaaattgagagattgatttttatacgtttttacaaatcccaacagaagaaaaaccaaaaataatggtatttcagaagaaataagtgagtgtgaatgaaagggagaagacttggaatagctaagtagagctagataaatcccttttgatagtcacagaatatgatcagacttgggaaaatgtggcagtgtacaagtcagtaaatttagctagagtattgttcattgtttcaatgaagaattcttaaggatatggtgctgccagatacttaggctaactcactttagaaactttaaaaatgataaaacattagggaaagtattgtgacattggataaaggcccataggctttcatgttaaaaatttatgaacttttatgaaaaatgatacatgtggtaccaagcacagatgtttatattttaactcattttttaactgagtacatcataataaactgagcttcctcctcctccaccccttttccttgattgtgaatcctgttttataaacataaacacccatggaaggagttacagagacaaagtttcgagctcagacaaaaggatgggccatctagagactgccatatccagggatccatcccataatcagcctccaaacgctgacaccattgcatacccaagattgcataccctatcaagattgtgctgataggaccctgatatagctgtctctggtgaggctatgccgggggcctagcaaacacagaagtggatgctcacagtcagctattggatggatcacagggcccccaatggaggagctagagaaaatacccaaggagctaaagggatctgcaaacctgtaggtggaacaacaatatgaactaaccagtaccccggagctcttgattctagctgcatatgtatcaaaagatggcctagtcggccatcactggaaagagaggcccatcggtcttgcaaactttatatgccccagtacaggtgaacaccagtgccagaaagtgggagtggggggtgggggtggagggcatgggggacttttgggatagcattggaaatgtaaatgaggaaaatacctaattaaaaaataaagaaacatggaaatactaagaagctaaaaaaaaaaaagaaaaaataaacatatactctcagatctgaaatatgtttaagcagaatttcttcgtgttttctttttatttaatcttttctccaattattcaaaggatttggtgataatattatccaacttgggagaggggtgttaggatggatgccttttgccttttccaagagctcagccttatgaacttattgaaaaatattttcaactccctcggaattaatcatcctttaactgtttaacttatagcactagccttattttctctcttgttaccccaatacttgggttgccttgcatatggtaagtgcccaatataattatagttacatgttattacatgtcattagaaagataagatcctacacagagttcatgaagtatagaagaaattctgatcttttaatgttgaaggaccatttcttgaaaatacctaatgcacactgtagtagtgagaacatagatacattgtcatgtgttattgatagttaatgtttataaatgaggtgcacaactttgtagataaaagaggaaatgggtatcgtaaaaacacacactttagaagacaccaaagctagagaatagtcattgcacacactgaaatatgtaatttgttatttgcagaaagacaggaatgaagtgctgcttgactttaggaaattctaaaaatgaacacagctcacctggtactgtttactaaaggttaacacaaataaagaaaactgcaacctacctcatgctgtactcctacgtcttaagatggtttgaaccttttggctaatgaatcctattgtagccttaatcatcttgttctgatgatttctgctatcttatctttgacaaatctctgaattccaacacattattggctatccaggtacctctgcttatatcagggaattaacttgtctggtccactcagtctcaacagtcctgtcaccaactttcatcttctgaatgatttacccattgcaaagattatcctaagcaaggccaagctttataaaataatgagtatattcttctgtttaaaaatgagtcaggatttggtaacttgactgatacagagtctatgcctacaaagcagaaaactgtgctagccattagtaacccctgattttcttcccttacttaacttctcccctgcccagctaaatgtaatattgtttttcccatgtgatttttcaaataatcatcctgccaaaaacaacacttcatgttagtgtttaatacttatgaataaaatctgagatgcagaaaggctgagtactccatgaatatttttatttaaacttttaacatattttctgattcatatacatggtttttgaaaaaaatgaagctttgattattttatacctttctcccttaatgtttttctcatccagactttgtccttgtgtgtatttttttttcctttgtcactgtagataaacagcagaatgtttgtctggggttgtcatatcatgtaaggttggaaaggacacaactaagagaagatacttatatttaaacaaccaaagtgatttcatttgtttcggtttatgtcagatacagatgattgacttaatttggtggaatactatcatttttcttaagactagaaagatgttacaagtatttggaacaatgtgtgtgtgttttttttaaaacaatgtgtttttaatttgcaatgtgcattagattccgctgttatgaagctctttcaactagcatgcttgtatttaaggcccttccttcatataaacacaccaaatcagaaatttcaggtgaagaagctaaaaacaaacaaacaaagaaaagcccaacaaaataaaaacaaaaccctagtagatttttgaggtccagttttttactggctggttttgtgtcaacttgagtcatcagagaaggagcttcagttgaggaaatgcctccatgagatttagctgtaaggcattttctcaattagtgatcaacaggggagggtccagcccatagtaggtggcccctggttccttaagaaatcaggccgaacaagccaggagaagcaatccagtaagctgcacccttcatgacctgtgcatcagctcctgcctccaggtccgtgctttgtttaacttcctgtcctggcttcctttggtgatgaacagcaatatggaagtctaagtggaataagccctttgcagctcaacttgttttttgctcttggtatttgtttgcagcaatagaaaccctaactaagataactttgttttaaaaagtacttaaaaggatgatagggtgtggagacaataaaaataaactacttttttgtataaaatgttggtgaaaaaagttaagacaaacattgcagtttgacggttatatgcaatggaaatgcatcagagagagagattaaaaaaaaactgttagagcacaggagtaactgaagttgtaatgcttgaaatgataattaatggaatagatactagagcaaggaactagaggcagtggaattaagggcatggacagaagagaaaagaatgaattaaaatatacatttaaaggcagaggtgaatgaaactgacagtattctccttaagtgtttcattaagtgatggatactattttccaatgaagctgtttgatttgagattcctatttaatatccaggtaaaaattctaggtatttctgtgtaagaaactctaggaataaatcaaattattataaatgaaggttattcgtgttttaaaaattaataagctttatttttagtgaagttttatgttaacaggaaaattaagtaggaaataaagttcttttttctttttcttttccttttattgttttgttttgttttttgtttttgtttttccagacagggtttctctgtgtagccctggctgtcctggaactcactctgtagaccaggctggcctccaactcagaaatccatctgactctgcctcccaagtgctgggattaaacgcttgtgccaccactgcccggccaatgcctcctgttcttgaacactgtttcctgtactgtgatgtcctgtcccattgtttcagctgataagtctacactgatacatcattatcacctgaggtgtgttgtttacacaggcccttctctttgggttgaacattctataggtttggacaaattcacaatgacttgcacttacaattgtcatgaccaccctacaaatcctctttgctcagtctgttcatcactttctcttatttctagtaatgtttgatccttccactatttctaccttgtgtacttgggatcatataatatgtaagttttttttttcagattcctttcctttatttagtgatgtgcatttacacttcctacacatcattttatgatttgataccttatttctattaactgctgggtaatgaaacctcacctggctgtatctatttacctcctaagagaacatctttgtcatttttaaggtttaggaataataataaaactattgtaaacatcgatattctacgcacctcccccccccccctgtaactttccagttcctttcagtaaataccaaggagtatgggtacaggagtctatgttaagaataagtttggttttgctagaaactgacaacatccacacattgggagcaaatgagaagcctgttctgcattctttttttttccatttttttattaggtatttagctcatttacatttccaatgctataccaaaagtcccccatacccacccacccccactcccctacccacccactccccctttttggccctggcgttcccctgtactggggcatacaaagtttgcatttccaatgggcctctctttgcagtgatggccgactaggccatcttttgatacatatgcagctagagtcaagagctccgggggtactggttagttcataatgttgttccacctatagggttgcagattttatcgaaaggacccagatgtagctatctcttgtgagactatgccggggcctagcaaacacagaagtggatgctcacagccagctaatggatggatcacagggctcccaatggaggagctagagaaagaacccaaggagctaaagagatctgttctgcattcttgacagtgtttggtagtgtcagtaccaaacttacattattttggctttttttttttttttttttttttttttttggtgtttttgagacagggtttctctgtatagccctggctgtcctggaactcactttgtagaccaggctggcctccaactcagaaatccgcctgcctcttcctcccaagtgcgccactacacctggccctattttggcaatttttaatagatgtatagttgtatttcattgttgttttatattaatcttcccccaaaacacatgttaaatattttttcatgttcattttccatttatgtttcttctttagtgaggtatctcttcagatactttagccagtttaaaatcaagtacatctatatatggtataataatcttttatctaatatttgtttttcaagtttttttcttacagtgtgtagtttttcttttcctttttgataagaatgtattttgtataatagaagttttatgctttactgaagtctattaatcattctttttatagatcatcattataccttaagtttactagatttccttttaggtaatcttttaggagttttaatgttttatatttttacacataacactggtccattttaggttaacaatgcatttaaagttaattgtttgggtttgaagtctgtttatagacttcttatctactagttatgttgaacttagaaactcatatatgttaggcaaacactctaacactctatcaatggaaccatgtatgtcagttctatattcattttatttgagacagggtcttattttaaagtcctgattgaccacttaattggtttgtagacccaacaggcctttgcctcttgaatgctagaactaaagatatgtaggcacctacatatcttctattttaaattttgcttttgcatgtgtatgtcctgtctggtggtgattcttgaaagatttatattttctttgttagatcttctttggttctttgccaaagataaatggttgtattaatatgtatccatttatgagatcttatttgattatactgattaaagtctattattttaccagtagcacattgtttttatgacttgaggtttatagaaagtctttgtggtttctacaatatattttgatcatggtttctccttcccatcttcttctacttcatggggatttagaatcaccatagaaacaatctcttggcatgtctgtgaggtattgccccaattaagttaactgagataggaaaaaacaacctaaatgtgggtggtgtcatccacagactttggtcgatgactgaataaataaaagcaagaaagtgggctgagtacaggaattcacctctttctcttctctgtggccacagtgtgatcagtgagttcctactcttgtgccttcatgctgtggtggattagataccctagaattgtcataggaaatacattcttccttgagttgcttttgtcaggtattttgtcacagcaatgagacaaataattaatacagccttgaaattcgtagtaatgtattactgccttcattattttctaatattgagtttgttattttatatcatttgtctctcaatataaacttcagaaatagttttttttttaatagtcacaacataaaggttgttaaggtatttttttggggggagggggaggctgtattatatttattggtcaaattgggaagaaaaccttgtaactattgggtctttgtatccttgaatccagaaatcatttctatttgcttatgcttttatttatttcatcagagttttctagttttcttgatagacatcttatataaattttattagattgttacctccttaacatcaaatacatgtcaatgtaaattgtaacctgtttgaagtttcaacttgtgctttggttttagaacaggtttattggaagaatttgggaaaaatgtagataagaattaaggaaaagccctaaaattctataaccagaactaaatgggttatttggtcagacccttatactgagagggaggtgaccagccaagactgctcatgaagatggaaatgaggattctgttagtaagtggactagaggttattcatgttgctatagcaaataacctttctagattttttctgtgctctaagacttttgttaaatttgaaggtgttagactaattatccaggtagaaggtatttctacacaatgcagcattcatattacaatatgggttatgcttgcttcttttagccagatttgtagtgaaaaccagaaggaaaaagtaaagaaaaaaataatcgaaaacttgagttttcacggaaagttgaggcaagacaggtatagctttcataaagttgaggccaagagaggttaacctgccaaagagactaggcttcataaaagcaagccaactaggtgtcaaagaggttgttcagtgaggattattctgaaatcatatccagctttaagagggaagaacctgaacaccttatacaagttactacatatacaagcacactcaaacacacagacacaggcacaggcacagacactcaggcaagacaaccccccttgcaaacaaacaatctaaaaagtgaactacacatagcaggacagcaggaaagttgctttaagtgtatatcaggcactgtctagcagcactttatacagggtcaggagcataaagatttaactaattttatttaaatactttgctttgagaagaaactattggttatttttcttacttgggactggagagatggatcagcagttaagagcacttgttactcttgaaactttagtccagtccattatacagaaggcaaagtgttgagaacatcagatatttagtcactttttaaaaataagtttattttgtgtgtgtattcctttgatttagttgctatgatttttttctttatttttcttttagccaacataatatccctattgattctttggaaaattcatatactgtaccccgatgatgatcacactcactttccgtttctctcaggtccacctttccacctgtgcaaactctccccaaaagaaaaaaagttaagccaagttaaatttttgttgcctgcatactcattagagaactgtcaaactcccaggggccagcctgggataactgagtcctctcccaatccccatccccaacataagccattaatgtgagaagctacacttcagcatctttgtcacaatttttttagaactctcttcaatagcttcctatttgaactggttctttgtagtgggcgggagaggctgtcatagaagccttcagtgtctctcattctcaattatgagtctacagttatcaataccactgcaaaagaagttttcttgtgcataacagccagtggcagcatgaatcatggacttccatatggtttctgatgacagctcagaactgaactggtcctcacaggctgcacagatcatgcaccaccgatatcaacatagcctcctgttgcagccctaatcatggttatcaacatgacctcaggcctctatatagaatgtggacatcaatgtgggcagcacataccatgtatattcacatggcctccagtggtaacatgaaccaaggcatcaacacagcctgtggttacatcatgaactacagaccagcagcatggctcctggctgcagcatcacttcagacttcaatatggcttctggtggcagcataaatcatggagatccttcaaagagacttaatacagagaattgctatagtttatcttagatatcttgttgctcagagctagggtgattgtgcgaccaggcagcatgtttgtggaaagagcctgtgcaagctccaggctgctatacaccatcctgccagccctacttggcaacggcatgctcctttgttgcagctctgctcccatacctgtcacctcccctgtatctccagttcttcctcgttgcatacctgcctgctcttttctgccatctttcctacatctatcacacattcacttattaaagggacattgcaaacatatatatgtatgtatacacatatatgtatatgtgtgtgtgtgtgtgtgtgtgtgtgtatgtgtatatatatatttgccccaacagctttacatgcgtatacttactgcaatcagtcattggtctggttcaaggtttctggtaaatactggacttatctctgagactcatttcagatatcacgttctctctgagtcagggtgatcttgtgcatccatttctggggtaggatccttgaaagctccaggtcttcctgccctttgtgcctgctccctatgggccatgtcactctcttgctgacacaatggcaagctgcataagcatgctctgttggctgctgggacagcactcccatgttatgtgtgacttctgctccaccatcttatttccacttccataagaccactttttaagagcattttttctttttttttttttcaaaagttcagggaatcctatagaaatgttgggagaaggattgagggacccaaagatttcagggactctgcaggaaaaccaacagagtcaactaacatagacccttggggacttccagagattgaaccaccaaccagatagtgagcacagaccagacctaggccttcggcacagatgagcagtttggtcttctagttgtaggtcccacaacaactggagcaagggctgtccctgactctgttgcctgcctgcctacctgtgatccattctcataagtggatctccttgtctggtctcagtggaagaggatataccaagtcctgcagtgacttgatgtgccatggtggtggtatatgagtgtgctagtgaggggttcatgagggattattttaaaaattcactgttatgcaaagaataaactatagaatagcatagccacatgcttctatttagaaatttaaaaaaaatagtgtcagggattggttcttgcccattggatgggtctcaagttgggctggtcattagtttgtggttacatctgtctttgtaccatctttgtccctgcacatcttgtaggcaagacaaactccatgtccaataaagatctacaggaagtatgcccctatctctttaggctgtgacaactggcctttaaagggtgaccactgtcttacagaggcaggcctgtgttttaaccaatgtctattctgaatttaagctttatcaaagcaggtttttttttattcctcttcactttctcatctgctagtcatttatatagcccttggttgcccttgtgttccttaagtgtgtgactagtgtcccctatgctttaatactaacttatggctttttatctattacccattttctcctctttctattttaatatttggtacctgagggatttgtcaggtgttatattattagtgtggtaggcagatgtatacatgtgcagtaattgttgtatcctgaataatgttaatgtgttttgtgctctgcctttgtagttcttttgagtgcaatggcatgggtattatatttaattattttaaatcatctttctcatgtgtgaccctgatactaatgttttgtgaggtttctaattatttccagtgctgatacaactgtataacattgccatttattttataattactctgtacccatttgtgtggccttttgaggctgcccataagtctgtgaatatatatatttttgcttatttatcaattatggattctctggctgtgagaactgcagttaggagtttttattgtgaagtatgttggactccccccacccccacccccaaagtatctttccataagacctgcccttttgtttgcttgttttcgtttttccgcaacagggtttctctctgtagtcttagctgtcctagaacttggtgtgtagactaagcaggcctcaaactcccagagatcctccctcctcagcctgctaaattctgggattaataatgggcatattccaccataaccagctgacttgcttcttcttttcttttttctttttctttttttttctttttcttttctttttctctttctttttcatttctttttcttttttttttcctttttatttccagaggtgctatacattctgcagactcatcttttgcagatgagcctctccttgaagcctccttgggtttttcaggttcctaggagaccctgtgggtgccagctgctgctgccaacctgaattctgctttatctaatcacattgtatctgtagtcaagaagcagagacatggcctttgaaagagggttaagtggttaaaagcatttctgcttttctggaggacctgtattcagttccaagcagctacatgacaggtgacaacaatctgtatctcttgttctgggtgatccagtggcctcttctggcctccatgggtaccaggtgtgtacatggggcacatacatataacatgtaaatgaaacactcatacccatataataataacacatcttaaaaaggaagcagagaagtgaatgttagcatcttccttttctctctttttattaagcatgagacattagttcatgggacagtgcttcccatgtttaggatacgtcttctacactgtaaatcctctttagatatttcctcaaaggtaagcccagagatgtaccccctatggtgataacatatccagttatgttgagtgtagactatccatctaaactggggtaccctgcttgcacaggccgattaaggaaatgattccatgtattcagctgtgtagacactcagtagccttcttagtcattattcaagggggctcagcctgctctatgaactgatagcaaactgatagcagccatcaaggaggcaagacttgagaggtcctgaaagctttttctcacatttcaaaataaaagtatgtatatagagatgcaaacagtgtatgtatggggggatcaagatcctcctgtagtcagtctctaagaggataatgtatgaagatatgaatacagcggagactcagaatttagagataataaggaaggaggagttactcctgaggaaaactgcaagcagagtacagttattcaaagagatgcatgtcatcaggattgctgtttgcaagaccatagggatagggcttcccaagctctttgacacttcatatcacaccatgtgcctcaaatgctgggcatgcagctacaggatttgatgcctaagaaagcatcaaagcatcaaatatacttgatttcagtcttctttggccatatctctttcattgcttccattctttcatttcagaatagaaatggtttactctgtgccattttatactacaaataggaggtcagacttaagaatgacatacattgtgggtaggataggtaggaggatggttcagcacttaagaacatttgctgttcttatagagaaccagggttcagttcccagtgccctcatagtggctcataaattgtatataactccatttcaggtgatttgatgccttcctcagacctctgtgcaccaggcatgtacatgttgtgcatacatataaatcaactgtttatgaaaacaaaactatatacatcatttaaaaattatatatgataaactctaatttcagcatttattaagtactcttgaaatacgtgggtcttgtacaggctttatcctttgtaatttttaaagcataagtattatgcttattaaaaatgttatcaagcataattaagtaaccaaagagccataaattagataggtaaacatagatcttaaaatgttcatagttgctctgctttctctatattgtctggtaattgtgattataaaaagataaggagatattggaatatattttatgggggtatggtgaggtgtaggggaaggaagtgccttggcagtcccatgctgaggcttcccttttctctgaggaactagatacacaatgttatagtataaaatagagtttatttaggccatgggaggggagttaaagagtagtaaaggcagaaagaaggagagagtagagaagagagtagaggctggccatgaccacgtggagaagagggaagggaatggggagagagagaaggagcaagaggtaagagagagaggagggggcaagcattcccctttatagtgggccaggcctacctggctgtcgccaggtaactggggaggagcatacctggctgttgtcaggtaactctgggggtggagtccagacagaatacccatagtaaaacttggtatagccatttttaagatcattcaaagacttgtgatgaacttttcttagtatgtactatcttcttgaaaggtttgaaaattaaatggacaaaaattgaaataacagtttgaactcttagacttcagtgcttcatatttataactttggaattctttgtgaaaatgtgttatatctaaaacacttgactcgaaataagttaactggtttctatttcttttcatattttaagactgtcttagaagacaagatgtgtgttattttctagaatcctggataagcaaatgtgactcaagtttcagaaacaatatcttgttcaaagcactttatagtctatcaatctctttcaatgtaggtccaatatgcctaatctttctggtttgtttcctagtgttagacattccaaatctgtagaaaactatatgaatatcttatcacagtaatttactgtgacttgtgtgattctgggagaaagcaggaaaagtgagaaatgtaagcctagttttagaatttgacatcactggaaaaatcagttaatggaacatatgacaactttcttttctaaattactattacttatggaaccaataatcatgttggtaagaatattttgactttttgtttgtttgtttgtttgttttgtttttcgagacagggtttctctgtatagccctggctgtcctggaactcgctttgtagaccaggctggcctcgaactcagaaatctgcttgccactgcctcccgagtgctgggattaaaggcagtgtgccaccacgcctggcttattttgactttttaattgtaattttatcctaattcagttttaaattcccttttcccttacaattgacaagatagtattgctgtagaagtcgcacaaatatctcagattcacagtctgataaggcaagtatttgttgcttcagatatgaacaatatttcaaaaagtcttaatggattttgaagtttattttaaaaagcaaatgacaatatttgtaagaagtattaatgtcttctttatgttcatttcttgaattcaccaatgagattctgaatagtccattcatattgttcttatcccagttcagagatccttgtttctttcctaatagtatgtagtcatgttcttttaactgatatctctagctctgtattacctattcttaacaccaaatctgttcattcagagatgttgaagcctcggatttgctgcacccccaccctcttcacagagcttctgggaggtcccgctcagtatccctgcagatcagattggttagtcaggttttatgtgcctaacatttctgaatcatttgtgcacaaaatttgttttctattttacttctacatttccttaacatttattttattttaattaggtattttcttcatttacatttccaatgctatcccaaaagtcccccataacccccactcccctacctacccactcccacttcatggccctggcgttttcccctgtactgagacatataaagtttgcaagaccaatgggcctctctttccactgatggctgactaggccatcttctgatacatatgcagctagagacacgagctccggggggaactgattagttcatattgttgttccacctatagggttacagacccctttagctccttgggtactttctctagctcctccgttggagggccctgtgatccatccaatacctgaatgtaagcatccacttctgtgtttgctaggcccctgcatagcctcacaagagacagctatatcagggtcctttcagcaaaatcttgctagtgtgtgtaatggtgtcagcgtttggaggctgattatgggatggatccccgggtatggcagtctctagatggtccatcctttcatctcagctccaaactttgtaactccttccatggatgttttgtccccagttctaagaaggggcaaagtgtctacactttggtcttccttcttcttgagttgcatgtgttttgcaaattgtgtcttatatcttgggtattctaagtttctgagctaatatccccttatcagtgagtacatatcatgtgagttctttggtgattgggttacctcactcaggatgatgccctccaggtccatccatttgcctaggaatttcataaattcattctttctaatagctgagtagtactccattgtgtaaatgtaccactttttctgtatccattcctctgttgaggggcatctgggttctttccagcttctggctattataaataaggctgctatgaacatagtggagcatgtgtccttcttaccagttggaacatcttctgaatatatgcccaggagaggtattgagggatcctcctgtagtactatgtccaattttctgagaaacctccagactgatttccagagtggttgtataagcttgcaatcccaccaacaatggaggagtgttcctcttctccacatccttgccagcatctgctgtcacctgaatttttgatcttagccattctgactggtgtgaggtggaatctcagggttgttttgatttgcatttccctgatgattaaggatgttgaacattttttcaggtgcttctcagacattcggtattcctcaggagaaaattctttgtttagctctgagccccatttttaaatggggttatttgattttctgaagtccaccttcttgagttctttatatatgttggatattagtcccctatctgatttaggataggtaaagatcctttcccaatctgcttgaggcctttttgtcttattgacagtgtgttttgcctaacagaaggtttgcaattttatgaggtcccatttatcgattctcgatcttacagcacaagccattgctgttctgttcaggaatttttcccttgtgcccatatcttccaggcttttccccactttctcctctataagtttcagtgtctctggttttatgtggagttccatgatccacttagatttgaccttagtacaaagagataggaatggacaattcacattctcctacatgataactgccaattgtgccagcactatttgttgaaaatgctgtcttttttccattggatggttttagctcccttgtcaaagatcaagtgaccataggtttgtgggttcatttctgggtcttcaattctattccattggtctacttgtctgttgctataccagtaccatgcagtttttatcacaattgctctgcagtcagtataccttaggtcaggcatggtgatttccccagaagttcttttacccttgagaagagtttttgttatcctaggtttttttgttattccagatgaatttgcaaattgccctttctaattcattgaagaattgagttggaattttgatggggattgcattgaatctatagattgcttttgccaagatggccatttttactgtattgatcctgcccatccatgagcatgggagatgttccatcttctgagatcttctttaatttttttcttcagagacttgaagttcttatcacacagatctttcacttccgcagttagagtcacgccaagatattttatattacttgtgactattgagaagggtgttgtttcactaatttctctctcagcctgtttatcctttgtgtagagaaaggccattgacttgtttgagttaattttatatccagcttcttcactgaagctgtttatcaggtttaggagttctctggtggaatttttagggtcacttatatatactatcatatcatctgcataaagtgttattttgacttcttcctttccaatatgtatccccttggtctccttttgttgtcgaattgctctggctaggacttcaagtataatgttgaataggtagggagaaagtgggcaaccttgtctagtccctgattttagtgagatgcttccagcttctcaccatttactttgatgttggctactggtttgctgtagataacttttatcatgcttaggtatgggccttgaattcctggtctttccaagacttttatcatgaatgggtgttaaataatgtcaaatgttttctcagcatctaacgagatgatcatgtggtttttgtctttgagtttaagccttaagaatttgtttgggtctaatcaaccatctctggctgtcctggacctcagattgtacttttcccctccctgagcagtgttccagtgcttctctacagcccaacaccacccagcaatgtatggggtaaggaggttagccaggtcaaacttcccacttcccacctccccaagcaaccattccctggggcagagcaacacagggctgacaaccctatagtctagttctttgcttagttaccattacaacaattcagagtgtgatatactattcttgccgctgtatttttatttttatttttatttttcaattctggtgagaggaagggatatctgagtcttcagcacaccagaaaactcaagtgcctggtgacaaaaatctcatatagaatgtaattttttgcttttgtttgcaacacaaacacactcttaaaaaaaagaaagaaagaaagaaagaaagaaagacaaaaccaaacaccagcaagaacaaaaacaaacaaacaaaaaagagtttattattatatgtattattagtatatgggtgttttgcctttatgcatatcaatgccaagtggatagtatgtagttagaagtgcaggctctctgtgcttatgtgtctcctgctctttgagaatttctcacaatggtgctgggaatatggtgtatgttcaaaatatttatattgatgtattcaattacattgttgagttaatgatacccatttaacttgtcttttaaaacagatatgctaatgatgtaggtacttgagtaacatgtctagtgttctggtcaaaaagcaagattgtttatttatttatttatttcaagcaatacctctctctccctgggtggcattgaactcattgtgtataccaggctggtatgaagctcagacatctacctgtctgtgcctcctaagtgctaggattaaaagtgtgtgcactatgcccagctgagaaagataagttttaatgatgttttcttgttttgttttgtttgtttttttttaaatcaaagtatacttgattttatatagtgatccctacttttttgttttacttgatttttaattatcttcaaatttctcaccttttgctatttgtttgaataacacattcaattaatatcatgactcagactgattttgcatgtagaaagtttctcacatttatatttagccagatattttttgggaagactcaggaacatagacatgattgccttccataaactaaaatcacacagaacagaatttctccccctgcctcctaccagacttgttttatatctattttccttcccttccttctttgtttacttaaaaaaaaataacttactatacaaaattctagtattatacaaatgttatcgcattttgaacaaagtatattctagtagattctttttcgtcatctcccctgtgcttccctagtctcattttcaaatttcacgtccatgtgtctttcatttcttatattactaaatgggaagattatatccagatgtctgggtaagaaacaacctgagtataagcaggaatgtaaccacaagtggaggtcagaaaacaactttgggatctgttttctccttctgcctttacatgtatgtgttctgggcatggatctcaaaccctcaggcttgcaacacaagcacctttatctgatgggctaccctactggtgcctcacagtcgtgttcctggtcttagacttaaagaccttaaattagggagctagcagcagtctgtattaccttccctcaaagaaatttctgttctttactgcttttcttctcagttaccttctcttcttctttagctatacaaataagtgcaagaaaggaagctgtctttcatcagtctgtccctttttttgatcataatgaactgaaatgaaacagtttaatgcacactgctctcattccaagtgtatataaaaagcaggtataaagtttgaaattatcatcttacctgatatttagcattcctttgactacaataaccttataacctagtaaataattactttgagagttcacactgtattgaagatttggcctgtcccattgtctacttgtagtccttagtgaagattactatagtctcttaaactttcattgaggtttcatatctaaaaaaaactcacaaagattatgtggattttcttcttcattgtccatttctttcctaactggacaatagccacaggctgtttaatgattttttttttcctgttactttcagtcattaatgagggcctgcctagggacaacactgtatagtttaagttaactcttacttgtttttctaggtctagccaaggcttatctctcttgtggcatagttattgaactttaactgatgttacattttatcctgttaaattactgcaaggacaagtggttgtttttctttttttttttaaatttatcatattgtggttaagatattttttaaactattgtgtgacttatttcccagaagctttaattaaattggatgtttctgtataatattggccatgaagtcttgaatcttaaggacactacattatttttatttcaagaactgtttaacatatctctatgtatattattattgtaagctatgaattatattaagatggctaacagttaatgtgcttctggctttctttttggcatagataaaccttattgttatgtgattgtatattatctgttgataatctgtatttaatgaaatgcaattccaattcattttcttggactttctccagccaggcagaactcagacagagaacattgatgggcttgccttataatctgaatttttcaaagtatattggcatggatctttctgataattaacatagctggatattttataaccataacctttgatttgatcataaaatatttaacaagaaaaaatagattaattttaggaaatattatcagacctttagagtattttcccatggaaccaagactaggtgacttaggaactcagttgatataagtccctcattcactgtacatcacatataacatccacaaagaagctgccagcttcaagggtgcctccatctgaagtaaataattacctgacactctatggaagatatcagagaatactctattagaaccatcaaaactcactgaatttgtttcttttaatcggttcagagttgaaacactgagttgaaacactcagtgtcccctcttaatatgttcttaaaatatttgaattaatatttctactttccagaaaactgatacatttaatgtggtgcagaacagcaataactgcacaactttatacaggccatggaggccatacttatctgtagtctcttctgtttgttatttggttagttgggttttggtttttcaagacagggtttttctatgtagccctttctgtcctggaactcactctgtagaccaggctggcctcaaactcagagtctcaactgcctctgcctcccaagtgctaggaataataatatgtgcctctacagcccagcctgacctagggaagagtctcataaatcttgctggagcaaggaagataagaagcttgataaacacttgttaggaattatatgtcttgtctctatgatataggaaacaaccttaaggtcgttcctcatctgttttctagtttcagatgagtgagtgactttctgctttgggaaaatagtaccacattgattttgtttttgctgtctatgtaagtaataaaataggtaagtcagtgatgtatatttactaatgtaacataataataatgtagtaatacacataggcctgttagccactgtgttgccacattagcgatgtttgtgtgtcataggaaaacattcacaggccaaacaactcagctagcatgtgtatcttaggatattccttgaggcttgtgcctatgtctgggcagaatgggaccagaacagaatttcgtattggaattaatcttgactgattttcttatattgtcagaccaagttaaaagaaaaaagatctccttcattagaaatttttgttcacaaaattgaaggaagtttgcttctgaagctaccctctctacaaacatatatttgaatattggtaggaaaggaatagtgacagcgtgtgggcctattcagattagtgccctttaaatatgttgttgcctcctattcatcaacccagtagactgttcaagctacaatactttgaatttctctctcttaaaaaaaaaaaatcaaggttttaccatataagcatttgcacctattctggtattatctctgaaaaataatagaaggcagcatgaaaaaatgttttctaaatttcatattttaaaaaaaaaaatgtttctgtaatacttgcctgtgatggtttgaatgaaaatggctcccataggttcatatatttgactcgttggtcccaagttgatgggactgtttgggagggattaggccttgccagaggaagtgtgtcactagggatgagctttaatgtttcagccatccctagcatacttctctctgtttcctgattgtgaatcaggatgtaagcttttagctgctgcttcagtgccatgcctgcctgcctactgacatgttctccataacggttatggactcctgtccctctataattgttagatccgaataagcctttcattctataagttccttggtcatggtgtttttatgacagtgacagaaaaccaaataaatacactcaatcatccattgtatccattttaaacatagtcatttgagacttttaaattttctactaagcattggtaattgcatttcagattctgatgtagtttcattaccatatagtctctaatgttcatttcatttctcttcaaatttattatctgtaaaatatttacttagatttgtgtgatttactttccagataggaaatgtttgctgagttttctcttcctttctctcttctctatttcacactcacacacacatacacacacagatgcatgcaagtcctcatgtgctttgtctgtctgtctgtctgtctatctgtctctctctcttacatacacactgagttacttttgaagtagctcttatctaaattttgtctatggttgaagcccctaacagtctggtatctataaaagtgtttcagggcttagtcagaatcaccagtagttagagattcaggtttcaccctgtatttcttctttcttttgaatgatcatgattccttgaatagattttctctacttctctaaagccagactgctacgtttgtttgtttgtttgtttgtttgttttttcttttgctctcacttttgccatacatattttgtttgtaaatactcctatgctgaaagacataccacaccatctcacttctaccaagtgagtggacactctccaacttgtgtcagtctacttctctgcacatactggtaacgttattgtggcagtttttggccttagtttacaattattttgctttgcatctcttcaggaactttatctatgcttcagttagaaatgttgatagacagaagtctggacacactctctagctctcttcctcctgctattcttacacttatcagtatttgccaatatgacttttcttgttctgtaagccagagaaatgagaggcttagcccatgtcctctcactgctctctcactgctctcaccataagtgctatatgtagccctgatcaaaagcgaaggttaagagcgccatgtggctttcatctctccttgagttctttctcagattctgtatgcttctctcccataccttaaatttatttatttttttattgtatttggatcattacattttgtaattcttttcctgtttttatgtggggatcctataggtgctaaggttatcatacccagaaatggaaaggtttcaagcctgtttttccccataggatggaaaggcagactaaaccaagggaaacacccacctctgttttactgaatcatcttttcaaaaccattttagttactattcttacagtgttcaagacttttgtttccatatgacagtgagtgggtatagcaagttttagatgtaaaaatatcccttaggaggctatataattcccacctctctaaaatatattacatttgaaaatatgttgcacagaatctgcagatattttgtttgtttgtttgtttttgttttttaataaaagagaaaactatttacaccaagttttgcgccaaatgcttgtttttttagaaattgtatctaatgcaaactgtattgagaaattatatatttaatgcatgatagtgatagtagagtgcattaataatgcacccactgtaataaattactcagtaaaatagctaaatgtgaacattaaagaaaaatagttttaagttttctttcagtaatgtagatgctcagctatatgtaacattttcctaggtaaaaattagtctattatgatatgctttattatatagtactatagaagttaagacacttgaagaaattatcacagatttaaaagtatagaatagaagagaatgagaggtttttatttatgatttggaggagagccttaagtgctctgtcctaggtgatacaggtagactcagaaaccctgaaaatatttgggggtttctcacttccttaagtggttatcttgctgttgactcttgtgacccatggctacttatcaacttgtaagcagcttctttctcccttagacatcatgaattgaaatcaaatgctctaagctacttttaggctttaattgaaaaaatgacttaagacaagaatgacaaggcaagttaggctaaagaatgttttcatggacaactatgaatgtggccaatggtatacttttcccccagatggttaaaaaagattcatttgtaatttagtggattttttgattcttttgaggatccagtttcatttcagttgattctctaaaaaataccacattgattactatcctttgacttactctcacatctgcagtagatgaatgaaggcctcaattaaataagaagaaaagagctatgctttcaaaggtcttgctgcctatctccatatttatgttatagacatagagaaagtcttatttaaaattaatattaaattagaaccccattatatgttggaattttgcaaatacttgttgaaagagaatcttctcctcaaattagcaacaatattggtatgtaggaggacctttttctaagactgatttttcttggtgattaatgttggagctagacatttcagaggcagtttccaagtaaatgaatagatggtgagataatttcttaaagttcttagatctagtcagtctctagagactttgaagctgtgagttacagagtattctgatttgatctcctgggatctctgccagattcataattgcattgagattttttaatgatcacaaatgatatcatgatgcttttctctttattctggaagtaagctgattactacagaggaaggaataaaaatagattttagtcagaagacttggaagatcagatatcaggtcagatgcaacagcatatctgatacatacttaagtagtcactgagttgtgactaattagtttggtgaaatagccttggttatatccattagtatatacacagtgtgggacaagttttatattcattgctttaatcattcaaccttgacagaatacttggccgtggtacttttttttttaaacttttgttataaagacaagttatctttcattacagtgttctaggctcccagtcttcttttttagcatgggaatagaagtgggaggactgggcaaaaggcagaataatgtgttctttcccttttgctcctggcaaataagtctttattttcataatttttttccaggtgtagtcaaccttatcattctcactgtgtgccctttcatagagtgtaagatgtttttgttgcatttttaatgtgtatctgtctttcttatgcaagtagagagcttaattattaattcacctgcccatctttgttacacccacttaaaacaaaacaaaacaaacgaggactacaatcaataaagccttaggtaaatatgtagctactttagagagtaaacttgaaaatgcctggttcttagaggatgtgtatgtatacacacacacacacacacacacctttctagttttctaatttgacaaacagcatgaaactctcttgttgctgttattgttcaaatgactatattccatacaagaagaaagagggcaaatagaaggaggatttggcagaattctctcttacaacggtcttatttattatatcactttgagagagagagagagagagagagagagagagagagagagagagagagagagatctatagtaacaggaattttgcacatgtttgatttatactaaggacaaaacccagagctttgtgcatgctaggcaagtgctttaccagatgagctattataactctccaacctcttccctgtttgcaaaatgttgtgatattatttgtagagagtttgtttaatagatgcatccaacagtgatatggaataatcaccaaagaagactgctcagaccttggtttaagccattagaaagtctttattagctggtcagcaactatactaggttttcaggatcccagtatagctctcagcctttctcagggtgagcttttaggcacaaaacctatgttttggattgacatacttcagttcccaagaacagttagcaggaaatgaaactacagaagcccaaaaacaaagtatagtacagtatatttagattctttcccaggactatatggactttgatggattaggcctttgttatagttttgttgggtggttttgtctatgtgttaagttttacagcctaattggtacttccatcatggagtcagttgtgctaaagactggggcctaagctggtgccctgttacattccccactggtcttagtgaatgagtcgaatcatgggctcatcttattttagtgtaagatgcaggaccttgctgctaatacaatcagaatgagaattaaaggcccagccagtgttgataacaaagtacttaggcagagggaccaagagaatagagtctggtaccaattattttctcaactatggcaataatttttttctacttactcctgatcaattagtatagaaacaataggttttttccaaagccatatatagtttcttttatttcatgagtggtctaagcctctccaattatgtagagccatttctgcaagggagtgtaaatgttgttttcatccagaaactgaaacttttgatatctctaggacatgatcaacctatctacttagtttagaaagcagaagaggcacatttagtcaaaccactagtacatgccaaccaagtagtcgcagagatccagtaatattgctattatccatatgaattaacccataaggcagtgggcatgggcatcagaataaaggaaaatgcctaggttaacggttttggatattagacaagttctaggcctttttaagtcctctaatatttttgcgggggagggctgctcccagttacactgagctttgtcagtcagctgacagtctggttagttcctaacatgtatagtacaggggatagttctcttaagcataactggcaatcctggctaatttgggtcagggggagctggacctgagcatgataaactctatacctagggacccttcctgagttatagggtgattcccctgttttgtttgtttgtttgttttaatgttttccaaaggccagaatcatttaaagattttttttcccttttggaatcctcagttttacaatctcaatttttgtaaaggaaactaccttgctatggcaattagggtgccctcagtcacaaggcatgcacagaattgaatattcttaattcaaaagataaatcccaatatctttccttcctctagtataaccagatgtttaaaatggacatcagcaaataaaagtcaagatggaaagtgggttgcttctttgtagttacagtagctaatactttctctgtatctgtcttcatcagttcccaggttcaggccaaagggccataggggttagcccataaccctgtattcatattaaacacatgtttcaggagaaagtagagtggagtatagagtagaagttcctggagcccaatgaaacctaaatttcaatgggtccacagtctagaaataattcatttggcagcatccatggcttctacctgcttgacctaagtgaggtggatccatgatgtaattaatgccagctatctttacaaataaaagactgaagagaatcactatctagagtcctttcaaagttgctttaagtaagtaaccctttagctatctgcctgatgcagacaacatcactggactggaacaaggggaaactggtaatggacttggaggttggctgggtctcttggatagtccaatgaatggaggactggagtacctgtagtgacttgaaaaagagacagttagaaatctgccaactgttggtttctgtgcctgggaagcagtcggggagatcttccaaacataatctcatgggggtaaatccctccctatatggggtgtagaaggctgatgcaaagaaaaggaagggtgcctattcatgctttgctggatgctggacgatgagagttttgttaaagtttctcttattgtcctatttattttttcagccttgtcagaacactgagttctatatgcacagtgaagttttcaatctgtgtctaaagccttagctattaattgagagattttgactatgaaagctgggccattattggaccccattactagggggaggctaaatcagagaaccagttcctggaggagctttttagctattatttgagcaatttctatttgggtgaggaacacttttactcacctggaaaaggtatttttaaaaattagcaaattattttgttcttccccagatggcttgatcttggtgaagtcgttttttttttttttttttttttttttttttttttttttttttttttttccagagtttgtggggatgttgctctctcattctgaccccatcctgagtaagggctctctgctttgtatttagctaagggcacacctggcatcttgctgagacatctcatgatagactgtccagtcaagggataacatatcttggactgaacaactcagaatgtttgtggaccccggataagtagcctggtgaaggttagttcccaaaagtcctgccaattctttctaggagtatgatcttcccctctaatgtcctccattgtggcagtttgaatatgtgtggccaagggagtggcactattaggtggtgtggccttgttggagtaggtgtggccatgttggaaaaagtgtgtctctgtgggagtgggcaatgatatcctcctcttagcaatctggtagtcagtcttcttctgtttcccttaagaacaagatgtagaactctcagcatctctagtaccatgcctgcctggatgttgtcatgcttcctaccatgatgataatggactgaacctcaggacctataaactagccccaattaaatgtcctttataagagttgccttggtcatggtgtctctttacaacaatgaaaacactaagacatctatcaacctgtgggtttgagctgttgtaatcgtttatatatgcttgggccggaaagcagcactatcagaatgtgtggccttgttggagtaggtgtgtcactgtgggtgtgggctttaataatctagtcctagcttcctggaagccactattttgctagcagccttcagatgaagatgtagaactctcagcatctcctataccatactttcctggatgctgccatgtttctgccttgataataatggactgaacctctgaacttgtaagccagaccccattaaatatatgtttttattagagttgccttggtcattgtgtctgttcacaaaagtaaaaccttaagacagcttttcatttttaccatggagtctcacgcagtatgggattgtaatatgtcatcagaatatcaataggccccattggtcttagagccatttgttgggcagcagcccagcagtggaggacaacaatttgtaggggaagccaagtagcctctaaaggagggccaagattttatgtcccatttttttcagcagtgagaaaccctctatctttataaaccataccatggacatggctggtagtaaaaccatactgatggctggtccatgaatatgatggtagacttttgttttccctatccaagagcatgggtcctgtcaatcaattttgctctttaggctgaggtaactggcatgggtccagattgtcttgataaaagtaactactgcagctcccacgtactttgttttatctttcatctccagacattcatggatgaatgcctgtgcataacagagttgatggcagtgggtttttcagctgaacttgtgggtaggtctggagtcaggcctggagtagagccacacagtctttatacagctagcattttggtgctgcttctcagagaagggcctcaactttgttgtgagtatacaatcttgatcatgagttaatttatttgctttccttcattaaactagcagtagcttccatagatagctctttggcaggtggggctatcctctggctacagggtacaatcattttgacagaaatgtcatgggacatttccaagacctcaaagttcaggttaaaaccccttttgtcttttttttttttttagtctcagtaaaagtacctagtgaaaattgcttaaaatctccatggttgtgttgaacaaaagcgaaatccattttgtccaggctgtgttgtcaggcagcaatccttgtgcccagcccaggggagtttttttttttttttttaattcctttttagacaacggtggatcttacagatcattgatttaaaaggtggcataaatcataaagaagaaaggaacggaactttctctcttccttcgggttcaacccaggggaatgtttcctcttccccaggactgcttaaagcagacatgcagagggaatactcaccttggagaacaatttccctctccctgtatacattcttcttaaaggacagcaggccctgctgtcttcataaaggacagcaggccctggatcataggcctggcctctccccctccacacaagggccaagcctgaccaggagcaggaggcagtcaacaaaatgaacaagtatgtttgctccaggtagatgttttttgtttgtttttatttttgtgttttgtttgtttgtttcttggtatgtcttggcagagtcacaaggattcagctccccagtggaatggagcacagatcataagccagggagttgtcccaccagaggctttgaaacacccccctccccagggtcttgaggtctgcctctctgggacaaatctcagtgggacctccagaaatgttgtggggttattcaccaaagaagacttcttggatatgggtttaaactaatagaaagtctttattagctggccagtaactacactgagtgattgggatgctaagcttttcgaagggtgagcttttaagcacaacccccccccaccaagttctgagttggcatacttcaattgacagacagttagccagaagcaggaccttagaagctaaaaggcaaggttagtacatttagagactttcccaaaattatatggactttagtgaattgggccctttttttagatttgtcaggtggtgctgagttttacagcctgaatggtacttccatcatggatcatttgtgatgaggtttggaggtctactaaattctggggccctgttacaacagaatctctggttatcagtgaaattttttttttcagtctgcttgaatgaggcttgggctagctggaaacccttaggaccctcgtttttctgttttgttttgtttttgtttgtttgtttgtttgtttttaattctacctttccttttattttctattgtcttcttaagggcctcctttctgttatttctgagtttacatgtgttctttattcgtttccacttcgtcaactaattatgtattcttgttctttcctcatatgcaatacatttgtttacacatgaattactatttctttgctacattaataggaattccaggttgatattgatacctgttaataatcttttcccccagagactgtggttccctctacaggttttggagggaaaaaaggggggcttttagggatgtttttgtatttttcatttctagaaaattgtgttcagtttagcaataaagcattttcttccttgtggaacaatttgaggggaaaaaagattgaaaaagaccccgtatgttaggtaatttcagaccagattttctggtgcattcagagcggtatgtggcgttagatgttatgtaatttcaaagaagactcatttggctgtgaaactaagggctcttaactctgtgaccaaagatttcgattctccaaaggatgctatagtcactcattatgttatcaaacttgtataatcctgtgcctcaagtcaggttgagacacctgttctcagtgaaaagcaacaatataatagtggaaaacagaaaatggacattcatttaatggggcatatttcaaagagggcaaaagagagccagtgaaatgtttctgaagtacagatcctgaaataagactaacaagtatatagagggccaaggacacttaacatctaagcagtgccctccaaagtgtagttttaccgaccattgactcatcattgtctaggcttcaatttcatttatacagtggtctaagaagttgttagaactgcttgaagtcacttccctggagaaaagtgccccctctggtactttttacttctactagcactagattccacattttgtggggctcattgttttatagtctgacagtcagattgagcaacataaaatatcttcatttctgccagacctattataaacagggttttgttgtctggggagatggaaagtgggtgatgtagggaaataaatatatttcatatattgatttatctgtttgtatgaatttacagcttcatatgtttatgtaatgtatttagtccttttcctctttctactctctttctgcaggccttcttaaaaaatttcccttctacttcttttttgtatgtggcctactgaatgtggacttatttacttactctgcatggtgggcggttattgagtagagcaagggcaactttttagagactgtaccaccaaagtttgaaaagaccatatatgtaaaagagtctaacaagatagttcatctttgtagaaagtttaagtttttgagaagaaaatattcttgaatacttaaaaaaaatctgtacatatccatggcaaaaagaaaccttatggttttatgtgaaaatgataggagagataattgcatctagcctatatgttcctgttacatgttccatgaatgatcaaggaattgtaaactaatgaagtgtcattttttaacttattggatcaaagttgaaaaacaaaatgctaatactcacaaatgtgttaagtaggcagtgttctaagaaagaattttgttgttgtttatttgaggcatcttctagctttatagcccccactggcctggtactcactgtgtagcctacactcatcttgaacttgcagcagctttcctgcttcatgttcccaatgctaggatgagagacatattctatcatgcctggaaaaaaaaagctctttcttataaatataaaagatgggagtgggcctgcatgctgcaggccttttcaagtgtcctgagccagcctacaggactccttgctgcagttgcagtgcagagtctggagctgttgtggtgcaagtcatgactggacaagcttttataaagtttcttctgctctttctcagagtatttgttgaaaggagtgctactgaaactgtaaccaaaagtagcattatgcttccagaaaagtctcaaggaaaagtattgcaagcaacagttgtggctgtggaatcaggtgtgaaagggaagggtggagagattcaaccaattagtataaaagttggagaaaaagttcttcttccagaatatgaaggcaccagaatgttctagacaacaaggaatatttattctttagaggttattaggactgaaattagtgttgaaacggtgtcacgtgaagctgcccatttcgttgatattctatttgatcatgtaaatttctatacctcccttttataataaacggatgatgcctaaactgacagccattgtccctgaagttcagttttgctgtactgttagaaacatttccaaataaaatgatgtaaatgagtggaaaatttttggtaaaagtaaaataacataaaggatcaagttacactaagtagaaagcctagtatagtaggaaattctgcatttactattttttttctaaatatgctttctaaagtcttatcttccctaattggatttgctttcttctgctaatttgaggcaaccaccctgtaatataatactcttgttacactaatgataaaatgaaattcatcatatccttctagatggtaagttactgaataatgactcacccaaggaatttattattagaaaataataagtgtgtataaaaaagaggagtgtgtttttctcttggttacaatgaaatgaaaccatcctaaatgaacgaccattaacagaagactgcttataaattactacatgtagggggctataaagaagctaataaaatggatgcattttacaggttgttagcctaaaggctgtcaatcagtttagtgaacagaaaatattaatcagacttactacaaaagaatctttattcaggggcagtggtgacacataaacttaatctcagcacttggatggcagaagcaggctaatttctgaactctcgagttcaaagcaaggctggtctacagagtgagttccaggacagccagggctacacagagaaaccttgtctcaaaaaaaaaataaataaaatctatgttcaatatagtgctaacacatatggctttgtgttaggtgttaagtaggaaaataaaagtaaaggaatgggaaatcaaagtaaaatgatatacatgtatgaaatgttttaaggaaacaaattattttatatgaaagtagacataaacaaaaaagcaaaacaatagaaagagcaaaaccaattatgtgattattacctacatttcactgttttttttgataatgaaacaatgtgtgaaaaagattacttgaatttatagttaaagaaaagcagtgagacagacaactggtttatttagactgctgaagagatttgctgtcttagcctggagctcctaagtgttttctgtgccagctggttactaaatgacagtactgcagaggccaagtcatgtcctcatctcttaagtagtttgccgtctgagggaaatactgtgcagttagaaagtcagtgcataagaatgagtccatttgatttaagtcttctcagaaattcagacagagatgttctggctaatcagcatgcatgactaaggaggaagggaattgttctgcttgtaataattactttcacaatcaattaaggtttgaaaatgaagtagcatttaaataaaggcacataatatgagcaaagtctttgaacagggaagttattcaacatttgtagaggtctgagatgattcagttataatgtacttactattaaaatcttggaaaagctgaactctgggctgggctccatctctgaaaatcttgctttaggacctgtgtttcatctttctaaaaatgaccttttaagtatcaacatcaactgtagaatagaatctattttcaggtaaaaaaaacaaacaaaaaaaacaaaaacaaaaaacaaaaagaaaccaactggttgttatttcatttttagcttaatgctacaataaggatagcatttgagtatgaatcttacttgaggcataggaggtctaaggacatagtggttttatcatcaagccaagatgtggttttcttatttctgaaacagaaatattattaatcatcctgggctcccctttagcccatcaggcacttatgtttacttggaaaactggtatgtgagacaggatttcagaagtttacagcttgaagctagtctccaaaaaaaaaaaaaaaaaagacaaaatgtttgttatttcccacctaccaaagtaatggacttgtggataaaaaaaactgagtgggtaaagagctccaccaagaactgaatgggcaggactgctctatttcataaaacactgtatcttttgaaatggagaatcctctaatccccattttcttcattctggaaaccaggtctcccataaccctctcaaaagcacagttcctttctttcttttccattgttgtgaagtgaccctatgatcaaggcaatatgtaagagaaaatattcaattgagagctttcttacagattcagaaggtaagtacataaccatcacagggaggagcctggccttctgaaagtaactaaaagcaaagaggttatgaaaaatggttcttaatatgtgactgcatgggactgtatctaatattgacccctaattgcattctgcttattatgtttacttcagatatatatgtattccacctcaatattgaagtgttagaacagaaagtgtgaaattgtaatgggcctagaagaaaagaagatagtctagagatgcgaaaggaatgataatttccccaggaatattgtgctgggagaaggaaaggaccttagccacagtaggagcttgtcttcctggagagatttcagttttaagaacttgtcagaccactttagaggattagactgaaaccccttcaatgaaaagtcaattcaatggtgagcaggatcacgcctggactaggacttaggtttgtgtattctttaacttctatttaaattttaatcttacttcaggtggtggtggttgtggtagtagctgcggtggcagctgtaagggctgtttgttgggtctcttgtttcctcttcccagtgtggacacattaaataaatttcctttttctgctttccatttaaaaatgtaagtgttctagcatttgccccatgtatggatttctataaattgtaaaatggtcataggcacagtgggggaaaaaaactagatctctcctttgaccaaattgtaattcaatccattttcctttgcccatttttatttcttaattctcttggaattatatagagaagttaagccaagtaagtttatgaactcaagtgcctagaaaatatagtttctttgaatgctggaattataagcttgttctgctctgttggctttacagggtttttgatgtttgtttggtttggtttttgagatagattctcattatatagctctgacaggccttgaactcagaaatctgtgtgcttctgcttctagagaactgggataaaagacatatgccaccatgtctggctttatagggatcttaatacacagattaagtgaaatagtataatggccttaatgcgtaaatgagacagcaaaaggagatcttcaaatctgctcagcacctgtttcatcacttacaatgaaaagaaaggtgtgtatctatgaaataaaggattagcagaaataagttcactcttcagaaagtggagtaccaaagtgacaaatgtccaggggaggaaaaaaaagatggaacaagttgtagtggtttctttttatctttgactttgtgacaacagataccctgattcagtttgatttttgttttccagggcaatacagatttggggaatcaatgtgataagctttccacaatctgttgatgttgagtagtaattcttaggcacccaaggcttccctcaaatgaactataaactttgcccttaataatttagaatggaatggcattctaaattcttttggcccatgtgcttgcttatcagcatttcttccagggctgtttgcttctgtctttggagaagggacagtgggtcagatctttcaggttttgtctacagaatggccattggcatctggatcaggtagattcaaagtgttgtctttgtcgtggtcacttaattggctgcactttctgttgtatgtctaggaaattttaggaaacaatttgtgagctaatttctaaatatataaatatagtatatactctacttctggatgtatttctgttggtctacttaaaaggtataagaaatttattattaaatctgcttatataaatatcgaagacattttcattgcttttcttttgaaaataacagagtaagcttttttttttttttttttttttttttttttgatctagtctcaaatcataagtgatgaagtttctggtcaatgaattttttttttaaatcttagtgataccacagttcatttaactcatgtttcttggcactgactactagggagtatatctctttatcagtgttatagaatatttcagccagttgtgttatacaaacttctatcttttgtattttatattcataatttttctgtgtcaggttttccttaaatactttatttttataaacttcatattatcttcttttatgatatcatttcacttacatattgtttaactcatctgaaaaccaagtggataaattgcatttgatactgaaataatgtgttgaattgatgtacagtatttttaaaaatttggtgatagtgtatggcaccaaattaggtgagatcaaaaatataattgggcctatagataaatatagcagcaactaatcatgtacatacagtaacccatatagtgaatacttgaagtgtatgtaaattatatcttgagttttctctttcaagcttccctgagtctcagtacatttcaccaggaaacgttttagtgagagaggaaacagtttcctacacatatttcacaactgagtaaggaacagaacacactgacctggttaaatttgccttactggtatcagttaccttgcatttacaatctgtggtctaactttgccactgtcatgctatgcccatttcctatagaatagttccaatgctgtttcaggtaagcatcagtctgtaaattggttaaatcaatttacttatatataaaaatctagtagtcatcagtttaattttcccagggggaaaaatatgcttgctgcaaaggataagatagctgacagcagatttccacatctgatggtctcatttttttgtacccaggaagttatcagaagtgagaataaaaattttaaaagactgatacattgctgctgctgctgctgctactactactactactgcgtctctgtatctagtttcaattttatctcattcctggctggcttggaataatatagaatagactagtaggaactcatagagatctgcttgcctctgctttcacaagtgctaggactagagacatgcaccatcatgcctggtctgctatattatatttgtttattgtacatgaggttattaaaaccttttgttagtttatgtatataagtgtttagcctgcacttatgtctatgtaacacatgtgtacctggtacctaaggaagctagaaaagtgtgtcagatctcctggaattagacttacagacagttttgatccatgatgtgtgggtgtttgaaattgaatccttggtaaaagttgccagtgctattaattgctgagccatcgctccagccctctgctacattattgttagcagaaaaaaaatagaccaaagttttaagggctgcctgttttaaatgattagatctactacactttatttttaagtagtaaaatatttagaacatggttgaattatcgtatatgaatgcttgtaaaatttcttagaatgaatagttctaaaaagtagatcacaaaatagaatatcatataagctcaacttgttaaaatacatttgtatgtttcaaatatagtaagtatgagtctataatatcatatacggtatatgtgatttctgcaggcattgaacaaaataggactttatgagattacatttccttttagggattggtgatattattaatttttagttaaatatgattaagcttattttataaatggtagaattttctttgaccttcaattcatagttcttctgctttttctcttaggattcatagctttccagttcaattagattaaaaagagtttaaaaccaaaacagataattcaggcctagcactgaattgggttttagggtttttttgttgttgttgttgttttgttttttgttttgttttcttttgtttttgtctttggttagtgtcacaataatataatcttcaaggaatgcatcatgaatttctttgggttgtttttgcatagcaagttattagtttgcaaaaggaaatagcacttcttcagggttctaaattttggttttataaacaaacctactcttgtgcttttatgagttgtaaatcttactgtatgtgatgtattattagttaattatttgaaacaaatttctcttaaaatatccttaaaagatatttataggagaaagatctttgataagaaaaatcacttccttattaaatatttttaaggtgcaagggtttaaacttagagacttgtatatgttaggtaaacactcgaaaatgagctatagctccagcccttgaataatttttttttgctgggagttgagtggattttgaacccaagagaaacaatcattaaagaaactatatatgagtattgtttatttaagaatttcattattcaaaataatcattctctgaagattcattgatttttactttatgtgtctgtgtaagtacctgcacatatgtatgtatgtgcatcatgtgcatgcctggtagctaaggaagccagaagcaagcatcagatcccatggaactggaattacaagtagttgtgaacaacctgatatgggtgttgggaaccagaccctaggtccgctgtagtagcaccaaacgcttttaactgcagaggcatcttggcagctccatattcagtctttagaattgaggttaatgttttaattgtgtatgcaagcaattgagttttagttctctcaatgactttaatgtaatatccttaagtattttcattacagtggcatgatttgttagatagtgatgtaatagcaatacatagcttataaaggtctttttccttttaaggcctccaagacatatcgaattccttttgtatgctatttgcagtgattattcaatatctgttttggtggcatacaatataataatggcagaattttaattgtgacaatctattctgcttttctagttattgttgtgttgagcgctttacatatgatctaatttattttaaacctcttataagaccacattaaaaaaacgtatatatattgttttgcatttcaggctgaaattctgtgctgtgatgtgcttaatattttgaaacccaaagccacattatttctcctttttcacttatatatggtgtccattaggcattgatcttgtcccgtaatattaactttctttaactgattgttctgctatctgaagagtcttattaaaatttaataagtaaagtaaaaataagcagctaatgctatggtacattctggtaactcataaaagaaagaaaaaagaaggaaaggaaagtttaatgttggcttgtgagtttaaagaaaggttaatacatccttactggctaattcaatcgtatctttaaaggatgaatttttgacccttgagatatgtataccacttacaggtaggatccatgtctgtttatgcaaaatttagtgttttatcctaagagcactgaactgcgctaaattgcatagcactaaaaaacaggctaaagaccatctataccctgttttatttcaaaaagcccttctggactgtgactatgggtaacatgtttcttgacctatttcttttttgtggtttccttccaatctactaaaaagattcagatcctactcatgtgttttgtcttcataatatcccctgccccttcccttgtcttgttcttgctttagaggttcattttcattactacttttctagttttcattctcaatctttatatactggaagagataactattgatattcccacttgatgttctttatcttttaaaaattattatattttgtgtgcacatgatatttgtgtgtgagcacatgcacatatggaagtcagaggacaactttttgaagtcagttctcttcttgtacccttacatgggttctgaggtttgaagtaaagttgcccagattgggtgttaagcacctgtaccccttgagacatcttgctggccctctttgtcttaatgactcttctactgctcaagcctttgttttcacaaagccatagggaacatttatataattatgactgtttgcttattttaaaagtatatgttccacctggcttcctgtctcatatatttgggagtttgaggtaagataaccaagagttcaagaccagcctgagctacatactaagtttgaggacagccttgcttatgtgagaccctgtattcaaaaagcaatgaaataaggccagtgaagtgtcagtggataaaggtacttgccatgtaggactggtgacctgactttgttcattggactccacataaggagaaagtggagtgctgtctcaacaaagttgttctctgacctctaaacatgtgccatgacacaaatggctgcaaatacatatcacatgtgcatgtacacatgtgtgtgcatataaacacaaataataaactaaaacatttaaaatacagacaaaaatatatacttcagtggatatgacttgaagcaaatactgtacaaaagatctccaaaagaccagttaacacatataagtatgttcaaatgtctcacttggttaaaaaaaaataatgtacagcatgccactacttccttctatcagagtactgaaaaaaattttaaaaaggtctttaagaatgtataacaactggaagcctgttggtacttgcacagaaagatttttttatacaaataaagcttaatgtaggtatgttctatgaaacagtaattccaggagacagaaatgtatacagcactgcttatagcaaacttatatctaaaataattcaatgttcatcaatagtaaaaaagtttaacatgcacctaacatagaatcagtagtgagaatgaatgtattccaggtctgtggaacaatgtgaatgggtttcaagagcatggtagtgagcaaaaaatgcttgaactaaaggactccacactaatgccatttttgtgacattcagaaatatgcaaaattaactgggcatgttatcacacacttgtaatcccagcactgagcagaaggaggcagtgttgaggcagaatgattatgtgtttggagccagctgcaaatacagtgagttcagggcaagattagggtatatggaaaaaccctgtctttactaccccttcatgcaaaactcatctactgtgtaaaaattagctgaataagcctagtcactacccttgctagaaactaagaattggatatatggagggctagtaggactcctccatgaaattttgttctgtgtcttaatctgcacgttttggtgacatgggtgtctttattctgtgagaattcagcacattatattgttctgtatctttgcatattttggttacaagggagtgtttattttgttagaatttaacaagggatatgttcatgatttcatgcttttctttttgtgttaccagtctgctagctgtgatccttatgctctattcagataaacattttagtagatgatgaaatgtgtatctgttgtttgcagttgtgaacctttaagtgttagtgctgtgactgggatagaagacctagaagcttccatccacagtcctgggagtcagagttttattgttccatgttttaaactaagaaacatacagttaagtaccaatggccctggcactctacagatccttggcttccagcaacagtgagttccatcataattcagaatctgctagtattaacctctttaatgggtattaggactatcagcacctacaatggttaatattacagctcttgagcctaaggctgtagaagccttactagcattacagctgataggcctagtctgttgtaactcgagccttggtaatgtctaatgttaatactcaggccttgagtgttagggtacttggcagttccttaaaatgcttccaatggccaagaactttcttgcaccccttcaccaacttcagccttgtcctcttctttctctggaagtctacatctgtccccttggcaatgtagcttctgcttctttcatcactgctgcagctccactgctgcagctattatatgctctttgtgtttacaatgcagcctgttctaatgacaatgtttaaaagtagacaggaacaatatagagaagccttttaacaggctcaatgttgcaacccccaggggaaggaatccctttcccccacttcctctctcctccagatccacttcctctgtttttcttcagaaaaaaagcaggccttccagagatatctaccgaacagagcaaagcaagttacaataagactatacacaaatcctcatagcaaggctagatgaggcaacccagtagaaggaaaaagcaggcaaaagagaaagaaacagtccccagccccattgttaggagttctacaaaaacactaagctaacaaccataacatatatgcatgcaaacctatataggctccatgattgctaggttgactctgtgggctgtgtccttagcctttgaaccctctggctccagcaatcctccctctctaatcttccatggggctggagaagtactgggaggagctcagggcagaatatattgtatgagagaagaataaataaaaaaggaaaaagaaaagaaaaggaaaggaaagaaaagaaaagaaaagaaaaaagaaaagaaaagaaaaggaaaggaaaggaaaggaaaggaaaggaaagaaaagaaaagaaaagaaaagagaagagaagagaagagaagagaagagaagagaagagaagagaagagaagagaagagaagagaaaagaaaagaaaagaaaagaaaagaaaagaaaaagaaaaagctgttaaatgccacctactattgctatttttaaatttataaacctttagatttactgactttttcatgtgtttaaatgttttgcctgcaccttatggatactatatgcattccaggcaagtcaggaggaaggccttagatcatcagcaactaaatttacagatggttgaactaccatgtaggtgctgggaatgaccctgggccatctgaaagagccatcaatactcgtatcactgaggtgcccatacttttaattcaagaaaacattagaaggagtatggcaaatcaatataaagttagcaaaaactcaacatagaactaagattgctaatacatgtaccaatagttaatagtatttaacaatgcttaacagtgattgactccttcactagggccccaaatggttgggtctttcttacctatatgtatgctccatttaaaagtattgcataaaaatgatatgtggtacattatctatgttatcctgtacattaaattttatcaaggcctagcaattttaattagcagatgtgtttttctgagaatcagtagttcaggagcagtataactgggtgattttagtatagcatattcctttcatatgaccctcaagttgtcagggctacagtcatttgaaggcttaaaaaggtttgagaatctgcttcgaagatagttgactcatatacattgaggtaagcctcggtaaaagctgtttgtattaaccaaagctaaagtacacacatactctaccacacatggaggtaacattttatatacaatcttacaatgggattatacaaagtttaagcccattgtgacttgaaaatattttaagttgaaaatgcagttaatacttacatccaccccattacagcaatagagtacaccaagttttgcttggctgactggcgtctgtggctcactgctactgcctaacaaaatcaagcgaggatcagatcatgtatcaccagcctggaatgagatccagattgagaattcacgtacattttcttctgaaaggatgtatctttcatacagttatgaagttgaaaactagtaaatcgatctattgaatgtcaagaaccatgtgtataatgtttcacatatatgtatatatatttatatatttaatatatatattaaatgaaaggatgtcacaattatactatgtagaaacctttgtatatttttgtgattagattatttatcaatttagttcagctttttttggtatccaaatttattgaggtgtaattgatgtaaattgttatcatatttatgtatgaagataaatttggaaacattttgaatgtatatatctacccacaaagttgttttcacagtcaagctagtgaatgaataagctgtcacactcccatgccttctttaaaaaagcttttcctttgtaatctctcctttcattatttattttttgagaaaactcctaatgtagcccaagactggccttgaaatggtgctttttttcccccattggtgttcagattaaaggccttaactgacctcattatctgtgagtaaatgttctccctcttcatatacatacatacatacatacatacatacatacatacatgactttgtaaaatatgtggcatatttctttctaatagaattttattggggattgcattgaatctgtagattgcttttggtaaggtggccagttttactatccatgagcatgggagatctttccatcttctgaggtcttctttgatttctttcttcacagacttgaaggtcttatcatagatcattcactcacttagttatagtcacaccaagatattttgtattatttgtagctattgtgaagacattgtttccccaatttctttcttggccagtttttcttctgtataaagtcaattttgtatctggccactttgttgaaggtgtttatcagctggaggagttctctggtagaattttggggttcacttattatgtatactagcatattatctgcaaatagtgataactgactttttcctttccaatttgtatccccttgatctccttttgctctctagttgctctagttaatgattctctgtttaaagcctatgggtcctggggattgaacttgagttgtcaggctttatgacaactgtcataacccactgacctctctcactggtcctgttaaatcattgtcacatacaaattcacttctctgcctaatttaatactgtaacaggagaatgtctcagcaggaatctttgaaatgtaaatattttcgcttgtatatgctatagaaagtctaatgacctctgccatatgatatataccaactattatgtcataaggaaattagtaaaaagcgagtaccagaagaccagaagtgggtcttgcataatggtgtacttttataattcaacttggaaggttgagtgagccaagaggttctcaaattctagatcagccttggctttatagtaagatcctgcctcaaacaaacatacaaatagcagcaataaaagcaatggaaatacttaccttacactcttattattttaatagtttatgctctttcctccctaattgtctttttggttgtcggccaatattgctcattatttaagatattgtatattttacttatttaaatgaaatggcacagaaataattttatgtttttctctgtaggttgtaactttcatgagatcagagaatatttttgcctgtattgtatactgttgcactctgagagacctagacatgttaacaagtaagcattatatatcttagtagacagatgtttgttgaattgaaaaggtgactgtactgattttggtgtctgttactataccctaagcttaggaaaactggaaaacaaaatagaaagtgctctttgtttgatcctataacttggctagtattgtgccacagattctacaaggtatctcaaaattcagtaatatttgttgtgatttttggcacttctacctaaagcaactatatgcatacatgtatgcatgcatagatatatgatttagtacatactaaatttaaagaatctatagtgttatggtactttgatgtagtttatgtttttttaaaaggtaactattaatacatagtattcacttatgacatatatcagcatttccttcttttatgtgagttaatgcaatctttttttgcactgtagacaatggatctggtgaagtgaacattgcacaggaagtagctaaaggttagtgggatttagaagaattcagcaagctcttagggagtcggttgttttatgaccacaagagcattgcttaatggttttcaccgcagttagaacagatatctaaatgttgtgccaactcataatgctttgtaccattgattttcatctttatccttctctcatttactgtgctaaagttgtattggacttcttgtttttctctatttaagttcctttattaaaccttaaaaatataatgaacacatgaacacacacacacacacaccttcacaaattctattctttcctgcagcagtgaccacttgtgttacttgccattaaatctctaatattcaggaaaattactgaaacatgatattaagtaaatatttggttttggctttgagacaagatctcatatattccaggctggccttcaaattgctatgtaactaaggatgacactgatcctcctgcctgcacagcctactgctggaattataagtaaacatcaccatgctgaggtttgcatgggcctgggaatcaaacacagagccctgtgaatgctaggcaaacagtctaccaagtaaacatctcttgccttaaagtaaataactatttaatgattaaagatttgactgaaagaatgtcagatttgttgtaagaaaatgcatgacaagatcttgatctgtagtaacactggtgttgtattagtcagctttccttctctgtgatcaaatacctcagaaaatcaacttaaagagggaagaatttattttggtttcagaagcttcagtccatggtcacttgactgttgtttctctccttgtgataagccagtgggtgtgctggaagaatgctgcactcttaaggcttccaggaaacagacaacaacaaagggtatagagataggatgtgttcctttgggacatctttatttcatgttcttttgggacccatttcatgccactggtttcattttctaaagtttttgctacctttgagtagcaacgtgaccaagcctttaacacatggtttttgtggttcatttttttttttaatatccagagcatcacaagtgtctccgtgaagattagcaaattacagtatttcagtataaatgcattgagacattaacccaatcctgaaatgatcttaactattagctgtttgaacatgaggaaattgatttcttcaaaatgtattaatagttatttttctttctacattatagagttgttttgggccctgataagtgaaattgccttaaaacagtgcacatgtatgcagcatatgccagctgaacctttattatttgaaagatgtggtatcaggaagaatggaaagccgggggtgggggtgggggggaatgaaacttctagaggcctaatagagtaaatggttccaggtgtggttgtgcaggccttgagttgcaccattagggggacaggaggatctttgagttccagactaaccagggctacgttgtataatcatgtcgcaagacaaagcaagacaaggcaggacaagacacatcctttctcttacagaagaaccctctgacaactgaagatatctatagctttaggaaagatgtcttaagaatggaaggattccagggattatcttatctctagcatgtgctacaagagctctttggccttctaaatcttaaattagaagagccatgggatgtggtaaagaaattaaacattaggactataagcatggtggccagaggttattgtaaaatgaatcagtgtgcaggggagggctgagaagtaagcagtttgcccaactatctatgacatccttgtagtttaaaactaatgacagtgtggatatgtatctctgcaaattaaaatatgtcctgcagtgttttgaacctaatagctaactgtagttgaatctcagaggattattagaagaataactacaaggaataggagactggggaaaagagggcaagtatttgcagaaatgacaaaggatatagttaaagaattaccatccccaagtttaatagttataatagctgaagaaaaatcaaaaatcaaagtttcacttgtaaaataaatattatgctaccctctcttaagctgttattattaattctgaatgcattgaaccatagtgaccacatgaagagaaagccagaagaaccagatggaaccaaagcatttgggtagtaggtgttaaacctaacaccttcatgatcctactcactgattccaagaactgttgcagctttttcattcaaacttttctcaaggcctatgatgctagagatgctttgataatcccagtatggtgaaataaaggtttaaaagggtaaatgagttgcctaagaccagataggagttggcaagccaggcacaaattctaaaacctgaactgtgatttcaccttttgttagaagtctttattaaactgtattttacccaccatttatttattcacttacttattttctcttttataacttagatcttattacttgtcaatcagtacacagacatttcaattcttttagaatgcctaagatacatacaaaaattcaaacagccatgctcctatttaagttttatgtatatttattttattattttattcatgtgttttacagtatgtgtatctggtgcctgtgaaagtcagaagagggggtcaaattccctgggactggagtccccatttaagtattgagagttaaatccacgttctctgcaagaaagattgctcttaactgctgagccaactctccagctcttgtgttattttaaacagttgcaaaactgataatcccatttcagatttgtccacaaattttccttaacaggatctcacatgactatcaaatgctcataatcttttactttcactggttcacaattttatttcacacatcccatatcctcaaattttctttcttccagagcattatcaaaattgaccaccacaaccagaatacagggtagacagttctaatagggaaagaaccaacaaatgttttcactgttgtttgtttgtttgtaaataattctgctaaaaacatcaaacaaacaaacaaaacaggagacaagaagtaattcaaactaatctagatgtaaatacatgactgtgactccgagttgttatttagtatgctttgtactgaggaatataaaactagttcctcttgtggactggtttgcttgctgaccctgagacaatgagtctctctgattcaatatcctgctatcttctggttctaccttagagtaagcaaccagtgaatgtctttactcttaaaacttatttacacttaaaaaaattggatgaggtagtatttccccccttttaaaaaatattgctagagctcctaagaaactcacatttacaaaatagttaataatattcctctggcttgttgaaccaggaagacaggaagtactgagagacatgacacatgatcagttggacttggcttctttctcttcagctttagaggatggactctggttttcagtgtctcccctttctacaggcaaatctttagtttcttggcctgtttgccttttgctaccctttcccattttgtttgacttttttgtctgatgtcgtactcttactgtgcctgtgctgtaagaccatgttaactattctgctacagtgaattatttgcttaatatcatacaatgagtagctaaaatgatcagttttgagcttatcattttcatttaggtatttgcagaatattttcaagtgctaccttggcaggagtgccttagcttaacaaccttacaggggagggggggcacttaggctccttcttgttccttccaagatgaactttcccgtgatcaacatggggtttgtgaggccacctaagtggctgaagaactacatagaacaggattagagttgtatcactgcctctcagtttccttctccctaatactgcattggccagttactccagtctttggcaaaagtgtccctgttattatttaagaggcaatgtttttctgtaatcattactttttgcatctgtctatcaagaaatatatatatatttatatataaatattatataaattatatatataaattataaattatgtataatattatgttattatctatgtatatataaacattgctctctctctactttaaacatagtttaaaaactacaaaaaaatttgcatgttgaaaagtaagcataccgcataattttcaatgtctgcctgtctgtctaaaattagagaaaatatgaaaaactatgtataattgttttaccaaattgaggatattttaactcactagactataaaagagtctcacaatttgcctgatattattatgaactgattatttaattgttagtcaaactgtttagtgtaataaaatgttatttggtatttagtaagttaaaataatagcacatcccagatattgatgtaaggttggtctagataaacacacacacacacacacacacacacacacacacacacattagtttacctaaagtattatgcagaatatgatatttctgtcaagttttcatttctaaattatactaacctaccgaagcaatgaaatttaataatttaaaacacaagtgtaaactgaataaaggctgaagtaagaatgtagtctaattgaaagaccattaactatgtgtagatagatgaattttgcaaaagaacttaacattggacactgggtagatggctcagcatttaaaggtaatttttgttcttgcaaaggattcacttctgaactatctgaaacgctagctttaggtgattcaatgccctcttctggtcttcttgggcaccagacatgcatgtgatacacagacacatacaggcaaatcacccatacacatataaaaagtctaaaatatagtcagtgaaatcttaatgttatggcttgtatatccttggaccagggagtggcaccatctgtaggtgtggccttgttggaataggtgtgacctggttgggatgggtgtgtcactgtgggtgtgggcataaggtcctcaccctatttgcctggaagtcagtcttccactagcagcctttggatgaagacatagaactctcagctcctcctgcgccatgcctgcctggatactgccatgttcccaccttgatgataatgaactgaacctctgaacctgtaatccagccccaattaaatgttgttttttataagacttgccttggtcatggtgtctgttcatagcagtaaaaccctaactaatacagaagttggtactgggagtagttctagagtaacagaagtacaaggatgaatcttttaaaatactggaattggcttgttgatccaccagcactttcaactactgaaacctctccagattctctccctcccgggagctcagagaattttgaagacccatggttgaaactatatttcaaccttaaagaagctaatgcccttgattttcttgatgaattaggtgattcagtgcacaaagctttctacaagatggagaaaaaaaaatcagtaaatgattttactggctggctgctcttagtatctgcagaaaaaatgatgaatgaaaggaaggagttgtgtgataaaatcgaaaggctccagacacaagtaaacgatctaaaagttgctaagtgtgtccttgaagtttcgaatcttctctcttgcagcaatagagctcaagttgcagaaaatcaaactgaaaccctcattgtaagtttggctgaactacagcaaaaattcaagtctcagcctcagagtgtgttgacagttgaagtaagggcactgattggcaaagaatggaatcctataacatgggacatggatgtgtgggaagaccatgttgaagctgagaattttgaatcttcagattctcaagggtttgccccacctgaggatgtagtaccctcagccccaccccttgaaataatgccttccccacagagtctgataaaccagcgatgactttcactgaagaaaatgccagacaagacaatgctgatgtttttcaaggcccaccaatagtttcttctagacctgtaaccagacttaaagcaaaacaggctcctagaggggaggtagaaagtatagtccaccaggaaatgcactacactactaaggagcttagtgagtttgctaattcattcaagcagaaacctggtgaatatgtgtgggaatggattttaaggttgtgggataagggtggaaggaacataaaactagagcaggctgagtttattgacatgggccctctgagtggagagtctaggtttaatacggaagcttgcatagttaaaaaaaggtgtcaaaagtttgtttgaatggttagctgaggtgtttatcaaaagatggcctactggaaatgacttggagatgcctgatattccgtggtttagtgttgatgaagggattttaagacttagggaaattgcaatactgtgtggaataccatgacgatagataaggcattttgtcagtccgtgaatggtggttttagcagaggcattacatgcaggaaaggcaaatccataaccagaataagtatctactccagtaagaacaaaacgctgtcctttccacgaaggaaggggcccaatgtagtcaacctctcaccaggttgctggctggtcacctcgaggaatggtgccatatctggggctcagtgttggtttctgctgttggcagatctggcattcagcagcagctgtagccaggtcagccttggtgagtggaagcctgtgttgctgagcccaagcataacctccatctcgacctccatgaccactttgttcatgtgcccattgagcaatgacagggatggctggggagagaggctgactgtccacagaacgggtcatcttatccacttgattaagttggtactgggagtggggtattgctgtgataggcctgaccatgcttttatttgaaagaatgtggattttgggactttggatttggaatgcagtggaatgctttaaatgtggcttaatgggtcatcctagtaggaatatggaagacttagttgctgggagtaatttgaactgtattgacctggcccaagagatttcaaaggagaagaatttcagaatgtggcataaagactggttttgtggtattttggtgaataatgtggctactttttgcccttgtctgaaaagtttgcctgaggctaaggtgaagagacttggattaattgcattgacaaaagaagtttcaaaaaaagcccagcagagactttgttctctggttaagtcttatgaagagaagtttaaacaagcatagcaagcttagaaaggaaaaatataaaatatatggttcgagtattaaagggtaccaggaagtgaaatggaacaaattcctgtgttctagttcctgtaagcagcagaactcggcagcttcagccatgtggctctggctctagagttaagaatggaaggaactactgggaaaattgatgctggttagctggagctaaggaattagcagtgattaagaagagaccagcatcactgaggtgaaatcttctggaaatttttttctgagagcacaaaagaagctgtgttccagagatacccaaggttgtacctcatgctgcggctggacttggtaatgtgtaagagtcactcaggtggtactgcttgtgaaggaatgaagggatcatggagagaagctgaggcttagcactgttagaggccagggaaggccattggagaaggtgaagcctcagctgtagttgatgggccaggactgaaggggtcatgcaaaggatttgaggcttggcactctgaagagagcctatgagagtctattggtgaagcctagttggagtggaataccgcagtatattggagatgtcagtaccatggagtgatcaccaagaactaaagccgtagtggagtggatccacctgagcttagagtgctacagagggcagagctggaaaagtgatgtcagcccttaggaggtgtccaaaagatcaaatggaatcccagacactgaaacaagaagctgtaacattgaaattgccttggagactcaaaaattttaaagatgccagagccatgggatacatgctgaggaaagctgctaacagggagtgtaaccagcccaggagaaagcagtttgttgcagtcaacaaaaatgaaaaaggagtagagatctgaagaccgctttgacatcagccatggagatgcagagtttggagtttgcccagctcgtttcctgccttgctttggagattacagttaattaagttgaatgaatctcagaagagaccttgaactttggacttttaacattgttgcgactgctatagactatgaggactttgaaagttggactaaatgcattttgcattattgctatgtttaagtatggcccccatagactcatgtttttgagcaagtctatggggaccagggagtggaatatgatggtttgtatatccttggatcagggagtggcaccatctggaggtgtggccttgttggaataggtgtgacctggttaggatgggtgtgtcactgtgggtgtgggcttaagatcccatcttgatgataatggactgaacctctgaacttgtaaaccagccccaattaaatgttgtttttttataagatggtgtctgttcacagcagtaaaaccctaactaatacacttaacaacccttaagattgattaatatggcatatagatttactagcgtttttaggtactattctaaactaagggaaactaaggcaaatgttatatttcctgaatatatttgttaagcaagcataccctaaatctgtttgtataagccattatatctttcattgagaataatcttttaccctgtagggaaccccatacatgtatagtagaaatattaattactttgtgagaattagtctgatacacactataaagtatttgtatctatctaggctaaatttcatacaacgagttcaaagaaacgattacatcttgatcaaataataagggaaggtgtcactacttatattgacgaataattgatttttttttatttttctttatttacatttcaaatgttatcccctttcctgatttcccctctgaaaaccccctgtctcttaccccctctccctgctcaccaacccacctactcctgcttcctggctgtgacattgccctatactggggcatagaaccttcacaggaccaagggcctcttcccattgatggcagactaggccatcctctgctacatatgcagctagagccacgagtcccaccatgtgctttctttggttggtggtttagtcccaggaagctctagggggttactggttagttcatattgttcctcctatggggctgcaaaccccttcagctccttgggtactttctttagctccttcactggggaccctgtgctccattcaatggatggctgtgaacattcacttctgtatttgccaggcactggcagagcctctcaggagacagctatatcaggctcctctcagcaagttcttgttggcacccacaatagtgtctggttttggttgttgtttatgggatggatcatttctgtttctgtatggtcatttcttcagtctctgctccaaactttgtctctgtaactccttccatgggtattttcttctcccttctaagaaagatcgaagtatccacattttggtcttcctttttttgagtttcatgtgttttgaaaattgtatcttgggtagtctgagattttggactaatatccacttacttatcagtgagtgcatatcacgtgaggttttttttttttttttttttttttttttttgtgattgggttacctcactcaggatgatatcctccagatccatccatttgcctaagaatttcacaaattccttgtttttaatagctgcatagtactccattgtgtaaatgtaccacattttctgtatctattcctctgttgagggaaatctgggttctttccagcttctgggtattataaataaggcttctatgaacatagtggagcatgtgtccttgttatatgttggtgcatcttctgggtatatgcccaggagtggtattgctgggtcctctggtagtaatatgttcagttttagacaattcagataaaatagagttaaaactcttcaaagcatatttaaggcgtgactggagtctgttttgacagggttgtattatagggagatagtttcccttctatatctggctatgtaagccacagtgtccccaaactcacagagatccacctgcctttgcttctggagtactgagattatagacatacactaccacttctggttgaagacattacttttcaggaaggcaggatctagttatagagagagcagtgggtctcacttttcccaatgcttcgaccttttaatacattttctcatgttttgatgatgcccagccataaaattatttcattgcttctttataactgtaattttgctactgttaggaatcataatgtatatatctgatgtgcaagatatttgatatgtgacccccccaaggggtcatcacctacagtttgagaaccattgttatagagtttatttagtgcaatgtaatgtaaatatgtggaagactgattagttttattttattttacttcatttgagacagggcctcactctgtaactctgactggcttcaaattcacgatgtagctcaggctgcccttaaagtcacagagatctgacttctttcgctgggataaacgtgtgccatcacacctagccctatttatatttcttaatatttggccaaaaggtactttgctaattgtttgtgagtatattgcattatgtaggaaatactatttagttttttcaaacagaatttttattataaagagctactatatttctagtgcatactgaattatttttggcagttaaaatatttcctaagggaaaaaatcttatggctaatatcttctctaagttatattaggatgaacaaaataatgcattttatatgggtaacaaaaagtgtaaacaattgacataatatcatatataattatatattactattctttatatttacatgacacattttaatgattgcttaaataattaaaaattaaatgaaataaaaataatagttaaataattcacaattatctagtgctttaaacaagatgtaccttttaaaattttttatttatttacatcctaagtgctgcatctcctccatgccccttcctcttctcttctgagaggtttgcccccacttggatgtccccaggcacatcctctccctctgaggccagacaaggcagccctgtttgggtatatagataccgcagtcaggctaaagctttagggagagcttctgctcctgttgttggggaagagggggctgctatttagttttaagatagggatctatctgagaaacaagatttgagtagtcctcatgtttagagaagtataaacctttaagtgctccccaactaccaccacctcctactgccccacaaacacctctcaaatgaaaggagatgagagttgaaggaatttcttaaaccttggcaacagaagagagcttggcttggcttagtaggctctgtaccctgtatatatgaggaaatcattttgtttaaaaccagagtctgattttttgaggtttgcctctagatgtctagatgaggtggctgacaagcaaatattgacttctgcttccttggtttcatcttctccagatgactcttcttaccatgctgacctctggaaaattctggccttgtctcatagttctttctttcctttgtggttcccactaacaacagaaataggcttttttttcctaaagagattgattacataataaagaagaaaaggcaagaaattaaaaaaaaaaaagaaaagaaaaaaaaacaatgaaatcaagaaatcctgccagattttcttttagcatctttgctatcattgttgccagtcaagctatccccaccccttaacttttccttccccatacttgccaatgattgcctcttaaaatccaacttaagccaccccactatcaccctgcttaactctttcaagtcatcatttttataagaatggattacccttcattgtactggctttttcctaaagccttcccagaataatttcacttgaaaggtcaagaggcaactggagcttcaaacttctagtttctgatgacagaatatacagaccacttcaaggagaaattccagtgagtggaacaatagttcttaccctaatttagcttaaataacttaaagtgtcaacctatttattaactagtgtttttcataaaagtttgttacagttttttgtccatatattagttatataatagtcgatcttattatgacaatttgatagataggtataatgcattttggctatatcacccttcattaccctttcttgttcacctcccactttatcagtccccttcttccgaactactaatcattcattcattttttttttcctgtttaatttgcttggtgttttaatgagctcacaagacctaacccttgtctgtataagattattttgaagaacttcaactgatttcaaaagaaaatgaaatgataagaaatgctttaaagaattaaacgttggtatcacttctcagccttttggcaaagatcgagtgaagaactgaccctgaaaaaaattttactcataaagaatgccaaataagttgaacttttgctacattttctcgttatccaattttaaaattttatatcatttattttgtgtgcatttgtgtatgtgttcctgtgcctgtggaagtcagaagaggggtctgatctggaagtagaattaaggatgtttgtgaccaactatgtgagttctgagtatcaaatctaggtcctctgtaagaacaataattgctcttaaccattgagtcatctgtccagaccataatttttaagtaactgaaaagtttgttgacaaggaaacttgtataggtttatgtcagtatttcagatatttattttatcaaacagccttcctcgcttttgaatgacataatttttaataccttataggatgtccagaacatacttaaatgcatgcacatatatatgacataatatatattatataatatataaaataagagtatatgagtatatgtagtttgagaaacccacatgtagcacatttccccattttgtgaagaatttgaaataaataaatggtttatttggtgccacacctagtgatcaagtttcagtctggcatttatttattgatttctcctactgaatttcaagtaaggttcctaatgggcagataggtcatattttttaacacacacacacacacacacacacacacctctgttcagctgctgagctacacattaagagcttgacacttgacaagtgattgtaaataatagcttatggtttgtatgtcgaataaactaaagaattattcatatgcattggcttatgcatatgttgtatgtttatgcttttttcacctataaaacagaatatctattttgctatgtctacttttcttccatttccactgcaatttgtgtgctttctgtaattctcttttgttgttgttgtcaggaatccatggtctttgattcatgatgtttattggaaataactctgggatgctttgcctcaaggataatttgatttggggaacctctgtttgacatcattcaggaaaatgttacactgtaaaggatattgtacttgtcacaatgataatgaagggaagatagtgacaagaaagctaataatatggcagcctgattattaatattgagcctttggtatttttgcctgccatcttttgttgacatgactatcctcctaaaagttaagcatgtgaccaatttgatgaatattattttgcagaagcaaaatctattaccagataaagaagatgagagtaagttgatatagacagcctgagctttccagaatactctttctgtcctctgagtttaggtatctgtggtcgagaacacagttttgtgagggagtaagattaggatgcattgaaataaaatgctcacactgactacatcagctgtaatggggcttatctgatgttgtgactcagcctctgtgaatctcattgtgtatgtgctctgttttgtacagagaatcatcattcaagacctgtcagaagctacaagcgaaaaatgggaaggggtaagtcttccctattaaaattttttagattctcctgatggtaatctagtgtaacagagaaattatgtctagaactgtgtttgtagatgcttaaattgtgtttttacttggtgttagaaaattttgtctgattcaaaattatatagaagaagaccaatataatatgtgttattcactggttctttttttgattttttattaatcattttactcgtttacattttaatgatatccctcttcccagttacccctccacaaccctcccatctcattccccctcctcctgctcccttttgcctctatgagggtcgtcgtgcacccattcacccactcctgcctcacccttctagcatctccctactctggagcatcaagcctccctccctttccattgatgtcagataagaccatcctctgctacgtatctggagtcctggttccctccatgtatactccttggttggtggtttagtccctgggagctctgggtgatccagttactagatattgttagtcttatggggctgcaatcctctttagctccttcagtccttcccctaggtcttccattggcgtctctgggctcagtcctgtagttcttttatttattctgatttttggttttggtggtggtggtgctggcagcacaaatatcaaagatggaagtggtggtagtggtgttggaggtatggtgtgtgtgtgtgtgtgtgtgtttgtgtgtgtgtgtataatagttcaaatttgttatgatgtaaatgtcctcaaattccaacttctttataactcctgccaaaattacccttatgccttgatcatatataagttttgttaatagtaacacaaatggtctgactcagtcattaacaacacttactgctctttcagagcacctggtttggttctctgtatctacatcaagcaccatacaactgactttaactctagttttaggtgttccagcacactgtggcctctgtaggcatgtatgtatacatggtgcacacaaaatcattgaggtacacatgtattgatatacataaaaataaattacaaatttttttaaatgtaaaaagcaaatatagtaatataaatcaaaaggtactattatgcagtcagtgttttaaatattgtttaaagtgggaacaattacatgaaatctttgtgcttattttgggtttttcataagggtattatggatcttggacaatagaaatatttaagttcatttcgttactgatatgggccatctgtcacaatgactttataaataattctagttcgtataaattataaaagcaacgtgctataaaggatactaagggaaaatgttgtgtggagtactatgttaaaatttatatgaattcagagttttgaaggcctgaattcaaattctgtggctactacttcagctaaatctcaaagctttcttaaatggaattttttgtcatctttgaggtagaattaatgcatcctgtacttgtaccttcaggaggatatggttagcataatgtgactaatatatgtgagtgtttagagctataatgtctaatagcatagaacatcagcttattgctagcttttgaatacgtatatctttatttgaccttttattggttcagattctataggaagcaacagagcttggggtggggctctgaagattactaagatctctgccttaagttgcttgccttaccatcatgtatgtttacaggcagcctctacatctcagctcactcataggaattcttttcgcatgttgttgttgctcttatgtgctccagagcttcctttggaagctgatttgttttagagatccagattctttccaaacattctccaaccatttgcaattttttacatgagtaataattttaaatacagtaagacacattttaggatgaattcatacttgctatatcctaaagtcagcttccagagtatctcattgcttgatccccactcaatccacaaagctataggcagatttggagaattccttagctgttggcatctattatcaccatatggaaaagggctgcatgaagtcaagggatctattttttccttgcttcttcttttattttcagactgatcattgatcaccaacaaaggggcctcctttaaaagatgctagagcaaatagtgattcaagctcaggcaaataatagaacacagcacaataatgtaatgtaatctgctaaaatgggcatatttccaacctggagattgaaaaagggaagtgcgtcacataatgctgtttttacaaacacaggaagcttgtgatagctgttattttgaatgttggtggtgaccaccaaaagtcaaagagacatcacccattattcatcaagctttgtttaggtttgcttggttattggttaattgctgctacttttagtggaaaaaacaaaatgttactgtgtatacgcatgactttcttttttggtactgtataaagaattgtgctgcatttagtaaacattcttacaaataagtcaatatgttatacaacaagatatgattggaaagatgtcaccacacttgtataaaataattaaaattaaagttaaaatactattctttaagaagaacaatcggtacttcataaatatatgaaacttttttattcatgggacattaaatatcataaagtttagatcattgaaatagaaggaacaagactatgtagtttaattgctatagtcctaacctagaatgtacaaagccctggatttagttcctagcactgcaggtacagttggtattcctagctcttgggagatgaaggctataagaccaggaattcagatcagccttgaatatatagcaagtctgaagccaccctgtaattcatgagaccccaccacaatgaaataagagggcaggtaaagaaaagacatgtatatatgtgaggagcaggtgtggcagcagtcccaagatggcacccaggactgcagccaagtcttatgacttgcacctgacttcctcatacacctcgcgtccatcgtgagaactgtgcagttgcaccatgatgcaagatcagaccatatgacaagtgatgattctggccaatggactgctgttacgtggactgggctgatggggcgtggtagagaggttatataagggattgtgattgggggtggaaaaaagagaagagagatttttttcctgcatccatgttgaaaggttcctgaaaaaactgctttgagaaggacgctgtgtcgtagctcttttctgctggttggagacagaagcgacaaatggtggctcgtacggggatgttcagaactcattgcagtcagggcagctagctggtaagttcccaggtaagtgggacaagttaagttctcggattgagacgataaggctcccagttttgggacaagttgcaccaagcaccatggtaaattcaacctcaggtcaaacagtgagctaagcccttaaggacttgctgaaagtgaaaggaatcaggctaaaaaaggaggccctggagaattttttaaaaacagtggatcaggtctctccttggttctctgtatcaggacatcttacagggcccagttgggagaagttagggaaggacttgaagtttgcaatatccgagattgtgtagaatctgaatgtaatttgtcaaattgagcatcaaactttttatacagaagaaaatagggaagttaggtgacacatcggcaaggtacaaatgaggttactggatgcttaatgactcttacacaaaacagaggaatgtaaacacaaagactggcaggaactgggcaataaaacaactgagacaaagtcagctctatctaaggtcagctatagtcttagaagccaggtgtgaggtctttacactcctagggcaagggcttttacacccaagtcatctttctaattagggagttccgctttagctaaccatctcatgaataatgcaatactctaaaaccacagccaatctgatctacttcctaaacaattgtaaattcctgtatatgggagcaacttggcttttgttctaagtggtagtgtaataccagaggcaattctgaatgtcactgaacaggcaacattcttactgaattcctagcccatggtcagctcaaggactttccagggcattggaacactggcgaaagcttagctatgtcagaattcaatcttaaaaggcacttatagtaagataatactaaaagagagcatgtggatccatacactagactaacgcgggaatagggtatgagtatacaggttaatgagaatgccaaagctccaggaggtaagtttccatgaaactctttgcctcgcaagcgcatccagggctcttggcctgccaagcagacttcactggggtgtgcgtggcaaaggagttctcgctaaaggggtgctgccagtgtggaatctagtacggaattgtatcgaggttaaggaaagatgtggagcagaactcaaaaagggcaatgaggcactaaatcaggtgagagaggagaggtcccaaaagtcagaggcagaaggaagttcttgtgatggagatatgtctgaggacgatatggagagcatagctgacagtctagagaaagtgaaaatgaaggtagaaccttgggcgccagggccaccatggccacctccatatgcccctgacagagcattgggtcgtagtctgcatgcagaaacctggaggaaactgcgagcccagtgctttcctgtatttcaggatgcacagggaggtcattatcatgagccgcttgattggaagattcttcaaagattagtggaaggggtttgtacttacggtgtcagtgctgcttttgtaagagcgcaattagagaacctgcactgctactgcatgactccaagtgattggcagaatgtggctcgtgcctgcttgtcaccaggccaatgtctagactggaaggcatttttcattgagtttgctgccgagtaagcagcgatcaacgctggcaatggccagccagcctgggatcaagacatgctgctgggacaagggagatttgtagcagctcaaactaattatcccatccaagtgtatgagcaaattaataacatagggactaaagcctaggcatttcttttgaatagaggagaggtgagtgggaacctgaccaagattgttcaggggcccacagagtcctttgctgactttgtggctcgtcttgtagaggcaggaggccgtgtttttggagaccctgatgctgccatgcctctactgaagcatctgatttttgaacagtgcaccaaagaatgcaggcaagcaattaatccatataagcataaaggattagaggtcgggatgaaaataagtagagaaataggaggaccgctttctaattcgggtctggctgccactgcatacagatgtcacaaggaaaaggtggccagcagaataataactgttttaaatgtagacagccaggccacatgaaccgtcaatgcccacaattgagtggtgccagaaaccagcgaccaaaagtgcccgggttatgtcttagatgcaaaaaataaaatcactgggtcagtgagtgtaggtcagttaaagatattcatggacagcctcttgctcccggatatggtggtgcccggccaaaaaacttgaaaaggggcccccgaccccagggccctcaaatatatggggcagtaaccaagggatggcccagtttgaggccaccgatgcgatggagtcaccctggagagcaacaacagggagtgcagggctcgacctctgttccaccacccgactcatattaacaccccgcatgggagtccagctggtggacacagactttaaaggcccactgccagctgatatggtggtacttgttgtgtctggccagtagatcacaacctgggttctagcctggaaaggcattttggaaacctggaagagaagaggggctgggctgcgcgagataaggaaggaaccaagacaaagctctctgctcaaggttcaatttttactatttcggcactcagttataaaggaagggggaggggcccaattcccgccaaataatcttgggatccagtagcagggtgatcacatgatggcttcggaacagcaaagcggcaggttccagcagtaggcatggcagaaagattgagcgggaagctccacccctgagcaagcaggtttcagtctgggggaggggagactacagtactgatttttgggaaggagctctgttaccatgcaaggattaatagttcatccaggagtaattgattcagattttacaggaaaggttaagattatggtatcttcccctagaggcatcgttgccatttcccctggtgatagaatagctcaattgcttcttttgcccagctatcactctcaatttccagccaaagattcagaatggggagacaagggatttggctctactgggacctccaatatattttgctctctaaatcttgatacccgacccctattgaagctcaggattgaaggaaaagctatatctcgtctcctagatactggtgctgatcgtagtatcatcagtaccagagattggccttctggttgtcctaagcaacagtcagaacaaactctgagaggactcgggtatgctcagatgcctgaaatgagttcctgcttcctatattggaaggccgaggaaggacattctggacagtttcagccatatgtgttggctgttccggtctctttgtggggccatgatatgatgactcagatgggctttgttctgactaatgaaggaggctatggcaacaaggctcatgacatgatgctggacatgggatatattcccggaaaagggttagggcaatttctgtaaggtagaacctctctagtgccagtttgcaaaaagaatgatcaggccggactgggtttttcctaggggccactgagggagcattacctattacatggaagactgaggatccagtaagagttcctcagtggccactccatcagaaaaattaaaagccacgaaagagctggtacaagaacaattggagttgggacatatttggccctctacatctccctggaatactccaatatttgttataaagaaaaaaaatcagaaaaatggagacttttgcatgatttgagagaaataaataagcaaataatcttgatggggcctgtatagaggggactgcctttgcctttggccttgcccagaaattggtccattatagttttagatattaaagattgttttttctctatcctgttgcatccaaatgatatggtaagatttacctttactgtcccctcccaaaatcatgctgaacctgataaaaggtttgagtggacagttctgccacaagggatggcgaacagtcccactatgtgtcaactctattttgatgcagctttgaaaggagttcgagagcgatttccaaaggtgaagtgttatcactatatggatgatatgcttcttgcccctcccagggatgccttgcttgatgaagcttatagctttgtggcgacacagttgaaggaacagaatttagtagtgaccccagaaaacgtgcaaaacgatgttgtagtgaactatttaggaacaaaaaatacagcaaaatatgtgtcctctcaaaagattcagtttcgcacagatggattatgcaccctgaatgattttcaaaagttattgggagatattcaatgagtcttaccctatctctctttgactaataaacaattacagccattatatgatatcttaccaggcaatacagatttaaattcttccagatatcttactgatgctgccaagaaggctttgttgttagtagaacagcatattcagagtgctgccttgaaacacagagatgagtccaaacagcttatcttgtgtgtactgcaaacagagtcgcaacccgctggggttttatggcagggagctcccctgttatggatacacccaaaagtctccccagccaagacatttgtttattatcctgcctcagtagctcagttggctctgattggtgtacagcaaagcatgcagttttttacagttgcacctgaaagtctaatagtaccatataatgctaagcaaattgaagtgtcaacagccacggaggataattgggctattttgtggtgtagttttcaaggccttatagataatcattaccctaaggatgcaatattacagttggttaaagtacatccagtaatctttcctcgtattactgctagagatccattgccggatgttcctcttgtttttacagatggttctaaaacaggacaaggagcctatttaataacaggatcatccccagttaccattcagtttcccccctacatctccacaagtcattgaattgcaaattgtgattaaagtatttgaattaattccaggtcccttttatttgatttctgactgccagtatgttgtaaatatgctgcagtgtttggagatagtaggcaaaatatatttgagatctaccattggagaattagttattaagttgcaaagaattactttgaattggcattcacccttttttattcaatatattcgtgctcatactggattgccaggaccccttgcagaagggaatgatatagttgataaagcttccagaaaatgcatgtcctttttaatggcctcatctattgatttggcacgtggttttcatgcacaatttcatgtaatttaaagactttgtcatcacgatttaaaatttcttgagcagaggcgagacagatcatgaaggcgtgcaaactttttcccctttattatctaaagtcagtgtgggggttaatccctggggattgtgcccctacatgtgtggcaaatagatgttacccattttcttgagtttggaaagttaaaatatattcatttttctatagatacagcctctggcattatttttgcctccttacagacaggtgagaaggcacaccaggtcattgcacattgttttgtggcttggggtgcctggggacaccctaaagaaataaagactgataatggaccagcctatacttcagcctcttttgtttccttttgcaagatgatgggtgtccatctggtgcatgggttgccatacaacgctcagggccaaggcattattgaaggagcccatcgtactttaaaagaatgtttaattaaacaaaaggggaaaattacccctgctgggtccacacaaagagagagattagccattgccttatttactttgaattttttgaatgaagataaacaagggcatgttgcagctgagcgacacgttaatcctggtatttctccaaaaggcatggtcatgtggaaggatgtcttaactggttgttggaagggccctgacccagtgctggattgggcgagagggtctgtttgtgtgtattcccaggatcactgacaaccgctgtgggtcccagaacagctgaccagagcaattcaaaacaagcagaacgatgaggacgtggattttcctgtggctgggaatgctcctgctagtgagaactaaagagctacgttgggaaattatgtctgcattcccaaaacccacggcattgacacatttggcacaagtgtttcctcgattctttacatttaatgcttcgctacatttgcctttttcaccatgtaatggagagatagctccagtacaggaatctatgcagcttcagctaaagggattgttgtgttttcagatgattcaaaatatttcacagatgagtgattgtgttcagctgtataatcagaccgcagcatggtttgatatgccagttaagagtttactatgctacctggattcgagggttgtagcctgccagtatccaagggcaatggcactataccctcccaacctagatgggccccctttcttaggggtgtttgtgattcccttccaccttggaccagctgtcaatctagaaaagtagcttgggtagtgaagaattatttttccttttccccttatataggtacagtccataatagttccttttcagggtataattggacataccaaaatccagctcaagtaggagctagtaatccttttaatgtatggttgttatgtggggtgaatggtagttgcactgatctttcccccttaagcatgatggcaggaggggcctgggacaatgcaagtttttattgaaatggttctgtgtttcaattttctggagggaggaatgtttcttttcaggctacgcctgtttgtatgtggcctccttttgtgcatattgtttataatggtagttatgagaataatgttgttaattgtagtagtaataattgcttttatagtatgtgctggaatgcatccttgcatcatttagcttttgttactagaatgcctcgttttgtaccccctggcctgttcaggctccttctgctatgactttgtttagacctaaaagggattttggcattactgcggccattgtcactgcaatagcagtttctgctaccgcagccacggctgcagccatatcccttattgagacagtccatcgtccatattaattccactcgtgtcgacatgtctgtggctgaaggattggccagatggatcgccacagcagtctcccacctgaatgactgggctggcattggtggacttgccatgtgcccaattctcatcggtgtcctggccatctgatgcatcttccacgtgcagagtcatcagcgcagagcccaagccttgatgatacaggcttttgcggcagtggaaacaggataatctcctcaagtgtggcttggcatgctagagaagtagtcaatgatgggtaagactccctgggcgtgtcacaaatctaagacagggatcaaaccaatgctgtttgtctcctgatgatgggtaaggggcattgccacagggggcaacctaagacaggcattctctgtgccaataagtaaagaagggggagatgtgaggagcgagtgtggcagcagtcccaagatagtgccttggactgcagccaagtcttatgacttgcacctgacttccttatacacctgaaaataagctgcatccatcgtgagaactgcgcaggtgcaccatgttgcaagaccagaccatatgacgagtgatgattctggccaatggactgctgttacatggactgggctgatggggcgtggtagaggggttatataagggattgcgattgggggcggataaaagagaagagagagtttttttttcctgcatgcatgttgaaaggttcctgaataaactgctttgagaagaatgctgtgttgttgcccttttctgctggtcagagacagaagcaacatatatattttatttcttatttgactataatcagtgtttactgagtgtagtattgaaatcacttttaatatttatgaagtagttgttgttttctatttatgactgaagaatttgtagttacttttatattaataagtatttacagtactttgtaattcacagatgtttcctctgacatccatcttacttatcttgagttataagaaaatctttactacaaaataaagataatcatttccatttatgtatttatatgtcaaatgaaattgatgtagaaaaaaatcatctatagtgaatagcctacaaatagtttttacattagaaagccaaaatgtaaaaccaagtcttatatgtcagtgtaagttttcattgcttctgataaactctgactatcataataattaataatgtcgggagcctcccggcctggagaggatagtggcacaggcacaactctgttgtggctttaaagtctgagggtctctggacgttctagctctctaactgtactgaagtgctgatggtaacttctaaaaagtccaaaaaatctttcttactctttcagagggtataatgctgctggcttatgtgaatgacacctgtaacagctggaaattaagtaatggggcttttgttctatctcagcaggaactgagcagttctatctttcagcctgttagtcagaacttgtaggaagaaaaagggacactctgaaaagtaattatagtatttattgctaagttataaaaggtttcatattaaagctatcttaggaaaaggtggaaagcggaaagatcctaagcagggcaagggaaaatttcttcttcctgtgggaaggggaaaaaatcacctcttttctctttgtcctcagtacttatacatcttcagaatacatgatcacatgttaaaaattcatcacaagttcacacaaaaaataattcataatttgaaatagaagtttacaacagagaatgtttacatgcataaccattaggagtaattatctggctaaacattcatcacctgtcacagctccacaggttcatagaaagttgaaaaccataactaagttgttagtgaagttttgtataaataaacccagtcaatcttttatcttctgtcctagcacctataatcattaattccctttttatgacttttggttaattgttttacaaccacttggaatgtgctctgagtaggagaaagtctggttactatctaagagcaattaactggtgacacatgggagactaacagagttcacattgcagttttgaatatgagaaaaggacctagtagcagctccactataaaagagcttaacagtcactcatataattttaggaattcttatagaagcatccttaagacttaagaagtcatctgtttatatagcatcactacaagacagtgcatcttcatagatctgcagcgatctgttccaaaggggtcggctgatacatagtgattgttatatatgttaaatagaaacaggaaaagcatattaatgtcaggattctttcctaaaatgaattctcctgggtcttgcttatagaagcgaatctgtcacagattatattataatctgaagcagaccttctcaggaagatcacctgctagttattaggttgttctattatgactcctgacgtaataatatgtgaagttggttatatcgaaagagcactctgttgctgagaaaagtatggggtgattattatttatttatgagatttgtagtgggattctaatattatgagggaatagacaagtattccaagtgaaatggctcaatgtccactaacatttccggtgacagataaagcacacatctatttcaccaaagtgccacaaatataaaaatcctgtaatcaacaatgatctgtgcatgcagtaattaaaaagtcagcagtacagtttagcaaagatcatagtagaggtcaagacagttcacttcacaaggtttgctctgaacattctacaagggaaggtgcctaaaagaagacactcagcactgtttacttgtcttttgtgaaagcttccctttttgactaaagaccttttatctttgtgctttccttgaaacaaagaatagaacgtgtcatacaacccagaattttatgacatgaaataatgagatgttggtttgaaaaagaacaatgtatgattataagtaaatgtctaataaaaacattttcataaagaagtgaatggaaagactatagtttttagatgcattttaaggtttctttttaatattcttgccctgaataattagtacatttctaaaataaaatcatgttttagaaaaaaaaaacattattcttaataatgtctttatccacaaaacagtaatttttgttatctacttgttactcatggctaatttacctgttttcgccttaagaacagggatactgaggaagctctcaccatgatgttttaatagtagtaaactatcctttacaagatagaaactatggccatgcatctttaaacacattgcttttttgctttcctgtacagaaactaacatacttggaatagcaagcagatattgtttgggaacaataatgaaacaaaagtgtgaaggtaatttaactttttctctcctttgctgtttccagtattgatattttggaactcattcaaatgctcaggtagaaacagagttcaaagtttagaagagtgtcttagatctataaaatctgcgtctgaaaagccattttctacttttatgttctatacataatggtatctcgctgttctgctgtggatgaatatagaatagtgatatcaactgggctgggcatgatggcacaaccctttaaaccaaatactcagaaggtagagggaaaaaaattagtagctcagcatcatcttcacagttaaaggccagcttttgccctatgtgaaacctgtttaaaaaacaaaacaagacaaaacaaacaaaataaaagcaaataaaaccccctaatgatggtaatagccataattaaaaactcctgaaaaaagattttttaaaaaacttaaaagaaccactgtacaaaagtctcaaaaaaagattttaattaaaagaagaaaaactgatttgaaaaatgggctttaggattcagcaaatgttcgtagctcatacttgctattgttgctatttaaaggttagtttcccaactatccaagaaagggcttgataaaaatgaaacaaaaccaaaaccaattaatgtattctgatctctttttttattgtgagtctttaatgactaagtcatctctctatccagtattctgatctcttaaggtatagtaatatggtggaaaaatcactaaactcagaaaataaaatgctttcttaaaaaaaaaaacaaaacaaaacactggtggttctgcgtactaagtcttgataaatagggaacatgttgagtttggcgggtaaaaaacacaagcacatgccagaagttatgcagcttgacagtatgaggaaagatgacttacagtgtgtgtagcacatctcaaaactttgcaattctgaatgtcaattttggtataaaaatccatgttataaaacatttgtaaaacatatttgaatcttcagattgacaagttttgtaaagtgacattttcataacattttatttgggagctccctggtttgtattagtaaaagtaaggacatttatttaaagtcaattaattatttcatattttgcctgtattagatctgacagtctctttattatggtgacgttaattttgctgcagattagatgatatcactagtttattgtaagcatttatcttcctaattttataacggtaatataaatctgcttggggctgacagctacgattattttttcctcgtgatttccactaggaaaaagggcctgtttaatggatatgctatttcttaaaacccattaaagagagttcttgtcattgatacagccatttttgccttttgtgtagatttgagaatataacatttgatgtataagttgtatttcttttttttggagactgattatgggatggatccctggatatggcagtctctagatggtccatcctttcatctcagctccaaatttagtctctgtaactccttccatgggtattttcttcccaattctaagaaggggcaaagtgtccacattttggtattcgttcttcttgagcgtcatatgttttacaaattgtatgttgtatcttgggtattgtaagtttccagactaatatccacttatcagtgagtacatatcatgtgagttcttttgtgattgggtaagcctcactcaggatgatgacctccaggtccatccatttgcctaggaatttcataaattcattctttttaatagctgagtaatactccattgtgtaaatgcgccatattttctgtatccattcctctgttgagggacatctgggtcctttccagcttctggctattataaataaggctgctatgaacatagtggagcatgtgtccttcttaccggttgggaccttttatggatatatgcccaggagaggtattgctggatcctcctgtagtactatgtccaattttctgaggaactgccagactgatttccagagtagttgtacaagcttgcaatcccaccaacaatggacgagtgttcctctttctctacatccttgccagcatctgctgtcacctgaattttttatcttagccattctgactggtgtgagatggaatctcagggttgttttgatttgcatttccctgatgattaaggatcctgaacatttttcaggtgcttctcagccattcggtattcctcaggtgagaattccttgtttagctctgagccccattttttaatggggttatttgattttctgaagtctaccttcttgagttctttatatatattggatattagtcccctatctgatttaggataggtaaagacctttaccaaactgttggtggtctttttgtcttattgacggtgtcttttgccttgcagaaactttggagtttcattaggtcccaattgtcaattctcgatcttacagcacaagccattgctgttctgttcaggaatttttccgctgtgcccatatcttcaagacttttccccattttctcctctataaattgtactgtctgtggtttaatgtcgacttccttgatccacttagatttgaccttagtataagtagataggaatggatcaattcacattcttctacatgatcaccgccagttgtgccagcactatttgttgaaaatgctgtcttttttttccactgggtggttttacgtcccttgtcaaagatcaagtggccatgaggtgtgtgggtttatttctgagtcttcatttctattccattgttctacttgtctatctctataccagtaccatgcagtttttatcacaattgcttattgcgtccggctcgaccggcaagaaagacgcaacaaaccagaataaagcaagagctttattgcttgcttcttcaagaagattctgaaccgggaaaatggcgctgcttttataacccgcagcatgacgtttcagcacctgatatggcgtgacagctcctgattcgttgcttgcccatcaccccactattacaccccgagaattggagtgactaggagtgaattcactctagcacctgcgtacaaggcttgtttactagttaggcacagtggaggcccgcgccatcttataatggcaattgcttgcggcacacatggctctcctcagagattactggctgcacgcacgcgattgctcatagcacgtaccggctctccacaattgctctgtagttcaactttaggtcaggcatggtgcttccactggaggttttttatccttaagcagagtttttgctatcctaggttttttgttatccagatgaatttgcaaattgccatttgtaattcgttaaataattaagtttgaattttgatgaggattgcattgaatctgcagattgcttttggcaagataatttttgctatattgatcctgccaatccatgagtatgggagatctttccatcttctgagatctttaatttctttcttcagagacttgaagttcttatacagatctttcacttccttagctagagtcacaccaaggtattttatactatttgtgactattgagaagggtgttgtttccctaatttctttttcaacctgtttatcctttgtgtagagaaaggccattgacttgtttgtgttaattttatatccagctactgccctgaagctgtttatcagatttaacagttctctggtggaatttttagggtcacttatatatactatcatatcatctgcaaaaagtgatattttgatttcttcctttccaatttgtatccccttgatctccttttgttgtcgaattgctctggctaggatttcaagtacaatgttgaataggtaggcagagagtggacagccttgactagtccctgattttagtgggattgcttcctgcttctaatcatttactttgatgttggctactggtttgctctagtttgcttttatcatgtttaggtatgggccttgaattcctgatctttccaagacttttatcatgaatgtgtgttggattttgtcaaatgctttctcctcatctaacgagttgatcatgtggtttttgtctttgagtttgtttatatagtggattatgttgatgcatttccctatattaaaccatccctgcatccctggaatgaaacctacttgatcaggatggatgattgttttgatgttttcttggatttggttagtgtgaatttcattgagtaattttttgctttggtattcataagggaaattggtctgaagttctccatttttggtgggtctttctgtggtttaggtatcagagtaattgtggcttcatagaatgaattgggtagagcaccttctgtttctattttgtggaatagtttgtggagaagtggaattagatcttctttgaaggtctgatagaacttttcactttggttgggagactaatattgactgctcttatttcttttgggaatataggactgtttagatcattaatctgatcctgatttaactttgatatatgatatctttctagaaatttgtccatttcatccaggttctccgattttgttgagtacagccttttgtaaaaggatctgatggtgttttggatttcttcaggatctgttgttatgtctcccttttcattactgattttgttaattaggatactgtccctgtgctctctagtgagtctggctaatggtgtatctatcttgttgattttctcaaagaaccagctcctggttaggttgattctttgaatagttcttcctgtgtccacttggttgattttgcccctgagtttgattatttcctgctgtctactcctcttgggtgaattttcttccttttgttctagagcttttaggtgtgttgtcaagctgcttgtgtgtgctctctctagtttctttttggaggcattcaaagctatgagttttcctcgcaggaatgctttcattgtgtcccataagtttgggtatgatgtggcttcattttcattaaagtctaaaaagtctttaatttctttctttattccttccttgaccaaggtatcatttcgaagagtgttgttcagttcccacgtgaatgttggctttctattatttatattgttattgaagatcagccttattccatggtgatctgataggatgcatgggactatttcaatatttttgtatctgttgaggcctgttttgtgaccaattatatggtcaattttggagaaggtaccatgagatgctgagaagaaggtatatcctttgttttaggatcaaatgttctgtagatatctgttaaatccatgtttcataactcctgttagtttcactgtgtccctgttaagtttctgtttccacgatctgtccattgatcaaagtggtgtgttgaagtctcctactattattgtgtgaggtgcaatgtgtgctttgagctttactaaagtttccttaataaatgtggctgcccttgcatttcgagcatagatattcagaattgagagttcctctttgaagattttacctttgatgaatatgaagtgccccactttgtcttttttgataactttgtgttggaagtcgattttattcgatattagaatggctactccagcttgtttttttcagaccgtttgcttggaaaattgttttccagcctttcactctaaggtagagtctgtctttccctgagatgggtttcctataagcagcaaaatgttgggtcctgtttgtgtagccagtctgttagtctatgtctttatttggggaattgagtccattgacattaagagaaattaaggaaaagtaattgttgcttcctattatttttgttgttagatttggcactctgttcttctggctgtcttcttttaggtttgttgaaggaatacttgcttccttttttgttgttgttcgtttttttcagtccttgtagtaatttttttctgttattatcctttgaagggctgaattcgtggaaagatattgtgtgaatttggttttgtcatggaatactttggtttctccatctatggtaattcagactttggctggttatagtagcctgggctggcatttgtgttctcttagtgtctgtataacaactgtctatgatcttctggctttcatattccctggtgagatgtctggaataattctcctagggctgcctttatatgttacttgaccttttgctctgactgcttttaatgttctatctttatttagtgcatttgttgttctgattactatgtgtcaggaggaatttcttttctgtcccagtctatttggagttatcaaggcttcttgtatgttcatgggcatctctttctttaggtatgggaaattttcttctataattttgttgaatatatttgctggccctttaagttgaaaatcttcattctcttctactcctattatccgtaggtttggtcttctcattgtgtcctggatttcctggatgttttgagttaggatccttttgcattttgcattttctttgattgttgtgcagatgttctctatggaatcttctgcacctgagattctctcttccatctcttgtattctgttgctgatgctcgcatctaaggttccatatttctttcctagggtttctctctccagagttgtctcattttgggttttctttattgtttctacctccctcttttggtcttgtatgattttgttcaatttcatcacctgtttggttgtgttttcctgtttttctttaaggacttgtatctctttagcagtgttctcctgtatttctttaagtgagttattaaagtccttcttgatgtcctctaccatcatcatgagatatgcttttaaatctgggtctagcttttcaagtgttttggagtatccaggactggctgaggtgggagtgctgggttctgatgatggtgtgtgatatttgtttatgttagtaagattattacattttcctttaaccatttgttaatctctgaagtcagttgttatagttgtctctggttagagcttgttcctcttgtgattctgttagcctctatcatctgacctgggagactagatctctcctgagtttcagtggttagagcactctctgcaggcaagctctcctcttgcagagatggtgcacagatatctgttgttcggatttgccttctggcagaagatgaaggccctaaacagggcctgtcccagaagatgtgctgcttctgcctttcccagaagctgcgcagcttcagtagttagcactctcacctacacagtctagtctctgagagatcccgggccagagatggctccccccaggtgctcctgcaaagcccttcctggcagggcagacacctctcctctggcagagagggtgaccagatgtctggagcctgaaacggggtctgccccagaagctgtgtggcctcaacctgtcccagaatctgtcagcctctgcagaccacacttttacctgagcagactagtctctgagggatccgggaaccaagatgcctctcctaggtgctccataagttgtttttctaaattacttttttattatgtaaatttatctttagacaaatttgtacatgtacacaatgcatactgaccactctaacttcccacttcctcacttttaactcacatcctgcctgtgaatctctgtcttatgtttgtatcatttcattttgttttgtgacccactgagattaacaagggcatctgtgtgatcatggatttggagctaagggctggagtttagtgggttcaactaaaaatagtggttcacctttcctagaatctctcagtagccaatcagtcagagggaaggagtaaggacacatgatcctccttcccttttccttcagtgattgtttataacactgatctgagagcctgcctgggtcaggtacctagagttttgtgggttcctgattacaatgattgttatcaagtccagagaatggtattcacagtgctgcgccatacattctgcctaattccttcttacacaatatcttgttagctgtagaagctgtttttaagggctggacccacacctattacttattttctactttttggtttgccatgaggctcagcatttgccagtattcattgtcaggaaaggctgcttttattaagactagcagtagcttttgtttgagcatagctatttaacaatatacgagtttataatcatttcttaatctcaaaataattgacctttaaaattgagtcaaaagtgacacagtataggtgtggtcattttaaagtatgtaggtcagtggtatttattacatctatagtactgtgcagccatctatttctaaaccattttcatcagtcataaaggagccctcacatcaaaggtaatctgtacctttgtgtttcctccaccttgaaggccctggacatttttattctgtgttctgtctctacagaggcagctagtctagatagttcatataaatggaatcaggtagtttatgacttgaagttccctaatgacatatattgttgagcagcagttctcaatgtgtgggttgtgacccctttgggatgtacaaccctttcacaggtcttgccttagacagtcagaaaacacagttatttacactatgattcatagcagtaacaaaattacagttatgaagtagcaataaaaataattttatggtttagggtaaccacaaatgaaacactctgaaatggtcacagcattacgaagattgagaacagctgattgtttcatagattttatttgacatctgtatacttatctttgctgaggtattgttaaagtcttcagcacatttgttaatccatctgtttggtttttttgttcttggttttcaagacttgtttatcgatttaatgaaatgttttctttttcttttggaatatttgactcaaggtcagagtatgtagccaggactaactttgaacttaacagtaccccctgcttttgttttacgtcttttagcacatgtaatttgtaaaacttttacccaatctgcggtttgtctttcatccttatgatatgattgtatttcttttgagttaaagagagaacaatagatggttctagaactgagacatgttctaactctataatcaaacatctgtgtttttcttttaatcacttaccttgtacatttccatttcctagtcagttagatgaagggattgagatggatcagtggtttatatgatactcaagtgaagcattacatttttaaaggtacccctgagggaagggggaaaaggaagggcttcagacaaaagaactctatttttttctgcctttatttccccatataattttgatttgaagaggattcttgcctagttaactttaggatagtaccactgaattacatgaatctcaaaaaatacttttcatattttagattgtgtgatacatgaatactacattgaatctactcgagtagtttcagtgtgcaaagagaaaaatcgtatccacaattctgttgataaatttggctttaacaattaataggtagtttctgagtaaatatttgtagtatccatttttaaagagttatgagatatggacctcccaagtagctactaatcaggtcataactaagttcttagaccacatttttctacatgtagactattaacagtaagaagatatatatacagactggagagatgacttaacagttgagagcgctgactggtcttccagaagactggatttaattccaagcacctttgttgtggctcatagccaataattctagttccagagaatctgacatcctcttcttgcatctttgggtctttatctgaaacccatgaaataattctagcactgatatttatgtaaaccttctagtttgttgaaagcaattattcattcttagaaatctagactgtagcagtcacaaagaatacgtattatactgtctatgttggtagataataaaataatactatagcataaatcttcatgctcagaactattgctcagatttaatgagttatatatgactgccttttgccccattaactaaagataagtatttcatccatttaagacagaaatataatcaatgtagacaagactcataaatccaaatgaagttgtggtgatttgaatctgcttgtcctatggaaagtgctattattaggagatgtagtcttgtccaaataggtgtggccttgttgaaggaagtgtatcactgttggggtgggctttgaaactcctcctagtgtaaaagagaccttcctcagcccttccagcctgcctggatgctgccatgcctcctgccatgatgataatggactgaaaccagtaagccaggcacaattaaatgttctctttataagagttgccttggtcatagtttctctttacagaagtggaaaccctaactaagacagaagttttattgtggtagtccatgtaagcactaacactacttataccttgatataattgagacattaattacaggagaaatagccatcatgggatatccctgttttgatgactctacttcactgtgtatttaattatgcccaattagaccactgtacttttacattttatttctttaggcaagtcattgtccatggtgtagaaatataatgtgctaacataccatacattaaataaattgatgtaactgctaaaaattgaacagaattgttagtggtagtatcatctgccatttcatgaggaattgtttttgtaagaggttacatattttaacactccttcaaagaaaagtcaactgtttgccttcctttgtgggagactttattagataatttctttgtatctcatttttctttatgcaccataaaaatctttaaacaaaagacctctgagtataagaactaaaatttagcttttacagaaaaaccttatcaaagtagttagtgtcactgcagaaaaccatttttattttgcttttaaagactatcagctttatagatatccattacctcttttgtcttttctgttatacaaatccattctgtgcagcattctccagacttattccaggaagtttgcctgtcacctggaatcttattttatgcctcctgtattccaatgctaattttgaagtcttgtcggcatcatacccatcatgtccttaggaaccaggtctgacacattaaagcatttaataacaattatttcttctttgaaatctttagactttccaggttcaggtgctccattccacaacttcaagttagtttttaaatccctgaactcttgaattgagtttatgacaacctgtttgggtataaccttactagaaattttgaattataaatgcagcagtcacgtagcaccaacctgtagttctcataaataggttgtttatttaaaatagtattgaaaactattctgttttcctacattcctaaataaaagaacatggcctaagaagtcttttatttatgcaataaacatttttatttatcttttattttcataattttattttaataagctttgttttcctaaggatagctatttccatcagtctgataagaagtacctgtttaatacatatgtcagaataaaaaataaacttgaaggcattatattgtctgcagacacaatgaagtagcaatattattctggtttatgagaaagaatatgtgggagtataagagtgacaccttataagaccattcaagacagggtctttcagcatagccgtggctgtcctggaacttgttctgtagactagattgggcaggctctaactcagaaatctgcttgcttctgcctcccaagggctaggattaaagacatgcaccaccacagctggctcccaacaccattcctggctaatttataaaattaaaaaaaattcttttaagcattgaattaaataggaatgatattttgttgagttttcttctgtgtatgtacatgtgttggtttgtgggatggtgaagctttggttaataaatagtatatacatgctccctaagatttgcatattacacagcattccattttctcagcatctttccagtgatggagatctttactgtcgtaactttaagaaatcacattcagcacgtacacttcaataattaagaaacagactctgataaatgaagtaaaaaaatgcaaatgttagagtcatacagcaagtttagtaccaaagcagtactagaagctaatatttcttacttccaaatgcagagcctattaaccatagcatggttctcattcttcccttgtccttacttcaacagaaggttggtaaaggtggatctcttagatttgaacactatatcactaaaggctgccttcatattgcaggcagaaaacttgaattagcagatactttgcatgttgtccagtcttgtatgagaaattcacaacaataaataaaacatcagagatttattccagaaaaaaataatcatctttcttaataacttgtatactccttatagatttagtttctgatacactaacatttatataacattatctgggaacaaattttccatttgagtaagtattatggattgatgattgcttgaaaacctgggctaaaagtgaagctcagtagtaaataacctttctaatattcagtatagcattgagttcaagccctgtttatgtggcaaaatttagaaaacaaatttttctatttaaaaaagccacttatttttaagcttagaagcagggaactggcctagcatgcacaaaattctgcacttttttggtgtaaacagttctatttttttttcatttttgttaggtatttagctcatttacatttccaatgctataccaaaaaaaaaaaaaaaaaaaaaagagaggcccattggacaggcaaactttatatgccccagtacaggggaatgccagggccaaaaagggggagtgggtgggtaggggagtgggggtgggtgggtatgggggacttttggtatagcattggaaatgcaagcagttctaaattagatccatatacacatactgtctatgaacattattctgaacatcatatgatgctttattggttactcatatccaccatgataataattgtgatggctactgctttgaaacctgtttatgtgagaggagttagatctttctctaagtaactcctgaagggctgtattttcttttcctttgcagtcagaataactagctttcacttcttgttcctgtcagtgtattgatctagttcagtttaaatctctctggtgtactttttagtgttaatgttcgatgttagttcaatgttcaatgacattaacatctcatagtctagcttgaagatatggatagcataaaaggacttttgatttctataaaggaatggggctccactgtaaagtgagcataaaatgtattgtagcacatttggatataacctctcatattttgcctcatgagattggatttatatgaatacttctaaatacaatgttattaatgtccaaaattataacatcaaatattttaatagccacctgtattatctacctaaattcaataaaatataattaatccaattttacatttcttattactctgcatgacttccaaatcttaacaaacttattgcatatgtaattttcctttcccagcagcttcttctgtgtggcctgatgttaaaattccaatgaggattctatcaacaggcaactaaaaaaataaaagtaagaatagaaattatagtaagggatatttactttgttacagatacttggtatttataaaacaagccctcaattacattcaaaagaatttctgaaactttaaaacctgattatatcccccaaatatccatgcctcatcacagcatactgtaacaagcatatgtcaatgtataattgaagggaattaagacagcctcattataagccagccctgtctgtgttcattccatattttcactgtacattttattatctgttgaataaatctgttgttttatttacatggaataacagccataagtcatattattacttactggctatccagtttttgctaagccttgaacattagcaaaacttagtctatgtacaatatctcattatgagattgatactatcattccaaatttactgaaaaacaaatgcttaggattttgcttctttacagatttgtttgctgtgacatcttagtttctaccttgttcactatttaacaactttgggtcatatctgttacccaaacaagtataagcttcccatagtacataaatgagttcttttctctttccattttaacaatattttcataggaaacccatgaaggttccatacctttctacctagcatttcattttcccatgcttacccataacacaatagtaagttattatcagaatgttttaattttcatgttcttgattattgcctattttgtgtcacattataattcataaaagtagcgaataagtagcaatgaaaataattttatggttggagtcaacataacatgaggaatcattaaagggtcgcagtcttagaaaggttggcaaccactgtactaaaggaaatcagagagttcttataaaacaggtgaatatattctctcagggaaaaataaagagaaatgttttataaagtttgaaaggtagtttcctttagatgaaaagcaggaagatatatgtaataaatgtaagtgaaagtatattttatatagcatgtagacattaaaattgaagcacatcataattagaagcctgcatttatcttttcattgagtctctcattttctctcattcttcctttgattttctctctacttactgaatcatattccacagtgagatatttactaggtgatacaaaccacagacattgaaccaaacattaatagcacatggttttcccaatcatatttatattcttgaagaggaaccaatgtcatgtcaaaacttacgagtataattgatttttctatctaaacatagattccatagcaaatctgtctaataagttgaaatggattaaatgcttagaaggtattacattagaaaaggagttcgcctgcctctcaacaaagcgagttccaggacaaccaaggctacacagagaaaccctgtctcaaaaaacaaacaaacaaacaaacaacagaaaaggagttcgccaagcaaaggaagtattaggtgaaaaattgtggagacccaaaagggccagtttgtagactgacgagatttgggcatttctttttttttttttttaaacagaaggcatataactgattttatatatatatatatatatatatatatatatatatatatatatactccatgaatccatgaaatctcatgttttggcggcatttttttgttgtttattgtttttgagtcagggtcttaccataaagctttgcctggcctggaactcacagaaatctgccctcttctgcctttagaatgctgggatcaaagatgtacccaatccttagtactgattagatttagtttgactgaggagaaagatgcatggtgagtgaaatggccacagagaatactttgtaatcttagctttcatttccgaccattcctctccattcattttgcaatcattgctctaaagcaatcttagtatcttttaacctgtctataagaagggacctttttctaagccttttcttttccatttttcccttccatcaccccctactctcttctgttggtatatctgagtttctagtattgtgttaataaaccctgaatgagtattaaatacttcaaatgtggtagtttaagatgaggcacctccatgacacagcaatttgctagtatcctgctttcattgcccagctattttctacttgaaccctacctatgaattcctttatagcccttgttttctcaattcaagctcttgttcacttctgttttcccagtacaattgttaccaccatttccccatgtccccatcctgccactccttacaaaaccaacacagataattttcattggtccctctaccacctccaaagcatacacacccagtagaaaaatatgtctatcttcttatcttctgaccaccaaaagaacccattgtattaagtttttctgtagagttctttctgtatgtctttaatctttgtctttgagagcagaggtcagtctgcccctcatcttcagttgtcacgttttcattgtgcatagttttgttcagtgattataccccaagacaaagaatgttgttcactttaaaatgtaaatgtttaatactgtctccttcagtgaaatcagacccaaccatgataaaaccaatgagataactgcaatagagagctttctagcttcaggctttcttctctgtttttttggtttggtttggtttgttttgtttttttgttgttgttgtttttttttggggtttttttttttttggcaacattgcagatataatcttacgtggctaaagattatttgttgtttaaatgcttaaaataccaatttttactaacctgtgcattaaattcaacacatttatgtgctggtatttattgtttattttagcttaactcagtaatttggacaatcacttgaaaaactcttttatttcatttattgttatttgtttcttttgaagagagagtacaagcttaatttgaaataatgaaaaggtatgtttttctcaataaattaatatttttgagtatttgtatatgaaatatttttaagttggaatttttcttgctgaatgtgatttaaaaacacgtatttgtttgtttagagagaaaactgcttatctgtaaataacatcttaaggagttcttaaagctcatttgtattctatataatggtattagcaggtgatccatgactttatatatatgatttctgtcaaatttgatttaactcatacagcttaaggagaaaggcagaaagacataattagctcaagtttcgaatatcactgctttggtttgatttattttttttttaaactaaagattgaacacacagtcttacatgtggaaaacattaacatcctgctacacccttagccactaggttttaattttaaattcctaatgaaactctatgtagttaggaaatgtcccaaagcaagccttgcagcctgagtactgtaccagtgttgggcctgcactggttcaagccagatagagtcctagctttgagagggggaagtggacatccctaaccaagaagataactacaattgacaccacttgcaaaggaaaaattctcaaaggagtcctcactggaatattaaccactcctaagagtaggccccatgcccagcagtagatggccagcacaaacgaatacaatggaatttttgtagactttgtttctgcattgctttgtttaaggacttattatcttactagtattttgcttgtatattatggtttccaattttgtgtttttctgggctttgctggtatgtgtgtttcttgtgctttttctttgttgttttaagtttgtttgtttgtttgtttgcctatttgttgggggggagagcacatgtatgcatgtatggacatttcatatggtccatgaagtgtgaatgtaaaggttcttatgttctactgtggatttcagggatcaaaatcaggttgataggcttggtgaagcacccagtgaagggtctcacaggcctctaattcttttatgctaatgtagagtcgattagatttccaaaccattttttaaaacaatcttttttctttcttctttaagatttatttatttatttatatttatttatttaatgtatgtgagtacactgtcgctctcttcagacacaccagaaaagggaattagatcccattgcatatggttgtgagctatcatgtggttgcttgggaattgaactcagaacctctggaagaacagtcagtgctttttaccactgagccatctctaaccctctagtccactatttcaaagactgtcaaatactttgttcttattacttgtttcctgatatataaaatttacctattatactatgtatttactgttgctcaagtttttgctttatgtaatgtcttctaattaactgtatttggcaaggagataaagtttacttgccaggatctagagttcttagtattatgttaccttgcttcttggtagaagaaatacataagagatgtttatgtagaatgctcctggtaatttgattagtctgatactaggagatatctgtcctgatatatcatttttccagctagtttgatatctacttttaggagttagccactttatgaaggaaggtttgtccagaaaaatcatatccacttagatgacaaacagatgaagaagtaaaaaaggaaaaagaaaactttctcttagaaaagagaattctcagtaaaatttggtatcatctattaattggaggagacctctatgttattttagaggatataaatacgatcagtagctgacatgttacaatttagttaaatgagtcttgaataggataccatagtcaaaacaatatcagacatacttattttaaagagaattataaaatgtatgttaaataggtgttaaagactttaataattgtagttaaatatgtctaaatctattaatccaggattttcataaacattcagaacttgtcttctgaggaactgatatgagggtagtaactcacaaactgcagtaatattaagatttcctgggaattcattgcaaattcattgcaacttctaaagttgtatggtgagcaggagggaagacttgaataacttgaagtcatgcaattttaaaactgtcatgtttgcttcaaaggaaatcaattatcctgaaaatgatgcacccattttgtcaatatgactgcacctgttgaagatgattttaaaacttggctcagttttagaaaacttttcagtcttgctgtatctactttgaagattacattttatgaaattcaaatgcagattaaattttctcaattcaaatttagcatttggattgaaatgaaatatatatatatatatatatatatatatatgaaatataaaccagatcttaaaaatctaatgcaagaagaaaataaaaatcccataaggattaaaaaagatgtatttgtgtgtgtgtgtgtgtatctatctatgtttttgtgcacatgcatatagataccctgaaggccaaaagagggagcagaatttgggtcttatcaaaaaatagcaagcactcttaaacactgagccactaatatcatttaatacaatgtttaagattttttatgagtgctttgcccacacatatatgtgtgtgtgtatatatatatatatgtatatatatatatatatatacacatatgtgtatgtatttatgtacatctgtatatatgtgtatgtatatatatatatgtattatatatgtgtgtatacatacatacatacatatatacatatatacatacatacatacatacatacatacatacatacatgtaatgtttgaatggctggtgcttgtacagggtcagaggacatttgatcacctgcaactggagttaaagataattctaaactaccatgtggattcttggaatacaaccttggtcatctgcaagagcagcaagtacacttaaccaccgagccatgtttccagctcactcctttattttaaattatgtaattatattttattttatctttttcattttcttttttaatttgttagtttatttatttacatttcaaatgttatctcccttctcagtttaccctctgcaaaccccctatcccatctcccctccaccctgcttctgtgagtcagcttccccacccatctacccaccaccctagcattcccctacattgattggggcattgagtctccacaggatcaagggactcaccttccattaatgccaaataaggccatcctctgctacataagcgctggagccatggttccctccatgcatattctttggtttgtggttttgtcctagtgagctctggggggtctggttggttgatattgttgttcttcctatgaggttgcaaacctcttcagcttcttctgaactgacttcttctaactcctccattggggtcccaatgttcaggctaatggttgacaatgagcatctgcatctgcatttgtcaggctctggcagaacctctcagaggacaactatatcaggctcctgtcagcaagcttcttggcatcagcaatagtgtctgggtttggtgtctgcagatgggatggatccctaggtggggtagtctctgaatggtcttttcttcagtctctgctccagactttgtccctgcatttcctttagacaggagcaattttgttttaatatttttgagatggggggggtggcctcatccctcaactggaggccgtgcttaacctctgaatatggtctctacaggttctctcttctcttggttgggtatttcagctaatctcatcccgttgggtcctgggagtctcttgctttcctggattctgtgacattctagtggctaccccagttcccccatctcccactgctacacacctctgttcaatttcctgcctctctatacttctcccctgtctcccctgatacctgatctgccccccttttccttccctctctgtctccctcccaggttcctccctctctctacctcccatgattattttgttccccgttctaaataggactgaagcatccacactttggtcttccttgttcttgagcttcatatggtctgtgagttgtattatgggtattccaaacttttgggctaatatccacttatcagtgagtgcaaaccatgtttgtccttttgtggctgggttacctcactcaggatgatattttctagttctgtccatttgcctaagaatttcatgaagtcattgggttttttgttttgttttgtttgattcgttttgttgttgttttttaggtttttttttttttttttttttggtttttcaagacaaggtttctctgtatagctatggctctcctggaactcactttgtagaccaggctggtctcaaactcagaaattcgcctgcctctgcctcctaagtgctgggattaaaggggtgtgccaccacacccggcaaagtcattgtttttaatagctgagtagtattccattgtgtaaatgtaccacattttctgtatctatttctctgttgaagtacatctggtttgtttccagcttctccctattataaatatggctgctatgaacatagtggagcatgtgtccttattacatgtcagagcatcttctgggtatatgcccaggagtgatattagtggttcctcaggtagtactatgtccaattttctcaagaactgctgtactgatttccagagtggttgtaccagcttacaatcccaccaaaaatggaggagtattcccccttttcaacatccttgccagtatctgtccaacccactcaagatgtattttgcaagtgtgtgtgtgtgtgtgtgtgtgtgtgtgtgtgtgtgtgtgtgtgtctgtgtctgtgtctgtgtctgtgtttctgtgatctgtgtctatgtttgcaattgtccagagaccaagggggtgttgaagcccctggggctaaacttccacatgtttgtgggccattatatgggtgctgggactaaacttttttgttgttgttgttgttgttattttgagataggatttctctgtgtagccctggctgtcctggaactcaccctatagaccaagctggcctcaaactcagaaatccatctgcttctgcctcccaagtgctaggattaaaggcttgcaccaccactgccaggccataaggggaccaaacttttaagtcctctgcaaaagcagcaggtgttattaacccctgaactatctttccaactgatgtaatgtgtttttttccatgttagaagtctgtataatggaaattttctaatctgtttatattaacagagattaaattatggtggcatggtatttacacaccaggcaaatgagacattttcagaaaaaaaaaaagtagaacttaaatgttctcatatataaatgtaaatgcacccctcccctataaagggtaaacataactatggtgtaatcagtgcctgctttttaaaatttgttagttcatttatttaatttatttattgcagtgctggggattgaacccagggctatagacacactaggcaagtgtactaccattgaactatattcccaaccaactatttttcttccaagacctggcctcactgtgtagcccaaggtgacttattgtgactcatttattccactggatttcacaagttcacactgaatgtttctaagatataattcatcagaagtttctttatttttcttttcttttcttttcttttcttttcttttcctctcctaaggacaatgaaataagattgaatgccttgaagtacagctacactatatttaacttgtttatttaggacaaaattattactgtttttttggactaagatgtagataaatttatcttttatatttcattgatttcagaaaattctttggaatatgctctttattttgctagttagaaagatatgtaatgggacttttactatgttaagtctttaagtaatggttctctaggttcatattattagttcatttggatttgtatttatttttaggtaggcagagatatcgtgtagagactggcttttggtttggttgcagaatgtttgggtatccatttacagtaatgaatataagtagtgatatcattattgctatttttaaacatccattggccatctagaatgtgctaaagtctgaatataacatggttaattatgtcactgttcttgcccatgttgactaacgggagatattcccattatgagaaagctatcaaatgctttggtttgaagttaaacattaattcactcctaaattactgaaagatgtttagaaggttgcctgtgatttctgaggagcatctggaaattttcttcttatatatcaacttcccacattagtttcttattgttttttatgcttattattatatattttttttagttttcctcacggaagaaaaagccaactcagtactaaaacgctacccaagagccaatgggctttttgaagaaataagacagggcaacattgagcgtgagtgcagagaagaaatctgtacatatgaagaagccagagaggcttttgaaaatcatgaaaaaactgtaagtatactggcaacataaaacatgttcacagcattacttaccattccatatattctgaaacctacattcccaaagaacatgaattgcttctagctaaaagttaatttgctgaagaagtcgccatgtaacagctaataaataatgttctgtataggagaaaactacacttacttccctctgttttggtctgtctttgagggccatgtttccacagtgttctgcttagctaacagttatggtggcaaggcatctggttcacagaaggcgttgatctataaagtaggtggtgtctttacctctcagtgcttaatcagagagagagggtagaaggtatggggaacagttaatgctttgatgttttatttctcctaggctggggtatacagctcagtggtaggatgcctccgtcatatgcttgagaccccaggttccaaatatagaatcaaaaagcatttcctttagttctctatacttttggtttcttcttccacatttcacaagactgaattagttcagtttactctgactgcaggctattcaaagataacagggttgtgaaagcagaagcaaggatgtaaattttctaaatcttctatacagttgtaaattacaacaccagaggtagcaattgtgtaaagatacttgcctgcgcaccaaaaaaaaataatactctatgctaattaagtggtatatcatgtgctgtaggggcattcactatgccataggaacagtgagaacatacattttaaagaaggagggtttgatcttttgtttgataaggctctcaagatgagagagaaagggcctcaaagaaattgccagattctcatgctcaaagcaaaagcaaaatctgcttataattaacaagctatgttcttcataagctttgctggttttacaagtagtagtttattgtcatatatatactgaattattggtatagtttcctctgtatggctatgtagctcaaagaccccttaacaaacagcccctcttcacagtcacttagttatccttcattagatatacattgtttccatatgtacttcatctatttctagatttttatgttctagtttatccttccactttcagaagatttgttttatgttctaatataaattagaagtagttctacattgttatggtattctacagtagtttgtgaaatttcttacctaccaaagagacagtgagctgcctttgtcatgtgaattttagtattaaattgtctcgcataaaaaaaaagtattttatcagtatttttattgggatttttttttcagtttgcactccttcccaaataatctgctcttgccatggtaagtagtaacttcaccaatgtacttgttgcctctttacatcaaaaccatttattatggtttgattactaagagaccctacaggctcacatattgaaagtttagtttccacctactgggaactttagaagctagggcctcagaaaactaagtaggtcactaggggtgtatctttgaaaggtatcgtccttctgcttcctcctgtctgtctctgctatctgactaccatgaggtgagtagactgccacattttcctctaccatgcttgcctcagactcaaagcagtatatcctaccagccatactttgatacctcttaagcaataagcaaaatttaatccccttcctttaaactgtttctttcaggtattttccttagcaacagaatgtatgattaatacattgctactaccatcttaagtctatcttttatccttaccacataatttcaaatttacattcttttattcatcagttctttgagaattttgtgcaatgttgtcgtattccctcacttcccaaacttttccaagatccacctccacttctctgagcactcaagattttcctattgattgattgattgatttagctcttttatagggagagggagaggcacatgccgtaggccagaggacaattgcacatgttagttttctctttctgtcatgtgaattctaaggcttgaatgcaggtcatcagacttggtggcaggtacttttaccaacttagtcatctaactgatctgcacaatttttgaaatggcagactaaaataacattttaacttttcttcactatgcatggtagttcatacctatagaagcaatcaatactcaggaggtgagtaagattgtgaatgaagcctaggctatgtagtgaggtctaggctagtctggccatactagtaagaacaacactgcaaaccaaagcaaagcaacacaaatctccgtgaaggcttcatatctcctccagtaaaacccaaagaattcagaatcacctataaggtacagttgtttgcaccctgcactaacacttccctacagaagaaacctcacatctccaaggactccatctccttagtgattgtgtagtacttttcttctgcttctttacagttaatgcaaagcaagtgcccactcttaagtctttgacccttgttcttttcacttgcaaattgatatgcctgaggtcattgtgaaacttcactttctcagtaaggaagtattctgtctcctgtgatttctcccccagcacttatcaccatctgacattgatttttttattcattacttgtttgctttctgcccaatgacagcactatttctcagttgtttggttcatagctacaaagttctgacacaaactagggacaaaataaatacttgatagaggcaagaagtaatcaattgtgaaattataaaacatgtttaaaacatcagatgaagtaatttaagttttgttcatgagttagatgagagatatggattttaaaatggattttgtgttaatattggttttctgccttctctatggtttctaagcctgtcatacaaaattatttacattataaaaatgatagcatttataatagggtgttattggaaggcatttaggtcaaggtaataatgtctaacgggcttcaaggcaactatttgagagtcatgtttgttacatcctaggaaagtactagttaacagaaaaaaaaaaaaaaagattagcttttgagatttgctttctcctatttttttgcatactaaaatgtcttacttaaaacagattttgtgatatattcatcatccttaagtatagattatatgaatttagtagatgaattcatgaaatattgatgagtaactctacctaactgagtgtgcacgtttaattatagattgggaggaaagacatgtttagtggtcatatgagtggttcagatttatgtggatgttacttgctaaataactactatgtaacacacataggatacataaaaagctgaggtctgatagaagtggctgactagacatgaaaattcacataagtacatcttgtttggggggaggcgaattgcaggcctaacccagagactgacctacactccaacctgaaattcacagcattatgtttgtgcatgttaagtttactggtttcacgctaagcaagtgctctactaagccatattctatttcatcttaaatatgtagggttttttttttgttctttatatttcaataaaaaagaagtagaaaaagttttctggatgtcattctgttttgttttttgtttttttgttttgttttgttttgttttgtttttccgatacagtgtttctttgtgtagccctggctgtcctggaactcacagtgtagaccagtctggcctcaaactcagaaatccgcctgcctctgcctcccaagtgctgggatgaaaggcatgtgccaccactgcccagcttctggatgtcattctgaaacatcagaaaatgagatagatctaatttggtgtctcaactctgccacctactgaccgtactatttttaattaaacatttcacctttatagatgttaattatccaaacatttttaggtttgagattatgtgctctgtggtgcctacaacagacagttcctaaaataaatatatttcattcacgtttcagctgctgaattatagctattttatttaggcctcatatttctgcttgacaattttccctttttttttcgaaaatgtgtgttgtgtttgtgtgtgtgtgtgtatgtgtgtgtcgtttgtgtgtgtgtgtgtatgtatgtatgtatgtatgtgtgtgtgtatgtgtgtctgtgtagagttaagataaatttgtgattgggttacctcactcaagatattttctaggtccatccatttgcctaagaatttcacaaattcattgtttttaatagctgagtagtacttcactgtataaatgcaccacattttctgtatccattcctctgtggaaggacatctgtgttatttacagattctggctattataaataaggctgctatgaacatagtggaacatgtgcctttattacatgttggggcatcttctggatatatgcccagaaatggtgttggtgggtcctcaggtagtactatgtccagttttctgaggaactgccagactgatttccagagaggttgtaccagcttgcattcccaccagcaatggaggagtgttcctctttctccacatccacgccagcatctgctgtcacctgaatttttgatcttagccattctgactggtgtgaggtggaatctcaaggttgttttgatttgcatttccctgatgattaaggatgttgaacattttttcaagtgcttcttggcccatcaatattcctcagttgagaattctttgtttagctctgtaccccatttttaatggggttatttgaatttctggagtccagcttcttgagctctttgtatattttggatattagtcccctatcagatttaggattggtaaaaatcctttcccaatctgttggtggcctttttgtcttattgacagtaccttttgctttacaaaagctttgcaattttatgaggtcccatttgacaataattgatcttagagcataggctattggtgttctgttcaggaaattttcccctgtgcccatgtgctcgaggctcttccccactttcttttctgttaatttcactgtatctggttttatgtggaggttcttgatccacttggacttgagctttgtacaaggagataaaaatggattgatttgcattcttctacatgctaacaaccagttgagccagcagccccataggaggaacaatatgaactaaacagtacccccagagctgccagggactaaattagcaaccaaagagaattacacatagtgggactcaggggatccaggtacatatgtcgcagagggtggccttgtcactcatcagtgggaggctaggcctttggtcctatgaaggctctgtgccccaatgtaggggaatgccagggccaggaagcaggagtgggtgggttgatgaacagggagaggggagaaggggatagggagttttcagaggggcaaccaggaaaggggacaacatttgaaatgtaagtaaagtaaatatctaattaaaaagaaaaaaaagataaatttggaggagtgagttctcatctttattcactttgcttttttctgtcactatactgccacttccattttccatattacagaaggaatgctaggattacagatgtgtgccatcacatatggcttttttattttttattaaactaataaaatttattttaaaatatacaacttagtattgtcatttttaactcatcaaaataatttataatagttaaatacctcttaaatatacatgagatcttctgaagctaaaaataatatacactcaaccagtttttaaaatctctttacagcattaaacttgatagaagtaggaaaaatctcttatgaagtcctctatgaaaggaaattgtgaaaagttcctgattagacagaaaccattccatctccaaggaagaatactcagcgtaattgtggattcatagaatgaattgggtaatgttccttctatttctattttgtggaatagtttgcagattattagtgttaggtcttctttgaaggtctgatagaactctactctaaacccatcttgtcctgggctttttttttttttttttttttttggttgaaagactttcaatgacttcttctgttttttagaggtgatagggctgttttgatggtttatctgatcctgatttaaatttactgtttggtatctgtctagaaaattgttcacttcatccagcttttccagttttgttgaatatagaattttgtagtagggtctgttgttttgttttgctttaatttcctcagtttctgttgttatatctcccatttcatttctgattgtgttaatttggatactgtctctgtgccctctagttagtctggctaggggtttatttaacttattgattttctcaaagaaccagctcttggttttgtttattctttgtgtagtttgttttctttctacttggttgatttgagccctgagtttgattatttcctcccttctactcctcttaggtgaatttacttctttgtgttttggagctttcaggtgtgctgttaagctgctagtgtatgctctctccagtttctttttggaggcattcatacctgagttttcctcttagcactactttcattgtgtcccataagtttgggtatgttgtgccttcattttcataaaattctaagtctttcatttctttatttcttctttaaccaatttattgagtagggcactgttcagctcccatgtgtatgtgggctttctgttgtttgtgttgtattgaagaccagccttagtccgtggtgatctgataggatgcatggggttatttcattcttcttttatctgttgaggcctgttttgtgaccaattatatggtcacttttggagaaggtaccatgaagtgccaggaagaaagtatattgttttgttttaggatgaaatgttctatagatatctgttaaatccagttggttcttaacttctgttagtttcaatgtgtctctgtttagtttatgtttcgatgatatgtctgtccattgatgagagtggggtgttcaagtctcccactattattgtatgaggtgcaatgtgtgctttaagctttaatacagtttcttttatgagtgttggcacccttggatttggagcatagatgttcagatttgagacttcatcttggtagttttttcctttgatgagtatggagtgtactttcggttgaaagttgattttattcgatattataatgactactccagcttgtttcttaggaccattttcctgaaagattgttttccagacctttactctgaggtagtgcctttctctgatactgaggtgcctttcctgtatgcagcaaaatgttccatcctgtttatgtatccagtccattagtctatgtctttttattgcggaattgagtctattgatgttaagaggaatagtgattgttgcttcctgtttatatatatttgtgtggctatcttttgggtttgttgaaagaagattactttcttgctttttctagggtgtggtttccctccttgtgttggtgttttccatctattatcttttgcaggacgggatttgtggaaggatattgtaaaaatttggttttgtcatgaaatagcttggtttctccatctatgataattgagaattgtgctgggtatagtagcctgtcctggcatttgtgtactcttagggtctgtataacatcttgccaggatcttatagccttcacagtctccggtgaaaagtctggtgtaattctgataggtctgcctctatatgtcacttgaccattttcctttactgattttaatattctttctttatttagtacatttgatgttttgattattatgtgacaggaggaatttcttttcatgtcaagtctctttggagttctgtaggcttcttctatgctcatgagcatctctttttttacattaaggaagttttcttttatcattttgttgaagatggccctgtaacttgtgaatcttcactctctcctatacctattatccttaggcttggtcttctcattgtgtcctggatttcctggatgttttagattagaagccttttacattttgcattttctttgactgttgtgtcaatgttttctgtactatcttctgcacctgagattctttcttctatctctggtattctgttggtggtgcttgcatctataactcctgatctctttcctaggttttctatctccttggtttttcccttcaagatttctttattatttctacttccatttttagctcctgaatggttttggtcaattccatcacctgtttggttgtgtttttctgcaattccttaagggatttttttgtctcctctttaagagcttcaagctgtttacctgtgttctcctgtatttctttcagggagttatttatgtccttcttaaagtcctctatcatcatcatgagatgtgatttcaattctgagtcttgcttttctggtgtgttgggttatccaggactcagtgttgtgttctgataatgccaaatagccttggtttctgttgcttatgttcttgcccttgcctctagccatctgtttatctcttgtgttagctggtcttgctgtctctatgacttgtccctactgcaagcctgtgtgtcagaactcctgtgaaaacagttctctcctggaggaatttgggtatggagagatgtggcacagggtcaactacagggtgcagactgaaaccagaagaatcatgtccctggttgttccttagttcctgtgtcctgatgtctcaggacaggtcccccttgggccaggaatctgagcagaagtggtagtcttacctgtgctcacaggtgagtcagcattcctgggagactggctctctcctgacaatatttgggtaaggagtgctgtgacacaggatcagctcttggctcagatggaaactcgaagcccacatatggctttttatttgggtaggatctagggccaagcttggtttatagtctctgctaatgctttttcccactgagccatctctccagcctttacctgtatttttagggcataaagaatctctgtggtctgatttgtttaatcttgtactagtgtgaagaaaatcctagtgattgtttcagaacatttttttcacaaataatgtaaagcttactttgcttgattctaggatagttgacctcaaactttaaagaatctggaaatagcttatgtgcttatcaaacttctacaatcatatctgatgcttagttctatatcttttttgttttctctgtggagctgaggattgaataaagggtaggcagtgttctatactgagctactatatatatatatccctagcctggaaaataaataagaattctttgaagaaatgattgattatagtgatggcattttttgtagtattagaaagtaaggatgtgccaaatcaggaaaaaaaaaactgaatcaatggatagaaacatgataaatggacttgacagttagctttaaggaaccttagtggctgaagatgttttcttggagcaagaagataaataatatagtattagattacaacccaaaacataaaatagactctcaaaatctgtttcagtgacatgcctccttcagcaaggctataccacctcccaagacttgtgccaccaaatgaggaacagtgttcaaatacatgagcctgtgggagacattccttagtcaaaccactacaataactttaatattatttttacttttatttctttacagtgcgttttgaataccccttgggatagacaaagttaatatgtttccatctttaaaccaggattgtgaaggttaataataatgctagtgttcagttggtttaggtttttttgtttattagtttttgggtatttttttgtttgttttgttttgttttactggaattgaagaaagttgtggcttttgattcctagtccactcctcaaaatacagcatactatgttagatgataccctcaaaaacaaggtaggatgtctagaagagaaagaaacctaataaaactaacagaaaagaaatatagaagttgagattccctgctatttgagaagggacaaccataagtgtaccttagacatttagtaggtgtggtgttgacaccgtttttgagagagctgtctttaaattatgtatattaatgaggtttcattgtatatctagagtatttgtaaaggaacagaaaaatgataagtacttctatctagctattgaacttccttaaaactacagaaaaaattttttttactctgaaaaatagattgtatcataaagatccaagctggacacaatggtgcatacctttaatcccagcacttggtggcagaggcaggcagatctctatgagtttgaagccatcctggtctagatactgaatctcagaacacccaaggctatacagtgagataatgtcttttttaaaaattgtactgataagtaaaatgagatcggcaagtaaaagttacaatccccttgccccaaataaatatttaatagtatgtgcctagcatgtgaacacaaattaccaatatcaggaatgagagagaaggcatcactacagataaaaaagaataatattctttaatctagctatgtcctagactactaattagatatatttcactcataaaaatgggctggatttttttactttattttatttgggggggggtggtttacaagacaggctttctctgtgtagccctagctgtcctgggactcactctgtagaccaggctggcctcaaactcagacatctatctacctcagtccttcaagtgctaggattaaaggtatgtaccaccactgtcttagaattttattttgtctatatttcactgaatgctgtccctttaaaaaggcgtcttcttcctttgcttgatttaggtgtgtgttgccttgctcagttttaatacttaaagtagaattttaattttctattttgagatattattttcccctttccagttttatacaatttgaatatttttaggtttattcattcaatcacttggaggctcagttattactcaaaataggacttttggtaaacataccatttgtacttaagaatatgcttttgtacaacataggctaaagtttttcctatacttaagtgttattactttcttttcattattttcttttctctttatgatcataaaagcaattggcatgtgattgataggaggagacccctgtggtttttaaagcatgtatcatgtattcaataaataacatgcactttcagagatgtttaaaattataatgaaattgtggctcaatacatgaaaatatttattcacacagaaaattacacacgtatatgaaaggaaaccattatcagatcacaattttatataaagaaattatacattttgtgctgactagttgtactcactaacatgaaaatgagaaagataccataatgaacaaatagaattaatactgaaggaaaagcagacataacacagaagacagaagagaacttcgaaaatttcactttcatggtcttataattgttaagacaatagagttaatatgaaaactgcccatgataatgaacaataaacgaaaagagagtacttagatgatacaattattactaaattaaaattaataatggcaagtctgtgaagtcttatagaaaactgagggagctcagggcttgcctgcctccacctgcctctgattctttttttttaagacttatttatttattatatgtaagtacactgtagctgtcttcagacaccccagaagaggttatcagatctctttacagatggttgtgaggcatcatgtggttgctgggatttgaactcaccacctttggaagagcagtagttgcccttaaccactgagccatctctccagcccatgccgctgatttttttttccttttccatttttattaggtatttagctcatttacatttccaatgctataccaaaagtcccccatacccacccacccccactcccctacccacccactacccctttttggccctggcgttcccctgtactggggcatataaagtttgcgtgtccaatgggcctctctttccagtgatggccgactaggccatcttttgatacatatgcagctagagtcaagagctccggggtagacgttccgtagtggtgaactccagttccacaccatgtgacaaaacattttctcactggcaccagacatgtacatagtacacattcatacatattatataaatactcatatacattgtatgaatctacatttaagaaatgttttgaagttggtctttgagactggagcgacagcttagtgttaatagtgcttactgcttttggcaaggacctagattgattcccagcacccaacagagtggctcacattctatcagtaaggcttgttcctggagatctgagagcctctgtgggtattgtatgtatgtgatgcactgacatacatataggcaaaatatgcatatctgtaaaattaataaatacaaaagaatgtggggaagtatccagatgatttactaaaacaccattgtattttatttataaataacttttaaaaataaacacttttgtgtgcattggctcacttatgctagggtatatatgtgctatggcccgctgctctgatggaagtcaaaaaaaaccagtttcttcctttcatctgtgtcctggtggttgaactcagactgtgtatcttgagttaatatctgtcacccttatctcctgaatcatttttctggctccaataacttttataatactgcatctgtattgctacagaaagtagaacttacaccctaacctctgacctttccgcctcaacatgaacagttgaaccccctttgcagcctttatacctctgacactttaacaatccaccccaccccaaccccacattttaccaccattacttccttcaggtgttgcctccccctctcacagcttccaccactgccgctgccaccattacttccttcctgtgctacacctcagacaagccaggggccttcattctcaggttaacccaacacctgaaatggaatttcaacgcaggcgaggtcaacaccagcaccactggtgccctctccacacttcccgagtgagtatggcctacccactgctgatcttgccagccaccctgactgcaactttatcctctcaagtgatgcaaaacaaccatcctgactgcgaggtgccatcaacagccacatccagtcctagctctatgtctcctacatctacctgtccatggctgccttctgtgacttcggaggtttgaaccaaaaacatttcacccgcttcttcctgagtaagtctcatgaatggtggacatttactgaacttttcctaacacttcagaatgagcaaggaggccacatctccttctgtgacattgagaagccagacagtgatgaatgggttaatggcctcgcatccatggaatgtgccttccacctagagatgactgtcaatgacagtttccaggacttgtatctgcctgcttttagcaaaggggatgctcatctttgcagcttcctgaagcaccagtgtctgaagcctcatttgaaagacatccagaagatgtttgtctttctggccaacatgctccaggtagaggctgggaaagatgatgttatcgagtatcttttcagtaagcttcacctggatagcagcagctcaaagaattgactgttgactggtgattgttgctgggtcactatactgagacctgtattgccctcagagcaagttcactagtttttcagtttcaactgttttatataaagttcttttgttctcagc

SEQ ID NO: 850 - DNA, 113912 bp, mus musculus; identical to SEQ ID NO: 849

SEQ ID NO: 851 - DNA, 103070 bp, mus musculus
gagcggggctcacggtgagtgaggcagcggtgcgggactccttggagagaacgtggttggcagccagaaagggactcgggtgtgtatggaagactttgacccggttaggggagactcgtgcagctttttcagtggcggggcttctcgaggttgccagcctccggctgcgtgtggagaggagtgagccgtggcgggagacttaaaggtgtgtaggagctgccgagttagaagaaagaagaaaggcgtttagaagctggaagtcctcacttgagcttggccaggccaggaaggttcgcttgagagccctggaaggtggcccagcttcaagttcagtccccctacttggtgcccccgagcggtgtcctagcttactcttttccttcctctgctttccctgggtgccgagttggcaggaaggtttcctgtcggtggggagaggatttgggggaggtgggttgttggcccggactgttgcaatagagggtgtggcgttcctatgactttcctttccccgggaatgtgtccctcttctgatacattgtgcctggacattttttaacaaaggctataactgttttgtaggctgtggtgggtgacagcggcggggggggggggggggcgagggtacgcgcgtgcgcgcacgtgtgtgtgtgtgtgtgtgtgtgtgtgtgtgtgtgtgtgtgtgtgtgtaggctcgcgcgcgcgtgtgtctgcaagcgagcgagcgcgcgcgtgttggctggcttgcttcagaagtctgtgttgccgccctagggggtggggaatcagtgtgggcctgaagttgggggaatttccagaaagacctagcaactttctgcagaggcttttttctttttactggtctgttgattttgagagtaagaatattccccataggaatgtgcctggttactattttgtgtgttcttgctctgtgtgtgtgtgtgtgtgtgtgtgtgtgtgtgtgtgtgtgtgtgagagagagagagagagagagagagagagagagagagagagagagagagagagaaattgagagattgatttttatacgtttttacaaatcccaacagaagaaaaaccaaaaataatggtatttcagaagaaataagtgagtgtgaatgaaagggagaagacttggaatagctaagtagagctagataaatcccttttgatagtcacagaatatgatcagacttgggaaaatgtggcagtgtacaagtcagtaaatttagctagagtattgttcattgtttcaatgaagaattcttaaggatatggtgctgccagatacttaggctaactcactttagaaactttaaaaatgataaaacattagggaaagtattgtgacattggataaaggcccataggctttcatgttaaaaatttatgaacttttatgaaaaatgatacatgtggtaccaagcacagatgtttatattttaactcattttttaactgagtacatcataataaactgagcttcctcctcctccaccccttttccttgattgtgaatcctgttttataaacataaacacccatggaaggagttacagagacaaagtttcgagctcagacaaaaggatgggccatctagagactgccatatccagggatccatcccataatcagcctccaaacgctgacaccattgcatacccaagattgcataccctatcaagattgtgctgataggaccctgatatagctgtctctggtgaggctatgccgggggcctagcaaacacagaagtggatgctcacagtcagctattggatggatcacagggcccccaatggaggagctagagaaaatacccaaggagctaaagggatctgcaaacctgtaggtggaacaacaatatgaactaaccagtaccccggagctcttgattctagctgcatatgtatcaaaagatggcctagtcggccatcactggaaagagaggcccatcggtcttgcaaactttatatgccccagtacaggtgaacaccagtgccagaaagtgggagtggggggtgggggtggagggcatgggggacttttgggatagcattggaaatgtaaatgaggaaaatacctaattaaaaaataaagaaacatggaaatactaagaagctaaaaaaaaaaaagaaaaaataaacatatactctcagatctgaaatatgtttaagcagaatttcttcgtgttttctttttatttaatcttttctccaattattcaaaggatttggtgataatattatccaacttgggagaggggtgttaggatggatgccttttgccttttccaagagctcagccttatgaacttattgaaaaatattttcaactccctcggaattaatcatcctttaactgtttaacttatagcactagccttattttctctcttgttaccccaatacttgggttgccttgcatatggtaagtgcccaatataattatagttacatgttattacatgtcattagaaagataagatcctacacagagttcatgaagtatagaagaaattctgatcttttaatgttgaaggaccatttcttgaaaatacctaatgcacactgtagtagtgagaacatagatacattgtcatgtgttattgatagttaatgtttataaatgaggtgcacaactttgtagataaaagaggaaatgggtatcgtaaaaacacacactttagaagacaccaaagctagagaatagtcattgcacacactgaaatatgtaatttgttatttgcagaaagacaggaatgaagtgctgcttgactttaggaaattctaaaaatgaacacagctcacctggtactgtttactaaaggttaacacaaataaagaaaactgcaacctacctcatgctgtactcctacgtcttaagatggtttgaaccttttggctaatgaatcctattgtagccttaatcatcttgttctgatgatttctgctatcttatctttgacaaatctctgaattccaacacattattggctatccaggtacctctgcttatatcagggaattaacttgtctggtccactcagtctcaacagtcctgtcaccaactttcatcttctgaatgatttacccattgcaaagattatcctaagcaaggccaagctttataaaataatgagtatattcttctgtttaaaaatgagtcaggatttggtaacttgactgatacagagtctatgcctacaaagcagaaaactgtgctagccattagtaacccctgattttcttcccttacttaacttctcccctgcccagctaaatgtaatattgtttttcccatgtgatttttcaaataatcatcctgccaaaaacaacacttcatgttagtgtttaatacttatgaataaaatctgagatgcagaaaggctgagtactccatgaatatttttatttaaacttttaacatattttctgattcatatacatggtttttgaaaaaaatgaagctttgattattttatacctttctcccttaatgtttttctcatccagactttgtccttgtgtgtatttttttttcctttgtcactgtagataaacagcagaatgtttgtctggggttgtcatatcatgtaaggttggaaaggacacaactaagagaagatacttatatttaaacaaccaaagtgatttcatttgtttcggtttatgtcagatacagatgattgacttaatttggtggaatactatcatttttcttaagactagaaagatgttacaagtatttggaacaatgtgtgtgtgttttttttaaaacaatgtgtttttaatttgcaatgtgcattagattccgctgttatgaagctctttcaactagcatgcttgtatttaaggcccttccttcatataaacacaccaaatcagaaatttcaggtgaagaagctaaaaacaaacaaacaaagaaaagcccaacaaaataaaaacaaaaccctagtagatttttgaggtccagttttttactggctggttttgtgtcaacttgagtcatcagagaaggagcttcagttgaggaaatgcctccatgagatttagctgtaaggcattttctcaattagtgatcaacaggggagggtccagcccatagtaggtggcccctggttccttaagaaatcaggccgaacaagccaggagaagcaatccagtaagctgcacccttcatgacctgtgcatcagctcctgcctccaggtccgtgctttgtttaacttcctgtcctggcttcctttggtgatgaacagcaatatggaagtctaagtggaataagccctttgcagctcaacttgttttttgctcttggtatttgtttgcagcaatagaaaccctaactaagataactttgttttaaaaagtacttaaaaggatgatagggtgtggagacaataaaaataaactacttttttgtataaaatgttggtgaaaaaagttaagacaaacattgcagtttgacggttatatgcaatggaaatgcatcagagagagagattaaaaaaaaactgttagagcacaggagtaactgaagttgtaatgcttgaaatgataattaatggaatagatactagagcaaggaactagaggcagtggaattaagggcatggacagaagagaaaagaatgaattaaaatatacatttaaaggcagaggtgaatgaaactgacagtattctccttaagtgtttcattaagtgatggatactattttccaatgaagctgtttgatttgagattcctatttaatatccaggtaaaaattctaggtatttctgtgtaagaaactctaggaataaatcaaattattataaatgaaggttattcgtgttttaaaaattaataagctttatttttagtgaagttttatgttaacaggaaaattaagtaggaaataaagttcttttttctttttcttttccttttattgttttgttttgttttttgtttttgtttttccagacagggtttctctgtgtagccctggctgtcctggaactcactctgtagaccaggctggcctccaactcagaaatccatctgactctgcctcccaagtgctgggattaaacgcttgtgccaccactgcccggccaatgcctcctgttcttgaacactgtttcctgtactgtgatgtcctgtcccattgtttcagctgataagtctacactgatacatcattatcacctgaggtgtgttgtttacacaggcccttctctttgggttgaacattctataggtttggacaaattcacaatgacttgcacttacaattgtcatgaccaccctacaaatcctctttgctcagtctgttcatcactttctcttatttctagtaatgtttgatccttccactatttctaccttgtgtacttgggatcatataatatgtaagttttttttttcagattcctttcctttatttagtgatgtgcatttacacttcctacacatcattttatgatttgataccttatttctattaactgctgggtaatgaaacctcacctggctgtatctatttacctcctaagagaacatctttgtcatttttaaggtttaggaataataataaaactattgtaaacatcgatattctacgcacctcccccccccccctgtaactttccagttcctttcagtaaataccaaggagtatgggtacaggagtctatgttaagaataagtttggttttgctagaaactgacaacatccacacattgggagcaaatgagaagcctgttctgcattctttttttttccatttttttattaggtatttagctcatttacatttccaatgctataccaaaagtcccccatacccacccacccccactcccctacccacccactccccctttttggccctggcgttcccctgtactggggcatacaaagtttgcatttccaatgggcctctctttgcagtgatggccgactaggccatcttttgatacatatgcagctagagtcaagagctccgggggtactggttagttcataatgttgttccacctatagggttgcagattttatcgaaaggacccagatgtagctatctcttgtgagactatgccggggcctagcaaacacagaagtggatgctcacagccagctaatggatggatcacagggctcccaatggaggagctagagaaagaacccaaggagctaaagagatctgttctgcattcttgacagtgtttggtagtgtcagtaccaaacttacattattttggctttttttttttttttttttttttttttttggtgtttttgagacagggtttctctgtatagccctggctgtcctggaactcactttgtagaccaggctggcctccaactcagaaatccgcctgcctcttcctcccaagtgcgccactacacctggccctattttggcaatttttaatagatgtatagttgtatttcattgttgttttatattaatcttcccccaaaacacatgttaaatattttttcatgttcattttccatttatgtttcttctttagtgaggtatctcttcagatactttagccagtttaaaatcaagtacatctatatatggtataataatcttttatctaatatttgtttttcaagtttttttcttacagtgtgtagtttttcttttcctttttgataagaatgtattttgtataatagaagttttatgctttactgaagtctattaatcattctttttatagatcatcattataccttaagtttactagatttccttttaggtaatcttttaggagttttaatgttttatatttttacacataacactggtccattttaggttaacaatgcatttaaagttaattgtttgggtttgaagtctgtttatagacttcttatctactagttatgttgaacttagaaactcatatatgttaggcaaacactctaacactctatcaatggaaccatgtatgtcagttctatattcattttatttgagacagggtcttattttaaagtcctgattgaccacttaattggtttgtagacccaacaggcctttgcctcttgaatgctagaactaaagatatgtaggcacctacatatcttctattttaaattttgcttttgcatgtgtatgtcctgtctggtggtgattcttgaaagatttatattttctttgttagatcttctttggttctttgccaaagataaatggttgtattaatatgtatccatttatgagatcttatttgattatactgattaaagtctattattttaccagtagcacattgtttttatgacttgaggtttatagaaagtctttgtggtttctacaatatattttgatcatggtttctccttcccatcttcttctacttcatggggatttagaatcaccatagaaacaatctcttggcatgtctgtgaggtattgccccaattaagttaactgagataggaaaaaacaacctaaatgtgggtggtgtcatccacagactttggtcgatgactgaataaataaaagcaagaaagtgggctgagtacaggaattcacctctttctcttctctgtggccacagtgtgatcagtgagttcctactcttgtgccttcatgctgtggtggattagataccctagaattgtcataggaaatacattcttccttgagttgcttttgtcaggtattttgtcacagcaatgagacaaataattaatacagccttgaaattcgtagtaatgtattactgccttcattattttctaatattgagtttgttattttatatcatttgtctctcaatataaacttcagaaatagttttttttttaatagtcacaacataaaggttgttaaggtatttttttggggggagggggaggctgtattatatttattggtcaaattgggaagaaaaccttgtaactattgggtctttgtatccttgaatccagaaatcatttctatttgcttatgcttttatttatttcatcagagttttctagttttcttgatagacatcttatataaattttattagattgttacctccttaacatcaaatacatgtcaatgtaaattgtaacctgtttgaagtttcaacttgtgctttggttttagaacaggtttattggaagaatttgggaaaaatgtagataagaattaaggaaaagccctaaaattctataaccagaactaaatgggttatttggtcagacccttatactgagagggaggtgaccagccaagactgctcatgaagatggaaatgaggattctgttagtaagtggactagaggttattcatgttgctatagcaaataacctttctagattttttctgtgctctaagacttttgttaaatttgaaggtgttagactaattatccaggtagaaggtatttctacacaatgcagcattcatattacaatatgggttatgcttgcttcttttagccagatttgtagtgaaaaccagaaggaaaaagtaaagaaaaaaataatcgaaaacttgagttttcacggaaagttgaggcaagacaggtatagctttcataaagttgaggccaagagaggttaacctgccaaagagactaggcttcataaaagcaagccaactaggtgtcaaagaggttgttcagtgaggattattctgaaatcatatccagctttaagagggaagaacctgaacaccttatacaagttactacatatacaagcacactcaaacacacagacacaggcacaggcacagacactcaggcaagacaaccccccttgcaaacaaacaatctaaaaagtgaactacacatagcaggacagcaggaaagttgctttaagtgtatatcaggcactgtctagcagcactttatacagggtcaggagcataaagatttaactaattttatttaaatactttgctttgagaagaaactattggttatttttcttacttgggactggagagatggatcagcagttaagagcacttgttactcttgaaactttagtccagtccattatacagaaggcaaagtgttgagaacatcagatatttagtcactttttaaaaataagtttattttgtgtgtgtattcctttgatttagttgctatgatttttttctttatttttcttttagccaacataatatccctattgattctttggaaaattcatatactgtaccccgatgatgatcacactcactttccgtttctctcaggtccacctttccacctgtgcaaactctccccaaaagaaaaaaagttaagccaagttaaatttttgttgcctgcatactcattagagaactgtcaaactcccaggggccagcctgggataactgagtcctctcccaatccccatccccaacataagccattaatgtgagaagctacacttcagcatctttgtcacaatttttttagaactctcttcaatagcttcctatttgaactggttctttgtagtgggcgggagaggctgtcatagaagccttcagtgtctctcattctcaattatgagtctacagttatcaataccactgcaaaagaagttttcttgtgcataacagccagtggcagcatgaatcatggacttccatatggtttctgatgacagctcagaactgaactggtcctcacaggctgcacagatcatgcaccaccgatatcaacatagcctcctgttgcagccctaatcatggttatcaacatgacctcaggcctctatatagaatgtggacatcaatgtgggcagcacataccatgtatattcacatggcctccagtggtaacatgaaccaaggcatcaacacagcctgtggttacatcatgaactacagaccagcagcatggctcctggctgcagcatcacttcagacttcaatatggcttctggtggcagcataaatcatggagatccttcaaagagacttaatacagagaattgctatagtttatcttagatatcttgttgctcagagctagggtgattgtgcgaccaggcagcatgtttgtggaaagagcctgtgcaagctccaggctgctatacaccatcctgccagccctacttggcaacggcatgctcctttgttgcagctctgctcccatacctgtcacctcccctgtatctccagttcttcctcgttgcatacctgcctgctcttttctgccatctttcctacatctatcacacattcacttattaaagggacattgcaaacatatatatgtatgtatacacatatatgtatatgtgtgtgtgtgtgtgtgtgtgtgtgtatgtgtatatatatatttgccccaacagctttacatgcgtatacttactgcaatcagtcattggtctggttcaaggtttctggtaaatactggacttatctctgagactcatttcagatatcacgttctctctgagtcagggtgatcttgtgcatccatttctggggtaggatccttgaaagctccaggtcttcctgccctttgtgcctgctccctatgggccatgtcactctcttgctgacacaatggcaagctgcataagcatgctctgttggctgctgggacagcactcccatgttatgtgtgacttctgctccaccatcttatttccacttccataagaccactttttaagagcattttttctttttttttttttcaaaagttcagggaatcctatagaaatgttgggagaaggattgagggacccaaagatttcagggactctgcaggaaaaccaacagagtcaactaacatagacccttggggacttccagagattgaaccaccaaccagatagtgagcacagaccagacctaggccttcggcacagatgagcagtttggtcttctagttgtaggtcccacaacaactggagcaagggctgtccctgactctgttgcctgcctgcctacctgtgatccattctcataagtggatctccttgtctggtctcagtggaagaggatataccaagtcctgcagtgacttgatgtgccatggtggtggtatatgagtgtgctagtgaggggttcatgagggattattttaaaaattcactgttatgcaaagaataaactatagaatagcatagccacatgcttctatttagaaatttaaaaaaaatagtgtcagggattggttcttgcccattggatgggtctcaagttgggctggtcattagtttgtggttacatctgtctttgtaccatctttgtccctgcacatcttgtaggcaagacaaactccatgtccaataaagatctacaggaagtatgcccctatctctttaggctgtgacaactggcctttaaagggtgaccactgtcttacagaggcaggcctgtgttttaaccaatgtctattctgaatttaagctttatcaaagcaggtttttttttattcctcttcactttctcatctgctagtcatttatatagcccttggttgcccttgtgttccttaagtgtgtgactagtgtcccctatgctttaatactaacttatggctttttatctattacccattttctcctctttctattttaatatttggtacctgagggatttgtcaggtgttatattattagtgtggtaggcagatgtatacatgtgcagtaattgttgtatcctgaataatgttaatgtgttttgtgctctgcctttgtagttcttttgagtgcaatggcatgggtattatatttaattattttaaatcatctttctcatgtgtgaccctgatactaatgttttgtgaggtttctaattatttccagtgctgatacaactgtataacattgccatttattttataattactctgtacccatttgtgtggccttttgaggctgcccataagtctgtgaatatatatatttttgcttatttatcaattatggattctctggctgtgagaactgcagttaggagtttttattgtgaagtatgttggactccccccacccccacccccaaagtatctttccataagacctgcccttttgtttgcttgttttcgtttttccgcaacagggtttctctctgtagtcttagctgtcctagaacttggtgtgtagactaagcaggcctcaaactcccagagatcctccctcctcagcctgctaaattctgggattaataatgggcatattccaccataaccagctgacttgcttcttcttttcttttttctttttctttttttttctttttcttttctttttctctttctttttcatttctttttcttttttttttcctttttatttccagaggtgctatacattctgcagactcatcttttgcagatgagcctctccttgaagcctccttgggtttttcaggttcctaggagaccctgtgggtgccagctgctgctgccaacctgaattctgctttatctaatcacattgtatctgtagtcaagaagcagagacatggcctttgaaagagggttaagtggttaaaagcatttctgcttttctggaggacctgtattcagttccaagcagctacatgacaggtgacaacaatctgtatctcttgttctgggtgatccagtggcctcttctggcctccatgggtaccaggtgtgtacatggggcacatacatataacatgtaaatgaaacactcatacccatataataataacacatcttaaaaaggaagcagagaagtgaatgttagcatcttccttttctctctttttattaagcatgagacattagttcatgggacagtgcttcccatgtttaggatacgtcttctacactgtaaatcctctttagatatttcctcaaaggtaagcccagagatgtaccccctatggtgataacatatccagttatgttgagtgtagactatccatctaaactggggtaccctgcttgcacaggccgattaaggaaatgattccatgtattcagctgtgtagacactcagtagccttcttagtcattattcaagggggctcagcctgctctatgaactgatagcaaactgatagcagccatcaaggaggcaagacttgagaggtcctgaaagctttttctcacatttcaaaataaaagtatgtatatagagatgcaaacagtgtatgtatggggggatcaagatcctcctgtagtcagtctctaagaggataatgtatgaagatatgaatacagcggagactcagaatttagagataataaggaaggaggagttactcctgaggaaaactgcaagcagagtacagttattcaaagagatgcatgtcatcaggattgctgtttgcaagaccatagggatagggcttcccaagctctttgacacttcatatcacaccatgtgcctcaaatgctgggcatgcagctacaggatttgatgcctaagaaagcatcaaagcatcaaatatacttgatttcagtcttctttggccatatctctttcattgcttccattctttcatttcagaatagaaatggtttactctgtgccattttatactacaaataggaggtcagacttaagaatgacatacattgtgggtaggataggtaggaggatggttcagcacttaagaacatttgctgttcttatagagaaccagggttcagttcccagtgccctcatagtggctcataaattgtatataactccatttcaggtgatttgatgccttcctcagacctctgtgcaccaggcatgtacatgttgtgcatacatataaatcaactgtttatgaaaacaaaactatatacatcatttaaaaattatatatgataaactctaatttcagcatttattaagtactcttgaaatacgtgggtcttgtacaggctttatcctttgtaatttttaaagcataagtattatgcttattaaaaatgttatcaagcataattaagtaaccaaagagccataaattagataggtaaacatagatcttaaaatgttcatagttgctctgctttctctatattgtctggtaattgtgattataaaaagataaggagatattggaatatattttatgggggtatggtgaggtgtaggggaaggaagtgccttggcagtcccatgctgaggcttcccttttctctgaggaactagatacacaatgttatagtataaaatagagtttatttaggccatgggaggggagttaaagagtagtaaaggcagaaagaaggagagagtagagaagagagtagaggctggccatgaccacgtggagaagagggaagggaatggggagagagagaaggagcaagaggtaagagagagaggagggggcaagcattcccctttatagtgggccaggcctacctggctgtcgccaggtaactggggaggagcatacctggctgttgtcaggtaactctgggggtggagtccagacagaatacccatagtaaaacttggtatagccatttttaagatcattcaaagacttgtgatgaacttttcttagtatgtactatcttcttgaaaggtttgaaaattaaatggacaaaaattgaaataacagtttgaactcttagacttcagtgcttcatatttataactttggaattctttgtgaaaatgtgttatatctaaaacacttgactcgaaataagttaactggtttctatttcttttcatattttaagactgtcttagaagacaagatgtgtgttattttctagaatcctggataagcaaatgtgactcaagtttcagaaacaatatcttgttcaaagcactttatagtctatcaatctctttcaatgtaggtccaatatgcctaatctttctggtttgtttcctagtgttagacattccaaatctgtagaaaactatatgaatatcttatcacagtaatttactgtgacttgtgtgattctgggagaaagcaggaaaagtgagaaatgtaagcctagttttagaatttgacatcactggaaaaatcagttaatggaacatatgacaactttcttttctaaattactattacttatggaaccaataatcatgttggtaagaatattttgactttttgtttgtttgtttgtttgttttgtttttcgagacagggtttctctgtatagccctggctgtcctggaactcgctttgtagaccaggctggcctcgaactcagaaatctgcttgccactgcctcccgagtgctgggattaaaggcagtgtgccaccacgcctggcttattttgactttttaattgtaattttatcctaattcagttttaaattcccttttcccttacaattgacaagatagtattgctgtagaagtcgcacaaatatctcagattcacagtctgataaggcaagtatttgttgcttcagatatgaacaatatttcaaaaagtcttaatggattttgaagtttattttaaaaagcaaatgacaatatttgtaagaagtattaatgtcttctttatgttcatttcttgaattcaccaatgagattctgaatagtccattcatattgttcttatcccagttcagagatccttgtttctttcctaatagtatgtagtcatgttcttttaactgatatctctagctctgtattacctattcttaacaccaaatctgttcattcagagatgttgaagcctcggatttgctgcacccccaccctcttcacagagcttctgggaggtcccgctcagtatccctgcagatcagattggttagtcaggttttatgtgcctaacatttctgaatcatttgtgcacaaaatttgttttctattttacttctacatttccttaacatttattttattttaattaggtattttcttcatttacatttccaatgctatcccaaaagtcccccataacccccactcccctacctacccactcccacttcatggccctggcgttttcccctgtactgagacatataaagtttgcaagaccaatgggcctctctttccactgatggctgactaggccatcttctgatacatatgcagctagagacacgagctccggggggaactgattagttcatattgttgttccacctatagggttacagacccctttagctccttgggtactttctctagctcctccgttggagggccctgtgatccatccaatacctgaatgtaagcatccacttctgtgtttgctaggcccctgcatagcctcacaagagacagctatatcagggtcctttcagcaaaatcttgctagtgtgtgtaatggtgtcagcgtttggaggctgattatgggatggatccccgggtatggcagtctctagatggtccatcctttcatctcagctccaaactttgtaactccttccatggatgttttgtccccagttctaagaaggggcaaagtgtctacactttggtcttccttcttcttgagttgcatgtgttttgcaaattgtgtcttatatcttgggtattctaagtttctgagctaatatccccttatcagtgagtacatatcatgtgagttctttggtgattgggttacctcactcaggatgatgccctccaggtccatccatttgcctaggaatttcataaattcattctttctaatagctgagtagtactccattgtgtaaatgtaccactttttctgtatccattcctctgttgaggggcatctgggttctttccagcttctggctattataaataaggctgctatgaacatagtggagcatgtgtccttcttaccagttggaacatcttctgaatatatgcccaggagaggtattgagggatcctcctgtagtactatgtccaattttctgagaaacctccagactgatttccagagtggttgtataagcttgcaatcccaccaacaatggaggagtgttcctcttctccacatccttgccagcatctgctgtcacctgaatttttgatcttagccattctgactggtgtgaggtggaatctcagggttgttttgatttgcatttccctgatgattaaggatgttgaacattttttcaggtgcttctcagacattcggtattcctcaggagaaaattctttgtttagctctgagccccatttttaaatggggttatttgattttctgaagtccaccttcttgagttctttatatatgttggatattagtcccctatctgatttaggataggtaaagatcctttcccaatctgcttgaggcctttttgtcttattgacagtgtgttttgcctaacagaaggtttgcaattttatgaggtcccatttatcgattctcgatcttacagcacaagccattgctgttctgttcaggaatttttcccttgtgcccatatcttccaggcttttccccactttctcctctataagtttcagtgtctctggttttatgtggagttccatgatccacttagatttgaccttagtacaaagagataggaatggacaattcacattctcctacatgataactgccaattgtgccagcactatttgttgaaaatgctgtcttttttccattggatggttttagctcccttgtcaaagatcaagtgaccataggtttgtgggttcatttctgggtcttcaattctattccattggtctacttgtctgttgctataccagtaccatgcagtttttatcacaattgctctgcagtcagtataccttaggtcaggcatggtgatttccccagaagttcttttacccttgagaagagtttttgttatcctaggtttttttgttattccagatgaatttgcaaattgccctttctaattcattgaagaattgagttggaattttgatggggattgcattgaatctatagattgcttttgccaagatggccatttttactgtattgatcctgcccatccatgagcatgggagatgttccatcttctgagatcttctttaatttttttcttcagagacttgaagttcttatcacacagatctttcacttccgcagttagagtcacgccaagatattttatattacttgtgactattgagaagggtgttgtttcactaatttctctctcagcctgtttatcctttgtgtagagaaaggccattgacttgtttgagttaattttatatccagcttcttcactgaagctgtttatcaggtttaggagttctctggtggaatttttagggtcacttatatatactatcatatcatctgcataaagtgttattttgacttcttcctttccaatatgtatccccttggtctccttttgttgtcgaattgctctggctaggacttcaagtataatgttgaataggtagggagaaagtgggcaaccttgtctagtccctgattttagtgagatgcttccagcttctcaccatttactttgatgttggctactggtttgctgtagataacttttatcatgcttaggtatgggccttgaattcctggtctttccaagacttttatcatgaatgggtgttaaataatgtcaaatgttttctcagcatctaacgagatgatcatgtggtttttgtctttgagtttaagccttaagaatttgtttgggtctaatcaaccatctctggctgtcctggacctcagattgtacttttcccctccctgagcagtgttccagtgcttctctacagcccaacaccacccagcaatgtatggggtaaggaggttagccaggtcaaacttcccacttcccacctccccaagcaaccattccctggggcagagcaacacagggctgacaaccctatagtctagttctttgcttagttaccattacaacaattcagagtgtgatatactattcttgccgctgtatttttatttttatttttatttttcaattctggtgagaggaagggatatctgagtcttcagcacaccagaaaactcaagtgcctggtgacaaaaatctcatatagaatgtaattttttgcttttgtttgcaacacaaacacactcttaaaaaaaagaaagaaagaaagaaagaaagaaagacaaaaccaaacaccagcaagaacaaaaacaaacaaacaaaaaagagtttattattatatgtattattagtatatgggtgttttgcctttatgcatatcaatgccaagtggatagtatgtagttagaagtgcaggctctctgtgcttatgtgtctcctgctctttgagaatttctcacaatggtgctgggaatatggtgtatgttcaaaatatttatattgatgtattcaattacattgttgagttaatgatacccatttaacttgtcttttaaaacagatatgctaatgatgtaggtacttgagtaacatgtctagtgttctggtcaaaaagcaagattgtttatttatttatttatttcaagcaatacctctctctccctgggtggcattgaactcattgtgtataccaggctggtatgaagctcagacatctacctgtctgtgcctcctaagtgctaggattaaaagtgtgtgcactatgcccagctgagaaagataagttttaatgatgttttcttgttttgttttgtttgtttttttttaaatcaaagtatacttgattttatatagtgatccctacttttttgttttacttgatttttaattatcttcaaatttctcaccttttgctatttgtttgaataacacattcaattaatatcatgactcagactgattttgcatgtagaaagtttctcacatttatatttagccagatattttttgggaagactcaggaacatagacatgattgccttccataaactaaaatcacacagaacagaatttctccccctgcctcctaccagacttgttttatatctattttccttcccttccttctttgtttacttaaaaaaaaataacttactatacaaaattctagtattatacaaatgttatcgcattttgaacaaagtatattctagtagattctttttcgtcatctcccctgtgcttccctagtctcattttcaaatttcacgtccatgtgtctttcatttcttatattactaaatgggaagattatatccagatgtctgggtaagaaacaacctgagtataagcaggaatgtaaccacaagtggaggtcagaaaacaactttgggatctgttttctccttctgcctttacatgtatgtgttctgggcatggatctcaaaccctcaggcttgcaacacaagcacctttatctgatgggctaccctactggtgcctcacagtcgtgttcctggtcttagacttaaagaccttaaattagggagctagcagcagtctgtattaccttccctcaaagaaatttctgttctttactgcttttcttctcagttaccttctcttcttctttagctatacaaataagtgcaagaaaggaagctgtctttcatcagtctgtccctttttttgatcataatgaactgaaatgaaacagtttaatgcacactgctctcattccaagtgtatataaaaagcaggtataaagtttgaaattatcatcttacctgatatttagcattcctttgactacaataaccttataacctagtaaataattactttgagagttcacactgtattgaagatttggcctgtcccattgtctacttgtagtccttagtgaagattactatagtctcttaaactttcattgaggtttcatatctaaaaaaaactcacaaagattatgtggattttcttcttcattgtccatttctttcctaactggacaatagccacaggctgtttaatgattttttttttcctgttactttcagtcattaatgagggcctgcctagggacaacactgtatagtttaagttaactcttacttgtttttctaggtctagccaaggcttatctctcttgtggcatagttattgaactttaactgatgttacattttatcctgttaaattactgcaaggacaagtggttgtttttctttttttttttaaatttatcatattgtggttaagatattttttaaactattgtgtgacttatttcccagaagctttaattaaattggatgtttctgtataatattggccatgaagtcttgaatcttaaggacactacattatttttatttcaagaactgtttaacatatctctatgtatattattattgtaagctatgaattatattaagatggctaacagttaatgtgcttctggctttctttttggcatagataaaccttattgttatgtgattgtatattatctgttgataatctgtatttaatgaaatgcaattccaattcattttcttggactttctccagccaggcagaactcagacagagaacattgatgggcttgccttataatctgaatttttcaaagtatattggcatggatctttctgataattaacatagctggatattttataaccataacctttgatttgatcataaaatatttaacaagaaaaaatagattaattttaggaaatattatcagacctttagagtattttcccatggaaccaagactaggtgacttaggaactcagttgatataagtccctcattcactgtacatcacatataacatccacaaagaagctgccagcttcaagggtgcctccatctgaagtaaataattacctgacactctatggaagatatcagagaatactctattagaaccatcaaaactcactgaatttgtttcttttaatcggttcagagttgaaacactgagttgaaacactcagtgtcccctcttaatatgttcttaaaatatttgaattaatatttctactttccagaaaactgatacatttaatgtggtgcagaacagcaataactgcacaactttatacaggccatggaggccatacttatctgtagtctcttctgtttgttatttggttagttgggttttggtttttcaagacagggtttttctatgtagccctttctgtcctggaactcactctgtagaccaggctggcctcaaactcagagtctcaactgcctctgcctcccaagtgctaggaataataatatgtgcctctacagcccagcctgacctagggaagagtctcataaatcttgctggagcaaggaagataagaagcttgataaacacttgttaggaattatatgtcttgtctctatgatataggaaacaaccttaaggtcgttcctcatctgttttctagtttcagatgagtgagtgactttctgctttgggaaaatagtaccacattgattttgtttttgctgtctatgtaagtaataaaataggtaagtcagtgatgtatatttactaatgtaacataataataatgtagtaatacacataggcctgttagccactgtgttgccacattagcgatgtttgtgtgtcataggaaaacattcacaggccaaacaactcagctagcatgtgtatcttaggatattccttgaggcttgtgcctatgtctgggcagaatgggaccagaacagaatttcgtattggaattaatcttgactgattttcttatattgtcagaccaagttaaaagaaaaaagatctccttcattagaaatttttgttcacaaaattgaaggaagtttgcttctgaagctaccctctctacaaacatatatttgaatattggtaggaaaggaatagtgacagcgtgtgggcctattcagattagtgccctttaaatatgttgttgcctcctattcatcaacccagtagactgttcaagctacaatactttgaatttctctctcttaaaaaaaaaaaatcaaggttttaccatataagcatttgcacctattctggtattatctctgaaaaataatagaaggcagcatgaaaaaatgttttctaaatttcatattttaaaaaaaaaaatgtttctgtaatacttgcctgtgatggtttgaatgaaaatggctcccataggttcatatatttgactcgttggtcccaagttgatgggactgtttgggagggattaggccttgccagaggaagtgtgtcactagggatgagctttaatgtttcagccatccctagcatacttctctctgtttcctgattgtgaatcaggatgtaagcttttagctgctgcttcagtgccatgcctgcctgcctactgacatgttctccataacggttatggactcctgtccctctataattgttagatccgaataagcctttcattctataagttccttggtcatggtgtttttatgacagtgacagaaaaccaaataaatacactcaatcatccattgtatccattttaaacatagtcatttgagacttttaaattttctactaagcattggtaattgcatttcagattctgatgtagtttcattaccatatagtctctaatgttcatttcatttctcttcaaatttattatctgtaaaatatttacttagatttgtgtgatttactttccagataggaaatgtttgctgagttttctcttcctttctctcttctctatttcacactcacacacacatacacacacagatgcatgcaagtcctcatgtgctttgtctgtctgtctgtctgtctatctgtctctctctcttacatacacactgagttacttttgaagtagctcttatctaaattttgtctatggttgaagcccctaacagtctggtatctataaaagtgtttcagggcttagtcagaatcaccagtagttagagattcaggtttcaccctgtatttcttctttcttttgaatgatcatgattccttgaatagattttctctacttctctaaagccagactgctacgtttgtttgtttgtttgtttgtttgttttttcttttgctctcacttttgccatacatattttgtttgtaaatactcctatgctgaaagacataccacaccatctcacttctaccaagtgagtggacactctccaacttgtgtcagtctacttctctgcacatactggtaacgttattgtggcagtttttggccttagtttacaattattttgctttgcatctcttcaggaactttatctatgcttcagttagaaatgttgatagacagaagtctggacacactctctagctctcttcctcctgctattcttacacttatcagtatttgccaatatgacttttcttgttctgtaagccagagaaatgagaggcttagcccatgtcctctcactgctctctcactgctctcaccataagtgctatatgtagccctgatcaaaagcgaaggttaagagcgccatgtggctttcatctctccttgagttctttctcagattctgtatgcttctctcccataccttaaatttatttatttttttattgtatttggatcattacattttgtaattcttttcctgtttttatgtggggatcctataggtgctaaggttatcatacccagaaatggaaaggtttcaagcctgtttttccccataggatggaaaggcagactaaaccaagggaaacacccacctctgttttactgaatcatcttttcaaaaccattttagttactattcttacagtgttcaagacttttgtttccatatgacagtgagtgggtatagcaagttttagatgtaaaaatatcccttaggaggctatataattcccacctctctaaaatatattacatttgaaaatatgttgcacagaatctgcagatattttgtttgtttgtttgtttttgttttttaataaaagagaaaactatttacaccaagttttgcgccaaatgcttgtttttttagaaattgtatctaatgcaaactgtattgagaaattatatatttaatgcatgatagtgatagtagagtgcattaataatgcacccactgtaataaattactcagtaaaatagctaaatgtgaacattaaagaaaaatagttttaagttttctttcagtaatgtagatgctcagctatatgtaacattttcctaggtaaaaattagtctattatgatatgctttattatatagtactatagaagttaagacacttgaagaaattatcacagatttaaaagtatagaatagaagagaatgagaggtttttatttatgatttggaggagagccttaagtgctctgtcctaggtgatacaggtagactcagaaaccctgaaaatatttgggggtttctcacttccttaagtggttatcttgctgttgactcttgtgacccatggctacttatcaacttgtaagcagcttctttctcccttagacatcatgaattgaaatcaaatgctctaagctacttttaggctttaattgaaaaaatgacttaagacaagaatgacaaggcaagttaggctaaagaatgttttcatggacaactatgaatgtggccaatggtatacttttcccccagatggttaaaaaagattcatttgtaatttagtggattttttgattcttttgaggatccagtttcatttcagttgattctctaaaaaataccacattgattactatcctttgacttactctcacatctgcagtagatgaatgaaggcctcaattaaataagaagaaaagagctatgctttcaaaggtcttgctgcctatctccatatttatgttatagacatagagaaagtcttatttaaaattaatattaaattagaaccccattatatgttggaattttgcaaatacttgttgaaagagaatcttctcctcaaattagcaacaatattggtatgtaggaggacctttttctaagactgatttttcttggtgattaatgttggagctagacatttcagaggcagtttccaagtaaatgaatagatggtgagataatttcttaaagttcttagatctagtcagtctctagagactttgaagctgtgagttacagagtattctgatttgatctcctgggatctctgccagattcataattgcattgagattttttaatgatcacaaatgatatcatgatgcttttctctttattctggaagtaagctgattactacagaggaaggaataaaaatagattttagtcagaagacttggaagatcagatatcaggtcagatgcaacagcatatctgatacatacttaagtagtcactgagttgtgactaattagtttggtgaaatagccttggttatatccattagtatatacacagtgtgggacaagttttatattcattgctttaatcattcaaccttgacagaatacttggccgtggtacttttttttttaaacttttgttataaagacaagttatctttcattacagtgttctaggctcccagtcttcttttttagcatgggaatagaagtgggaggactgggcaaaaggcagaataatgtgttctttcccttttgctcctggcaaataagtctttattttcataatttttttccaggtgtagtcaaccttatcattctcactgtgtgccctttcatagagtgtaagatgtttttgttgcatttttaatgtgtatctgtctttcttatgcaagtagagagcttaattattaattcacctgcccatctttgttacacccacttaaaacaaaacaaaacaaacgaggactacaatcaataaagccttaggtaaatatgtagctactttagagagtaaacttgaaaatgcctggttcttagaggatgtgtatgtatacacacacacacacacacacacctttctagttttctaatttgacaaacagcatgaaactctcttgttgctgttattgttcaaatgactatattccatacaagaagaaagagggcaaatagaaggaggatttggcagaattctctcttacaacggtcttatttattatatcactttgagagagagagagagagagagagagagagagagagagagagagagagagagatctatagtaacaggaattttgcacatgtttgatttatactaaggacaaaacccagagctttgtgcatgctaggcaagtgctttaccagatgagctattataactctccaacctcttccctgtttgcaaaatgttgtgatattatttgtagagagtttgtttaatagatgcatccaacagtgatatggaataatcaccaaagaagactgctcagaccttggtttaagccattagaaagtctttattagctggtcagcaactatactaggttttcaggatcccagtatagctctcagcctttctcagggtgagcttttaggcacaaaacctatgttttggattgacatacttcagttcccaagaacagttagcaggaaatgaaactacagaagcccaaaaacaaagtatagtacagtatatttagattctttcccaggactatatggactttgatggattaggcctttgttatagttttgttgggtggttttgtctatgtgttaagttttacagcctaattggtacttccatcatggagtcagttgtgctaaagactggggcctaagctggtgccctgttacattccccactggtcttagtgaatgagtcgaatcatgggctcatcttattttagtgtaagatgcaggaccttgctgctaatacaatcagaatgagaattaaaggcccagccagtgttgataacaaagtacttaggcagagggaccaagagaatagagtctggtaccaattattttctcaactatggcaataatttttttctacttactcctgatcaattagtatagaaacaataggttttttccaaagccatatatagtttcttttatttcatgagtggtctaagcctctccaattatgtagagccatttctgcaagggagtgtaaatgttgttttcatccagaaactgaaacttttgatatctctaggacatgatcaacctatctacttagtttagaaagcagaagaggcacatttagtcaaaccactagtacatgccaaccaagtagtcgcagagatccagtaatattgctattatccatatgaattaacccataaggcagtgggcatgggcatcagaataaaggaaaatgcctaggttaacggttttggatattagacaagttctaggcctttttaagtcctctaatatttttgcgggggagggctgctcccagttacactgagctttgtcagtcagctgacagtctggttagttcctaacatgtatagtacaggggatagttctcttaagcataactggcaatcctggctaatttgggtcagggggagctggacctgagcatgataaactctatacctagggacccttcctgagttatagggtgattcccctgttttgtttgtttgtttgttttaatgttttccaaaggccagaatcatttaaagattttttttcccttttggaatcctcagttttacaatctcaatttttgtaaaggaaactaccttgctatggcaattagggtgccctcagtcacaaggcatgcacagaattgaatattcttaattcaaaagataaatcccaatatctttccttcctctagtataaccagatgtttaaaatggacatcagcaaataaaagtcaagatggaaagtgggttgcttctttgtagttacagtagctaatactttctctgtatctgtcttcatcagttcccaggttcaggccaaagggccataggggttagcccataaccctgtattcatattaaacacatgtttcaggagaaagtagagtggagtatagagtagaagttcctggagcccaatgaaacctaaatttcaatgggtccacagtctagaaataattcatttggcagcatccatggcttctacctgcttgacctaagtgaggtggatccatgatgtaattaatgccagctatctttacaaataaaagactgaagagaatcactatctagagtcctttcaaagttgctttaagtaagtaaccctttagctatctgcctgatgcagacaacatcactggactggaacaaggggaaactggtaatggacttggaggttggctgggtctcttggatagtccaatgaatggaggactggagtacctgtagtgacttgaaaaagagacagttagaaatctgccaactgttggtttctgtgcctgggaagcagtcggggagatcttccaaacataatctcatgggggtaaatccctccctatatggggtgtagaaggctgatgcaaagaaaaggaagggtgcctattcatgctttgctggatgctggacgatgagagttttgttaaagtttctcttattgtcctatttattttttcagccttgtcagaacactgagttctatatgcacagtgaagttttcaatctgtgtctaaagccttagctattaattgagagattttgactatgaaagctgggccattattggaccccattactagggggaggctaaatcagagaaccagttcctggaggagctttttagctattatttgagcaatttctatttgggtgaggaacacttttactcacctggaaaaggtatttttaaaaattagcaaattattttgttcttccccagatggcttgatcttggtgaagtcgttttttttttttttttttttttttttttttttttttttttttttttttccagagtttgtggggatgttgctctctcattctgaccccatcctgagtaagggctctctgctttgtatttagctaagggcacacctggcatcttgctgagacatctcatgatagactgtccagtcaagggataacatatcttggactgaacaactcagaatgtttgtggaccccggataagtagcctggtgaaggttagttcccaaaagtcctgccaattctttctaggagtatgatcttcccctctaatgtcctccattgtggcagtttgaatatgtgtggccaagggagtggcactattaggtggtgtggccttgttggagtaggtgtggccatgttggaaaaagtgtgtctctgtgggagtgggcaatgatatcctcctcttagcaatctggtagtcagtcttcttctgtttcccttaagaacaagatgtagaactctcagcatctctagtaccatgcctgcctggatgttgtcatgcttcctaccatgatgataatggactgaacctcaggacctataaactagccccaattaaatgtcctttataagagttgccttggtcatggtgtctctttacaacaatgaaaacactaagacatctatcaacctgtgggtttgagctgttgtaatcgtttatatatgcttgggccggaaagcagcactatcagaatgtgtggccttgttggagtaggtgtgtcactgtgggtgtgggctttaataatctagtcctagcttcctggaagccactattttgctagcagccttcagatgaagatgtagaactctcagcatctcctataccatactttcctggatgctgccatgtttctgccttgataataatggactgaacctctgaacttgtaagccagaccccattaaatatatgtttttattagagttgccttggtcattgtgtctgttcacaaaagtaaaaccttaagacagcttttcatttttaccatggagtctcacgcagtatgggattgtaatatgtcatcagaatatcaataggccccattggtcttagagccatttgttgggcagcagcccagcagtggaggacaacaatttgtaggggaagccaagtagcctctaaaggagggccaagattttatgtcccatttttttcagcagtgagaaaccctctatctttataaaccataccatggacatggctggtagtaaaaccatactgatggctggtccatgaatatgatggtagacttttgttttccctatccaagagcatgggtcctgtcaatcaattttgctctttaggctgaggtaactggcatgggtccagattgtcttgataaaagtaactactgcagctcccacgtactttgttttatctttcatctccagacattcatggatgaatgcctgtgcataacagagttgatggcagtgggtttttcagctgaacttgtgggtaggtctggagtcaggcctggagtagagccacacagtctttatacagctagcattttggtgctgcttctcagagaagggcctcaactttgttgtgagtatacaatcttgatcatgagttaatttatttgctttccttcattaaactagcagtagcttccatagatagctctttggcaggtggggctatcctctggctacagggtacaatcattttgacagaaatgtcatgggacatttccaagacctcaaagttcaggttaaaaccccttttgtcttttttttttttttagtctcagtaaaagtacctagtgaaaattgcttaaaatctccatggttgtgttgaacaaaagcgaaatccattttgtccaggctgtgttgtcaggcagcaatccttgtgcccagcccaggggagtttttttttttttttttaattcctttttagacaacggtggatcttacagatcattgatttaaaaggtggcataaatcataaagaagaaaggaacggaactttctctcttccttcgggttcaacccaggggaatgtttcctcttccccaggactgcttaaagcagacatgcagagggaatactcaccttggagaacaatttccctctccctgtatacattcttcttaaaggacagcaggccctgctgtcttcataaaggacagcaggccctggatcataggcctggcctctccccctccacacaagggccaagcctgaccaggagcaggaggcagtcaacaaaatgaacaagtatgtttgctccaggtagatgttttttgtttgtttttatttttgtgttttgtttgtttgtttcttggtatgtcttggcagagtcacaaggattcagctccccagtggaatggagcacagatcataagccagggagttgtcccaccagaggctttgaaacacccccctccccagggtcttgaggtctgcctctctgggacaaatctcagtgggacctccagaaatgttgtggggttattcaccaaagaagacttcttggatatgggtttaaactaatagaaagtctttattagctggccagtaactacactgagtgattgggatgctaagcttttcgaagggtgagcttttaagcacaacccccccccaccaagttctgagttggcatacttcaattgacagacagttagccagaagcaggaccttagaagctaaaaggcaaggttagtacatttagagactttcccaaaattatatggactttagtgaattgggccctttttttagatttgtcaggtggtgctgagttttacagcctgaatggtacttccatcatggatcatttgtgatgaggtttggaggtctactaaattctggggccctgttacaacagaatctctggttatcagtgaaattttttttttcagtctgcttgaatgaggcttgggctagctggaaacccttaggaccctcgtttttctgttttgttttgtttttgtttgtttgtttgtttgtttttaattctacctttccttttattttctattgtcttcttaagggcctcctttctgttatttctgagtttacatgtgttctttattcgtttccacttcgtcaactaattatgtattcttgttctttcctcatatgcaatacatttgtttacacatgaattactatttctttgctacattaataggaattccaggttgatattgatacctgttaataatcttttcccccagagactgtggttccctctacaggttttggagggaaaaaaggggggcttttagggatgtttttgtatttttcatttctagaaaattgtgttcagtttagcaataaagcattttcttccttgtggaacaatttgaggggaaaaaagattgaaaaagaccccgtatgttaggtaatttcagaccagattttctggtgcattcagagcggtatgtggcgttagatgttatgtaatttcaaagaagactcatttggctgtgaaactaagggctcttaactctgtgaccaaagatttcgattctccaaaggatgctatagtcactcattatgttatcaaacttgtataatcctgtgcctcaagtcaggttgagacacctgttctcagtgaaaagcaacaatataatagtggaaaacagaaaatggacattcatttaatggggcatatttcaaagagggcaaaagagagccagtgaaatgtttctgaagtacagatcctgaaataagactaacaagtatatagagggccaaggacacttaacatctaagcagtgccctccaaagtgtagttttaccgaccattgactcatcattgtctaggcttcaatttcatttatacagtggtctaagaagttgttagaactgcttgaagtcacttccctggagaaaagtgccccctctggtactttttacttctactagcactagattccacattttgtggggctcattgttttatagtctgacagtcagattgagcaacataaaatatcttcatttctgccagacctattataaacagggttttgttgtctggggagatggaaagtgggtgatgtagggaaataaatatatttcatatattgatttatctgtttgtatgaatttacagcttcatatgtttatgtaatgtatttagtccttttcctctttctactctctttctgcaggccttcttaaaaaatttcccttctacttcttttttgtatgtggcctactgaatgtggacttatttacttactctgcatggtgggcggttattgagtagagcaagggcaactttttagagactgtaccaccaaagtttgaaaagaccatatatgtaaaagagtctaacaagatagttcatctttgtagaaagtttaagtttttgagaagaaaatattcttgaatacttaaaaaaaatctgtacatatccatggcaaaaagaaaccttatggttttatgtgaaaatgataggagagataattgcatctagcctatatgttcctgttacatgttccatgaatgatcaaggaattgtaaactaatgaagtgtcattttttaacttattggatcaaagttgaaaaacaaaatgctaatactcacaaatgtgttaagtaggcagtgttctaagaaagaattttgttgttgtttatttgaggcatcttctagctttatagcccccactggcctggtactcactgtgtagcctacactcatcttgaacttgcagcagctttcctgcttcatgttcccaatgctaggatgagagacatattctatcatgcctggaaaaaaaaagctctttcttataaatataaaagatgggagtgggcctgcatgctgcaggccttttcaagtgtcctgagccagcctacaggactccttgctgcagttgcagtgcagagtctggagctgttgtggtgcaagtcatgactggacaagcttttataaagtttcttctgctctttctcagagtatttgttgaaaggagtgctactgaaactgtaaccaaaagtagcattatgcttccagaaaagtctcaaggaaaagtattgcaagcaacagttgtggctgtggaatcaggtgtgaaagggaagggtggagagattcaaccaattagtataaaagttggagaaaaagttcttcttccagaatatgaaggcaccagaatgttctagacaacaaggaatatttattctttagaggttattaggactgaaattagtgttgaaacggtgtcacgtgaagctgcccatttcgttgatattctatttgatcatgtaaatttctatacctcccttttataataaacggatgatgcctaaactgacagccattgtccctgaagttcagttttgctgtactgttagaaacatttccaaataaaatgatgtaaatgagtggaaaatttttggtaaaagtaaaataacataaaggatcaagttacactaagtagaaagcctagtatagtaggaaattctgcatttactattttttttctaaatatgctttctaaagtcttatcttccctaattggatttgctttcttctgctaatttgaggcaaccaccctgtaatataatactcttgttacactaatgataaaatgaaattcatcatatccttctagatggtaagttactgaataatgactcacccaaggaatttattattagaaaataataagtgtgtataaaaaagaggagtgtgtttttctcttggttacaatgaaatgaaaccatcctaaatgaacgaccattaacagaagactgcttataaattactacatgtagggggctataaagaagctaataaaatggatgcattttacaggttgttagcctaaaggctgtcaatcagtttagtgaacagaaaatattaatcagacttactacaaaagaatctttattcaggggcagtggtgacacataaacttaatctcagcacttggatggcagaagcaggctaatttctgaactctcgagttcaaagcaaggctggtctacagagtgagttccaggacagccagggctacacagagaaaccttgtctcaaaaaaaaaataaataaaatctatgttcaatatagtgctaacacatatggctttgtgttaggtgttaagtaggaaaataaaagtaaaggaatgggaaatcaaagtaaaatgatatacatgtatgaaatgttttaaggaaacaaattattttatatgaaagtagacataaacaaaaaagcaaaacaatagaaagagcaaaaccaattatgtgattattacctacatttcactgttttttttgataatgaaacaatgtgtgaaaaagattacttgaatttatagttaaagaaaagcagtgagacagacaactggtttatttagactgctgaagagatttgctgtcttagcctggagctcctaagtgttttctgtgccagctggttactaaatgacagtactgcagaggccaagtcatgtcctcatctcttaagtagtttgccgtctgagggaaatactgtgcagttagaaagtcagtgcataagaatgagtccatttgatttaagtcttctcagaaattcagacagagatgttctggctaatcagcatgcatgactaaggaggaagggaattgttctgcttgtaataattactttcacaatcaattaaggtttgaaaatgaagtagcatttaaataaaggcacataatatgagcaaagtctttgaacagggaagttattcaacatttgtagaggtctgagatgattcagttataatgtacttactattaaaatcttggaaaagctgaactctgggctgggctccatctctgaaaatcttgctttaggacctgtgtttcatctttctaaaaatgaccttttaagtatcaacatcaactgtagaatagaatctattttcaggtaaaaaaaacaaacaaaaaaaacaaaaacaaaaaacaaaaagaaaccaactggttgttatttcatttttagcttaatgctacaataaggatagcatttgagtatgaatcttacttgaggcataggaggtctaaggacatagtggttttatcatcaagccaagatgtggttttcttatttctgaaacagaaatattattaatcatcctgggctcccctttagcccatcaggcacttatgtttacttggaaaactggtatgtgagacaggatttcagaagtttacagcttgaagctagtctccaaaaaaaaaaaaaaaaaagacaaaatgtttgttatttcccacctaccaaagtaatggacttgtggataaaaaaaactgagtgggtaaagagctccaccaagaactgaatgggcaggactgctctatttcataaaacactgtatcttttgaaatggagaatcctctaatccccattttcttcattctggaaaccaggtctcccataaccctctcaaaagcacagttcctttctttcttttccattgttgtgaagtgaccctatgatcaaggcaatatgtaagagaaaatattcaattgagagctttcttacagattcagaaggtaagtacataaccatcacagggaggagcctggccttctgaaagtaactaaaagcaaagaggttatgaaaaatggttcttaatatgtgactgcatgggactgtatctaatattgacccctaattgcattctgcttattatgtttacttcagatatatatgtattccacctcaatattgaagtgttagaacagaaagtgtgaaattgtaatgggcctagaagaaaagaagatagtctagagatgcgaaaggaatgataatttccccaggaatattgtgctgggagaaggaaaggaccttagccacagtaggagcttgtcttcctggagagatttcagttttaagaacttgtcagaccactttagaggattagactgaaaccccttcaatgaaaagtcaattcaatggtgagcaggatcacgcctggactaggacttaggtttgtgtattctttaacttctatttaaattttaatcttacttcaggtggtggtggttgtggtagtagctgcggtggcagctgtaagggctgtttgttgggtctcttgtttcctcttcccagtgtggacacattaaataaatttcctttttctgctttccatttaaaaatgtaagtgttctagcatttgccccatgtatggatttctataaattgtaaaatggtcataggcacagtgggggaaaaaaactagatctctcctttgaccaaattgtaattcaatccattttcctttgcccatttttatttcttaattctcttggaattatatagagaagttaagccaagtaagtttatgaactcaagtgcctagaaaatatagtttctttgaatgctggaattataagcttgttctgctctgttggctttacagggtttttgatgtttgtttggtttggtttttgagatagattctcattatatagctctgacaggccttgaactcagaaatctgtgtgcttctgcttctagagaactgggataaaagacatatgccaccatgtctggctttatagggatcttaatacacagattaagtgaaatagtataatggccttaatgcgtaaatgagacagcaaaaggagatcttcaaatctgctcagcacctgtttcatcacttacaatgaaaagaaaggtgtgtatctatgaaataaaggattagcagaaataagttcactcttcagaaagtggagtaccaaagtgacaaatgtccaggggaggaaaaaaaagatggaacaagttgtagtggtttctttttatctttgactttgtgacaacagataccctgattcagtttgatttttgttttccagggcaatacagatttggggaatcaatgtgataagctttccacaatctgttgatgttgagtagtaattcttaggcacccaaggcttccctcaaatgaactataaactttgcccttaataatttagaatggaatggcattctaaattcttttggcccatgtgcttgcttatcagcatttcttccagggctgtttgcttctgtctttggagaagggacagtgggtcagatctttcaggttttgtctacagaatggccattggcatctggatcaggtagattcaaagtgttgtctttgtcgtggtcacttaattggctgcactttctgttgtatgtctaggaaattttaggaaacaatttgtgagctaatttctaaatatataaatatagtatatactctacttctggatgtatttctgttggtctacttaaaaggtataagaaatttattattaaatctgcttatataaatatcgaagacattttcattgcttttcttttgaaaataacagagtaagcttttttttttttttttttttttttttttttgatctagtctcaaatcataagtgatgaagtttctggtcaatgaattttttttttaaatcttagtgataccacagttcatttaactcatgtttcttggcactgactactagggagtatatctctttatcagtgttatagaatatttcagccagttgtgttatacaaacttctatcttttgtattttatattcataatttttctgtgtcaggttttccttaaatactttatttttataaacttcatattatcttcttttatgatatcatttcacttacatattgtttaactcatctgaaaaccaagtggataaattgcatttgatactgaaataatgtgttgaattgatgtacagtatttttaaaaatttggtgatagtgtatggcaccaaattaggtgagatcaaaaatataattgggcctatagataaatatagcagcaactaatcatgtacatacagtaacccatatagtgaatacttgaagtgtatgtaaattatatcttgagttttctctttcaagcttccctgagtctcagtacatttcaccaggaaacgttttagtgagagaggaaacagtttcctacacatatttcacaactgagtaaggaacagaacacactgacctggttaaatttgccttactggtatcagttaccttgcatttacaatctgtggtctaactttgccactgtcatgctatgcccatttcctatagaatagttccaatgctgtttcaggtaagcatcagtctgtaaattggttaaatcaatttacttatatataaaaatctagtagtcatcagtttaattttcccagggggaaaaatatgcttgctgcaaaggataagatagctgacagcagatttccacatctgatggtctcatttttttgtacccaggaagttatcagaagtgagaataaaaattttaaaagactgatacattgctgctgctgctgctgctactactactactactgcgtctctgtatctagtttcaattttatctcattcctggctggcttggaataatatagaatagactagtaggaactcatagagatctgcttgcctctgctttcacaagtgctaggactagagacatgcaccatcatgcctggtctgctatattatatttgtttattgtacatgaggttattaaaaccttttgttagtttatgtatataagtgtttagcctgcacttatgtctatgtaacacatgtgtacctggtacctaaggaagctagaaaagtgtgtcagatctcctggaattagacttacagacagttttgatccatgatgtgtgggtgtttgaaattgaatccttggtaaaagttgccagtgctattaattgctgagccatcgctccagccctctgctacattattgttagcagaaaaaaaatagaccaaagttttaagggctgcctgttttaaatgattagatctactacactttatttttaagtagtaaaatatttagaacatggttgaattatcgtatatgaatgcttgtaaaatttcttagaatgaatagttctaaaaagtagatcacaaaatagaatatcatataagctcaacttgttaaaatacatttgtatgtttcaaatatagtaagtatgagtctataatatcatatacggtatatgtgatttctgcaggcattgaacaaaataggactttatgagattacatttccttttagggattggtgatattattaatttttagttaaatatgattaagcttattttataaatggtagaattttctttgaccttcaattcatagttcttctgctttttctcttaggattcatagctttccagttcaattagattaaaaagagtttaaaaccaaaacagataattcaggcctagcactgaattgggttttagggtttttttgttgttgttgttgttttgttttttgttttgttttcttttgtttttgtctttggttagtgtcacaataatataatcttcaaggaatgcatcatgaatttctttgggttgtttttgcatagcaagttattagtttgcaaaaggaaatagcacttcttcagggttctaaattttggttttataaacaaacctactcttgtgcttttatgagttgtaaatcttactgtatgtgatgtattattagttaattatttgaaacaaatttctcttaaaatatccttaaaagatatttataggagaaagatctttgataagaaaaatcacttccttattaaatatttttaaggtgcaagggtttaaacttagagacttgtatatgttaggtaaacactcgaaaatgagctatagctccagcccttgaataatttttttttgctgggagttgagtggattttgaacccaagagaaacaatcattaaagaaactatatatgagtattgtttatttaagaatttcattattcaaaataatcattctctgaagattcattgatttttactttatgtgtctgtgtaagtacctgcacatatgtatgtatgtgcatcatgtgcatgcctggtagctaaggaagccagaagcaagcatcagatcccatggaactggaattacaagtagttgtgaacaacctgatatgggtgttgggaaccagaccctaggtccgctgtagtagcaccaaacgcttttaactgcagaggcatcttggcagctccatattcagtctttagaattgaggttaatgttttaattgtgtatgcaagcaattgagttttagttctctcaatgactttaatgtaatatccttaagtattttcattacagtggcatgatttgttagatagtgatgtaatagcaatacatagcttataaaggtctttttccttttaaggcctccaagacatatcgaattccttttgtatgctatttgcagtgattattcaatatctgttttggtggcatacaatataataatggcagaattttaattgtgacaatctattctgcttttctagttattgttgtgttgagcgctttacatatgatctaatttattttaaacctcttataagaccacattaaaaaaacgtatatatattgttttgcatttcaggctgaaattctgtgctgtgatgtgcttaatattttgaaacccaaagccacattatttctcctttttcacttatatatggtgtccattaggcattgatcttgtcccgtaatattaactttctttaactgattgttctgctatctgaagagtcttattaaaatttaataagtaaagtaaaaataagcagctaatgctatggtacattctggtaactcataaaagaaagaaaaaagaaggaaaggaaagtttaatgttggcttgtgagtttaaagaaaggttaatacatccttactggctaattcaatcgtatctttaaaggatgaatttttgacccttgagatatgtataccacttacaggtaggatccatgtctgtttatgcaaaatttagtgttttatcctaagagcactgaactgcgctaaattgcatagcactaaaaaacaggctaaagaccatctataccctgttttatttcaaaaagcccttctggactgtgactatgggtaacatgtttcttgacctatttcttttttgtggtttccttccaatctactaaaaagattcagatcctactcatgtgttttgtcttcataatatcccctgccccttcccttgtcttgttcttgctttagaggttcattttcattactacttttctagttttcattctcaatctttatatactggaagagataactattgatattcccacttgatgttctttatcttttaaaaattattatattttgtgtgcacatgatatttgtgtgtgagcacatgcacatatggaagtcagaggacaactttttgaagtcagttctcttcttgtacccttacatgggttctgaggtttgaagtaaagttgcccagattgggtgttaagcacctgtaccccttgagacatcttgctggccctctttgtcttaatgactcttctactgctcaagcctttgttttcacaaagccatagggaacatttatataattatgactgtttgcttattttaaaagtatatgttccacctggcttcctgtctcatatatttgggagtttgaggtaagataaccaagagttcaagaccagcctgagctacatactaagtttgaggacagccttgcttatgtgagaccctgtattcaaaaagcaatgaaataaggccagtgaagtgtcagtggataaaggtacttgccatgtaggactggtgacctgactttgttcattggactccacataaggagaaagtggagtgctgtctcaacaaagttgttctctgacctctaaacatgtgccatgacacaaatggctgcaaatacatatcacatgtgcatgtacacatgtgtgtgcatataaacacaaataataaactaaaacatttaaaatacagacaaaaatatatacttcagtggatatgacttgaagcaaatactgtacaaaagatctccaaaagaccagttaacacatataagtatgttcaaatgtctcacttggttaaaaaaaaataatgtacagcatgccactacttccttctatcagagtactgaaaaaaattttaaaaaggtctttaagaatgtataacaactggaagcctgttggtacttgcacagaaagatttttttatacaaataaagcttaatgtaggtatgttctatgaaacagtaattccaggagacagaaatgtatacagcactgcttatagcaaacttatatctaaaataattcaatgttcatcaatagtaaaaaagtttaacatgcacctaacatagaatcagtagtgagaatgaatgtattccaggtctgtggaacaatgtgaatgggtttcaagagcatggtagtgagcaaaaaatgcttgaactaaaggactccacactaatgccatttttgtgacattcagaaatatgcaaaattaactgggcatgttatcacacacttgtaatcccagcactgagcagaaggaggcagtgttgaggcagaatgattatgtgtttggagccagctgcaaatacagtgagttcagggcaagattagggtatatggaaaaaccctgtctttactaccccttcatgcaaaactcatctactgtgtaaaaattagctgaataagcctagtcactacccttgctagaaactaagaattggatatatggagggctagtaggactcctccatgaaattttgttctgtgtcttaatctgcacgttttggtgacatgggtgtctttattctgtgagaattcagcacattatattgttctgtatctttgcatattttggttacaagggagtgtttattttgttagaatttaacaagggatatgttcatgatttcatgcttttctttttgtgttaccagtctgctagctgtgatccttatgctctattcagataaacattttagtagatgatgaaatgtgtatctgttgtttgcagttgtgaacctttaagtgttagtgctgtgactgggatagaagacctagaagcttccatccacagtcctgggagtcagagttttattgttccatgttttaaactaagaaacatacagttaagtaccaatggccctggcactctacagatccttggcttccagcaacagtgagttccatcataattcagaatctgctagtattaacctctttaatgggtattaggactatcagcacctacaatggttaatattacagctcttgagcctaaggctgtagaagccttactagcattacagctgataggcctagtctgttgtaactcgagccttggtaatgtctaatgttaatactcaggccttgagtgttagggtacttggcagttccttaaaatgcttccaatggccaagaactttcttgcaccccttcaccaacttcagccttgtcctcttctttctctggaagtctacatctgtccccttggcaatgtagcttctgcttctttcatcactgctgcagctccactgctgcagctattatatgctctttgtgtttacaatgcagcctgttctaatgacaatgtttaaaagtagacaggaacaatatagagaagccttttaacaggctcaatgttgcaacccccaggggaaggaatccctttcccccacttcctctctcctccagatccacttcctctgtttttcttcagaaaaaaagcaggccttccagagatatctaccgaacagagcaaagcaagttacaataagactatacacaaatcctcatagcaaggctagatgaggcaacccagtagaaggaaaaagcaggcaaaagagaaagaaacagtccccagccccattgttaggagttctacaaaaacactaagctaacaaccataacatatatgcatgcaaacctatataggctccatgattgctaggttgactctgtgggctgtgtccttagcctttgaaccctctggctccagcaatcctccctctctaatcttccatggggctggagaagtactgggaggagctcagggcagaatatattgtatgagagaagaataaataaaaaaggaaaaagaaaagaaaaggaaaggaaagaaaagaaaagaaaagaaaaaagaaaagaaaagaaaaggaaaggaaaggaaaggaaaggaaaggaaagaaaagaaaagaaaagaaaagagaagagaagagaagagaagagaagagaagagaagagaagagaagagaagagaagagaagagaaaagaaaagaaaagaaaagaaaagaaaagaaaaagaaaaagctgttaaatgccacctactattgctatttttaaatttataaacctttagatttactgactttttcatgtgtttaaatgttttgcctgcaccttatggatactatatgcattccaggcaagtcaggaggaaggccttagatcatcagcaactaaatttacagatggttgaactaccatgtaggtgctgggaatgaccctgggccatctgaaagagccatcaatactcgtatcactgaggtgcccatacttttaattcaagaaaacattagaaggagtatggcaaatcaatataaagttagcaaaaactcaacatagaactaagattgctaatacatgtaccaatagttaatagtatttaacaatgcttaacagtgattgactccttcactagggccccaaatggttgggtctttcttacctatatgtatgctccatttaaaagtattgcataaaaatgatatgtggtacattatctatgttatcctgtacattaaattttatcaaggcctagcaattttaattagcagatgtgtttttctgagaatcagtagttcaggagcagtataactgggtgattttagtatagcatattcctttcatatgaccctcaagttgtcagggctacagtcatttgaaggcttaaaaaggtttgagaatctgcttcgaagatagttgactcatatacattgaggtaagcctcggtaaaagctgtttgtattaaccaaagctaaagtacacacatactctaccacacatggaggtaacattttatatacaatcttacaatgggattatacaaagtttaagcccattgtgacttgaaaatattttaagttgaaaatgcagttaatacttacatccaccccattacagcaatagagtacaccaagttttgcttggctgactggcgtctgtggctcactgctactgcctaacaaaatcaagcgaggatcagatcatgtatcaccagcctggaatgagatccagattgagaattcacgtacattttcttctgaaaggatgtatctttcatacagttatgaagttgaaaactagtaaatcgatctattgaatgtcaagaaccatgtgtataatgtttcacatatatgtatatatatttatatatttaatatatatattaaatgaaaggatgtcacaattatactatgtagaaacctttgtatatttttgtgattagattatttatcaatttagttcagctttttttggtatccaaatttattgaggtgtaattgatgtaaattgttatcatatttatgtatgaagataaatttggaaacattttgaatgtatatatctacccacaaagttgttttcacagtcaagctagtgaatgaataagctgtcacactcccatgccttctttaaaaaagcttttcctttgtaatctctcctttcattatttattttttgagaaaactcctaatgtagcccaagactggccttgaaatggtgctttttttcccccattggtgttcagattaaaggccttaactgacctcattatctgtgagtaaatgttctccctcttcatatacatacatacatacatacatacatacatacatacatgactttgtaaaatatgtggcatatttctttctaatagaattttattggggattgcattgaatctgtagattgcttttggtaaggtggccagttttactatccatgagcatgggagatctttccatcttctgaggtcttctttgatttctttcttcacagacttgaaggtcttatcatagatcattcactcacttagttatagtcacaccaagatattttgtattatttgtagctattgtgaagacattgtttccccaatttctttcttggccagtttttcttctgtataaagtcaattttgtatctggccactttgttgaaggtgtttatcagctggaggagttctctggtagaattttggggttcacttattatgtatactagcatattatctgcaaatagtgataactgactttttcctttccaatttgtatccccttgatctccttttgctctctagttgctctagttaatgattctctgtttaaagcctatgggtcctggggattgaacttgagttgtcaggctttatgacaactgtcataacccactgacctctctcactggtcctgttaaatcattgtcacatacaaattcacttctctgcctaatttaatactgtaacaggagaatgtctcagcaggaatctttgaaatgtaaatattttcgcttgtatatgctatagaaagtctaatgacctctgccatatgatatataccaactattatgtcataaggaaattagtaaaaagcgagtaccagaagaccagaagtgggtcttgcataatggtgtacttttataattcaacttggaaggttgagtgagccaagaggttctcaaattctagatcagccttggctttatagtaagatcctgcctcaaacaaacatacaaatagcagcaataaaagcaatggaaatacttaccttacactcttattattttaatagtttatgctctttcctccctaattgtctttttggttgtcggccaatattgctcattatttaagatattgtatattttacttatttaaatgaaatggcacagaaataattttatgtttttctctgtaggttgtaactttcatgagatcagagaatatttttgcctgtattgtatactgttgcactctgagagacctagacatgttaacaagtaagcattatatatcttagtagacagatgtttgttgaattgaaaaggtgactgtactgattttggtgtctgttactataccctaagcttaggaaaactggaaaacaaaatagaaagtgctctttgtttgatcctataacttggctagtattgtgccacagattctacaaggtatctcaaaattcagtaatatttgttgtgatttttggcacttctacctaaagcaactatatgcatacatgtatgcatgcatagatatatgatttagtacatactaaatttaaagaatctatagtgttatggtactttgatgtagtttatgtttttttaaaaggtaactattaatacatagtattcacttatgacatatatcagcatttccttcttttatgtgagttaatgcaatctttttttgcactgtagacaatggatctggtgaagtgaacattgcacaggaagtagctaaaggttagtgggatttagaagaattcagcaagctcttagggagtcggttgttttatgaccacaagagcattgcttaatggttttcaccgcagttagaacagatatctaaatgttgtgccaactcataatgctttgtaccattgattttcatctttatccttctctcatttactgtgctaaagttgtattggacttcttgtttttctctatttaagttcctttattaaaccttaaaaatataatgaacacatgaacacacacacacacacaccttcacaaattctattctttcctgcagcagtgaccacttgtgttacttgccattaaatctctaatattcaggaaaattactgaaacatgatattaagtaaatatttggttttggctttgagacaagatctcatatattccaggctggccttcaaattgctatgtaactaaggatgacactgatcctcctgcctgcacagcctactgctggaattataagtaaacatcaccatgctgaggtttgcatgggcctgggaatcaaacacagagccctgtgaatgctaggcaaacagtctaccaagtaaacatctcttgccttaaagtaaataactatttaatgattaaagatttgactgaaagaatgtcagatttgttgtaagaaaatgcatgacaagatcttgatctgtagtaacactggtgttgtattagtcagctttccttctctgtgatcaaatacctcagaaaatcaacttaaagagggaagaatttattttggtttcagaagcttcagtccatggtcacttgactgttgtttctctccttgtgataagccagtgggtgtgctggaagaatgctgcactcttaaggcttccaggaaacagacaacaacaaagggtatagagataggatgtgttcctttgggacatctttatttcatgttcttttgggacccatttcatgccactggtttcattttctaaagtttttgctacctttgagtagcaacgtgaccaagcctttaacacatggtttttgtggttcatttttttttttaatatccagagcatcacaagtgtctccgtgaagattagcaaattacagtatttcagtataaatgcattgagacattaacccaatcctgaaatgatcttaactattagctgtttgaacatgaggaaattgatttcttcaaaatgtattaatagttatttttctttctacattatagagttgttttgggccctgataagtgaaattgccttaaaacagtgcacatgtatgcagcatatgccagctgaacctttattatttgaaagatgtggtatcaggaagaatggaaagccgggggtgggggtgggggggaatgaaacttctagaggcctaatagagtaaatggttccaggtgtggttgtgcaggccttgagttgcaccattagggggacaggaggatctttgagttccagactaaccagggctacgttgtataatcatgtcgcaagacaaagcaagacaaggcaggacaagacacatcctttctcttacagaagaaccctctgacaactgaagatatctatagctttaggaaagatgtcttaagaatggaaggattccagggattatcttatctctagcatgtgctacaagagctctttggccttctaaatcttaaattagaagagccatgggatgtggtaaagaaattaaacattaggactataagcatggtggccagaggttattgtaaaatgaatcagtgtgcaggggagggctgagaagtaagcagtttgcccaactatctatgacatccttgtagtttaaaactaatgacagtgtggatatgtatctctgcaaattaaaatatgtcctgcagtgttttgaacctaatagctaactgtagttgaatctcagaggattattagaagaataactacaaggaataggagactggggaaaagagggcaagtatttgcagaaatgacaaaggatatagttaaagaattaccatccccaagtttaatagttataatagctgaagaaaaatcaaaaatcaaagtttcacttgtaaaataaatattatgctaccctctcttaagctgttattattaattctgaatgcattgaaccatagtgaccacatgaagagaaagccagaagaaccagatggaaccaaagcatttgggtagtaggtgttaaacctaacaccttcatgatcctactcactgattccaagaactgttgcagctttttcattcaaacttttctcaaggcctatgatgctagagatgctttgataatcccagtatggtgaaataaaggtttaaaagggtaaatgagttgcctaagaccagataggagttggcaagccaggcacaaattctaaaacctgaactgtgatttcaccttttgttagaagtctttattaaactgtattttacccaccatttatttattcacttacttattttctcttttataacttagatcttattacttgtcaatcagtacacagacatttcaattcttttagaatgcctaagatacatacaaaaattcaaacagccatgctcctatttaagttttatgtatatttattttattattttattcatgtgttttacagtatgtgtatctggtgcctgtgaaagtcagaagagggggtcaaattccctgggactggagtccccatttaagtattgagagttaaatccacgttctctgcaagaaagattgctcttaactgctgagccaactctccagctcttgtgttattttaaacagttgcaaaactgataatcccatttcagatttgtccacaaattttccttaacaggatctcacatgactatcaaatgctcataatcttttactttcactggttcacaattttatttcacacatcccatatcctcaaattttctttcttccagagcattatcaaaattgaccaccacaaccagaatacagggtagacagttctaatagggaaagaaccaacaaatgttttcactgttgtttgtttgtttgtaaataattctgctaaaaacatcaaacaaacaaacaaaacaggagacaagaagtaattcaaactaatctagatgtaaatacatgactgtgactccgagttgttatttagtatgctttgtactgaggaatataaaactagttcctcttgtggactggtttgcttgctgaccctgagacaatgagtctctctgattcaatatcctgctatcttctggttctaccttagagtaagcaaccagtgaatgtctttactcttaaaacttatttacacttaaaaaaattggatgaggtagtatttccccccttttaaaaaatattgctagagctcctaagaaactcacatttacaaaatagttaataatattcctctggcttgttgaaccaggaagacaggaagtactgagagacatgacacatgatcagttggacttggcttctttctcttcagctttagaggatggactctggttttcagtgtctcccctttctacaggcaaatctttagtttcttggcctgtttgccttttgctaccctttcccattttgtttgacttttttgtctgatgtcgtactcttactgtgcctgtgctgtaagaccatgttaactattctgctacagtgaattatttgcttaatatcatacaatgagtagctaaaatgatcagttttgagcttatcattttcatttaggtatttgcagaatattttcaagtgctaccttggcaggagtgccttagcttaacaaccttacaggggagggggggcacttaggctccttcttgttccttccaagatgaactttcccgtgatcaacatggggtttgtgaggccacctaagtggctgaagaactacatagaacaggattagagttgtatcactgcctctcagtttccttctccctaatactgcattggccagttactccagtctttggcaaaagtgtccctgttattatttaagaggcaatgtttttctgtaatcattactttttgcatctgtctatcaagaaatatatatatatttatatataaatattatataaattatatatataaattataaattatgtataatattatgttattatctatgtatatataaacattgctctctctctactttaaacatagtttaaaaactacaaaaaaatttgcatgttgaaaagtaagcataccgcataattttcaatgtctgcctgtctgtctaaaattagagaaaatatgaaaaactatgtataattgttttaccaaattgaggatattttaactcactagactataaaagagtctcacaatttgcctgatattattatgaactgattatttaattgttagtcaaactgtttagtgtaataaaatgttatttggtatttagtaagttaaaataatagcacatcccagatattgatgtaaggttggtctagataaacacacacacacacacacacacacacacacacacacacattagtttacctaaagtattatgcagaatatgatatttctgtcaagttttcatttctaaattatactaacctaccgaagcaatgaaatttaataatttaaaacacaagtgtaaactgaataaaggctgaagtaagaatgtagtctaattgaaagaccattaactatgtgtagatagatgaattttgcaaaagaacttaacattggacactgggtagatggctcagcatttaaaggtaatttttgttcttgcaaaggattcacttctgaactatctgaaacgctagctttaggtgattcaatgccctcttctggtcttcttgggcaccagacatgcatgtgatacacagacacatacaggcaaatcacccatacacatataaaaagtctaaaatatagtcagtgaaatcttaatgttatggcttgtatatccttggaccagggagtggcaccatctgtaggtgtggccttgttggaataggtgtgacctggttgggatgggtgtgtcactgtgggtgtgggcataaggtcctcaccctatttgcctggaagtcagtcttccactagcagcctttggatgaagacatagaactctcagctcctcctgcgccatgcctgcctggatactgccatgttcccaccttgatgataatgaactgaacctctgaacctgtaatccagccccaattaaatgttgttttttataagacttgccttggtcatggtgtctgttcatagcagtaaaaccctaactaatacagaagttggtactgggagtagttctagagtaacagaagtacaaggatgaatcttttaaaatactggaattggcttgttgatccaccagcactttcaactactgaaacctctccagattctctccctcccgggagctcagagaattttgaagacccatggttgaaactatatttcaaccttaaagaagctaatgcccttgattttcttgatgaattaggtgattcagtgcacaaagctttctacaagatggagaaaaaaaaatcagtaaatgattttactggctggctgctcttagtatctgcagaaaaaatgatgaatgaaaggaaggagttgtgtgataaaatcgaaaggctccagacacaagtaaacgatctaaaagttgctaagtgtgtccttgaagtttcgaatcttctctcttgcagcaatagagctcaagttgcagaaaatcaaactgaaaccctcattgtaagtttggctgaactacagcaaaaattcaagtctcagcctcagagtgtgttgacagttgaagtaagggcactgattggcaaagaatggaatcctataacatgggacatggatgtgtgggaagaccatgttgaagctgagaattttgaatcttcagattctcaagggtttgccccacctgaggatgtagtaccctcagccccaccccttgaaataatgccttccccacagagtctgataaaccagcgatgactttcactgaagaaaatgccagacaagacaatgctgatgtttttcaaggcccaccaatagtttcttctagacctgtaaccagacttaaagcaaaacaggctcctagaggggaggtagaaagtatagtccaccaggaaatgcactacactactaaggagcttagtgagtttgctaattcattcaagcagaaacctggtgaatatgtgtgggaatggattttaaggttgtgggataagggtggaaggaacataaaactagagcaggctgagtttattgacatgggccctctgagtggagagtctaggtttaatacggaagcttgcatagttaaaaaaaggtgtcaaaagtttgtttgaatggttagctgaggtgtttatcaaaagatggcctactggaaatgacttggagatgcctgatattccgtggtttagtgttgatgaagggattttaagacttagggaaattgcaatactgtgtggaataccatgacgatagataaggcattttgtcagtccgtgaatggtggttttagcagaggcattacatgcaggaaaggcaaatccataaccagaataagtatctactccagtaagaacaaaacgctgtcctttccacgaaggaaggggcccaatgtagtcaacctctcaccaggttgctggctggtcacctcgaggaatggtgccatatctggggctcagtgttggtttctgctgttggcagatctggcattcagcagcagctgtagccaggtcagccttggtgagtggaagcctgtgttgctgagcccaagcataacctccatctcgacctccatgaccactttgttcatgtgcccattgagcaatgacagggatggctggggagagaggctgactgtccacagaacgggtcatcttatccacttgattaagttggtactgggagtggggtattgctgtgataggcctgaccatgcttttatttgaaagaatgtggattttgggactttggatttggaatgcagtggaatgctttaaatgtggcttaatgggtcatcctagtaggaatatggaagacttagttgctgggagtaatttgaactgtattgacctggcccaagagatttcaaaggagaagaatttcagaatgtggcataaagactggttttgtggtattttggtgaataatgtggctactttttgcccttgtctgaaaagtttgcctgaggctaaggtgaagagacttggattaattgcattgacaaaagaagtttcaaaaaaagcccagcagagactttgttctctggttaagtcttatgaagagaagtttaaacaagcatagcaagcttagaaaggaaaaatataaaatatatggttcgagtattaaagggtaccaggaagtgaaatggaacaaattcctgtgttctagttcctgtaagcagcagaactcggcagcttcagccatgtggctctggctctagagttaagaatggaaggaactactgggaaaattgatgctggttagctggagctaaggaattagcagtgattaagaagagaccagcatcactgaggtgaaatcttctggaaatttttttctgagagcacaaaagaagctgtgttccagagatacccaaggttgtacctcatgctgcggctggacttggtaatgtgtaagagtcactcaggtggtactgcttgtgaaggaatgaagggatcatggagagaagctgaggcttagcactgttagaggccagggaaggccattggagaaggtgaagcctcagctgtagttgatgggccaggactgaaggggtcatgcaaaggatttgaggcttggcactctgaagagagcctatgagagtctattggtgaagcctagttggagtggaataccgcagtatattggagatgtcagtaccatggagtgatcaccaagaactaaagccgtagtggagtggatccacctgagcttagagtgctacagagggcagagctggaaaagtgatgtcagcccttaggaggtgtccaaaagatcaaatggaatcccagacactgaaacaagaagctgtaacattgaaattgccttggagactcaaaaattttaaagatgccagagccatgggatacatgctgaggaaagctgctaacagggagtgtaaccagcccaggagaaagcagtttgttgcagtcaacaaaaatgaaaaaggagtagagatctgaagaccgctttgacatcagccatggagatgcagagtttggagtttgcccagctcgtttcctgccttgctttggagattacagttaattaagttgaatgaatctcagaagagaccttgaactttggacttttaacattgttgcgactgctatagactatgaggactttgaaagttggactaaatgcattttgcattattgctatgtttaagtatggcccccatagactcatgtttttgagcaagtctatggggaccagggagtggaatatgatggtttgtatatccttggatcagggagtggcaccatctggaggtgtggccttgttggaataggtgtgacctggttaggatgggtgtgtcactgtgggtgtgggcttaagatcccatcttgatgataatggactgaacctctgaacttgtaaaccagccccaattaaatgttgtttttttataagatggtgtctgttcacagcagtaaaaccctaactaatacacttaacaacccttaagattgattaatatggcatatagatttactagcgtttttaggtactattctaaactaagggaaactaaggcaaatgttatatttcctgaatatatttgttaagcaagcataccctaaatctgtttgtataagccattatatctttcattgagaataatcttttaccctgtagggaaccccatacatgtatagtagaaatattaattactttgtgagaattagtctgatacacactataaagtatttgtatctatctaggctaaatttcatacaacgagttcaaagaaacgattacatcttgatcaaataataagggaaggtgtcactacttatattgacgaataattgatttttttttatttttctttatttacatttcaaatgttatcccctttcctgatttcccctctgaaaaccccctgtctcttaccccctctccctgctcaccaacccacctactcctgcttcctggctgtgacattgccctatactggggcatagaaccttcacaggaccaagggcctcttcccattgatggcagactaggccatcctctgctacatatgcagctagagccacgagtcccaccatgtgctttctttggttggtggtttagtcccaggaagctctagggggttactggttagttcatattgttcctcctatggggctgcaaaccccttcagctccttgggtactttctttagctccttcactggggaccctgtgctccattcaatggatggctgtgaacattcacttctgtatttgccaggcactggcagagcctctcaggagacagctatatcaggctcctctcagcaagttcttgttggcacccacaatagtgtctggttttggttgttgtttatgggatggatcatttctgtttctgtatggtcatttcttcagtctctgctccaaactttgtctctgtaactccttccatgggtattttcttctcccttctaagaaagatcgaagtatccacattttggtcttcctttttttgagtttcatgtgttttgaaaattgtatcttgggtagtctgagattttggactaatatccacttacttatcagtgagtgcatatcacgtgaggttttttttttttttttttttttttttttttgtgattgggttacctcactcaggatgatatcctccagatccatccatttgcctaagaatttcacaaattccttgtttttaatagctgcatagtactccattgtgtaaatgtaccacattttctgtatctattcctctgttgagggaaatctgggttctttccagcttctgggtattataaataaggcttctatgaacatagtggagcatgtgtccttgttatatgttggtgcatcttctgggtatatgcccaggagtggtattgctgggtcctctggtagtaatatgttcagttttagacaattcagataaaatagagttaaaactcttcaaagcatatttaaggcgtgactggagtctgttttgacagggttgtattatagggagatagtttcccttctatatctggctatgtaagccacagtgtccccaaactcacagagatccacctgcctttgcttctggagtactgagattatagacatacactaccacttctggttgaagacattacttttcaggaaggcaggatctagttatagagagagcagtgggtctcacttttcccaatgcttcgaccttttaatacattttctcatgttttgatgatgcccagccataaaattatttcattgcttctttataactgtaattttgctactgttaggaatcataatgtatatatctgatgtgcaagatatttgatatgtgacccccccaaggggtcatcacctacagtttgagaaccattgttatagagtttatttagtgcaatgtaatgtaaatatgtggaagactgattagttttattttattttacttcatttgagacagggcctcactctgtaactctgactggcttcaaattcacgatgtagctcaggctgcccttaaagtcacagagatctgacttctttcgctgggataaacgtgtgccatcacacctagccctatttatatttcttaatatttggccaaaaggtactttgctaattgtttgtgagtatattgcattatgtaggaaatactatttagttttttcaaacagaatttttattataaagagctactatatttctagtgcatactgaattatttttggcagttaaaatatttcctaagggaaaaaatcttatggctaatatcttctctaagttatattaggatgaacaaaataatgcattttatatgggtaacaaaaagtgtaaacaattgacataatatcatatataattatatattactattctttatatttacatgacacattttaatgattgcttaaataattaaaaattaaatgaaataaaaataatagttaaataattcacaattatctagtgctttaaacaagatgtaccttttaaaattttttatttatttacatcctaagtgctgcatctcctccatgccccttcctcttctcttctgagaggtttgcccccacttggatgtccccaggcacatcctctccctctgaggccagacaaggcagccctgtttgggtatatagataccgcagtcaggctaaagctttagggagagcttctgctcctgttgttggggaagagggggctgctatttagttttaagatagggatctatctgagaaacaagatttgagtagtcctcatgtttagagaagtataaacctttaagtgctccccaactaccaccacctcctactgccccacaaacacctctcaaatgaaaggagatgagagttgaaggaatttcttaaaccttggcaacagaagagagcttggcttggcttagtaggctctgtaccctgtatatatgaggaaatcattttgtttaaaaccagagtctgattttttgaggtttgcctctagatgtctagatgaggtggctgacaagcaaatattgacttctgcttccttggtttcatcttctccagatgactcttcttaccatgctgacctctggaaaattctggccttgtctcatagttctttctttcctttgtggttcccactaacaacagaaataggcttttttttcctaaagagattgattacataataaagaagaaaaggcaagaaattaaaaaaaaaaaagaaaagaaaaaaaaacaatgaaatcaagaaatcctgccagattttcttttagcatctttgctatcattgttgccagtcaagctatccccaccccttaacttttccttccccatacttgccaatgattgcctcttaaaatccaacttaagccaccccactatcaccctgcttaactctttcaagtcatcatttttataagaatggattacccttcattgtactggctttttcctaaagccttcccagaataatttcacttgaaaggtcaagaggcaactggagcttcaaacttctagtttctgatgacagaatatacagaccacttcaaggagaaattccagtgagtggaacaatagttcttaccctaatttagcttaaataacttaaagtgtcaacctatttattaactagtgtttttcataaaagtttgttacagttttttgtccatatattagttatataatagtcgatcttattatgacaatttgatagataggtataatgcattttggctatatcacccttcattaccctttcttgttcacctcccactttatcagtccccttcttccgaactactaatcattcattcattttttttttcctgtttaatttgcttggtgttttaatgagctcacaagacctaacccttgtctgtataagattattttgaagaacttcaactgatttcaaaagaaaatgaaatgataagaaatgctttaaagaattaaacgttggtatcacttctcagccttttggcaaagatcgagtgaagaactgaccctgaaaaaaattttactcataaagaatgccaaataagttgaacttttgctacattttctcgttatccaattttaaaattttatatcatttattttgtgtgcatttgtgtatgtgttcctgtgcctgtggaagtcagaagaggggtctgatctggaagtagaattaaggatgtttgtgaccaactatgtgagttctgagtatcaaatctaggtcctctgtaagaacaataattgctcttaaccattgagtcatctgtccagaccataatttttaagtaactgaaaagtttgttgacaaggaaacttgtataggtttatgtcagtatttcagatatttattttatcaaacagccttcctcgcttttgaatgacataatttttaataccttataggatgtccagaacatacttaaatgcatgcacatatatatgacataatatatattatataatatataaaataagagtatatgagtatatgtagtttgagaaacccacatgtagcacatttccccattttgtgaagaatttgaaataaataaatggtttatttggtgccacacctagtgatcaagtttcagtctggcatttatttattgatttctcctactgaatttcaagtaaggttcctaatgggcagataggtcatattttttaacacacacacacacacacacacacacacctctgttcagctgctgagctacacattaagagcttgacacttgacaagtgattgtaaataatagcttatggtttgtatgtcgaataaactaaagaattattcatatgcattggcttatgcatatgttgtatgtttatgcttttttcacctataaaacagaatatctattttgctatgtctacttttcttccatttccactgcaatttgtgtgctttctgtaattctcttttgttgttgttgtcaggaatccatggtctttgattcatgatgtttattggaaataactctgggatgctttgcctcaaggataatttgatttggggaacctctgtttgacatcattcaggaaaatgttacactgtaaaggatattgtacttgtcacaatgataatgaagggaagatagtgacaagaaagctaataatatggcagcctgattattaatattgagcctttggtatttttgcctgccatcttttgttgacatgactatcctcctaaaagttaagcatgtgaccaatttgatgaatattattttgcagaagcaaaatctattaccagataaagaagatgagagtaagttgatatagacagcctgagctttccagaatactctttctgtcctctgagtttaggtatctgtggtcgagaacacagttttgtgagggagtaagattaggatgcattgaaataaaatgctcacactgactacatcagctgtaatggggcttatctgatgttgtgactcagcctctgtgaatctcattgtgtatgtgctctgttttgtacagagaatcatcattcaagacctgtcagaagctacaagcgaaaaatgggaaggggtaagtcttccctattaaaattttttagattctcctgatggtaatctagtgtaacagagaaattatgtctagaactgtgtttgtagatgcttaaattgtgtttttacttggtgttagaaaattttgtctgattcaaaattatatagaagaagaccaatataatatgtgttattcactggttctttttttgattttttattaatcattttactcgtttacattttaatgatatccctcttcccagttacccctccacaaccctcccatctcattccccctcctcctgctcccttttgcctctatgagggtcgtcgtgcacccattcacccactcctgcctcacccttctagcatctccctactctggagcatcaagcctccctccctttccattgatgtcagataagaccatcctctgctacgtatctggagtcctggttccctccatgtatactccttggttggtggtttagtccctgggagctctgggtgatccagttactagatattgttagtcttatggggctgcaatcctctttagctccttcagtccttcccctaggtcttccattggcgtctctgggctcagtcctgtagttcttttatttattctgatttttggttttggtggtggtggtgctggcagcacaaatatcaaagatggaagtggtggtagtggtgttggaggtatggtgtgtgtgtgtgtgtgtgtgtttgtgtgtgtgtgtataatagttcaaatttgttatgatgtaaatgtcctcaaattccaacttctttataactcctgccaaaattacccttatgccttgatcatatataagttttgttaatagtaacacaaatggtctgactcagtcattaacaacacttactgctctttcagagcacctggtttggttctctgtatctacatcaagcaccatacaactgactttaactctagttttaggtgttccagcacactgtggcctctgtaggcatgtatgtatacatggtgcacacaaaatcattgaggtacacatgtattgatatacataaaaataaattacaaatttttttaaatgtaaaaagcaaatatagtaatataaatcaaaaggtactattatgcagtcagtgttttaaatattgtttaaagtgggaacaattacatgaaatctttgtgcttattttgggtttttcataagggtattatggatcttggacaatagaaatatttaagttcatttcgttactgatatgggccatctgtcacaatgactttataaataattctagttcgtataaattataaaagcaacgtgctataaaggatactaagggaaaatgttgtgtggagtactatgttaaaatttatatgaattcagagttttgaaggcctgaattcaaattctgtggctactacttcagctaaatctcaaagctttcttaaatggaattttttgtcatctttgaggtagaattaatgcatcctgtacttgtaccttcaggaggatatggttagcataatgtgactaatatatgtgagtgtttagagctataatgtctaatagcatagaacatcagcttattgctagcttttgaatacgtatatctttatttgaccttttattggttcagattctataggaagcaacagagcttggggtggggctctgaagattactaagatctctgccttaagttgcttgccttaccatcatgtatgtttacaggcagcctctacatctcagctcactcataggaattcttttcgcatgttgttgttgctcttatgtgctccagagcttcctttggaagctgatttgttttagagatccagattctttccaaacattctccaaccatttgcaattttttacatgagtaataattttaaatacagtaagacacattttaggatgaattcatacttgctatatcctaaagtcagcttccagagtatctcattgcttgatccccactcaatccacaaagctataggcagatttggagaattccttagctgttggcatctattatcaccatatggaaaagggctgcatgaagtcaagggatctattttttccttgcttcttcttttattttcagactgatcattgatcaccaacaaaggggcctcctttaaaagatgctagagcaaatagtgattcaagctcaggcaaataatagaacacagcacaataatgtaatgtaatctgctaaaatgggcatatttccaacctggagattgaaaaagggaagtgcgtcacataatgctgtttttacaaacacaggaagcttgtgatagctgttattttgaatgttggtggtgaccaccaaaagtcaaagagacatcacccattattcatcaagctttgtttaggtttgcttggttattggttaattgctgctacttttagtggaaaaaacaaaatgttactgtgtatacgcatgactttcttttttggtactgtataaagaattgtgctgcatttagtaaacattcttacaaataagtcaatatgttatacaacaagatatgattggaaagatgtcaccacacttgtataaaataattaaaattaaagttaaaatactattctttaagaagaacaatcggtacttcataaatatatgaaacttttttattcatgggacattaaatatcataaagtttagatcattgaaatagaaggaacaagactatgtagtttaattgctatagtcctaacctagaatgtacaaagccctggatttagttcctagcactgcaggtacagttggtattcctagctcttgggagatgaaggctataagaccaggaattcagatcagccttgaatatatagcaagtctgaagccaccctgtaattcatgagaccccaccacaatgaaataagagggcaggtaaagaaaagacatgtatatatgtgaggagcaggtgtggcagcagtcccaagatggcacccaggactgcagccaagtcttatgacttgcacctgacttcctcatacacctcgcgtccatcgtgagaactgtgcagttgcaccatgatgcaagatcagaccatatgacaagtgatgattctggccaatggactgctgttacgtggactgggctgatggggcgtggtagagaggttatataagggattgtgattgggggtggaaaaaagagaagagagatttttttcctgcatccatgttgaaaggttcctgaaaaaactgctttgagaaggacgctgtgtcgtagctcttttctgctggttggagacagaagcgacaaatggtggctcgtacggggatgttcagaactcattgcagtcagggcagctagctggtaagttcccaggtaagtgggacaagttaagttctcggattgagacgataaggctcccagttttgggacaagttgcaccaagcaccatggtaaattcaacctcaggtcaaacagtgagctaagcccttaaggacttgctgaaagtgaaaggaatcaggctaaaaaaggaggccctggagaattttttaaaaacagtggatcaggtctctccttggttctctgtatcaggacatcttacagggcccagttgggagaagttagggaaggacttgaagtttgcaatatccgagattgtgtagaatctgaatgtaatttgtcaaattgagcatcaaactttttatacagaagaaaatagggaagttaggtgacacatcggcaaggtacaaatgaggttactggatgcttaatgactcttacacaaaacagaggaatgtaaacacaaagactggcaggaactgggcaataaaacaactgagacaaagtcagctctatctaaggtcagctatagtcttagaagccaggtgtgaggtctttacactcctagggcaagggcttttacacccaagtcatctttctaattagggagttccgctttagctaaccatctcatgaataatgcaatactctaaaaccacagccaatctgatctacttcctaaacaattgtaaattcctgtatatgggagcaacttggcttttgttctaagtggtagtgtaataccagaggcaattctgaatgtcactgaacaggcaacattcttactgaattcctagcccatggtcagctcaaggactttccagggcattggaacactggcgaaagcttagctatgtcagaattcaatcttaaaaggcacttatagtaagataatactaaaagagagcatgtggatccatacactagactaacgcgggaatagggtatgagtatacaggttaatgagaatgccaaagctccaggaggtaagtttccatgaaactctttgcctcgcaagcgcatccagggctcttggcctgccaagcagacttcactggggtgtgcgtggcaaaggagttctcgctaaaggggtgctgccagtgtggaatctagtacggaattgtatcgaggttaaggaaagatgtggagcagaactcaaaaagggcaatgaggcactaaatcaggtgagagaggagaggtcccaaaagtcagaggcagaaggaagttcttgtgatggagatatgtctgaggacgatatggagagcatagctgacagtctagagaaagtgaaaatgaaggtagaaccttgggcgccagggccaccatggccacctccatatgcccctgacagagcattgggtcgtagtctgcatgcagaaacctggaggaaactgcgagcccagtgctttcctgtatttcaggatgcacagggaggtcattatcatgagccgcttgattggaagattcttcaaagattagtggaaggggtttgtacttacggtgtcagtgctgcttttgtaagagcgcaattagagaacctgcactgctactgcatgactccaagtgattggcagaatgtggctcgtgcctgcttgtcaccaggccaatgtctagactggaaggcatttttcattgagtttgctgccgagtaagcagcgatcaacgctggcaatggccagccagcctgggatcaagacatgctgctgggacaagggagatttgtagcagctcaaactaattatcccatccaagtgtatgagcaaattaataacatagggactaaagcctaggcatttcttttgaatagaggagaggtgagtgggaacctgaccaagattgttcaggggcccacagagtcctttgctgactttgtggctcgtcttgtagaggcaggaggccgtgtttttggagaccctgatgctgccatgcctctactgaagcatctgatttttgaacagtgcaccaaagaatgcaggcaagcaattaatccatataagcataaaggattagaggtcgggatgaaaataagtagagaaataggaggaccgctttctaattcgggtctggctgccactgcatacagatgtcacaaggaaaaggtggccagcagaataataactgttttaaatgtagacagccaggccacatgaaccgtcaatgcccacaattgagtggtgccagaaaccagcgaccaaaagtgcccgggttatgtcttagatgcaaaaaataaaatcactgggtcagtgagtgtaggtcagttaaagatattcatggacagcctcttgctcccggatatggtggtgcccggccaaaaaacttgaaaaggggcccccgaccccagggccctcaaatatatggggcagtaaccaagggatggcccagtttgaggccaccgatgcgatggagtcaccctggagagcaacaacagggagtgcagggctcgacctctgttccaccacccgactcatattaacaccccgcatgggagtccagctggtggacacagactttaaaggcccactgccagctgatatggtggtacttgttgtgtctggccagtagatcacaacctgggttctagcctggaaaggcattttggaaacctggaagagaagaggggctgggctgcgcgagataaggaaggaaccaagacaaagctctctgctcaaggttcaatttttactatttcggcactcagttataaaggaagggggaggggcccaattcccgccaaataatcttgggatccagtagcagggtgatcacatgatggcttcggaacagcaaagcggcaggttccagcagtaggcatggcagaaagattgagcgggaagctccacccctgagcaagcaggtttcagtctgggggaggggagactacagtactgatttttgggaaggagctctgttaccatgcaaggattaatagttcatccaggagtaattgattcagattttacaggaaaggttaagattatggtatcttcccctagaggcatcgttgccatttcccctggtgatagaatagctcaattgcttcttttgcccagctatcactctcaatttccagccaaagattcagaatggggagacaagggatttggctctactgggacctccaatatattttgctctctaaatcttgatacccgacccctattgaagctcaggattgaaggaaaagctatatctcgtctcctagatactggtgctgatcgtagtatcatcagtaccagagattggccttctggttgtcctaagcaacagtcagaacaaactctgagaggactcgggtatgctcagatgcctgaaatgagttcctgcttcctatattggaaggccgaggaaggacattctggacagtttcagccatatgtgttggctgttccggtctctttgtggggccatgatatgatgactcagatgggctttgttctgactaatgaaggaggctatggcaacaaggctcatgacatgatgctggacatgggatatattcccggaaaagggttagggcaatttctgtaaggtagaacctctctagtgccagtttgcaaaaagaatgatcaggccggactgggtttttcctaggggccactgagggagcattacctattacatggaagactgaggatccagtaagagttcctcagtggccactccatcagaaaaattaaaagccacgaaagagctggtacaagaacaattggagttgggacatatttggccctctacatctccctggaatactccaatatttgttataaagaaaaaaaatcagaaaaatggagacttttgcatgatttgagagaaataaataagcaaataatcttgatggggcctgtatagaggggactgcctttgcctttggccttgcccagaaattggtccattatagttttagatattaaagattgttttttctctatcctgttgcatccaaatgatatggtaagatttacctttactgtcccctcccaaaatcatgctgaacctgataaaaggtttgagtggacagttctgccacaagggatggcgaacagtcccactatgtgtcaactctattttgatgcagctttgaaaggagttcgagagcgatttccaaaggtgaagtgttatcactatatggatgatatgcttcttgcccctcccagggatgccttgcttgatgaagcttatagctttgtggcgacacagttgaaggaacagaatttagtagtgaccccagaaaacgtgcaaaacgatgttgtagtgaactatttaggaacaaaaaatacagcaaaatatgtgtcctctcaaaagattcagtttcgcacagatggattatgcaccctgaatgattttcaaaagttattgggagatattcaatgagtcttaccctatctctctttgactaataaacaattacagccattatatgatatcttaccaggcaatacagatttaaattcttccagatatcttactgatgctgccaagaaggctttgttgttagtagaacagcatattcagagtgctgccttgaaacacagagatgagtccaaacagcttatcttgtgtgtactgcaaacagagtcgcaacccgctggggttttatggcagggagctcccctgttatggatacacccaaaagtctccccagccaagacatttgtttattatcctgcctcagtagctcagttggctctgattggtgtacagcaaagcatgcagttttttacagttgcacctgaaagtctaatagtaccatataatgctaagcaaattgaagtgtcaacagccacggaggataattgggctattttgtggtgtagttttcaaggccttatagataatcattaccctaaggatgcaatattacagttggttaaagtacatccagtaatctttcctcgtattactgctagagatccattgccggatgttcctcttgtttttacagatggttctaaaacaggacaaggagcctatttaataacaggatcatccccagttaccattcagtttcccccctacatctccacaagtcattgaattgcaaattgtgattaaagtatttgaattaattccaggtcccttttatttgatttctgactgccagtatgttgtaaatatgctgcagtgtttggagatagtaggcaaaatatatttgagatctaccattggagaattagttattaagttgcaaagaattactttgaattggcattcacccttttttattcaatatattcgtgctcatactggattgccaggaccccttgcagaagggaatgatatagttgataaagcttccagaaaatgcatgtcctttttaatggcctcatctattgatttggcacgtggttttcatgcacaatttcatgtaatttaaagactttgtcatcacgatttaaaatttcttgagcagaggcgagacagatcatgaaggcgtgcaaactttttcccctttattatctaaagtcagtgtgggggttaatccctggggattgtgcccctacatgtgtggcaaatagatgttacccattttcttgagtttggaaagttaaaatatattcatttttctatagatacagcctctggcattatttttgcctccttacagacaggtgagaaggcacaccaggtcattgcacattgttttgtggcttggggtgcctggggacaccctaaagaaataaagactgataatggaccagcctatacttcagcctcttttgtttccttttgcaagatgatgggtgtccatctggtgcatgggttgccatacaacgctcagggccaaggcattattgaaggagcccatcgtactttaaaagaatgtttaattaaacaaaaggggaaaattacccctgctgggtccacacaaagagagagattagccattgccttatttactttgaattttttgaatgaagataaacaagggcatgttgcagctgagcgacacgttaatcctggtatttctccaaaaggcatggtcatgtggaaggatgtcttaactggttgttggaagggccctgacccagtgctggattgggcgagagggtctgtttgtgtgtattcccaggatcactgacaaccgctgtgggtcccagaacagctgaccagagcaattcaaaacaagcagaacgatgaggacgtggattttcctgtggctgggaatgctcctgctagtgagaactaaagagctacgttgggaaattatgtctgcattcccaaaacccacggcattgacacatttggcacaagtgtttcctcgattctttacatttaatgcttcgctacatttgcctttttcaccatgtaatggagagatagctccagtacaggaatctatgcagcttcagctaaagggattgttgtgttttcagatgattcaaaatatttcacagatgagtgattgtgttcagctgtataatcagaccgcagcatggtttgatatgccagttaagagtttactatgctacctggattcgagggttgtagcctgccagtatccaagggcaatggcactataccctcccaacctagatgggccccctttcttaggggtgtttgtgattcccttccaccttggaccagctgtcaatctagaaaagtagcttgggtagtgaagaattatttttccttttccccttatataggtacagtccataatagttccttttcagggtataattggacataccaaaatccagctcaagtaggagctagtaatccttttaatgtatggttgttatgtggggtgaatggtagttgcactgatctttcccccttaagcatgatggcaggaggggcctgggacaatgcaagtttttattgaaatggttctgtgtttcaattttctggagggaggaatgtttcttttcaggctacgcctgtttgtatgtggcctccttttgtgcatattgtttataatggtagttatgagaataatgttgttaattgtagtagtaataattgcttttatagtatgtgctggaatgcatccttgcatcatttagcttttgttactagaatgcctcgttttgtaccccctggcctgttcaggctccttctgctatgactttgtttagacctaaaagggattttggcattactgcggccattgtcactgcaatagcagtttctgctaccgcagccacggctgcagccatatcccttattgagacagtccatcgtccatattaattccactcgtgtcgacatgtctgtggctgaaggattggccagatggatcgccacagcagtctcccacctgaatgactgggctggcattggtggacttgccatgtgcccaattctcatcggtgtcctggccatctgatgcatcttccacgtgcagagtcatcagcgcagagcccaagccttgatgatacaggcttttgcggcagtggaaacaggataatctcctcaagtgtggcttggcatgctagagaagtagtcaatgatgggtaagactccctgggcgtgtcacaaatctaagacagggatcaaaccaatgctgtttgtctcctgatgatgggtaaggggcattgccacagggggcaacctaagacaggcattctctgtgccaataagtaaagaagggggagatgtgaggagcgagtgtggcagcagtcccaagatagtgccttggactgcagccaagtcttatgacttgcacctgacttccttatacacctgaaaataagctgcatccatcgtgagaactgcgcaggtgcaccatgttgcaagaccagaccatatgacgagtgatgattctggccaatggactgctgttacatggactgggctgatggggcgtggtagaggggttatataagggattgcgattgggggcggataaaagagaagagagagtttttttttcctgcatgcatgttgaaaggttcctgaataaactgctttgagaagaatgctgtgttgttgcccttttctgctggtcagagacagaagcaacatatatattttatttcttatttgactataatcagtgtttactgagtgtagtattgaaatcacttttaatatttatgaagtagttgttgttttctatttatgactgaagaatttgtagttacttttatattaataagtatttacagtactttgtaattcacagatgtttcctctgacatccatcttacttatcttgagttataagaaaatctttactacaaaataaagataatcatttccatttatgtatttatatgtcaaatgaaattgatgtagaaaaaaatcatctatagtgaatagcctacaaatagtttttacattagaaagccaaaatgtaaaaccaagtcttatatgtcagtgtaagttttcattgcttctgataaactctgactatcataataattaataatgtcgggagcctcccggcctggagaggatagtggcacaggcacaactctgttgtggctttaaagtctgagggtctctggacgttctagctctctaactgtactgaagtgctgatggtaacttctaaaaagtccaaaaaatctttcttactctttcagagggtataatgctgctggcttatgtgaatgacacctgtaacagctggaaattaagtaatggggcttttgttctatctcagcaggaactgagcagttctatctttcagcctgttagtcagaacttgtaggaagaaaaagggacactctgaaaagtaattatagtatttattgctaagttataaaaggtttcatattaaagctatcttaggaaaaggtggaaagcggaaagatcctaagcagggcaagggaaaatttcttcttcctgtgggaaggggaaaaaatcacctcttttctctttgtcctcagtacttatacatcttcagaatacatgatcacatgttaaaaattcatcacaagttcacacaaaaaataattcataatttgaaatagaagtttacaacagagaatgtttacatgcataaccattaggagtaattatctggctaaacattcatcacctgtcacagctccacaggttcatagaaagttgaaaaccataactaagttgttagtgaagttttgtataaataaacccagtcaatcttttatcttctgtcctagcacctataatcattaattccctttttatgacttttggttaattgttttacaaccacttggaatgtgctctgagtaggagaaagtctggttactatctaagagcaattaactggtgacacatgggagactaacagagttcacattgcagttttgaatatgagaaaaggacctagtagcagctccactataaaagagcttaacagtcactcatataattttaggaattcttatagaagcatccttaagacttaagaagtcatctgtttatatagcatcactacaagacagtgcatcttcatagatctgcagcgatctgttccaaaggggtcggctgatacatagtgattgttatatatgttaaatagaaacaggaaaagcatattaatgtcaggattctttcctaaaatgaattctcctgggtcttgcttatagaagcgaatctgtcacagattatattataatctgaagcagaccttctcaggaagatcacctgctagttattaggttgttctattatgactcctgacgtaataatatgtgaagttggttatatcgaaagagcactctgttgctgagaaaagtatggggtgattattatttatttatgagatttgtagtgggattctaatattatgagggaatagacaagtattccaagtgaaatggctcaatgtccactaacatttccggtgacagataaagcacacatctatttcaccaaagtgccacaaatataaaaatcctgtaatcaacaatgatctgtgcatgcagtaattaaaaagtcagcagtacagtttagcaaagatcatagtagaggtcaagacagttcacttcacaaggtttgctctgaacattctacaagggaaggtgcctaaaagaagacactcagcactgtttacttgtcttttgtgaaagcttccctttttgactaaagaccttttatctttgtgctttccttgaaacaaagaatagaacgtgtcatacaacccagaattttatgacatgaaataatgagatgttggtttgaaaaagaacaatgtatgattataagtaaatgtctaataaaaacattttcataaagaagtgaatggaaagactatagtttttagatgcattttaaggtttctttttaatattcttgccctgaataattagtacatttctaaaataaaatcatgttttagaaaaaaaaaacattattcttaataatgtctttatccacaaaacagtaatttttgttatctacttgttactcatggctaatttacctgttttcgccttaagaacagggatactgaggaagctctcaccatgatgttttaatagtagtaaactatcctttacaagatagaaactatggccatgcatctttaaacacattgcttttttgctttcctgtacagaaactaacatacttggaatagcaagcagatattgtttgggaacaataatgaaacaaaagtgtgaaggtaatttaactttttctctcctttgctgtttccagtattgatattttggaactcattcaaatgctcaggtagaaacagagttcaaagtttagaagagtgtcttagatctataaaatctgcgtctgaaaagccattttctacttttatgttctatacataatggtatctcgctgttctgctgtggatgaatatagaatagtgatatcaactgggctgggcatgatggcacaaccctttaaaccaaatactcagaaggtagagggaaaaaaattagtagctcagcatcatcttcacagttaaaggccagcttttgccctatgtgaaacctgtttaaaaaacaaaacaagacaaaacaaacaaaataaaagcaaataaaaccccctaatgatggtaatagccataattaaaaactcctgaaaaaagattttttaaaaaacttaaaagaaccactgtacaaaagtctcaaaaaaagattttaattaaaagaagaaaaactgatttgaaaaatgggctttaggattcagcaaatgttcgtagctcatacttgctattgttgctatttaaaggttagtttcccaactatccaagaaagggcttgataaaaatgaaacaaaaccaaaaccaattaatgtattctgatctctttttttattgtgagtctttaatgactaagtcatctctctatccagtattctgatctcttaaggtatagtaatatggtggaaaaatcactaaactcagaaaataaaatgctttcttaaaaaaaaaaacaaaacaaaacactggtggttctgcgtactaagtcttgataaatagggaacatgttgagtttggcgggtaaaaaacacaagcacatgccagaagttatgcagcttgacagtatgaggaaagatgacttacagtgtgtgtagcacatctcaaaactttgcaattctgaatgtcaattttggtataaaaatccatgttataaaacatttgtaaaacatatttgaatcttcagattgacaagttttgtaaagtgacattttcataacattttatttgggagctccctggtttgtattagtaaaagtaaggacatttatttaaagtcaattaattatttcatattttgcctgtattagatctgacagtctctttattatggtgacgttaattttgctgcagattagatgatatcactagtttattgtaagcatttatcttcctaattttataacggtaatataaatctgcttggggctgacagctacgattattttttcctcgtgatttccactaggaaaaagggcctgtttaatggatatgctatttcttaaaacccattaaagagagttcttgtcattgatacagccatttttgccttttgtgtagatttgagaatataacatttgatgtataagttgtatttcttttttttggagactgattatgggatggatccctggatatggcagtctctagatggtccatcctttcatctcagctccaaatttagtctctgtaactccttccatgggtattttcttcccaattctaagaaggggcaaagtgtccacattttggtattcgttcttcttgagcgtcatatgttttacaaattgtatgttgtatcttgggtattgtaagtttccagactaatatccacttatcagtgagtacatatcatgtgagttcttttgtgattgggtaagcctcactcaggatgatgacctccaggtccatccatttgcctaggaatttcataaattcattctttttaatagctgagtaatactccattgtgtaaatgcgccatattttctgtatccattcctctgttgagggacatctgggtcctttccagcttctggctattataaataaggctgctatgaacatagtggagcatgtgtccttcttaccggttgggaccttttatggatatatgcccaggagaggtattgctggatcctcctgtagtactatgtccaattttctgaggaactgccagactgatttccagagtagttgtacaagcttgcaatcccaccaacaatggacgagtgttcctctttctctacatccttgccagcatctgctgtcacctgaattttttatcttagccattctgactggtgtgagatggaatctcagggttgttttgatttgcatttccctgatgattaaggatcctgaacatttttcaggtgcttctcagccattcggtattcctcaggtgagaattccttgtttagctctgagccccattttttaatggggttatttgattttctgaagtctaccttcttgagttctttatatatattggatattagtcccctatctgatttaggataggtaaagacctttaccaaactgttggtggtctttttgtcttattgacggtgtcttttgccttgcagaaactttggagtttcattaggtcccaattgtcaattctcgatcttacagcacaagccattgctgttctgttcaggaatttttccgctgtgcccatatcttcaagacttttccccattttctcctctataaattgtactgtctgtggtttaatgtcgacttccttgatccacttagatttgaccttagtataagtagataggaatggatcaattcacattcttctacatgatcaccgccagttgtgccagcactatttgttgaaaatgctgtcttttttttccactgggtggttttacgtcccttgtcaaagatcaagtggccatgaggtgtgtgggtttatttctgagtcttcatttctattccattgttctacttgtctatctctataccagtaccatgcagtttttatcacaattgcttattgcgtccggctcgaccggcaagaaagacgcaacaaaccagaataaagcaagagctttattgcttgcttcttcaagaagattctgaaccgggaaaatggcgctgcttttataacccgcagcatgacgtttcagcacctgatatggcgtgacagctcctgattcgttgcttgcccatcaccccactattacaccccgagaattggagtgactaggagtgaattcactctagcacctgcgtacaaggcttgtttactagttaggcacagtggaggcccgcgccatcttataatggcaattgcttgcggcacacatggctctcctcagagattactggctgcacgcacgcgattgctcatagcacgtaccggctctccacaattgctctgtagttcaactttaggtcaggcatggtgcttccactggaggttttttatccttaagcagagtttttgctatcctaggttttttgttatccagatgaatttgcaaattgccatttgtaattcgttaaataattaagtttgaattttgatgaggattgcattgaatctgcagattgcttttggcaagataatttttgctatattgatcctgccaatccatgagtatgggagatctttccatcttctgagatctttaatttctttcttcagagacttgaagttcttatacagatctttcacttccttagctagagtcacaccaaggtattttatactatttgtgactattgagaagggtgttgtttccctaatttctttttcaacctgtttatcctttgtgtagagaaaggccattgacttgtttgtgttaattttatatccagctactgccctgaagctgtttatcagatttaacagttctctggtggaatttttagggtcacttatatatactatcatatcatctgcaaaaagtgatattttgatttcttcctttccaatttgtatccccttgatctccttttgttgtcgaattgctctggctaggatttcaagtacaatgttgaataggtaggcagagagtggacagccttgactagtccctgattttagtgggattgcttcctgcttctaatcatttactttgatgttggctactggtttgctctagtttgcttttatcatgtttaggtatgggccttgaattcctgatctttccaagacttttatcatgaatgtgtgttggattttgtcaaatgctttctcctcatctaacgagttgatcatgtggtttttgtctttgagtttgtttatatagtggattatgttgatgcatttccctatattaaaccatccctgcatccctggaatgaaacctacttgatcaggatggatgattgttttgatgttttcttggatttggttagtgtgaatttcattgagtaattttttgctttggtattcataagggaaattggtctgaagttctccatttttggtgggtctttctgtggtttaggtatcagagtaattgtggcttcatagaatgaattgggtagagcaccttctgtttctattttgtggaatagtttgtggagaagtggaattagatcttctttgaaggtctgatagaacttttcactttggttgggagactaatattgactgctcttatttcttttgggaatataggactgtttagatcattaatctgatcctgatttaactttgatatatgatatctttctagaaatttgtccatttcatccaggttctccgattttgttgagtacagccttttgtaaaaggatctgatggtgttttggatttcttcaggatctgttgttatgtctcccttttcattactgattttgttaattaggatactgtccctgtgctctctagtgagtctggctaatggtgtatctatcttgttgattttctcaaagaaccagctcctggttaggttgattctttgaatagttcttcctgtgtccacttggttgattttgcccctgagtttgattatttcctgctgtctactcctcttgggtgaattttcttccttttgttctagagcttttaggtgtgttgtcaagctgcttgtgtgtgctctctctagtttctttttggaggcattcaaagctatgagttttcctcgcaggaatgctttcattgtgtcccataagtttgggtatgatgtggcttcattttcattaaagtctaaaaagtctttaatttctttctttattccttccttgaccaaggtatcatttcgaagagtgttgttcagttcccacgtgaatgttggctttctattatttatattgttattgaagatcagccttattccatggtgatctgataggatgcatgggactatttcaatatttttgtatctgttgaggcctgttttgtgaccaattatatggtcaattttggagaaggtaccatgagatgctgagaagaaggtatatcctttgttttaggatcaaatgttctgtagatatctgttaaatccatgtttcataactcctgttagtttcactgtgtccctgttaagtttctgtttccacgatctgtccattgatcaaagtggtgtgttgaagtctcctactattattgtgtgaggtgcaatgtgtgctttgagctttactaaagtttccttaataaatgtggctgcccttgcatttcgagcatagatattcagaattgagagttcctctttgaagattttacctttgatgaatatgaagtgccccactttgtcttttttgataactttgtgttggaagtcgattttattcgatattagaatggctactccagcttgtttttttcagaccgtttgcttggaaaattgttttccagcctttcactctaaggtagagtctgtctttccctgagatgggtttcctataagcagcaaaatgttgggtcctgtttgtgtagccagtctgttagtctatgtctttatttggggaattgagtccattgacattaagagaaattaaggaaaagtaattgttgcttcctattatttttgttgttagatttggcactctgttcttctggctgtcttcttttaggtttgttgaaggaatacttgcttccttttttgttgttgttcgtttttttcagtccttgtagtaatttttttctgttattatcctttgaagggctgaattcgtggaaagatattgtgtgaatttggttttgtcatggaatactttggtttctccatctatggtaattcagactttggctggttatagtagcctgggctggcatttgtgttctcttagtgtctgtataacaactgtctatgatcttctggctttcatattccctggtgagatgtctggaataattctcctagggctgcctttatatgttacttgaccttttgctctgactgcttttaatgttctatctttatttagtgcatttgttgttctgattactatgtgtcaggaggaatttcttttctgtcccagtctatttggagttatcaaggcttcttgtatgttcatgggcatctctttctttaggtatgggaaattttcttctataattttgttgaatatatttgctggccctttaagttgaaaatcttcattctcttctactcctattatccgtaggtttggtcttctcattgtgtcctggatttcctggatgttttgagttaggatccttttgcattttgcattttctttgattgttgtgcagatgttctctatggaatcttctgcacctgagattctctcttccatctcttgtattctgttgctgatgctcgcatctaaggttccatatttctttcctagggtttctctctccagagttgtctcattttgggttttctttattgtttctacctccctcttttggtcttgtatgattttgttcaatttcatcacctgtttggttgtgttttcctgtttttctttaaggacttgtatctctttagcagtgttctcctgtatttctttaagtgagttattaaagtccttcttgatgtcctctaccatcatcatgagatatgcttttaaatctgggtctagcttttcaagtgttttggagtatccaggactggctgaggtgggagtgctgggttctgatgatggtgtgtgatatttgtttatgttagtaagattattacattttcctttaaccatttgttaatctctgaagtcagttgttatagttgtctctggttagagcttgttcctcttgtgattctgttagcctctatcatctgacctgggagactagatctctcctgagtttcagtggttagagcactctctgcaggcaagctctcctcttgcagagatggtgcacagatatctgttgttcggatttgccttctggcagaagatgaaggccctaaacagggcctgtcccagaagatgtgctgcttctgcctttcccagaagctgcgcagcttcagtagttagcactctcacctacacagtctagtctctgagagatcccgggccagagatggctccccccaggtgctcctgcaaagcccttcctggcagggcagacacctctcctctggcagagagggtgaccagatgtctggagcctgaaacggggtctgccccagaagctgtgtggcctcaacctgtcccagaatctgtcagcctctgcagaccacacttttacctgagcagactagtctctgagggatccgggaaccaagatgcctctcctaggtgctccataagttgtttttctaaattacttttttattatgtaaatttatctttagacaaatttgtacatgtacacaatgcatactgaccactctaacttcccacttcctcacttttaactcacatcctgcctgtgaatctctgtcttatgtttgtatcatttcattttgttttgtgacccactgagattaacaagggcatctgtgtgatcatggatttggagctaagggctggagtttagtgggttcaactaaaaatagtggttcacctttcctagaatctctcagtagccaatcagtcagagggaaggagtaaggacacatgatcctccttcccttttccttcagtgattgtttataacactgatctgagagcctgcctgggtcaggtacctagagttttgtgggttcctgattacaatgattgttatcaagtccagagaatggtattcacagtgctgcgccatacattctgcctaattccttcttacacaatatcttgttagctgtagaagctgtttttaagggctggacccacacctattacttattttctactttttggtttgccatgaggctcagcatttgccagtattcattgtcaggaaaggctgcttttattaagactagcagtagcttttgtttgagcatagctatttaacaatatacgagtttataatcatttcttaatctcaaaataattgacctttaaaattgagtcaaaagtgacacagtataggtgtggtcattttaaagtatgtaggtcagtggtatttattacatctatagtactgtgcagccatctatttctaaaccattttcatcagtcataaaggagccctcacatcaaaggtaatctgtacctttgtgtttcctccaccttgaaggccctggacatttttattctgtgttctgtctctacagaggcagctagtctagatagttcatataaatggaatcaggtagtttatgacttgaagttccctaatgacatatattgttgagcagcagttctcaatgtgtgggttgtgacccctttgggatgtacaaccctttcacaggtcttgccttagacagtcagaaaacacagttatttacactatgattcatagcagtaacaaaattacagttatgaagtagcaataaaaataattttatggtttagggtaaccacaaatgaaacactctgaaatggtcacagcattacgaagattgagaacagctgattgtttcatagattttatttgacatctgtatacttatctttgctgaggtattgttaaagtcttcagcacatttgttaatccatctgtttggtttttttgttcttggttttcaagacttgtttatcgatttaatgaaatgttttctttttcttttggaatatttgactcaaggtcagagtatgtagccaggactaactttgaacttaacagtaccccctgcttttgttttacgtcttttagcacatgtaatttgtaaaacttttacccaatctgcggtttgtctttcatccttatgatatgattgtatttcttttgagttaaagagagaacaatagatggttctagaactgagacatgttctaactctataatcaaacatctgtgtttttcttttaatcacttaccttgtacatttccatttcctagtcagttagatgaagggattgagatggatcagtggtttatatgatactcaagtgaagcattacatttttaaaggtacccctgagggaagggggaaaaggaagggcttcagacaaaagaactctatttttttctgcctttatttccccatataattttgatttgaagaggattcttgcctagttaactttaggatagtaccactgaattacatgaatctcaaaaaatacttttcatattttagattgtgtgatacatgaatactacattgaatctactcgagtagtttcagtgtgcaaagagaaaaatcgtatccacaattctgttgataaatttggctttaacaattaataggtagtttctgagtaaatatttgtagtatccatttttaaagagttatgagatatggacctcccaagtagctactaatcaggtcataactaagttcttagaccacatttttctacatgtagactattaacagtaagaagatatatatacagactggagagatgacttaacagttgagagcgctgactggtcttccagaagactggatttaattccaagcacctttgttgtggctcatagccaataattctagttccagagaatctgacatcctcttcttgcatctttgggtctttatctgaaacccatgaaataattctagcactgatatttatgtaaaccttctagtttgttgaaagcaattattcattcttagaaatctagactgtagcagtcacaaagaatacgtattatactgtctatgttggtagataataaaataatactatagcataaatcttcatgctcagaactattgctcagatttaatgagttatatatgactgccttttgccccattaactaaagataagtatttcatccatttaagacagaaatataatcaatgtagacaagactcataaatccaaatgaagttgtggtgatttgaatctgcttgtcctatggaaagtgctattattaggagatgtagtcttgtccaaataggtgtggccttgttgaaggaagtgtatcactgttggggtgggctttgaaactcctcctagtgtaaaagagaccttcctcagcccttccagcctgcctggatgctgccatgcctcctgccatgatgataatggactgaaaccagtaagccaggcacaattaaatgttctctttataagagttgccttggtcatagtttctctttacagaagtggaaaccctaactaagacagaagttttattgtggtagtccatgtaagcactaacactacttataccttgatataattgagacattaattacaggagaaatagccatcatgggatatccctgttttgatgactctacttcactgtgtatttaattatgcccaattagaccactgtacttttacattttatttctttaggcaagtcattgtccatggtgtagaaatataatgtgctaacataccatacattaaataaattgatgtaactgctaaaaattgaacagaattgttagtggtagtatcatctgccatttcatgaggaattgtttttgtaagaggttacatattttaacactccttcaaagaaaagtcaactgtttgccttcctttgtgggagactttattagataatttctttgtatctcatttttctttatgcaccataaaaatctttaaacaaaagacctctgagtataagaactaaaatttagcttttacagaaaaaccttatcaaagtagttagtgtcactgcagaaaaccatttttattttgcttttaaagactatcagctttatagatatccattacctcttttgtcttttctgttatacaaatccattctgtgcagcattctccagacttattccaggaagtttgcctgtcacctggaatcttattttatgcctcctgtattccaatgctaattttgaagtcttgtcggcatcatacccatcatgtccttaggaaccaggtctgacacattaaagcatttaataacaattatttcttctttgaaatctttagactttccaggttcaggtgctccattccacaacttcaagttagtttttaaatccctgaactcttgaattgagtttatgacaacctgtttgggtataaccttactagaaattttgaattataaatgcagcagtcacgtagcaccaacctgtagttctcataaataggttgtttatttaaaatagtattgaaaactattctgttttcctacattcctaaataaaagaacatggcctaagaagtcttttatttatgcaataaacatttttatttatcttttattttcataattttattttaataagctttgttttcctaaggatagctatttccatcagtctgataagaagtacctgtttaatacatatgtcagaataaaaaataaacttgaaggcattatattgtctgcagacacaatgaagtagcaatattattctggtttatgagaaagaatatgtgggagtataagagtgacaccttataagaccattcaagacagggtctttcagcatagccgtggctgtcctggaacttgttctgtagactagattgggcaggctctaactcagaaatctgcttgcttctgcctcccaagggctaggattaaagacatgcaccaccacagctggctcccaacaccattcctggctaatttataaaattaaaaaaaattcttttaagcattgaattaaataggaatgatattttgttgagttttcttctgtgtatgtacatgtgttggtttgtgggatggtgaagctttggttaataaatagtatatacatgctccctaagatttgcatattacacagcattccattttctcagcatctttccagtgatggagatctttactgtcgtaactttaagaaatcacattcagcacgtacacttcaataattaagaaacagactctgataaatgaagtaaaaaaatgcaaatgttagagtcatacagcaagtttagtaccaaagcagtactagaagctaatatttcttacttccaaatgcagagcctattaaccatagcatggttctcattcttcccttgtccttacttcaacagaaggttggtaaaggtggatctcttagatttgaacactatatcactaaaggctgccttcatattgcaggcagaaaacttgaattagcagatactttgcatgttgtccagtcttgtatgagaaattcacaacaataaataaaacatcagagatttattccagaaaaaaataatcatctttcttaataacttgtatactccttatagatttagtttctgatacactaacatttatataacattatctgggaacaaattttccatttgagtaagtattatggattgatgattgcttgaaaacctgggctaaaagtgaagctcagtagtaaataacctttctaatattcagtatagcattgagttcaagccctgtttatgtggcaaaatttagaaaacaaatttttctatttaaaaaagccacttatttttaagcttagaagcagggaactggcctagcatgcacaaaattctgcacttttttggtgtaaacagttctatttttttttcatttttgttaggtatttagctcatttacatttccaatgctataccaaaaaaaaaaaaaaaaaaaaaagagaggcccattggacaggcaaactttatatgccccagtacaggggaatgccagggccaaaaagggggagtgggtgggtaggggagtgggggtgggtgggtatgggggacttttggtatagcattggaaatgcaagcagttctaaattagatccatatacacatactgtctatgaacattattctgaacatcatatgatgctttattggttactcatatccaccatgataataattgtgatggctactgctttgaaacctgtttatgtgagaggagttagatctttctctaagtaactcctgaagggctgtattttcttttcctttgcagtcagaataactagctttcacttcttgttcctgtcagtgtattgatctagttcagtttaaatctctctggtgtactttttagtgttaatgttcgatgttagttcaatgttcaatgacattaacatctcatagtctagcttgaagatatggatagcataaaaggacttttgatttctataaaggaatggggctccactgtaaagtgagcataaaatgtattgtagcacatttggatataacctctcatattttgcctcatgagattggatttatatgaatacttctaaatacaatgttattaatgtccaaaattataacatcaaatattttaatagccacctgtattatctacctaaattcaataaaatataattaatccaattttacatttcttattactctgcatgacttccaaatcttaacaaacttattgcatatgtaattttcctttcccagcagcttcttctgtgtggcctgatgttaaaattccaatgaggattctatcaacaggcaactaaaaaaataaaagtaagaatagaaattatagtaagggatatttactttgttacagatacttggtatttataaaacaagccctcaattacattcaaaagaatttctgaaactttaaaacctgattatatcccccaaatatccatgcctcatcacagcatactgtaacaagcatatgtcaatgtataattgaagggaattaagacagcctcattataagccagccctgtctgtgttcattccatattttcactgtacattttattatctgttgaataaatctgttgttttatttacatggaataacagccataagtcatattattacttactggctatccagtttttgctaagccttgaacattagcaaaacttagtctatgtacaatatctcattatgagattgatactatcattccaaatttactgaaaaacaaatgcttaggattttgcttctttacagatttgtttgctgtgacatcttagtttctaccttgttcactatttaacaactttgggtcatatctgttacccaaacaagtataagcttcccatagtacataaatgagttcttttctctttccattttaacaatattttcataggaaacccatgaaggttccatacctttctacctagcatttcattttcccatgcttacccataacacaatagtaagttattatcagaatgttttaattttcatgttcttgattattgcctattttgtgtcacattataattcataaaagtagcgaataagtagcaatgaaaataattttatggttggagtcaacataacatgaggaatcattaaagggtcgcagtcttagaaaggttggcaaccactgtactaaaggaaatcagagagttcttataaaacaggtgaatatattctctcagggaaaaataaagagaaatgttttataaagtttgaaaggtagtttcctttagatgaaaagcaggaagatatatgtaataaatgtaagtgaaagtatattttatatagcatgtagacattaaaattgaagcacatcataattagaagcctgcatttatcttttcattgagtctctcattttctctcattcttcctttgattttctctctacttactgaatcatattccacagtgagatatttactaggtgatacaaaccacagacattgaaccaaacattaatagcacatggttttcccaatcatatttatattcttgaagaggaaccaatgtcatgtcaaaacttacgagtataattgatttttctatctaaacatagattccatagcaaatctgtctaataagttgaaatggattaaatgcttagaaggtattacattagaaaaggagttcgcctgcctctcaacaaagcgagttccaggacaaccaaggctacacagagaaaccctgtctcaaaaaacaaacaaacaaacaaacaacagaaaaggagttcgccaagcaaaggaagtattaggtgaaaaattgtggagacccaaaagggccagtttgtagactgacgagatttgggcatttctttttttttttttttaaacagaaggcatataactgattttatatatatatatatatatatatatatatatatatatatatatactccatgaatccatgaaatctcatgttttggcggcatttttttgttgtttattgtttttgagtcagggtcttaccataaagctttgcctggcctggaactcacagaaatctgccctcttctgcctttagaatgctgggatcaaagatgtacccaatccttagtactgattagatttagtttgactgaggagaaagatgcatggtgagtgaaatggccacagagaatactttgtaatcttagctttcatttccgaccattcctctccattcattttgcaatcattgctctaaagcaatcttagtatcttttaacctgtctataagaagggacctttttctaagccttttcttttccatttttcccttccatcaccccctactctcttctgttggtatatctgagtttctagtattgtgttaataaaccctgaatgagtattaaatacttcaaatgtggtagtttaagatgaggcacctccatgacacagcaatttgctagtatcctgctttcattgcccagctattttctacttgaaccctacctatgaattcctttatagcccttgttttctcaattcaagctcttgttcacttctgttttcccagtacaattgttaccaccatttccccatgtccccatcctgccactccttacaaaaccaacacagataattttcattggtccctctaccacctccaaagcatacacacccagtagaaaaatatgtctatcttcttatcttctgaccaccaaaagaacccattgtattaagtttttctgtagagttctttctgtatgtctttaatctttgtctttgagagcagaggtcagtctgcccctcatcttcagttgtcacgttttcattgtgcatagttttgttcagtgattataccccaagacaaagaatgttgttcactttaaaatgtaaatgtttaatactgtctccttcagtgaaatcagacccaaccatgataaaaccaatgagataactgcaatagagagctttctagcttcaggctttcttctctgtttttttggtttggtttggtttgttttgtttttttgttgttgttgtttttttttggggtttttttttttttggcaacattgcagatataatcttacgtggctaaagattatttgttgtttaaatgcttaaaataccaatttttactaacctgtgcattaaattcaacacatttatgtgctggtatttattgtttattttagcttaactcagtaatttggacaatcacttgaaaaactcttttatttcatttattgttatttgtttcttttgaagagagagtacaagcttaatttgaaataatgaaaaggtatgtttttctcaataaattaatatttttgagtatttgtatatgaaatatttttaagttggaatttttcttgctgaatgtgatttaaaaacacgtatttgtttgtttagagagaaaactgcttatctgtaaataacatcttaaggagttcttaaagctcatttgtattctatataatggtattagcaggtgatccatgactttatatatatgatttctgtcaaatttgatttaactcatacagcttaaggagaaaggcagaaagacataattagctcaagtttcgaatatcactgctttggtttgatttattttttttttaaactaaagattgaacacacagtcttacatgtggaaaacattaacatcctgctacacccttagccactaggttttaattttaaattcctaatgaaactctatgtagttaggaaatgtcccaaagcaagccttgcagcctgagtactgtaccagtgttgggcctgcactggttcaagccagatagagtcctagctttgagagggggaagtggacatccctaaccaagaagataactacaattgacaccacttgcaaaggaaaaattctcaaaggagtcctcactggaatattaaccactcctaagagtaggccccatgcccagcagtagatggccagcacaaacgaatacaatggaatttttgtagactttgtttctgcattgctttgtttaaggacttattatcttactagtattttgcttgtatattatggtttccaattttgtgtttttctgggctttgctggtatgtgtgtttcttgtgctttttctttgttgttttaagtttgtttgtttgtttgtttgcctatttgttgggggggagagcacatgtatgcatgtatggacatttcatatggtccatgaagtgtgaatgtaaaggttcttatgttctactgtggatttcagggatcaaaatcaggttgataggcttggtgaagcacccagtgaagggtctcacaggcctctaattcttttatgctaatgtagagtcgattagatttccaaaccattttttaaaacaatcttttttctttcttctttaagatttatttatttatttatatttatttatttaatgtatgtgagtacactgtcgctctcttcagacacaccagaaaagggaattagatcccattgcatatggttgtgagctatcatgtggttgcttgggaattgaactcagaacctctggaagaacagtcagtgctttttaccactgagccatctctaaccctctagtccactatttcaaagactgtcaaatactttgttcttattacttgtttcctgatatataaaatttacctattatactatgtatttactgttgctcaagtttttgctttatgtaatgtcttctaattaactgtatttggcaaggagataaagtttacttgccaggatctagagttcttagtattatgttaccttgcttcttggtagaagaaatacataagagatgtttatgtagaatgctcctggtaatttgattagtctgatactaggagatatctgtcctgatatatcatttttccagctagtttgatatctacttttaggagttagccactttatgaaggaaggtttgtccagaaaaatcatatccacttagatgacaaacagatgaagaagtaaaaaaggaaaaagaaaactttctcttagaaaagagaattctcagtaaaatttggtatcatctattaattggaggagacctctatgttattttagaggatataaatacgatcagtagctgacatgttacaatttagttaaatgagtcttgaataggataccatagtcaaaacaatatcagacatacttattttaaagagaattataaaatgtatgttaaataggtgttaaagactttaataattgtagttaaatatgtctaaatctattaatccaggattttcataaacattcagaacttgtcttctgaggaactgatatgagggtagtaactcacaaactgcagtaatattaagatttcctgggaattcattgcaaattcattgcaacttctaaagttgtatggtgagcaggagggaagacttgaataacttgaagtcatgcaattttaaaactgtcatgtttgcttcaaaggaaatcaattatcctgaaaatgatgcacccattttgtcaatatgactgcacctgttgaagatgattttaaaacttggctcagttttagaaaacttttcagtcttgctgtatctactttgaagattacattttatgaaattcaaatgcagattaaattttctcaattcaaatttagcatttggattgaaatgaaatatatatatatatatatatatatatatatgaaatataaaccagatcttaaaaatctaatgcaagaagaaaataaaaatcccataaggattaaaaaagatgtatttgtgtgtgtgtgtgtgtatctatctatgtttttgtgcacatgcatatagataccctgaaggccaaaagagggagcagaatttgggtcttatcaaaaaatagcaagcactcttaaacactgagccactaatatcatttaatacaatgtttaagattttttatgagtgctttgcccacacatatatgtgtgtgtgtatatatatatatatgtatatatatatatatatatacacatatgtgtatgtatttatgtacatctgtatatatgtgtatgtatatatatatatgtattatatatgtgtgtatacatacatacatacatatatacatatatacatacatacatacatacatacatacatacatacatgtaatgtttgaatggctggtgcttgtacagggtcagaggacatttgatcacctgcaactggagttaaagataattctaaactaccatgtggattcttggaatacaaccttggtcatctgcaagagcagcaagtacacttaaccaccgagccatgtttccagctcactcctttattttaaattatgtaattatattttattttatctttttcattttcttttttaatttgttagtttatttatttacatttcaaatgttatctcccttctcagtttaccctctgcaaaccccctatcccatctcccctccaccctgcttctgtgagtcagcttccccacccatctacccaccaccctagcattcccctacattgattggggcattgagtctccacaggatcaagggactcaccttccattaatgccaaataaggccatcctctgctacataagcgctggagccatggttccctccatgcatattctttggtttgtggttttgtcctagtgagctctggggggtctggttggttgatattgttgttcttcctatgaggttgcaaacctcttcagcttcttctgaactgacttcttctaactcctccattggggtcccaatgttcaggctaatggttgacaatgagcatctgcatctgcatttgtcaggctctggcagaacctctcagaggacaactatatcaggctcctgtcagcaagcttcttggcatcagcaatagtgtctgggtttggtgtctgcagatgggatggatccctaggtggggtagtctctgaatggtcttttcttcagtctctgctccagactttgtccctgcatttcctttagacaggagcaattttgttttaatatttttgagatggggggggtggcctcatccctcaactggaggccgtgcttaacctctgaatatggtctctacaggttctctcttctcttggttgggtatttcagctaatctcatcccgttgggtcctgggagtctcttgctttcctggattctgtgacattctagtggctaccccagttcccccatctcccactgctacacacctctgttcaatttcctgcctctctatacttctcccctgtctcccctgatacctgatctgccccccttttccttccctctctgtctccctcccaggttcctccctctctctacctcccatgattattttgttccccgttctaaataggactgaagcatccacactttggtcttccttgttcttgagcttcatatggtctgtgagttgtattatgggtattccaaacttttgggctaatatccacttatcagtgagtgcaaaccatgtttgtccttttgtggctgggttacctcactcaggatgatattttctagttctgtccatttgcctaagaatttcatgaagtcattgggttttttgttttgttttgtttgattcgttttgttgttgttttttaggtttttttttttttttttttttggtttttcaagacaaggtttctctgtatagctatggctctcctggaactcactttgtagaccaggctggtctcaaactcagaaattcgcctgcctctgcctcctaagtgctgggattaaaggggtgtgccaccacacccggcaaagtcattgtttttaatagctgagtagtattccattgtgtaaatgtaccacattttctgtatctatttctctgttgaagtacatctggtttgtttccagcttctccctattataaatatggctgctatgaacatagtggagcatgtgtccttattacatgtcagagcatcttctgggtatatgcccaggagtgatattagtggttcctcaggtagtactatgtccaattttctcaagaactgctgtactgatttccagagtggttgtaccagcttacaatcccaccaaaaatggaggagtattcccccttttcaacatccttgccagtatctgtccaacccactcaagatgtattttgcaagtgtgtgtgtgtgtgtgtgtgtgtgtgtgtgtgtgtgtgtgtgtgtctgtgtctgtgtctgtgtctgtgtttctgtgatctgtgtctatgtttgcaattgtccagagaccaagggggtgttgaagcccctggggctaaacttccacatgtttgtgggccattatatgggtgctgggactaaacttttttgttgttgttgttgttgttattttgagataggatttctctgtgtagccctggctgtcctggaactcaccctatagaccaagctggcctcaaactcagaaatccatctgcttctgcctcccaagtgctaggattaaaggcttgcaccaccactgccaggccataaggggaccaaacttttaagtcctctgcaaaagcagcaggtgttattaacccctgaactatctttccaactgatgtaatgtgtttttttccatgttagaagtctgtataatggaaattttctaatctgtttatattaacagagattaaattatggtggcatggtatttacacaccaggcaaatgagacattttcagaaaaaaaaaaagtagaacttaaatgttctcatatataaatgtaaatgcacccctcccctataaagggtaaacataactatggtgtaatcagtgcctgctttttaaaatttgttagttcatttatttaatttatttattgcagtgctggggattgaacccagggctatagacacactaggcaagtgtactaccattgaactatattcccaaccaactatttttcttccaagacctggcctcactgtgtagcccaaggtgacttattgtgactcatttattccactggatttcacaagttcacactgaatgtttctaagatataattcatcagaagtttctttatttttcttttcttttcttttcttttcttttcttttcctctcctaaggacaatgaaataagattgaatgccttgaagtacagctacactatatttaacttgtttatttaggacaaaattattactgtttttttggactaagatgtagataaatttatcttttatatttcattgatttcagaaaattctttggaatatgctctttattttgctagttagaaagatatgtaatgggacttttactatgttaagtctttaagtaatggttctctaggttcatattattagttcatttggatttgtatttatttttaggtaggcagagatatcgtgtagagactggcttttggtttggttgcagaatgtttgggtatccatttacagtaatgaatataagtagtgatatcattattgctatttttaaacatccattggccatctagaatgtgctaaagtctgaatataacatggttaattatgtcactgttcttgcccatgttgactaacgggagatattcccattatgagaaagctatcaaatgctttggtttgaagttaaacattaattcactcctaaattactgaaagatgtttagaaggttgcctgtgatttctgaggagcatctggaaattttcttcttatatatcaacttcccacattagtttcttattgttttttatgcttattattatatattttttttagttttcctcacggaagaaaaagccaactcagtactaaaacgctacccaagagccaatgggctttttgaagaaataagacagggcaacattgagcgtgagtgcagagaagaaatctgtacatatgaagaagccagagaggcttttgaaaatcatgaaaaaactgtaagtatactggcaacataaaacatgttcacagcattacttaccattccatatattctgaaacctacattcccaaagaacatgaattgcttctagctaaaagttaatttgctgaagaagtcgccatgtaacagctaataaataatgttctgtataggagaaaactacacttacttccctctgttttggtctgtctttgagggccatgtttccacagtgttctgcttagctaacagttatggtggcaaggcatctggttcacagaaggcgttgatctataaagtaggtggtgtctttacctctcagtgcttaatcagagagagagggtagaaggtatggggaacagttaatgctttgatgttttatttctcctaggctggggtatacagctcagtggtaggatgcctccgtcatatgcttgagaccccaggttccaaatatagaatcaaaaagcatttcctttagttctctatacttttggtttcttcttccacatttcacaagactgaattagttcagtttactctgactgcaggctattcaaagataacagggttgtgaaagcagaagcaaggatgtaaattttctaaatcttctatacagttgtaaattacaacaccagaggtagcaattgtgtaaagatacttgcctgcgcaccaaaaaaaaataatactctatgctaattaagtggtatatcatgtgctgtaggggcattcactatgccataggaacagtgagaacatacattttaaagaaggagggtttgatcttttgtttgataaggctctcaagatgagagagaaagggcctcaaagaaattgccagattctcatgctcaaagcaaaagcaaaatctgcttataattaacaagctatgttcttcataagctttgctggttttacaagtagtagtttattgtcatatatatactgaattattggtatagtttcctctgtatggctatgtagctcaaagaccccttaacaaacagcccctcttcacagtcacttagttatccttcattagatatacattgtttccatatgtacttcatctatttctagatttttatgttctagtttatccttccactttcagaagatttgttttatgttctaatataaattagaagtagttctacattgttatggtattctacagtagtttgtgaaatttcttacctaccaaagagacagtgagctgcctttgtcatgtgaattttagtattaaattgtctcgcataaaaaaaaagtattttatcagtatttttattgggatttttttttcagtttgcactccttcccaaataatctgctcttgccatggtaagtagtaacttcaccaatgtacttgttgcctctttacatcaaaaccatttattatggtttgattactaagagaccctacaggctcacatattgaaagtttagtttccacctactgggaactttagaagctagggcctcagaaaactaagtaggtcactaggggtgtatctttgaaaggtatcgtccttctgcttcctcctgtctgtctctgctatctgactaccatgaggtgagtagactgccacattttcctctaccatgcttgcctcagactcaaagcagtatatcctaccagccatactttgatacctcttaagcaataagcaaaatttaatccccttcctttaaactgtttctttcaggtattttccttagcaacagaatgtatgattaatacattgctactaccatcttaagtctatcttttatccttaccacataatttcaaatttacattcttttattcatcagttctttgagaattttgtgcaatgttgtcgtattccctcacttcccaaacttttccaagatccacctccacttctctgagcactcaagattttcctattgattgattgattgatttagctcttttatagggagagggagaggcacatgccgtaggccagaggacaattgcacatgttagttttctctttctgtcatgtgaattctaaggcttgaatgcaggtcatcagacttggtggcaggtacttttaccaacttagtcatctaactgatctgcacaatttttgaaatggcagactaaaataacattttaacttttcttcactatgcatggtagttcatacctatagaagcaatcaatactcaggaggtgagtaagattgtgaatgaagcctaggctatgtagtgaggtctaggctagtctggccatactagtaagaacaacactgcaaaccaaagcaaagcaacacaaatctccgtgaaggcttcatatctcctccagtaaaacccaaagaattcagaatcacctataaggtacagttgtttgcaccctgcactaacacttccctacagaagaaacctcacatctccaaggactccatctccttagtgattgtgtagtacttttcttctgcttctttacagttaatgcaaagcaagtgcccactcttaagtctttgacccttgttcttttcacttgcaaattgatatgcctgaggtcattgtgaaacttcactttctcagtaaggaagtattctgtctcctgtgatttctcccccagcacttatcaccatctgacattgatttttttattcattacttgtttgctttctgcccaatgacagcactatttctcagttgtttggttcatagctacaaagttctgacacaaactagggacaaaataaatacttgatagaggcaagaagtaatcaattgtgaaattataaaacatgtttaaaacatcagatgaagtaatttaagttttgttcatgagttagatgagagatatggattttaaaatggattttgtgttaatattggttttctgccttctctatggtttctaagcctgtcatacaaaattatttacattataaaaatgatagcatttataatagggtgttattggaaggcatttaggtcaaggtaataatgtctaacgggcttcaaggcaactatttgagagtcatgtttgttacatcctaggaaagtactagttaacagaaaaaaaaaaaaaaa

SEQ ID NO: 852 - DNA, 103070 bp, mus musculus; identical to SEQ ID NO: 851

SEQ ID NO: 853 - DNA, 66587 bp, mus musculus
ctattgcccttcgcatcagcagcagctgcaggctccctctttgctcctggctccggctctagcgggtgcgcgcaggcgcggcttgcagctctgctagcgcgtagtagctgagcggggctcacggtgagtgaggcagcggtgcgggactccttggagagaacgtggttggcagccagaaagggactcgggtgtgtatggaagactttgacccggttaggggagactcgtgcagctttttcagtggcggggcttctcgaggttgccagcctccggctgcgtgtggagaggagtgagccgtggcgggagacttaaaggtgtgtaggagctgccgagttagaagaaagaagaaaggcgtttagaagctggaagtcctcacttgagcttggccaggccaggaaggttcgcttgagagccctggaaggtggcccagcttcaagttcagtccccctacttggtgcccccgagcggtgtcctagcttactcttttccttcctctgctttccctgggtgccgagttggcaggaaggtttcctgtcggtggggagaggatttgggggaggtgggttgttggcccggactgttgcaatagagggtgtggcgttcctatgactttcctttccccgggaatgtgtccctcttctgatacattgtgcctggacattttttaacaaaggctataactgttttgtaggctgtggtgggtgacagcggcggggggggggggggggcgagggtacgcgcgtgcgcgcacgtgtgtgtgtgtgtgtgtgtgtgtgtgtgtgtgtgtgtgtgtgtgtgtaggctcgcgcgcgcgtgtgtctgcaagcgagcgagcgcgcgcgtgttggctggcttgcttcagaagtctgtgttgccgccctagggggtggggaatcagtgtgggcctgaagttgggggaatttccagaaagacctagcaactttctgcagaggcttttttctttttactggtctgttgattttgagagtaagaatattccccataggaatgtgcctggttactattttgtgtgttcttgctctgtgtgtgtgtgtgtgtgtgtgtgtgtgtgtgtgtgtgtgtgtgagagagagagagagagagagagagagagagagagagagagagagagagagagaaattgagagattgatttttatacgtttttacaaatcccaacagaagaaaaaccaaaaataatggtatttcagaagaaataagtgagtgtgaatgaaagggagaagacttggaatagctaagtagagctagataaatcccttttgatagtcacagaatatgatcagacttgggaaaatgtggcagtgtacaagtcagtaaatttagctagagtattgttcattgtttcaatgaagaattcttaaggatatggtgctgccagatacttaggctaactcactttagaaactttaaaaatgataaaacattagggaaagtattgtgacattggataaaggcccataggctttcatgttaaaaatttatgaacttttatgaaaaatgatacatgtggtaccaagcacagatgtttatattttaactcattttttaactgagtacatcataataaactgagcttcctcctcctccaccccttttccttgattgtgaatcctgttttataaacataaacacccatggaaggagttacagagacaaagtttcgagctcagacaaaaggatgggccatctagagactgccatatccagggatccatcccataatcagcctccaaacgctgacaccattgcatacccaagattgcataccctatcaagattgtgctgataggaccctgatatagctgtctctggtgaggctatgccgggggcctagcaaacacagaagtggatgctcacagtcagctattggatggatcacagggcccccaatggaggagctagagaaaatacccaaggagctaaagggatctgcaaacctgtaggtggaacaacaatatgaactaaccagtaccccggagctcttgattctagctgcatatgtatcaaaagatggcctagtcggccatcactggaaagagaggcccatcggtcttgcaaactttatatgccccagtacaggtgaacaccagtgccagaaagtgggagtggggggtgggggtggagggcatgggggacttttgggatagcattggaaatgtaaatgaggaaaatacctaattaaaaaataaagaaacatggaaatactaagaagctaaaaaaaaaaaagaaaaaataaacatatactctcagatctgaaatatgtttaagcagaatttcttcgtgttttctttttatttaatcttttctccaattattcaaaggatttggtgataatattatccaacttgggagaggggtgttaggatggatgccttttgccttttccaagagctcagccttatgaacttattgaaaaatattttcaactccctcggaattaatcatcctttaactgtttaacttatagcactagccttattttctctcttgttaccccaatacttgggttgccttgcatatggtaagtgcccaatataattatagttacatgttattacatgtcattagaaagataagatcctacacagagttcatgaagtatagaagaaattctgatcttttaatgttgaaggaccatttcttgaaaatacctaatgcacactgtagtagtgagaacatagatacattgtcatgtgttattgatagttaatgtttataaatgaggtgcacaactttgtagataaaagaggaaatgggtatcgtaaaaacacacactttagaagacaccaaagctagagaatagtcattgcacacactgaaatatgtaatttgttatttgcagaaagacaggaatgaagtgctgcttgactttaggaaattctaaaaatgaacacagctcacctggtactgtttactaaaggttaacacaaataaagaaaactgcaacctacctcatgctgtactcctacgtcttaagatggtttgaaccttttggctaatgaatcctattgtagccttaatcatcttgttctgatgatttctgctatcttatctttgacaaatctctgaattccaacacattattggctatccaggtacctctgcttatatcagggaattaacttgtctggtccactcagtctcaacagtcctgtcaccaactttcatcttctgaatgatttacccattgcaaagattatcctaagcaaggccaagctttataaaataatgagtatattcttctgtttaaaaatgagtcaggatttggtaacttgactgatacagagtctatgcctacaaagcagaaaactgtgctagccattagtaacccctgattttcttcccttacttaacttctcccctgcccagctaaatgtaatattgtttttcccatgtgatttttcaaataatcatcctgccaaaaacaacacttcatgttagtgtttaatacttatgaataaaatctgagatgcagaaaggctgagtactccatgaatatttttatttaaacttttaacatattttctgattcatatacatggtttttgaaaaaaatgaagctttgattattttatacctttctcccttaatgtttttctcatccagactttgtccttgtgtgtatttttttttcctttgtcactgtagataaacagcagaatgtttgtctggggttgtcatatcatgtaaggttggaaaggacacaactaagagaagatacttatatttaaacaaccaaagtgatttcatttgtttcggtttatgtcagatacagatgattgacttaatttggtggaatactatcatttttcttaagactagaaagatgttacaagtatttggaacaatgtgtgtgtgttttttttaaaacaatgtgtttttaatttgcaatgtgcattagattccgctgttatgaagctctttcaactagcatgcttgtatttaaggcccttccttcatataaacacaccaaatcagaaatttcaggtgaagaagctaaaaacaaacaaacaaagaaaagcccaacaaaataaaaacaaaaccctagtagatttttgaggtccagttttttactggctggttttgtgtcaacttgagtcatcagagaaggagcttcagttgaggaaatgcctccatgagatttagctgtaaggcattttctcaattagtgatcaacaggggagggtccagcccatagtaggtggcccctggttccttaagaaatcaggccgaacaagccaggagaagcaatccagtaagctgcacccttcatgacctgtgcatcagctcctgcctccaggtccgtgctttgtttaacttcctgtcctggcttcctttggtgatgaacagcaatatggaagtctaagtggaataagccctttgcagctcaacttgttttttgctcttggtatttgtttgcagcaatagaaaccctaactaagataactttgttttaaaaagtacttaaaaggatgatagggtgtggagacaataaaaataaactacttttttgtataaaatgttggtgaaaaaagttaagacaaacattgcagtttgacggttatatgcaatggaaatgcatcagagagagagattaaaaaaaaactgttagagcacaggagtaactgaagttgtaatgcttgaaatgataattaatggaatagatactagagcaaggaactagaggcagtggaattaagggcatggacagaagagaaaagaatgaattaaaatatacatttaaaggcagaggtgaatgaaactgacagtattctccttaagtgtttcattaagtgatggatactattttccaatgaagctgtttgatttgagattcctatttaatatccaggtaaaaattctaggtatttctgtgtaagaaactctaggaataaatcaaattattataaatgaaggttattcgtgttttaaaaattaataagctttatttttagtgaagttttatgttaacaggaaaattaagtaggaaataaagttcttttttctttttcttttccttttattgttttgttttgttttttgtttttgtttttccagacagggtttctctgtgtagccctggctgtcctggaactcactctgtagaccaggctggcctccaactcagaaatccatctgactctgcctcccaagtgctgggattaaacgcttgtgccaccactgcccggccaatgcctcctgttcttgaacactgtttcctgtactgtgatgtcctgtcccattgtttcagctgataagtctacactgatacatcattatcacctgaggtgtgttgtttacacaggcccttctctttgggttgaacattctataggtttggacaaattcacaatgacttgcacttacaattgtcatgaccaccctacaaatcctctttgctcagtctgttcatcactttctcttatttctagtaatgtttgatccttccactatttctaccttgtgtacttgggatcatataatatgtaagttttttttttcagattcctttcctttatttagtgatgtgcatttacacttcctacacatcattttatgatttgataccttatttctattaactgctgggtaatgaaacctcacctggctgtatctatttacctcctaagagaacatctttgtcatttttaaggtttaggaataataataaaactattgtaaacatcgatattctacgcacctcccccccccccctgtaactttccagttcctttcagtaaataccaaggagtatgggtacaggagtctatgttaagaataagtttggttttgctagaaactgacaacatccacacattgggagcaaatgagaagcctgttctgcattctttttttttccatttttttattaggtatttagctcatttacatttccaatgctataccaaaagtcccccatacccacccacccccactcccctacccacccactccccctttttggccctggcgttcccctgtactggggcatacaaagtttgcatttccaatgggcctctctttgcagtgatggccgactaggccatcttttgatacatatgcagctagagtcaagagctccgggggtactggttagttcataatgttgttccacctatagggttgcagattttatcgaaaggacccagatgtagctatctcttgtgagactatgccggggcctagcaaacacagaagtggatgctcacagccagctaatggatggatcacagggctcccaatggaggagctagagaaagaacccaaggagctaaagagatctgttctgcattcttgacagtgtttggtagtgtcagtaccaaacttacattattttggctttttttttttttttttttttttttttttggtgtttttgagacagggtttctctgtatagccctggctgtcctggaactcactttgtagaccaggctggcctccaactcagaaatccgcctgcctcttcctcccaagtgcgccactacacctggccctattttggcaatttttaatagatgtatagttgtatttcattgttgttttatattaatcttcccccaaaacacatgttaaatattttttcatgttcattttccatttatgtttcttctttagtgaggtatctcttcagatactttagccagtttaaaatcaagtacatctatatatggtataataatcttttatctaatatttgtttttcaagtttttttcttacagtgtgtagtttttcttttcctttttgataagaatgtattttgtataatagaagttttatgctttactgaagtctattaatcattctttttatagatcatcattataccttaagtttactagatttccttttaggtaatcttttaggagttttaatgttttatatttttacacataacactggtccattttaggttaacaatgcatttaaagttaattgtttgggtttgaagtctgtttatagacttcttatctactagttatgttgaacttagaaactcatatatgttaggcaaacactctaacactctatcaatggaaccatgtatgtcagttctatattcattttatttgagacagggtcttattttaaagtcctgattgaccacttaattggtttgtagacccaacaggcctttgcctcttgaatgctagaactaaagatatgtaggcacctacatatcttctattttaaattttgcttttgcatgtgtatgtcctgtctggtggtgattcttgaaagatttatattttctttgttagatcttctttggttctttgccaaagataaatggttgtattaatatgtatccatttatgagatcttatttgattatactgattaaagtctattattttaccagtagcacattgtttttatgacttgaggtttatagaaagtctttgtggtttctacaatatattttgatcatggtttctccttcccatcttcttctacttcatggggatttagaatcaccatagaaacaatctcttggcatgtctgtgaggtattgccccaattaagttaactgagataggaaaaaacaacctaaatgtgggtggtgtcatccacagactttggtcgatgactgaataaataaaagcaagaaagtgggctgagtacaggaattcacctctttctcttctctgtggccacagtgtgatcagtgagttcctactcttgtgccttcatgctgtggtggattagataccctagaattgtcataggaaatacattcttccttgagttgcttttgtcaggtattttgtcacagcaatgagacaaataattaatacagccttgaaattcgtagtaatgtattactgccttcattattttctaatattgagtttgttattttatatcatttgtctctcaatataaacttcagaaatagttttttttttaatagtcacaacataaaggttgttaaggtatttttttggggggagggggaggctgtattatatttattggtcaaattgggaagaaaaccttgtaactattgggtctttgtatccttgaatccagaaatcatttctatttgcttatgcttttatttatttcatcagagttttctagttttcttgatagacatcttatataaattttattagattgttacctccttaacatcaaatacatgtcaatgtaaattgtaacctgtttgaagtttcaacttgtgctttggttttagaacaggtttattggaagaatttgggaaaaatgtagataagaattaaggaaaagccctaaaattctataaccagaactaaatgggttatttggtcagacccttatactgagagggaggtgaccagccaagactgctcatgaagatggaaatgaggattctgttagtaagtggactagaggttattcatgttgctatagcaaataacctttctagattttttctgtgctctaagacttttgttaaatttgaaggtgttagactaattatccaggtagaaggtatttctacacaatgcagcattcatattacaatatgggttatgcttgcttcttttagccagatttgtagtgaaaaccagaaggaaaaagtaaagaaaaaaataatcgaaaacttgagttttcacggaaagttgaggcaagacaggtatagctttcataaagttgaggccaagagaggttaacctgccaaagagactaggcttcataaaagcaagccaactaggtgtcaaagaggttgttcagtgaggattattctgaaatcatatccagctttaagagggaagaacctgaacaccttatacaagttactacatatacaagcacactcaaacacacagacacaggcacaggcacagacactcaggcaagacaaccccccttgcaaacaaacaatctaaaaagtgaactacacatagcaggacagcaggaaagttgctttaagtgtatatcaggcactgtctagcagcactttatacagggtcaggagcataaagatttaactaattttatttaaatactttgctttgagaagaaactattggttatttttcttacttgggactggagagatggatcagcagttaagagcacttgttactcttgaaactttagtccagtccattatacagaaggcaaagtgttgagaacatcagatatttagtcactttttaaaaataagtttattttgtgtgtgtattcctttgatttagttgctatgatttttttctttatttttcttttagccaacataatatccctattgattctttggaaaattcatatactgtaccccgatgatgatcacactcactttccgtttctctcaggtccacctttccacctgtgcaaactctccccaaaagaaaaaaagttaagccaagttaaatttttgttgcctgcatactcattagagaactgtcaaactcccaggggccagcctgggataactgagtcctctcccaatccccatccccaacataagccattaatgtgagaagctacacttcagcatctttgtcacaatttttttagaactctcttcaatagcttcctatttgaactggttctttgtagtgggcgggagaggctgtcatagaagccttcagtgtctctcattctcaattatgagtctacagttatcaataccactgcaaaagaagttttcttgtgcataacagccagtggcagcatgaatcatggacttccatatggtttctgatgacagctcagaactgaactggtcctcacaggctgcacagatcatgcaccaccgatatcaacatagcctcctgttgcagccctaatcatggttatcaacatgacctcaggcctctatatagaatgtggacatcaatgtgggcagcacataccatgtatattcacatggcctccagtggtaacatgaaccaaggcatcaacacagcctgtggttacatcatgaactacagaccagcagcatggctcctggctgcagcatcacttcagacttcaatatggcttctggtggcagcataaatcatggagatccttcaaagagacttaatacagagaattgctatagtttatcttagatatcttgttgctcagagctagggtgattgtgcgaccaggcagcatgtttgtggaaagagcctgtgcaagctccaggctgctatacaccatcctgccagccctacttggcaacggcatgctcctttgttgcagctctgctcccatacctgtcacctcccctgtatctccagttcttcctcgttgcatacctgcctgctcttttctgccatctttcctacatctatcacacattcacttattaaagggacattgcaaacatatatatgtatgtatacacatatatgtatatgtgtgtgtgtgtgtgtgtgtgtgtgtatgtgtatatatatatttgccccaacagctttacatgcgtatacttactgcaatcagtcattggtctggttcaaggtttctggtaaatactggacttatctctgagactcatttcagatatcacgttctctctgagtcagggtgatcttgtgcatccatttctggggtaggatccttgaaagctccaggtcttcctgccctttgtgcctgctccctatgggccatgtcactctcttgctgacacaatggcaagctgcataagcatgctctgttggctgctgggacagcactcccatgttatgtgtgacttctgctccaccatcttatttccacttccataagaccactttttaagagcattttttctttttttttttttcaaaagttcagggaatcctatagaaatgttgggagaaggattgagggacccaaagatttcagggactctgcaggaaaaccaacagagtcaactaacatagacccttggggacttccagagattgaaccaccaaccagatagtgagcacagaccagacctaggccttcggcacagatgagcagtttggtcttctagttgtaggtcccacaacaactggagcaagggctgtccctgactctgttgcctgcctgcctacctgtgatccattctcataagtggatctccttgtctggtctcagtggaagaggatataccaagtcctgcagtgacttgatgtgccatggtggtggtatatgagtgtgctagtgaggggttcatgagggattattttaaaaattcactgttatgcaaagaataaactatagaatagcatagccacatgcttctatttagaaatttaaaaaaaatagtgtcagggattggttcttgcccattggatgggtctcaagttgggctggtcattagtttgtggttacatctgtctttgtaccatctttgtccctgcacatcttgtaggcaagacaaactccatgtccaataaagatctacaggaagtatgcccctatctctttaggctgtgacaactggcctttaaagggtgaccactgtcttacagaggcaggcctgtgttttaaccaatgtctattctgaatttaagctttatcaaagcaggtttttttttattcctcttcactttctcatctgctagtcatttatatagcccttggttgcccttgtgttccttaagtgtgtgactagtgtcccctatgctttaatactaacttatggctttttatctattacccattttctcctctttctattttaatatttggtacctgagggatttgtcaggtgttatattattagtgtggtaggcagatgtatacatgtgcagtaattgttgtatcctgaataatgttaatgtgttttgtgctctgcctttgtagttcttttgagtgcaatggcatgggtattatatttaattattttaaatcatctttctcatgtgtgaccctgatactaatgttttgtgaggtttctaattatttccagtgctgatacaactgtataacattgccatttattttataattactctgtacccatttgtgtggccttttgaggctgcccataagtctgtgaatatatatatttttgcttatttatcaattatggattctctggctgtgagaactgcagttaggagtttttattgtgaagtatgttggactccccccacccccacccccaaagtatctttccataagacctgcccttttgtttgcttgttttcgtttttccgcaacagggtttctctctgtagtcttagctgtcctagaacttggtgtgtagactaagcaggcctcaaactcccagagatcctccctcctcagcctgctaaattctgggattaataatgggcatattccaccataaccagctgacttgcttcttcttttcttttttctttttctttttttttctttttcttttctttttctctttctttttcatttctttttcttttttttttcctttttatttccagaggtgctatacattctgcagactcatcttttgcagatgagcctctccttgaagcctccttgggtttttcaggttcctaggagaccctgtgggtgccagctgctgctgccaacctgaattctgctttatctaatcacattgtatctgtagtcaagaagcagagacatggcctttgaaagagggttaagtggttaaaagcatttctgcttttctggaggacctgtattcagttccaagcagctacatgacaggtgacaacaatctgtatctcttgttctgggtgatccagtggcctcttctggcctccatgggtaccaggtgtgtacatggggcacatacatataacatgtaaatgaaacactcatacccatataataataacacatcttaaaaaggaagcagagaagtgaatgttagcatcttccttttctctctttttattaagcatgagacattagttcatgggacagtgcttcccatgtttaggatacgtcttctacactgtaaatcctctttagatatttcctcaaaggtaagcccagagatgtaccccctatggtgataacatatccagttatgttgagtgtagactatccatctaaactggggtaccctgcttgcacaggccgattaaggaaatgattccatgtattcagctgtgtagacactcagtagccttcttagtcattattcaagggggctcagcctgctctatgaactgatagcaaactgatagcagccatcaaggaggcaagacttgagaggtcctgaaagctttttctcacatttcaaaataaaagtatgtatatagagatgcaaacagtgtatgtatggggggatcaagatcctcctgtagtcagtctctaagaggataatgtatgaagatatgaatacagcggagactcagaatttagagataataaggaaggaggagttactcctgaggaaaactgcaagcagagtacagttattcaaagagatgcatgtcatcaggattgctgtttgcaagaccatagggatagggcttcccaagctctttgacacttcatatcacaccatgtgcctcaaatgctgggcatgcagctacaggatttgatgcctaagaaagcatcaaagcatcaaatatacttgatttcagtcttctttggccatatctctttcattgcttccattctttcatttcagaatagaaatggtttactctgtgccattttatactacaaataggaggtcagacttaagaatgacatacattgtgggtaggataggtaggaggatggttcagcacttaagaacatttgctgttcttatagagaaccagggttcagttcccagtgccctcatagtggctcataaattgtatataactccatttcaggtgatttgatgccttcctcagacctctgtgcaccaggcatgtacatgttgtgcatacatataaatcaactgtttatgaaaacaaaactatatacatcatttaaaaattatatatgataaactctaatttcagcatttattaagtactcttgaaatacgtgggtcttgtacaggctttatcctttgtaatttttaaagcataagtattatgcttattaaaaatgttatcaagcataattaagtaaccaaagagccataaattagataggtaaacatagatcttaaaatgttcatagttgctctgctttctctatattgtctggtaattgtgattataaaaagataaggagatattggaatatattttatgggggtatggtgaggtgtaggggaaggaagtgccttggcagtcccatgctgaggcttcccttttctctgaggaactagatacacaatgttatagtataaaatagagtttatttaggccatgggaggggagttaaagagtagtaaaggcagaaagaaggagagagtagagaagagagtagaggctggccatgaccacgtggagaagagggaagggaatggggagagagagaaggagcaagaggtaagagagagaggagggggcaagcattcccctttatagtgggccaggcctacctggctgtcgccaggtaactggggaggagcatacctggctgttgtcaggtaactctgggggtggagtccagacagaatacccatagtaaaacttggtatagccatttttaagatcattcaaagacttgtgatgaacttttcttagtatgtactatcttcttgaaaggtttgaaaattaaatggacaaaaattgaaataacagtttgaactcttagacttcagtgcttcatatttataactttggaattctttgtgaaaatgtgttatatctaaaacacttgactcgaaataagttaactggtttctatttcttttcatattttaagactgtcttagaagacaagatgtgtgttattttctagaatcctggataagcaaatgtgactcaagtttcagaaacaatatcttgttcaaagcactttatagtctatcaatctctttcaatgtaggtccaatatgcctaatctttctggtttgtttcctagtgttagacattccaaatctgtagaaaactatatgaatatcttatcacagtaatttactgtgacttgtgtgattctgggagaaagcaggaaaagtgagaaatgtaagcctagttttagaatttgacatcactggaaaaatcagttaatggaacatatgacaactttcttttctaaattactattacttatggaaccaataatcatgttggtaagaatattttgactttttgtttgtttgtttgtttgttttgtttttcgagacagggtttctctgtatagccctggctgtcctggaactcgctttgtagaccaggctggcctcgaactcagaaatctgcttgccactgcctcccgagtgctgggattaaaggcagtgtgccaccacgcctggcttattttgactttttaattgtaattttatcctaattcagttttaaattcccttttcccttacaattgacaagatagtattgctgtagaagtcgcacaaatatctcagattcacagtctgataaggcaagtatttgttgcttcagatatgaacaatatttcaaaaagtcttaatggattttgaagtttattttaaaaagcaaatgacaatatttgtaagaagtattaatgtcttctttatgttcatttcttgaattcaccaatgagattctgaatagtccattcatattgttcttatcccagttcagagatccttgtttctttcctaatagtatgtagtcatgttcttttaactgatatctctagctctgtattacctattcttaacaccaaatctgttcattcagagatgttgaagcctcggatttgctgcacccccaccctcttcacagagcttctgggaggtcccgctcagtatccctgcagatcagattggttagtcaggttttatgtgcctaacatttctgaatcatttgtgcacaaaatttgttttctattttacttctacatttccttaacatttattttattttaattaggtattttcttcatttacatttccaatgctatcccaaaagtcccccataacccccactcccctacctacccactcccacttcatggccctggcgttttcccctgtactgagacatataaagtttgcaagaccaatgggcctctctttccactgatggctgactaggccatcttctgatacatatgcagctagagacacgagctccggggggaactgattagttcatattgttgttccacctatagggttacagacccctttagctccttgggtactttctctagctcctccgttggagggccctgtgatccatccaatacctgaatgtaagcatccacttctgtgtttgctaggcccctgcatagcctcacaagagacagctatatcagggtcctttcagcaaaatcttgctagtgtgtgtaatggtgtcagcgtttggaggctgattatgggatggatccccgggtatggcagtctctagatggtccatcctttcatctcagctccaaactttgtaactccttccatggatgttttgtccccagttctaagaaggggcaaagtgtctacactttggtcttccttcttcttgagttgcatgtgttttgcaaattgtgtcttatatcttgggtattctaagtttctgagctaatatccccttatcagtgagtacatatcatgtgagttctttggtgattgggttacctcactcaggatgatgccctccaggtccatccatttgcctaggaatttcataaattcattctttctaatagctgagtagtactccattgtgtaaatgtaccactttttctgtatccattcctctgttgaggggcatctgggttctttccagcttctggctattataaataaggctgctatgaacatagtggagcatgtgtccttcttaccagttggaacatcttctgaatatatgcccaggagaggtattgagggatcctcctgtagtactatgtccaattttctgagaaacctccagactgatttccagagtggttgtataagcttgcaatcccaccaacaatggaggagtgttcctcttctccacatccttgccagcatctgctgtcacctgaatttttgatcttagccattctgactggtgtgaggtggaatctcagggttgttttgatttgcatttccctgatgattaaggatgttgaacattttttcaggtgcttctcagacattcggtattcctcaggagaaaattctttgtttagctctgagccccatttttaaatggggttatttgattttctgaagtccaccttcttgagttctttatatatgttggatattagtcccctatctgatttaggataggtaaagatcctttcccaatctgcttgaggcctttttgtcttattgacagtgtgttttgcctaacagaaggtttgcaattttatgaggtcccatttatcgattctcgatcttacagcacaagccattgctgttctgttcaggaatttttcccttgtgcccatatcttccaggcttttccccactttctcctctataagtttcagtgtctctggttttatgtggagttccatgatccacttagatttgaccttagtacaaagagataggaatggacaattcacattctcctacatgataactgccaattgtgccagcactatttgttgaaaatgctgtcttttttccattggatggttttagctcccttgtcaaagatcaagtgaccataggtttgtgggttcatttctgggtcttcaattctattccattggtctacttgtctgttgctataccagtaccatgcagtttttatcacaattgctctgcagtcagtataccttaggtcaggcatggtgatttccccagaagttcttttacccttgagaagagtttttgttatcctaggtttttttgttattccagatgaatttgcaaattgccctttctaattcattgaagaattgagttggaattttgatggggattgcattgaatctatagattgcttttgccaagatggccatttttactgtattgatcctgcccatccatgagcatgggagatgttccatcttctgagatcttctttaatttttttcttcagagacttgaagttcttatcacacagatctttcacttccgcagttagagtcacgccaagatattttatattacttgtgactattgagaagggtgttgtttcactaatttctctctcagcctgtttatcctttgtgtagagaaaggccattgacttgtttgagttaattttatatccagcttcttcactgaagctgtttatcaggtttaggagttctctggtggaatttttagggtcacttatatatactatcatatcatctgcataaagtgttattttgacttcttcctttccaatatgtatccccttggtctccttttgttgtcgaattgctctggctaggacttcaagtataatgttgaataggtagggagaaagtgggcaaccttgtctagtccctgattttagtgagatgcttccagcttctcaccatttactttgatgttggctactggtttgctgtagataacttttatcatgcttaggtatgggccttgaattcctggtctttccaagacttttatcatgaatgggtgttaaataatgtcaaatgttttctcagcatctaacgagatgatcatgtggtttttgtctttgagtttaagccttaagaatttgtttgggtctaatcaaccatctctggctgtcctggacctcagattgtacttttcccctccctgagcagtgttccagtgcttctctacagcccaacaccacccagcaatgtatggggtaaggaggttagccaggtcaaacttcccacttcccacctccccaagcaaccattccctggggcagagcaacacagggctgacaaccctatagtctagttctttgcttagttaccattacaacaattcagagtgtgatatactattcttgccgctgtatttttatttttatttttatttttcaattctggtgagaggaagggatatctgagtcttcagcacaccagaaaactcaagtgcctggtgacaaaaatctcatatagaatgtaattttttgcttttgtttgcaacacaaacacactcttaaaaaaaagaaagaaagaaagaaagaaagaaagacaaaaccaaacaccagcaagaacaaaaacaaacaaacaaaaaagagtttattattatatgtattattagtatatgggtgttttgcctttatgcatatcaatgccaagtggatagtatgtagttagaagtgcaggctctctgtgcttatgtgtctcctgctctttgagaatttctcacaatggtgctgggaatatggtgtatgttcaaaatatttatattgatgtattcaattacattgttgagttaatgatacccatttaacttgtcttttaaaacagatatgctaatgatgtaggtacttgagtaacatgtctagtgttctggtcaaaaagcaagattgtttatttatttatttatttcaagcaatacctctctctccctgggtggcattgaactcattgtgtataccaggctggtatgaagctcagacatctacctgtctgtgcctcctaagtgctaggattaaaagtgtgtgcactatgcccagctgagaaagataagttttaatgatgttttcttgttttgttttgtttgtttttttttaaatcaaagtatacttgattttatatagtgatccctacttttttgttttacttgatttttaattatcttcaaatttctcaccttttgctatttgtttgaataacacattcaattaatatcatgactcagactgattttgcatgtagaaagtttctcacatttatatttagccagatattttttgggaagactcaggaacatagacatgattgccttccataaactaaaatcacacagaacagaatttctccccctgcctcctaccagacttgttttatatctattttccttcccttccttctttgtttacttaaaaaaaaataacttactatacaaaattctagtattatacaaatgttatcgcattttgaacaaagtatattctagtagattctttttcgtcatctcccctgtgcttccctagtctcattttcaaatttcacgtccatgtgtctttcatttcttatattactaaatgggaagattatatccagatgtctgggtaagaaacaacctgagtataagcaggaatgtaaccacaagtggaggtcagaaaacaactttgggatctgttttctccttctgcctttacatgtatgtgttctgggcatggatctcaaaccctcaggcttgcaacacaagcacctttatctgatgggctaccctactggtgcctcacagtcgtgttcctggtcttagacttaaagaccttaaattagggagctagcagcagtctgtattaccttccctcaaagaaatttctgttctttactgcttttcttctcagttaccttctcttcttctttagctatacaaataagtgcaagaaaggaagctgtctttcatcagtctgtccctttttttgatcataatgaactgaaatgaaacagtttaatgcacactgctctcattccaagtgtatataaaaagcaggtataaagtttgaaattatcatcttacctgatatttagcattcctttgactacaataaccttataacctagtaaataattactttgagagttcacactgtattgaagatttggcctgtcccattgtctacttgtagtccttagtgaagattactatagtctcttaaactttcattgaggtttcatatctaaaaaaaactcacaaagattatgtggattttcttcttcattgtccatttctttcctaactggacaatagccacaggctgtttaatgattttttttttcctgttactttcagtcattaatgagggcctgcctagggacaacactgtatagtttaagttaactcttacttgtttttctaggtctagccaaggcttatctctcttgtggcatagttattgaactttaactgatgttacattttatcctgttaaattactgcaaggacaagtggttgtttttctttttttttttaaatttatcatattgtggttaagatattttttaaactattgtgtgacttatttcccagaagctttaattaaattggatgtttctgtataatattggccatgaagtcttgaatcttaaggacactacattatttttatttcaagaactgtttaacatatctctatgtatattattattgtaagctatgaattatattaagatggctaacagttaatgtgcttctggctttctttttggcatagataaaccttattgttatgtgattgtatattatctgttgataatctgtatttaatgaaatgcaattccaattcattttcttggactttctccagccaggcagaactcagacagagaacattgatgggcttgccttataatctgaatttttcaaagtatattggcatggatctttctgataattaacatagctggatattttataaccataacctttgatttgatcataaaatatttaacaagaaaaaatagattaattttaggaaatattatcagacctttagagtattttcccatggaaccaagactaggtgacttaggaactcagttgatataagtccctcattcactgtacatcacatataacatccacaaagaagctgccagcttcaagggtgcctccatctgaagtaaataattacctgacactctatggaagatatcagagaatactctattagaaccatcaaaactcactgaatttgtttcttttaatcggttcagagttgaaacactgagttgaaacactcagtgtcccctcttaatatgttcttaaaatatttgaattaatatttctactttccagaaaactgatacatttaatgtggtgcagaacagcaataactgcacaactttatacaggccatggaggccatacttatctgtagtctcttctgtttgttatttggttagttgggttttggtttttcaagacagggtttttctatgtagccctttctgtcctggaactcactctgtagaccaggctggcctcaaactcagagtctcaactgcctctgcctcccaagtgctaggaataataatatgtgcctctacagcccagcctgacctagggaagagtctcataaatcttgctggagcaaggaagataagaagcttgataaacacttgttaggaattatatgtcttgtctctatgatataggaaacaaccttaaggtcgttcctcatctgttttctagtttcagatgagtgagtgactttctgctttgggaaaatagtaccacattgattttgtttttgctgtctatgtaagtaataaaataggtaagtcagtgatgtatatttactaatgtaacataataataatgtagtaatacacataggcctgttagccactgtgttgccacattagcgatgtttgtgtgtcataggaaaacattcacaggccaaacaactcagctagcatgtgtatcttaggatattccttgaggcttgtgcctatgtctgggcagaatgggaccagaacagaatttcgtattggaattaatcttgactgattttcttatattgtcagaccaagttaaaagaaaaaagatctccttcattagaaatttttgttcacaaaattgaaggaagtttgcttctgaagctaccctctctacaaacatatatttgaatattggtaggaaaggaatagtgacagcgtgtgggcctattcagattagtgccctttaaatatgttgttgcctcctattcatcaacccagtagactgttcaagctacaatactttgaatttctctctcttaaaaaaaaaaaatcaaggttttaccatataagcatttgcacctattctggtattatctctgaaaaataatagaaggcagcatgaaaaaatgttttctaaatttcatattttaaaaaaaaaaatgtttctgtaatacttgcctgtgatggtttgaatgaaaatggctcccataggttcatatatttgactcgttggtcccaagttgatgggactgtttgggagggattaggccttgccagaggaagtgtgtcactagggatgagctttaatgtttcagccatccctagcatacttctctctgtttcctgattgtgaatcaggatgtaagcttttagctgctgcttcagtgccatgcctgcctgcctactgacatgttctccataacggttatggactcctgtccctctataattgttagatccgaataagcctttcattctataagttccttggtcatggtgtttttatgacagtgacagaaaaccaaataaatacactcaatcatccattgtatccattttaaacatagtcatttgagacttttaaattttctactaagcattggtaattgcatttcagattctgatgtagtttcattaccatatagtctctaatgttcatttcatttctcttcaaatttattatctgtaaaatatttacttagatttgtgtgatttactttccagataggaaatgtttgctgagttttctcttcctttctctcttctctatttcacactcacacacacatacacacacagatgcatgcaagtcctcatgtgctttgtctgtctgtctgtctgtctatctgtctctctctcttacatacacactgagttacttttgaagtagctcttatctaaattttgtctatggttgaagcccctaacagtctggtatctataaaagtgtttcagggcttagtcagaatcaccagtagttagagattcaggtttcaccctgtatttcttctttcttttgaatgatcatgattccttgaatagattttctctacttctctaaagccagactgctacgtttgtttgtttgtttgtttgtttgttttttcttttgctctcacttttgccatacatattttgtttgtaaatactcctatgctgaaagacataccacaccatctcacttctaccaagtgagtggacactctccaacttgtgtcagtctacttctctgcacatactggtaacgttattgtggcagtttttggccttagtttacaattattttgctttgcatctcttcaggaactttatctatgcttcagttagaaatgttgatagacagaagtctggacacactctctagctctcttcctcctgctattcttacacttatcagtatttgccaatatgacttttcttgttctgtaagccagagaaatgagaggcttagcccatgtcctctcactgctctctcactgctctcaccataagtgctatatgtagccctgatcaaaagcgaaggttaagagcgccatgtggctttcatctctccttgagttctttctcagattctgtatgcttctctcccataccttaaatttatttatttttttattgtatttggatcattacattttgtaattcttttcctgtttttatgtggggatcctataggtgctaaggttatcatacccagaaatggaaaggtttcaagcctgtttttccccataggatggaaaggcagactaaaccaagggaaacacccacctctgttttactgaatcatcttttcaaaaccattttagttactattcttacagtgttcaagacttttgtttccatatgacagtgagtgggtatagcaagttttagatgtaaaaatatcccttaggaggctatataattcccacctctctaaaatatattacatttgaaaatatgttgcacagaatctgcagatattttgtttgtttgtttgtttttgttttttaataaaagagaaaactatttacaccaagttttgcgccaaatgcttgtttttttagaaattgtatctaatgcaaactgtattgagaaattatatatttaatgcatgatagtgatagtagagtgcattaataatgcacccactgtaataaattactcagtaaaatagctaaatgtgaacattaaagaaaaatagttttaagttttctttcagtaatgtagatgctcagctatatgtaacattttcctaggtaaaaattagtctattatgatatgctttattatatagtactatagaagttaagacacttgaagaaattatcacagatttaaaagtatagaatagaagagaatgagaggtttttatttatgatttggaggagagccttaagtgctctgtcctaggtgatacaggtagactcagaaaccctgaaaatatttgggggtttctcacttccttaagtggttatcttgctgttgactcttgtgacccatggctacttatcaacttgtaagcagcttctttctcccttagacatcatgaattgaaatcaaatgctctaagctacttttaggctttaattgaaaaaatgacttaagacaagaatgacaaggcaagttaggctaaagaatgttttcatggacaactatgaatgtggccaatggtatacttttcccccagatggttaaaaaagattcatttgtaatttagtggattttttgattcttttgaggatccagtttcatttcagttgattctctaaaaaataccacattgattactatcctttgacttactctcacatctgcagtagatgaatgaaggcctcaattaaataagaagaaaagagctatgctttcaaaggtcttgctgcctatctccatatttatgttatagacatagagaaagtcttatttaaaattaatattaaattagaaccccattatatgttggaattttgcaaatacttgttgaaagagaatcttctcctcaaattagcaacaatattggtatgtaggaggacctttttctaagactgatttttcttggtgattaatgttggagctagacatttcagaggcagtttccaagtaaatgaatagatggtgagataatttcttaaagttcttagatctagtcagtctctagagactttgaagctgtgagttacagagtattctgatttgatctcctgggatctctgccagattcataattgcattgagattttttaatgatcacaaatgatatcatgatgcttttctctttattctggaagtaagctgattactacagaggaaggaataaaaatagattttagtcagaagacttggaagatcagatatcaggtcagatgcaacagcatatctgatacatacttaagtagtcactgagttgtgactaattagtttggtgaaatagccttggttatatccattagtatatacacagtgtgggacaagttttatattcattgctttaatcattcaaccttgacagaatacttggccgtggtacttttttttttaaacttttgttataaagacaagttatctttcattacagtgttctaggctcccagtcttcttttttagcatgggaatagaagtgggaggactgggcaaaaggcagaataatgtgttctttcccttttgctcctggcaaataagtctttattttcataatttttttccaggtgtagtcaaccttatcattctcactgtgtgccctttcatagagtgtaagatgtttttgttgcatttttaatgtgtatctgtctttcttatgcaagtagagagcttaattattaattcacctgcccatctttgttacacccacttaaaacaaaacaaaacaaacgaggactacaatcaataaagccttaggtaaatatgtagctactttagagagtaaacttgaaaatgcctggttcttagaggatgtgtatgtatacacacacacacacacacacacctttctagttttctaatttgacaaacagcatgaaactctcttgttgctgttattgttcaaatgactatattccatacaagaagaaagagggcaaatagaaggaggatttggcagaattctctcttacaacggtcttatttattatatcactttgagagagagagagagagagagagagagagagagagagagagagagagagagatctatagtaacaggaattttgcacatgtttgatttatactaaggacaaaacccagagctttgtgcatgctaggcaagtgctttaccagatgagctattataactctccaacctcttccctgtttgcaaaatgttgtgatattatttgtagagagtttgtttaatagatgcatccaacagtgatatggaataatcaccaaagaagactgctcagaccttggtttaagccattagaaagtctttattagctggtcagcaactatactaggttttcaggatcccagtatagctctcagcctttctcagggtgagcttttaggcacaaaacctatgttttggattgacatacttcagttcccaagaacagttagcaggaaatgaaactacagaagcccaaaaacaaagtatagtacagtatatttagattctttcccaggactatatggactttgatggattaggcctttgttatagttttgttgggtggttttgtctatgtgttaagttttacagcctaattggtacttccatcatggagtcagttgtgctaaagactggggcctaagctggtgccctgttacattccccactggtcttagtgaatgagtcgaatcatgggctcatcttattttagtgtaagatgcaggaccttgctgctaatacaatcagaatgagaattaaaggcccagccagtgttgataacaaagtacttaggcagagggaccaagagaatagagtctggtaccaattattttctcaactatggcaataatttttttctacttactcctgatcaattagtatagaaacaataggttttttccaaagccatatatagtttcttttatttcatgagtggtctaagcctctccaattatgtagagccatttctgcaagggagtgtaaatgttgttttcatccagaaactgaaacttttgatatctctaggacatgatcaacctatctacttagtttagaaagcagaagaggcacatttagtcaaaccactagtacatgccaaccaagtagtcgcagagatccagtaatattgctattatccatatgaattaacccataaggcagtgggcatgggcatcagaataaaggaaaatgcctaggttaacggttttggatattagacaagttctaggcctttttaagtcctctaatatttttgcgggggagggctgctcccagttacactgagctttgtcagtcagctgacagtctggttagttcctaacatgtatagtacaggggatagttctcttaagcataactggcaatcctggctaatttgggtcagggggagctggacctgagcatgataaactctatacctagggacccttcctgagttatagggtgattcccctgttttgtttgtttgtttgttttaatgttttccaaaggccagaatcatttaaagattttttttcccttttggaatcctcagttttacaatctcaatttttgtaaaggaaactaccttgctatggcaattagggtgccctcagtcacaaggcatgcacagaattgaatattcttaattcaaaagataaatcccaatatctttccttcctctagtataaccagatgtttaaaatggacatcagcaaataaaagtcaagatggaaagtgggttgcttctttgtagttacagtagctaatactttctctgtatctgtcttcatcagttcccaggttcaggccaaagggccataggggttagcccataaccctgtattcatattaaacacatgtttcaggagaaagtagagtggagtatagagtagaagttcctggagcccaatgaaacctaaatttcaatgggtccacagtctagaaataattcatttggcagcatccatggcttctacctgcttgacctaagtgaggtggatccatgatgtaattaatgccagctatctttacaaataaaagactgaagagaatcactatctagagtcctttcaaagttgctttaagtaagtaaccctttagctatctgcctgatgcagacaacatcactggactggaacaaggggaaactggtaatggacttggaggttggctgggtctcttggatagtccaatgaatggaggactggagtacctgtagtgacttgaaaaagagacagttagaaatctgccaactgttggtttctgtgcctgggaagcagtcggggagatcttccaaacataatctcatgggggtaaatccctccctatatggggtgtagaaggctgatgcaaagaaaaggaagggtgcctattcatgctttgctggatgctggacgatgagagttttgttaaagtttctcttattgtcctatttattttttcagccttgtcagaacactgagttctatatgcacagtgaagttttcaatctgtgtctaaagccttagctattaattgagagattttgactatgaaagctgggccattattggaccccattactagggggaggctaaatcagagaaccagttcctggaggagctttttagctattatttgagcaatttctatttgggtgaggaacacttttactcacctggaaaaggtatttttaaaaattagcaaattattttgttcttccccagatggcttgatcttggtgaagtcgttttttttttttttttttttttttttttttttttttttttttttttttccagagtttgtggggatgttgctctctcattctgaccccatcctgagtaagggctctctgctttgtatttagctaagggcacacctggcatcttgctgagacatctcatgatagactgtccagtcaagggataacatatcttggactgaacaactcagaatgtttgtggaccccggataagtagcctggtgaaggttagttcccaaaagtcctgccaattctttctaggagtatgatcttcccctctaatgtcctccattgtggcagtttgaatatgtgtggccaagggagtggcactattaggtggtgtggccttgttggagtaggtgtggccatgttggaaaaagtgtgtctctgtgggagtgggcaatgatatcctcctcttagcaatctggtagtcagtcttcttctgtttcccttaagaacaagatgtagaactctcagcatctctagtaccatgcctgcctggatgttgtcatgcttcctaccatgatgataatggactgaacctcaggacctataaactagccccaattaaatgtcctttataagagttgccttggtcatggtgtctctttacaacaatgaaaacactaagacatctatcaacctgtgggtttgagctgttgtaatcgtttatatatgcttgggccggaaagcagcactatcagaatgtgtggccttgttggagtaggtgtgtcactgtgggtgtgggctttaataatctagtcctagcttcctggaagccactattttgctagcagccttcagatgaagatgtagaactctcagcatctcctataccatactttcctggatgctgccatgtttctgccttgataataatggactgaacctctgaacttgtaagccagaccccattaaatatatgtttttattagagttgccttggtcattgtgtctgttcacaaaagtaaaaccttaagacagcttttcatttttaccatggagtctcacgcagtatgggattgtaatatgtcatcagaatatcaataggccccattggtcttagagccatttgttgggcagcagcccagcagtggaggacaacaatttgtaggggaagccaagtagcctctaaaggagggccaagattttatgtcccatttttttcagcagtgagaaaccctctatctttataaaccataccatggacatggctggtagtaaaaccatactgatggctggtccatgaatatgatggtagacttttgttttccctatccaagagcatgggtcctgtcaatcaattttgctctttaggctgaggtaactggcatgggtccagattgtcttgataaaagtaactactgcagctcccacgtactttgttttatctttcatctccagacattcatggatgaatgcctgtgcataacagagttgatggcagtgggtttttcagctgaacttgtgggtaggtctggagtcaggcctggagtagagccacacagtctttatacagctagcattttggtgctgcttctcagagaagggcctcaactttgttgtgagtatacaatcttgatcatgagttaatttatttgctttccttcattaaactagcagtagcttccatagatagctctttggcaggtggggctatcctctggctacagggtacaatcattttgacagaaatgtcatgggacatttccaagacctcaaagttcaggttaaaaccccttttgtcttttttttttttttagtctcagtaaaagtacctagtgaaaattgcttaaaatctccatggttgtgttgaacaaaagcgaaatccattttgtccaggctgtgttgtcaggcagcaatccttgtgcccagcccaggggagtttttttttttttttttaattcctttttagacaacggtggatcttacagatcattgatttaaaaggtggcataaatcataaagaagaaaggaacggaactttctctcttccttcgggttcaacccaggggaatgtttcctcttccccaggactgcttaaagcagacatgcagagggaatactcaccttggagaacaatttccctctccctgtatacattcttcttaaaggacagcaggccctgctgtcttcataaaggacagcaggccctggatcataggcctggcctctccccctccacacaagggccaagcctgaccaggagcaggaggcagtcaacaaaatgaacaagtatgtttgctccaggtagatgttttttgtttgtttttatttttgtgttttgtttgtttgtttcttggtatgtcttggcagagtcacaaggattcagctccccagtggaatggagcacagatcataagccagggagttgtcccaccagaggctttgaaacacccccctccccagggtcttgaggtctgcctctctgggacaaatctcagtgggacctccagaaatgttgtggggttattcaccaaagaagacttcttggatatgggtttaaactaatagaaagtctttattagctggccagtaactacactgagtgattgggatgctaagcttttcgaagggtgagcttttaagcacaacccccccccaccaagttctgagttggcatacttcaattgacagacagttagccagaagcaggaccttagaagctaaaaggcaaggttagtacatttagagactttcccaaaattatatggactttagtgaattgggccctttttttagatttgtcaggtggtgctgagttttacagcctgaatggtacttccatcatggatcatttgtgatgaggtttggaggtctactaaattctggggccctgttacaacagaatctctggttatcagtgaaattttttttttcagtctgcttgaatgaggcttgggctagctggaaacccttaggaccctcgtttttctgttttgttttgtttttgtttgtttgtttgtttgtttttaattctacctttccttttattttctattgtcttcttaagggcctcctttctgttatttctgagtttacatgtgttctttattcgtttccacttcgtcaactaattatgtattcttgttctttcctcatatgcaatacatttgtttacacatgaattactatttctttgctacattaataggaattccaggttgatattgatacctgttaataatcttttcccccagagactgtggttccctctacaggttttggagggaaaaaaggggggcttttagggatgtttttgtatttttcatttctagaaaattgtgttcagtttagcaataaagcattttcttccttgtggaacaatttgaggggaaaaaagattgaaaaagaccccgtatgttaggtaatttcagaccagattttctggtgcattcagagcggtatgtggcgttagatgttatgtaatttcaaagaagactcatttggctgtgaaactaagggctcttaactctgtgaccaaagatttcgattctccaaaggatgctatagtcactcattatgttatcaaacttgtataatcctgtgcctcaagtcaggttgagacacctgttctcagtgaaaagcaacaatataatagtggaaaacagaaaatggacattcatttaatggggcatatttcaaagagggcaaaagagagccagtgaaatgtttctgaagtacagatcctgaaataagactaacaagtatatagagggccaaggacacttaacatctaagcagtgccctccaaagtgtagttttaccgaccattgactcatcattgtctaggcttcaatttcatttatacagtggtctaagaagttgttagaactgcttgaagtcacttccctggagaaaagtgccccctctggtactttttacttctactagcactagattccacattttgtggggctcattgttttatagtctgacagtcagattgagcaacataaaatatcttcatttctgccagacctattataaacagggttttgttgtctggggagatggaaagtgggtgatgtagggaaataaatatatttcatatattgatttatctgtttgtatgaatttacagcttcatatgtttatgtaatgtatttagtccttttcctctttctactctctttctgcaggccttcttaaaaaatttcccttctacttcttttttgtatgtggcctactgaatgtggacttatttacttactctgcatggtgggcggttattgagtagagcaagggcaactttttagagactgtaccaccaaagtttgaaaagaccatatatgtaaaagagtctaacaagatagttcatctttgtagaaagtttaagtttttgagaagaaaatattcttgaatacttaaaaaaaatctgtacatatccatggcaaaaagaaaccttatggttttatgtgaaaatgataggagagataattgcatctagcctatatgttcctgttacatgttccatgaatgatcaaggaattgtaaactaatgaagtgtcattttttaacttattggatcaaagttgaaaaacaaaatgctaatactcacaaatgtgttaagtaggcagtgttctaagaaagaattttgttgttgtttatttgaggcatcttctagctttatagcccccactggcctggtactcactgtgtagcctacactcatcttgaacttgcagcagctttcctgcttcatgttcccaatgctaggatgagagacatattctatcatgcctggaaaaaaaaagctctttcttataaatataaaagatgggagtgggcctgcatgctgcaggccttttcaagtgtcctgagccagcctacaggactccttgctgcagttgcagtgcagagtctggagctgttgtggtgcaagtcatgactggacaagcttttataaagtttcttctgctctttctcagagtatttgttgaaaggagtgctactgaaactgtaaccaaaagtagcattatgcttccagaaaagtctcaaggaaaagtattgcaagcaacagttgtggctgtggaatcaggtgtgaaagggaagggtggagagattcaaccaattagtataaaagttggagaaaaagttcttcttccagaatatgaaggcaccagaatgttctagacaacaaggaatatttattctttagaggttattaggactgaaattagtgttgaaacggtgtcacgtgaagctgcccatttcgttgatattctatttgatcatgtaaatttctatacctcccttttataataaacggatgatgcctaaactgacagccattgtccctgaagttcagttttgctgtactgttagaaacatttccaaataaaatgatgtaaatgagtggaaaatttttggtaaaagtaaaataacataaaggatcaagttacactaagtagaaagcctagtatagtaggaaattctgcatttactattttttttctaaatatgctttctaaagtcttatcttccctaattggatttgctttcttctgctaatttgaggcaaccaccctgtaatataatactcttgttacactaatgataaaatgaaattcatcatatccttctagatggtaagttactgaataatgactcacccaaggaatttattattagaaaataataagtgtgtataaaaaagaggagtgtgtttttctcttggttacaatgaaatgaaaccatcctaaatgaacgaccattaacagaagactgcttataaattactacatgtagggggctataaagaagctaataaaatggatgcattttacaggttgttagcctaaaggctgtcaatcagtttagtgaacagaaaatattaatcagacttactacaaaagaatctttattcaggggcagtggtgacacataaacttaatctcagcacttggatggcagaagcaggctaatttctgaactctcgagttcaaagcaaggctggtctacagagtgagttccaggacagccagggctacacagagaaaccttgtctcaaaaaaaaaataaataaaatctatgttcaatatagtgctaacacatatggctttgtgttaggtgttaagtaggaaaataaaagtaaaggaatgggaaatcaaagtaaaatgatatacatgtatgaaatgttttaaggaaacaaattattttatatgaaagtagacataaacaaaaaagcaaaacaatagaaagagcaaaaccaattatgtgattattacctacatttcactgttttttttgataatgaaacaatgtgtgaaaaagattacttgaatttatagttaaagaaaagcagtgagacagacaactggtttatttagactgctgaagagatttgctgtcttagcctggagctcctaagtgttttctgtgccagctggttactaaatgacagtactgcagaggccaagtcatgtcctcatctcttaagtagtttgccgtctgagggaaatactgtgcagttagaaagtcagtgcataagaatgagtccatttgatttaagtcttctcagaaattcagacagagatgttctggctaatcagcatgcatgactaaggaggaagggaattgttctgcttgtaataattactttcacaatcaattaaggtttgaaaatgaagtagcatttaaataaaggcacataatatgagcaaagtctttgaacagggaagttattcaacatttgtagaggtctgagatgattcagttataatgtacttactattaaaatcttggaaaagctgaactctgggctgggctccatctctgaaaatcttgctttaggacctgtgtttcatctttctaaaaatgaccttttaagtatcaacatcaactgtagaatagaatctattttcaggtaaaaaaaacaaacaaaaaaaacaaaaacaaaaaacaaaaagaaaccaactggttgttatttcatttttagcttaatgctacaataaggatagcatttgagtatgaatcttacttgaggcataggaggtctaaggacatagtggttttatcatcaagccaagatgtggttttcttatttctgaaacagaaatattattaatcatcctgggctcccctttagcccatcaggcacttatgtttacttggaaaactggtatgtgagacaggatttcagaagtttacagcttgaagctagtctccaaaaaaaaaaaaaaaaaagacaaaatgtttgttatttcccacctaccaaagtaatggacttgtggataaaaaaaactgagtgggtaaagagctccaccaagaactgaatgggcaggactgctctatttcataaaacactgtatcttttgaaatggagaatcctctaatccccattttcttcattctggaaaccaggtctcccataaccctctcaaaagcacagttcctttctttcttttccattgttgtgaagtgaccctatgatcaaggcaatatgtaagagaaaatattcaattgagagctttcttacagattcagaaggtaagtacataaccatcacagggaggagcctggccttctgaaagtaactaaaagcaaagaggttatgaaaaatggttcttaatatgtgactgcatgggactgtatctaatattgacccctaattgcattctgcttattatgtttacttcagatatatatgtattccacctcaatattgaagtgttagaacagaaagtgtgaaattgtaatgggcctagaagaaaagaagatagtctagagatgcgaaaggaatgataatttccccaggaatattgtgctgggagaaggaaaggaccttagccacagtaggagcttgtcttcctggagagatttcagttttaagaacttgtcagaccactttagaggattagactgaaaccccttcaatgaaaagtcaattcaatggtgagcaggatcacgcctggactaggacttaggtttgtgtattctttaacttctatttaaattttaatcttacttcaggtggtggtggttgtggtagtagctgcggtggcagctgtaagggctgtttgttgggtctcttgtttcctcttcccagtgtggacacattaaataaatttcctttttctgctttccatttaaaaatgtaagtgttctagcatttgccccatgtatggatttctataaattgtaaaatggtcataggcacagtgggggaaaaaaactagatctctcctttgaccaaattgtaattcaatccattttcctttgcccatttttatttcttaattctcttggaattatatagagaagttaagccaagtaagtttatgaactcaagtgcctagaaaatatagtttctttgaatgctggaattataagcttgttctgctctgttggctttacagggtttttgatgtttgtttggtttggtttttgagatagattctcattatatagctctgacaggccttgaactcagaaatctgtgtgcttctgcttctagagaactgggataaaagacatatgccaccatgtctggctttatagggatcttaatacacagattaagtgaaatagtataatggccttaatgcgtaaatgagacagcaaaaggagatcttcaaatctgctcagcacctgtttcatcacttacaatgaaaagaaaggtgtgtatctatgaaataaaggattagcagaaataagttcactcttcagaaagtggagtaccaaagtgacaaatgtccaggggaggaaaaaaaagatggaacaagttgtagtggtttctttttatctttgactttgtgacaacagataccctgattcagtttgatttttgttttccagggcaatacagatttggggaatcaatgtgataagctttccacaatctgttgatgttgagtagtaattcttaggcacccaaggcttccctcaaatgaactataaactttgcccttaataatttagaatggaatggcattctaaattcttttggcccatgtgcttgcttatcagcatttcttccagggctgtttgcttctgtctttggagaagggacagtgggtcagatctttcaggttttgtctacagaatggccattggcatctggatcaggtagattcaaagtgttgtctttgtcgtggtcacttaattggctgcactttctgttgtatgtctaggaaattttaggaaacaatttgtgagctaatttctaaatatataaatatagtatatactctacttctggatgtatttctgttggtctacttaaaaggtataagaaatttattattaaatctgcttatataaatatcgaagacattttcattgcttttcttttgaaaataacagagtaagcttttttttttttttttttttttttttttttgatctagtctcaaatcataagtgatgaagtttctggtcaatgaattttttttttaaatcttagtgataccacagttcatttaactcatgtttcttggcactgactactagggagtatatctctttatcagtgttatagaatatttcagccagttgtgttatacaaacttctatcttttgtattttatattcataatttttctgtgtcaggttttccttaaatactttatttttataaacttcatattatcttcttttatgatatcatttcacttacatattgtttaactcatctgaaaaccaagtggataaattgcatttgatactgaaataatgtgttgaattgatgtacagtatttttaaaaatttggtgatagtgtatggcaccaaattaggtgagatcaaaaatataattgggcctatagataaatatagcagcaactaatcatgtacatacagtaacccatatagtgaatacttgaagtgtatgtaaattatatcttgagttttctctttcaagcttccctgagtctcagtacatttcaccaggaaacgttttagtgagagaggaaacagtttcctacacatatttcacaactgagtaaggaacagaacacactgacctggttaaatttgccttactggtatcagttaccttgcatttacaatctgtggtctaactttgccactgtcatgctatgcccatttcctatagaatagttccaatgctgtttcaggtaagcatcagtctgtaaattggttaaatcaatttacttatatataaaaatctagtagtcatcagtttaattttcccagggggaaaaatatgcttgctgcaaaggataagatagctgacagcagatttccacatctgatggtctcatttttttgtacccaggaagttatcagaagtgagaataaaaattttaaaagactgatacattgctgctgctgctgctgctactactactactactgcgtctctgtatctagtttcaattttatctcattcctggctggcttggaataatatagaatagactagtaggaactcatagagatctgcttgcctctgctttcacaagtgctaggactagagacatgcaccatcatgcctggtctgctatattatatttgtttattgtacatgaggttattaaaaccttttgttagtttatgtatataagtgtttagcctgcacttatgtctatgtaacacatgtgtacctggtacctaaggaagctagaaaagtgtgtcagatctcctggaattagacttacagacagttttgatccatgatgtgtgggtgtttgaaattgaatccttggtaaaagttgccagtgctattaattgctgagccatcgctccagccctctgctacattattgttagcagaaaaaaaatagaccaaagttttaagggctgcctgttttaaatgattagatctactacactttatttttaagtagtaaaatatttagaacatggttgaattatcgtatatgaatgcttgtaaaatttcttagaatgaatagttctaaaaagtagatcacaaaatagaatatcatataagctcaacttgttaaaatacatttgtatgtttcaaatatagtaagtatgagtctataatatcatatacggtatatgtgatttctgcaggcattgaacaaaataggactttatgagattacatttccttttagggattggtgatattattaatttttagttaaatatgattaagcttattttataaatggtagaattttctttgaccttcaattcatagttcttctgctttttctcttaggattcatagctttccagttcaattagattaaaaagagtttaaaaccaaaacagataattcaggcctagcactgaattgggttttagggtttttttgttgttgttgttgttttgttttttgttttgttttcttttgtttttgtctttggttagtgtcacaataatataatcttcaaggaatgcatcatgaatttctttgggttgtttttgcatagcaagttattagtttgcaaaaggaaatagcacttcttcagggttctaaattttggttttataaacaaacctactcttgtgcttttatgagttgtaaatcttactgtatgtgatgtattattagttaattatttgaaacaaatttctcttaaaatatccttaaaagatatttataggagaaagatctttgataagaaaaatcacttccttattaaatatttttaaggtgcaagggtttaaacttagagacttgtatatgttaggtaaacactcgaaaatgagctatagctccagcccttgaataatttttttttgctgggagttgagtggattttgaacccaagagaaacaatcattaaagaaactatatatgagtattgtttatttaagaatttcattattcaaaataatcattctctgaagattcattgatttttactttatgtgtctgtgtaagtacctgcacatatgtatgtatgtgcatcatgtgcatgcctggtagctaaggaagccagaagcaagcatcagatcccatggaactggaattacaagtagttgtgaacaacctgatatgggtgttgggaaccagaccctaggtccgctgtagtagcaccaaacgcttttaactgcagaggcatcttggcagctccatattcagtctttagaattgaggttaatgttttaattgtgtatgcaagcaattgagttttagttctctcaatgactttaatgtaatatccttaagtattttcattacagtggcatgatttgttagatagtgatgtaatagcaatacatagcttataaaggtctttttccttttaaggcctccaagacatatcgaattccttttgtatgctatttgcagtgattattcaatatctgttttggtggcatacaatataataatggcagaattttaattgtgacaatctattctgcttttctagttattgttgtgttgagcgctttacatatgatctaatttattttaaacctcttataagaccacattaaaaaaacgtatatatattgttttgcatttcaggctgaaattctgtgctgtgatgtgcttaatattttgaaacccaaagccacattatttctcctttttcacttatatatggtgtccattaggcattgatcttgtcccgtaatattaactttctttaactgattgttctgctatctgaagagtcttattaaaatttaataagtaaagtaaaaataagcagctaatgctatggtacattctggtaactcataaaagaaagaaaaaagaaggaaaggaaagtttaatgttggcttgtgagtttaaagaaaggttaatacatccttactggctaattcaatcgtatctttaaaggatgaatttttgacccttgagatatgtataccacttacaggtaggatccatgtctgtttatgcaaaatttagtgttttatcctaagagcactgaactgcgctaaattgcatagcactaaaaaacaggctaaagaccatctataccctgttttatttcaaaaagcccttctggactgtgactatgggtaacatgtttcttgacctatttcttttttgtggtttccttccaatctactaaaaagattcagatcctactcatgtgttttgtcttcataatatcccctgccccttcccttgtcttgttcttgctttagaggttcattttcattactacttttctagttttcattctcaatctttatatactggaagagataactattgatattcccacttgatgttctttatcttttaaaaattattatattttgtgtgcacatgatatttgtgtgtgagcacatgcacatatggaagtcagaggacaactttttgaagtcagttctcttcttgtacccttacatgggttctgaggtttgaagtaaagttgcccagattgggtgttaagcacctgtaccccttgagacatcttgctggccctctttgtcttaatgactcttctactgctcaagcctttgttttcacaaagccatagggaacatttatataattatgactgtttgcttattttaaaagtatatgttccacctggcttcctgtctcatatatttgggagtttgaggtaagataaccaagagttcaagaccagcctgagctacatactaagtttgaggacagccttgcttatgtgagaccctgtattcaaaaagcaatgaaataaggccagtgaagtgtcagtggataaaggtacttgccatgtaggactggtgacctgactttgttcattggactccacataaggagaaagtggagtgctgtctcaacaaagttgttctctgacctctaaacatgtgccatgacacaaatggctgcaaatacatatcacatgtgcatgtacacatgtgtgtgcatataaacacaaataataaactaaaacatttaaaatacagacaaaaatatatacttcagtggatatgacttgaagcaaatactgtacaaaagatctccaaaagaccagttaacacatataagtatgttcaaatgtctcacttggttaaaaaaaaataatgtacagcatgccactacttccttctatcagagtactgaaaaaaattttaaaaaggtctttaagaatgtataacaactggaagcctgttggtacttgcacagaaagatttttttatacaaataaagcttaatgtaggtatgttctatgaaacagtaattccaggagacagaaatgtatacagcactgcttatagcaaacttatatctaaaataattcaatgttcatcaatagtaaaaaagtttaacatgcacctaacatagaatcagtagtgagaatgaatgtattccaggtctgtggaacaatgtgaatgggtttcaagagcatggtagtgagcaaaaaatgcttgaactaaaggactccacactaatgccatttttgtgacattcagaaatatgcaaaattaactgggcatgttatcacacacttgtaatcccagcactgagcagaaggaggcagtgttgaggcagaatgattatgtgtttggagccagctgcaaatacagtgagttcagggcaagattagggtatatggaaaaaccctgtctttactaccccttcatgcaaaactcatctactgtgtaaaaattagctgaataagcctagtcactacccttgctagaaactaagaattggatatatggagggctagtaggactcctccatgaaattttgttctgtgtcttaatctgcacgttttggtgacatgggtgtctttattctgtgagaattcagcacattatattgttctgtatctttgcatattttggttacaagggagtgtttattttgttagaatttaacaagggatatgttcatgatttcatgcttttctttttgtgttaccagtctgctagctgtgatccttatgctctattcagataaacattttagtagatgatgaaatgtgtatctgttgtttgcagttgtgaacctttaagtgttagtgctgtgactgggatagaagacctagaagcttccatccacagtcctgggagtcagagttttattgttccatgttttaaactaagaaacatacagttaagtaccaatggccctggcactctacagatccttggcttccagcaacagtgagttccatcataattcagaatctgctagtattaacctctttaatgggtattaggactatcagcacctacaatggttaatattacagctcttgagcctaaggctgtagaagccttactagcattacagctgataggcctagtctgttgtaactcgagccttggtaatgtctaatgttaatactcaggccttgagtgttagggtacttggcagttccttaaaatgcttccaatggccaagaactttcttgcaccccttcaccaacttcagccttgtcctcttctttctctggaagtctacatctgtccccttggcaatgtagcttctgcttctttcatcactgctgcagctccactgctgcagctattatatgctctttgtgtttacaatgcagcctgttctaatgacaatgtttaaaagtagacaggaacaatatagagaagccttttaacaggctcaatgttgcaacccccaggggaaggaatccctttcccccacttcctctctcctccagatccacttcctctgtttttcttcagaaaaaaagcaggccttccagagatatctaccgaacagagcaaagcaagttacaataagactatacacaaatcctcatagcaaggctagatgaggcaacccagtagaaggaaaaagcaggcaaaagagaaagaaacagtccccagccccattgttaggagttctacaaaaacactaagctaacaaccataacatatatgcatgcaaacctatataggctccatgattgctaggttgactctgtgggctgtgtccttagcctttgaaccctctggctccagcaatcctccctctctaatcttccatggggctggagaagtactgggaggagctcagggcagaatatattgtatgagagaagaataaataaaaaaggaaaaagaaaagaaaaggaaaggaaagaaaagaaaagaaaagaaaaaagaaaagaaaagaaaaggaaaggaaaggaaaggaaaggaaaggaaagaaaagaaaagaaaagaaaagagaagagaagagaagagaagagaagagaagagaagagaagagaagagaagagaagagaagagaaaagaaaagaaaagaaaagaaaagaaaagaaaaagaaaaagctgttaaatgccacctactattgctatttttaaatttataaacctttagatttactgactttttcatgtgtttaaatgttttgcctgcaccttatggatactatatgcattccaggcaagtcaggaggaaggccttagatcatcagcaactaaatttacagatggttgaactaccatgtaggtgctgggaatgaccctgggccatctgaaagagccatcaatactcgtatcactgaggtgcccatacttttaattcaagaaaacattagaaggagtatggcaaatcaatataaagttagcaaaaactcaacatagaactaagattgctaatacatgtaccaatagttaatagtatttaacaatgcttaacagtgattgactccttcactagggccccaaatggttgggtctttcttacctatatgtatgctccatttaaaagtattgcataaaaatgatatgtggtacattatctatgttatcctgtacattaaattttatcaaggcctagcaattttaattagcagatgtgtttttctgagaatcagtagttcaggagcagtataactgggtgattttagtatagcatattcctttcatatgaccctcaagttgtcagggctacagtcatttgaaggcttaaaaaggtttgagaatctgcttcgaagatagttgactcatatacattgaggtaagcctcggtaaaagctgtttgtattaaccaaagctaaagtacacacatactctaccacacatggaggtaacattttatatacaatcttacaatgggattatacaaagtttaagcccattgtgacttgaaaatattttaagttgaaaatgcagttaatacttacatccaccccattacagcaatagagtacaccaagttttgcttggctgactggcgtctgtggctcactgctactgcctaacaaaatcaagcgaggatcagatcatgtatcaccagcctggaatgagatccagattgagaattcacgtacattttcttctgaaaggatgtatctttcatacagttatgaagttgaaaactagtaaatcgatctattgaatgtcaagaaccatgtgtataatgtttcacatatatgtatatatatttatatatttaatatatatattaaatgaaaggatgtcacaattatactatgtagaaacctttgtatatttttgtgattagattatttatcaatttagttcagctttttttggtatccaaatttattgaggtgtaattgatgtaaattgttatcatatttatgtatgaagataaatttggaaacattttgaatgtatatatctacccacaaagttgttttcacagtcaagctagtgaatgaataagctgtcacactcccatgccttctttaaaaaagcttttcctttgtaatctctcctttcattatttattttttgagaaaactcctaatgtagcccaagactggccttgaaatggtgctttttttcccccattggtgttcagattaaaggccttaactgacctcattatctgtgagtaaatgttctccctcttcatatacatacatacatacatacatacatacatacatacatgactttgtaaaatatgtggcatatttctttctaatagaattttattggggattgcattgaatctgtagattgcttttggtaaggtggccagttttactatccatgagcatgggagatctttccatcttctgaggtcttctttgatttctttcttcacagacttgaaggtcttatcatagatcattcactcacttagttatagtcacaccaagatattttgtattatttgtagctattgtgaagacattgtttccccaatttctttcttggccagtttttcttctgtataaagtcaattttgtatctggccactttgttgaaggtgtttatcagctggaggagttctctggtagaattttggggttcacttattatgtatactagcatattatctgcaaatagtgataactgactttttcctttccaatttgtatccccttgatctccttttgctctctagttgctctagttaatgattctctgtttaaagcctatgggtcctggggattgaacttgagttgtcaggctttatgacaactgtcataacccactgacctctctcactggtcctgttaaatcattgtcacatacaaattcacttctctgcctaatttaatactgtaacaggagaatgtctcagcaggaatctttgaaatgtaaatattttcgcttgtatatgctatagaaagtctaatgacctctgccatatgatatataccaactattatgtcataaggaaattagtaaaaagcgagtaccagaagaccagaagtgggtcttgcataatggtgtacttttataattcaacttggaaggttgagtgagccaagaggttctcaaattctagatcagccttggctttatagtaagatcctgcctcaaacaaacatacaaatagcagcaataaaagcaatggaaatacttaccttacactcttattattttaatagtttatgctctttcctccctaattgtctttttggttgtcggccaatattgctcattatttaagatattgtatattttacttatttaaatgaaatggcacagaaataattttatgtttttctctgtaggttgtaactttcatgagatcagagaatatttttgcctgtattgtatactgttgcactctgagagacctagacatgttaacaagtaagcattatatatcttagtagacagatgtttgttgaattgaaaaggtgactgtactgattttggtgtctgttactataccctaagcttaggaaaactggaaaacaaaatagaaagtgctctttgtttgatcctataacttggctagtattgtgccacagattctacaaggtatctcaaaattcagtaatatttgttgtgatttttggcacttctacctaaagcaactatatgcatacatgtatgcatgcatagatatatgatttagtacatactaaatttaaagaatctatagtgttatggtactttgatgtagtttatgtttttttaaaaggtaactattaatacatagtattcacttatgacatatatcagcatttccttcttttatgtgagttaatgcaatctttttttgcactgtagacaatggatctggtgaagtgaacattgcacaggaagtagctaaaggttagtgggatttagaagaattcagcaagctcttagggagtcggttgttttatgaccacaagagcattgcttaatggttttcaccgcagttagaacagatatctaaatgttgtgccaactcataatgctttgtaccattgattttcatctttatccttctctcatttactgtgctaaagttgtattggacttcttgtttttctctatttaagttcctttattaaaccttaaaaatataatgaacacatgaacacacacacacacacaccttcacaaattctattctttcctgcagcagtgaccacttgtgttacttgccattaaatctctaatattcaggaaaattactgaaacatgatattaagtaaatatttggttttggctttgagacaagatctcatatattccaggctggccttcaaattgctatgtaactaaggatgacactgatcctcctgcctgcacagcctactgctggaattataagtaaacatcaccatgctgaggtttgcatgggcctgggaatcaaacacagagccctgtgaatgctaggcaaacagtctaccaagtaaacatctcttgccttaaagtaaataactatttaatgattaaagatttgactgaaagaatgtcagatttgttgtaagaaaatgcatgacaagatcttgatctgtagtaacactggtgttgtattagtcagctttccttctctgtgatcaaatacctcagaaaatcaacttaaagagggaagaatttattttggtttcagaagcttcagtccatggtcacttgactgttgtttctctccttgtgataagccagtgggtgtgctggaagaatgctgcactcttaaggcttccaggaaacagacaacaacaaagggtatagagataggatgtgttcctttgggacatctttatttcatgttcttttgggacccatttcatgccactggtttcattttctaaagtttttgctacctttgagtagcaacgtgaccaagcctttaacacatggtttttgtggttcatttttttttttaatatccagagcatcacaagtgtctccgtgaagattagcaaattacagtatttcagtataaatgcattgagacattaacccaatcctgaaatgatcttaactattagctgtttgaacatgaggaaattgatttcttcaaaatgtattaatagttatttttctttctacattatagagttgttttgggccctgataagtgaaattgccttaaaacagtgcacatgtatgcagcatatgccagctgaacctttattatttgaaagatgtggtatcaggaagaatggaaagccgggggtgggggtgggggggaatgaaacttctagaggcctaatagagtaaatggttccaggtgtggttgtgcaggccttgagttgcaccattagggggacaggaggatctttgagttccagactaaccagggctacgttgtataatcatgtcgcaagacaaagcaagacaaggcaggacaagacacatcctttctcttacagaagaaccctctgacaactgaagatatctatagctttaggaaagatgtcttaagaatggaaggattccagggattatcttatctctagcatgtgctacaagagctctttggccttctaaatcttaaattagaagagccatgggatgtggtaaagaaattaaacattaggactataagcatggtggccagaggttattgtaaaatgaatcagtgtgcaggggagggctgagaagtaagcagtttgcccaactatctatgacatccttgtagtttaaaactaatgacagtgtggatatgtatctctgcaaattaaaatatgtcctgcagtgttttgaacctaatagctaactgtagttgaatctcagaggattattagaagaataactacaaggaataggagactggggaaaagagggcaagtatttgcagaaatgacaaaggatatagttaaagaattaccatccccaagtttaatagttataatagctgaagaaaaatcaaaaatcaaagtttcacttgtaaaataaatattatgctaccctctcttaagctgttattattaattctgaatgcattgaaccatagtgaccacatgaagagaaagccagaagaaccagatggaaccaaagcatttgggtagtaggtgttaaacctaacaccttcatgatcctactcactgattccaagaactgttgcagctttttcattcaaacttttctcaaggcctatgatgctagagatgctttgataatcccagtatggtgaaataaaggtttaaaagggtaaatgagttgcctaagaccagataggagttggcaagccaggcacaaattctaaaacctgaactgtgatttcaccttttgttagaagtctttattaaactgtattttacccaccatttatttattcacttacttattttctcttttataacttagatcttattacttgtcaatcagtacacagacatttcaattcttttagaatgcctaagatacatacaaaaattcaaacagccatgctcctatttaagttttatgtatatttattttattattttattcatgtgttttacagtatgtgtatctggtgcctgtgaaagtcagaagagggggtcaaattccctgggactggagtccccatttaagtattgagagttaaatccacgttctctgcaagaaagattgctcttaactgctgagccaactctccagctcttgtgttattttaaacagttgcaaaactgataatcccatttcagatttgtccacaaattttccttaacaggatctcacatgactatcaaatgctcataatcttttactttcactggttcacaattttatttcacacatcccatatcctcaaattttctttcttccagagcattatcaaaattgaccaccacaaccagaatacagggtagacagttctaatagggaaagaaccaacaaatgttttcactgttgtttgtttgtttgtaaataattctgctaaaaacatcaaacaaacaaacaaaacaggagacaagaagtaattcaaactaatctagatgtaaatacatgactgtgactccgagttgttatttagtatgctttgtactgaggaatataaaactagttcctcttgtggactggtttgcttgctgaccctgagacaatgagtctctctgattcaatatcctgctatcttctggttctaccttagagtaagcaaccagtgaatgtctttactcttaaaacttatttacacttaaaaaaattggatgaggtagtatttccccccttttaaaaaatattgctagagctcctaagaaactcacatttacaaaatagttaataatattcctctggcttgttgaaccaggaagacaggaagtactgagagacatgacacatgatcagttggacttggcttctttctcttcagctttagaggatggactctggttttcagtgtctcccctttctacaggcaaatctttagtttcttggcctgtttgccttttgctaccctttcccattttgtttgacttttttgtctgatgtcgtactcttactgtgcctgtgctgtaagaccatgttaactattctgctacagtgaattatttgcttaatatcatacaatgagtagctaaaatgatcagttttgagcttatcattttcatttaggtatttgcagaatattttcaagtgctaccttggcaggagtgccttagcttaacaaccttacaggggagggggggcacttaggctccttcttgttccttccaagatgaactttcccgtgatcaacatggggtttgtgaggccacctaagtggctgaagaactacatagaacaggattagagttgtatcactgcctctcagtttccttctccctaatactgcattggccagttactccagtctttggcaaaagtgtccctgttattatttaagaggcaatgtttttctgtaatcattactttttgcatctgtctatcaagaaatatatatatatttatatataaatattatataaattatatatataaattataaattatgtataatattatgttattatctatgtatatataaacattgctctctctctactttaaacatagtttaaaaactacaaaaaaatttgcatgttgaaaagtaagcataccgcataattttcaatgtctgcctgtctgtctaaaattagagaaaatatgaaaaactatgtataattgttttaccaaattgaggatattttaactcactagactataaaagagtctcacaatttgcctgatattattatgaactgattatttaattgttagtcaaactgtttagtgtaataaaatgttatttggtatttagtaagttaaaataatagcacatcccagatattgatgtaaggttggtctagataaacacacacacacacacacacacacacacacacacacacattagtttacctaaagtattatgcagaatatgatatttctgtcaagttttcatttctaaattatactaacctaccgaagcaatgaaatttaataatttaaaacacaagtgtaaactgaataaaggctgaagtaagaatgtagtctaattgaaagaccattaactatgtgtagatagatgaattttgcaaaagaacttaacattggacactgggtagatggctcagcatttaaaggtaatttttgttcttgcaaaggattcacttctgaactatctgaaacgctagctttaggtgattcaatgccctcttctggtcttcttgggcaccagacatgcatgtgatacacagacacatacaggcaaatcacccatacacatataaaaagtctaaaatatagtcagtgaaatcttaatgttatggcttgtatatccttggaccagggagtggcaccatctgtaggtgtggccttgttggaataggtgtgacctggttgggatgggtgtgtcactgtgggtgtgggcataaggtcctcaccctatttgcctggaagtcagtcttccactagcagcctttggatgaagacatagaactctcagctcctcctgcgccatgcctgcctggatactgccatgttcccaccttgatgataatgaactgaacctctgaacctgtaatccagccccaattaaatgttgttttttataagacttgccttggtcatggtgtctgttcatagcagtaaaaccctaactaatacagaagttggtactgggagtagttctagagtaacagaagtacaaggatgaatcttttaaaatactggaattggcttgttgatccaccagcactttcaactactgaaacctctccagattctctccctcccgggagctcagagaattttgaagacccatggttgaaactatatttcaaccttaaagaagctaatgcccttgattttcttgatgaattaggtgattcagtgcacaaagctttctacaagatggagaaaaaaaaatcagtaaatgattttactggctggctgctcttagtatctgcagaaaaaatgatgaatgaaaggaaggagttgtgtgataaaatcgaaaggctccagacacaagtaaacgatctaaaagttgctaagtgtgtccttgaagtttcgaatcttctctcttgcagcaatagagctcaagttgcagaaaatcaaactgaaaccctcattgtaagtttggctgaactacagcaaaaattcaagtctcagcctcagagtgtgttgacagttgaagtaagggcactgattggcaaagaatggaatcctataacatgggacatggatgtgtgggaagaccatgttgaagctgagaattttgaatcttcagattctcaagggtttgccccacctgaggatgtagtaccctcagccccaccccttgaaataatgccttccccacagagtctgataaaccagcgatgactttcactgaagaaaatgccagacaagacaatgctgatgtttttcaaggcccaccaatagtttcttctagacctgtaaccagacttaaagcaaaacaggctcctagaggggaggtagaaagtatagtccaccaggaaatgcactacactactaaggagcttagtgagtttgctaattcattcaagcagaaacctggtgaatatgtgtgggaatggattttaaggttgtgggataagggtggaaggaacataaaactagagcaggctgagtttattgacatgggccctctgagtggagagtctaggtttaatacggaagcttgcatagttaaaaaaaggtgtcaaaagtttgtttgaatggttagctgaggtgtttatcaaaagatggcctactggaaatgacttggagatgcctgatattccgtggtttagtgttgatgaagggattttaagacttagggaaattgcaatactgtgtggaataccatgacgatagataaggcattttgtcagtccgtgaatggtggttttagcagaggcattacatgcaggaaaggcaaatccataaccagaataagtatctactccagtaagaacaaaacgctgtcctttccacgaaggaaggggcccaatgtagtcaacctctcaccaggttgctggctggtcacctcgaggaatggtgccatatctggggctcagtgttggtttctgctgttggcagatctggcattcagcagcagctgtagccaggtcagccttggtgagtggaagcctgtgttgctgagcccaagcataacctccatctcgacctccatgaccactttgttcatgtgcccattgagcaatgacagggatggctggggagagaggctgactgtccacagaacgggtcatcttatccacttgattaagttggtactgggagtggggtattgctgtgataggcctgaccatgcttttatttgaaagaatgtggattttgggactttggatttggaatgcagtggaatgctttaaatgtggcttaatgggtcatcctagtaggaatatggaagacttagttgctgggagtaatttgaactgtattgacctggcccaagagatttcaaaggagaagaatttcagaatgtggcataaagactggttttgtggtattttggtgaataatgtggctactttttgcccttgtctgaaaagtttgcctgaggctaaggtgaagagacttggattaattgcattgacaaaagaagtttcaaaaaaagcccagcagagactttgttctctggttaagtcttatgaagagaagtttaaacaagcatagcaagcttagaaaggaaaaatataaaatatatggttcgagtattaaagggtaccaggaagtgaaatggaacaaattcctgtgttctagttcctgtaagcagcagaactcggcagcttcagccatgtggctctggctctagagttaagaatggaaggaactactgggaaaattgatgctggttagctggagctaaggaattagcagtgattaagaagagaccagcatcactgaggtgaaatcttctggaaatttttttctgagagcacaaaagaagctgtgttccagagatacccaaggttgtacctcatgctgcggctggacttggtaatgtgtaagagtcactcaggtggtactgcttgtgaaggaatgaagggatcatggagagaagctgaggcttagcactgttagaggccagggaaggccattggagaaggtgaagcctcagctgtagttgatgggccaggactgaaggggtcatgcaaaggatttgaggcttggcactctgaagagagcctatgagagtctattggtgaagcctagttggagtggaataccgcagtatattggagatgtcagtaccatggagtgatcaccaagaactaaagccgtagtggagtggatccacctgagcttagagtgctacagagggcagagctggaaaagtgatgtcagcccttaggaggtgtccaaaagatcaaatggaatcccagacactgaaacaagaagctgtaacattgaaattgccttggagactcaaaaattttaaagatgccagagccatgggatacatgctgaggaaagctgctaacagggagtgtaaccagcccaggagaaagcagtttgttgcagtcaacaaaaatgaaaaaggagtagagatctgaagaccgctttgacatcagccatggagatgcagagtttggagtttgcccagctcgtttcctgccttgctttggagattacagttaattaagttgaatgaatctcagaagagaccttgaactttggacttttaacattgttgcgactgctatagactatgaggactttgaaagttggactaaatgcattttgcattattgctatgtttaagtatggcccccatagactcatgtttttgagcaagtctatggggaccagggagtggaatatgatggtttgtatatccttggatcagggagtggcaccatctggaggtgtggccttgttggaataggtgtgacctggttaggatgggtgtgtcactgtgggtgtgggcttaagatcccatcttgatgataatggactgaacctctgaacttgtaaaccagccccaattaaatgttgtttttttataagatggtgtctgttcacagcagtaaaaccctaactaatacacttaacaacccttaagattgattaatatggcatatagatttactagcgtttttaggtactattctaaactaagggaaactaaggcaaatgttatatttcctgaatatatttgttaagcaagcataccctaaatctgtttgtataagccattatatctttcattgagaataatcttttaccctgtagggaaccccatacatgtatagtagaaatattaattactttgtgagaattagtctgatacacactataaagtatttgtatctatctaggctaaatttcatacaacgagttcaaagaaacgattacatcttgatcaaataataagggaaggtgtcactacttatattgacgaataattgatttttttttatttttctttatttacatttcaaatgttatcccctttcctgatttcccctctgaaaaccccctgtctcttaccccctctccctgctcaccaacccacctactcctgcttcctggctgtgacattgccctatactggggcatagaaccttcacaggaccaagggcctcttcccattgatggcagactaggccatcctctgctacatatgcagctagagccacgagtcccaccatgtgctttctttggttggtggtttagtcccaggaagctctagggggttactggttagttcatattgttcctcctatggggctgcaaaccccttcagctccttgggtactttctttagctccttcactggggaccctgtgctccattcaatggatggctgtgaacattcacttctgtatttgccaggcactggcagagcctctcaggagacagctatatcaggctcctctcagcaagttcttgttggcacccacaatagtgtctggttttggttgttgtttatgggatggatcatttctgtttctgtatggtcatttcttcagtctctgctccaaactttgtctctgtaactccttccatgggtattttcttctcccttctaagaaagatcgaagtatccacattttggtcttcctttttttgagtttcatgtgttttgaaaattgtatcttgggtagtctgagattttggactaatatccacttacttatcagtgagtgcatatcacgtgaggttttttttttttttttttttttttttttttgtgattgggttacctcactcaggatgatatcctccagatccatccatttgcctaagaatttcacaaattccttgtttttaatagctgcatagtactccattgtgtaaatgtaccacattttctgtatctattcctctgttgagggaaatctgggttctttccagcttctgggtattataaataaggcttctatgaacatagtggagcatgtgtccttgttatatgttggtgcatcttctgggtatatgcccaggagtggtattgctgggtcctctggtagtaatatgttcagttttagacaattcagataaaatagagttaaaactcttcaaagcatatttaaggcgtgactggagtctgttttgacagggttgtattatagggagatagtttcccttctatatctggctatgtaagccacagtgtccccaaactcacagagatccacctgcctttgcttctggagtactgagattatagacatacactaccacttctggttgaagacattacttttcaggaaggcaggatctagttatagagagagcagtgggtctcacttttcccaatgcttcgaccttttaatacattttctcatgttttgatgatgcccagccataaaattatttcattgcttctttataactgtaattttgctactgttaggaatcataatgtatatatctgatgtgcaagatatttgatatgtgacccccccaaggggtcatcacctacagtttgagaaccattgttatagagtttatttagtgcaatgtaatgtaaatatgtggaagactgattagttttattttattttacttcatttgagacagggcctcactctgtaactctgactggcttcaaattcacgatgtagctcaggctgcccttaaagtcacagagatctgacttctttcgctgggataaacgtgtgccatcacacctagccctatttatatttcttaatatttggccaaaaggtactttgctaattgtttgtgagtatattgcattatgtaggaaatactatttagttttttcaaacagaatttttattataaagagctactatatttctagtgcatactgaattatttttggcagttaaaatatttcctaagggaaaaaatcttatggctaatatcttctctaagttatattaggatgaacaaaataatgcattttatatgggtaacaaaaagtgtaaacaattgacataatatcatatataattatatattactattctttatatttacatgacacattttaatgattgcttaaataattaaaaattaaatgaaataaaaataatagttaaataattcacaattatctagtgctttaaacaagatgtaccttttaaaattttttatttatttacatcctaagtgctgcatctcctccatgccccttcctcttctcttctgagaggtttgcccccacttggatgtccccaggcacatcctctccctctgaggccagacaaggcagccctgtttgggtatatagataccgcagtcaggctaaagctttagggagagcttctgctcctgttgttggggaagagggggctgctatttagttttaagatagggatctatctgagaaacaagatttgagtagtcctcatgtttagagaagtataaacctttaagtgctccccaactaccaccacctcctactgccccacaaacacctctcaaatgaaaggagatgagagttgaaggaatttcttaaaccttggcaacagaagagagcttggcttggcttagtaggctctgtaccctgtatatatgaggaaatcattttgtttaaaaccagagtctgattttttgaggtttgcctctagatgtctagatgaggtggctgacaagcaaatattgacttctgcttccttggtttcatcttctccagatgactcttcttaccatgctgacctctggaaaattctggccttgtctcatagttctttctttcctttgtggttcccactaacaacagaaataggcttttttttcctaaagagattgattacataataaagaagaaaaggcaagaaattaaaaaaaaaaaagaaaagaaaaaaaaacaatgaaatcaagaaatcctgccagattttcttttagcatctttgctatcattgttgccagtcaagctatccccaccccttaacttttccttccccatacttgccaatgattgcctcttaaaatccaacttaagccaccccactatcaccctgcttaactctttcaagtcatcatttttataagaatggattacccttcattgtactggctttttcctaaagccttcccagaataatttcacttgaaaggtcaagaggcaactggagcttcaaacttctagtttctgatgacagaatatacagaccacttcaaggagaaattccagtgagtggaacaatagttcttaccctaatttagcttaaataacttaaagtgtcaacctatttattaactagtgtttttcataaaagtttgttacagttttttgtccatatattagttatataatagtcgatcttattatgacaatttgatagataggtataatgcattttggctatatcacccttcattaccctttcttgttcacctcccactttatcagtccccttcttccgaactactaatcattcattcattttttttttcctgtttaatttgcttggtgttttaatgagctcacaagacctaacccttgtctgtataagattattttgaagaacttcaactgatttcaaaagaaaatgaaatgataagaaatgctttaaagaattaaacgttggtatcacttctcagccttttggcaaagatcgagtgaagaactgaccctgaaaaaaattttactcataaagaatgccaaataagttgaacttttgctacattttctcgttatccaattttaaaattttatatcatttattttgtgtgcatttgtgtatgtgttcctgtgcctgtggaagtcagaagaggggtctgatctggaagtagaattaaggatgtttgtgaccaactatgtgagttctgagtatcaaatctaggtcctctgtaagaacaataattgctcttaaccattgagtcatctgtccagaccataatttttaagtaactgaaaagtttgttgacaaggaaacttgtataggtttatgtcagtatttcagatatttattttatcaaacagccttcctcgcttttgaatgacataatttttaataccttataggatgtccagaacatacttaaatgcatgcacatatatatgacataatatatattatataatatataaaataagagtatatgagtatatgtagtttgagaaacccacatgtagcacatttccccattttgtgaagaatttgaaataaataaatggtttatttggtgccacacctagtgatcaagtttcagtctggcatttatttattgatttctcctactgaatttcaagtaaggttcctaatgggcagataggtcatattttttaacacacacacacacacacacacacacacctctgttcagctgctgagctacacattaagagcttgacacttgacaagtgattgtaaataatagcttatggtttgtatgtcgaataaactaaagaattattcatatgcattggcttatgcatatgttgtatgtttatgcttttttcacctataaaacagaatatctattttgctatgtctacttttcttccatttccactgcaatttgtgtgctttctgtaattctcttttgttgttgttgtcaggaatccatggtctttgattcatgatgtttattggaaataactctgggatgctttgcctcaaggataatttgatttggggaacctctgtttgacatcattcaggaaaatgttacactgtaaaggatattgtacttgtcacaatgataatgaagggaagatagtgacaagaaagctaataatatggcagcctgattattaatattgagcctttggtatttttgcctgccatcttttgttgacatgactatcctcctaaaagttaagcatgtgaccaatttgatgaatattattttgcagaagcaaaatctattaccagataaagaagatgagagtaagttgatatagacagcctgagctttccagaatactctttctgtcctctgagtttaggtatctgtggtcgagaacacagttttgtgagggagtaagattaggatgcattgaaataaaatgctcacactgactacatcagctgtaatggggcttatctgatgttgtgactcagcctctgtgaatctcattgtgtatgtgctctgttttgtacagagaatcatcattcaagacctgtcagaagctacaagcgaaaaatgggaaggggtaagtcttccctattaaaattttttagattctcctgatggtaatctagtgtaacagagaaattatgtctagaactgtgtttgtagatgcttaaattgtgtttttacttggtgttagaaaattttgtctgattcaaaattatatagaagaagaccaatataatatgtgttattcactggttctttttttgattttttattaatcattttactcgtttacattttaatgatatccctcttcccagttacccctccacaaccctcccatctcattccccctcctcctgctcccttttgcctctatgagggtcgtcgtgcacccattcacccactcctgcctcacccttctagcatctccctactctggagcatcaagcctccctccctttccattgatgtcagataagaccatcctctgctacgtatctggagtcctggttccctccatgtatactccttggttggtggtttagtccctgggagctctgggtgatccagttactagatattgttagtcttatggggctgcaatcctctttagctccttcagtccttcccctaggtcttccattggcgtctctgggctcagtcctgtagttcttttatttattctgatttttggttttggtggtggtggtgctggcagcacaaatatcaaagatggaagtggtggtagtggtgttggaggtatggtgtgtgtgtgtgtgtgtgtgtttgtgtgtgtgtgtataatagttcaaatttgttatgatgtaaatgtcctcaaattccaacttctttataactcctgccaaaattacccttatgccttgatcatatataagttttgttaatagtaacacaaatggtctgactcagtcattaacaacacttactgctctttcagagcacctggtttggttctctgtatctacatcaagcaccatacaactgactttaactctagttttaggtgttccagcacactgtggcctctgtaggcatgtatgtatacatggtgcacacaaaatcattgaggtacacatgtattgatatacataaaaataaattacaaatttttttaaatgtaaaaagcaaatatagtaatataaatcaaaaggtactattatgcagtcagtgttttaaatattgtttaaagtgggaacaattacatgaaatctttgtgcttattttgggtttttcataagggtattatggatcttggacaatagaaatatttaagttcatttcgttactgatatgggccatctgtcacaatgactttataaataattctagttcgtataaattataaaagcaacgtgctataaaggatactaagggaaaatgttgtgtggagtactatgttaaaatttatatgaattcagagttttgaaggcctgaattcaaattctgtggctactacttcagctaaatctcaaagctttcttaaatggaattttttgtcatctttgaggtagaattaatgcatcctgtacttgtaccttcaggaggatatggttagcataatgtgactaatatatgtgagtgtttagagctataatgtctaatagcatagaacatcagcttattgctagcttttgaatacgtatatctttatttgaccttttattggttcagattctataggaagcaacagagcttggggtggggctctgaagattactaagatctctgccttaagttgcttgccttaccatcatgtatgtttacaggcagcctctacatctcagctcactcataggaattcttttcgcatgttgttgttgctcttatgtgctccagagcttcctttggaagctgatttgttttagagatccagattctttccaaacattctccaaccatttgcaattttttacatgagtaataattttaaatacagtaagacacattttaggatgaattcatacttgctatatcctaaagtcagcttccagagtatctcattgcttgatccccactcaatccacaaagctataggcagatttggagaattccttagctgttggcatctattatcaccatatggaaaagggctgcatgaagtcaagggatctattttttccttgcttcttcttttattttcagactgatcattgatcaccaacaaaggggcctcctttaaaagatgctagagcaaatagtgattcaagctcaggcaaataatagaacacagcacaataatgtaatgtaatctgctaaaatgggcatatttccaacctggagattgaaaaagggaagtgcgtcacataatgctgtttttacaaacacaggaagcttgtgatagctgttattttgaatgttggtggtgaccaccaaaagtcaaagagacatcacccattattcatcaagctttgtttaggtttgcttggttattggttaattgctgctacttttagtggaaaaaacaaaatgttactgtgtatacgcatgactttcttttttggtactgtataaagaattgtgctgcatttagtaaacattcttacaaataagtcaatatgttatacaacaagatatgattggaaagatgtcaccacacttgtataaaataattaaaattaaagttaaaatactattctttaagaagaacaatcggtacttcataaatatatgaaacttttttattcatgggacattaaatatcataaagtttagatcattgaaatagaaggaacaagactatgtagtttaattgctatagtcctaacctagaatgtacaaagccctggatttagttcctagcactgcaggtacagttggtattcctagctcttgggagatgaaggctataagaccaggaattcagatcagccttgaatatatagcaagtctgaagccaccctgtaattcatgagaccccaccacaatgaaataagagggcaggtaaagaaaagacatgtatatatgtgaggagcaggtgtggcagcagtcccaagatggcacccaggactgcagccaagtcttatgacttgcacctgacttcctcatacacctcgcgtccatcgtgagaactgtgcagttgcaccatgatgcaagatcagaccatatgacaagtgatgattctggccaatggactgctgttacgtggactgggctgatggggcgtggtagagaggttatataagggattgtgattgggggtggaaaaaagagaagagagatttttttcctgcatccatgttgaaaggttcctgaaaaaactgctttgagaaggacgctgtgtcgtagctcttttctgctggttggagacagaagcgacaaatggtggctcgtacggggatgttcagaactcattgcagtcagggcagctagctggtaagttcccaggtaagtgggacaagttaagttctcggattgagacgataaggctcccagttttgggacaagttgcaccaagcaccatggtaaattcaacctcaggtcaaacagtgagctaagcccttaaggacttgctgaaagtg

SEQ ID NO: 854 - DNA, 2794 bp, mus musculus; identical to SEQ ID NO: 18

SEQ ID NO: 855 - DNA, 21476 bp, mus musculus; identical to SEQ ID NO: 20

SEQ ID NO: 856 - DNA, 21476 bp, mus musculus; identical to SEQ ID NO: 20

SEQ ID NO: 857 - DNA, 21401 bp, mus musculus; identical to SEQ ID NO: 22

SEQ ID NO: 858 - DNA, 3024 bp, mus musculus
agagctgagcggaactggggctattagggagcctgcaggtcttcctggaaagtcgcaagcctgtgttaggaagtcgccctgcgatcgcgccgcctggggtgagtgccagccagcttgtccgagcccctccacgtgcccagaccctccacgacagcggtttgcctgcgagtcctgccctaccctgcgcttgcgcgggacccgggccctaaatcggttgtccagacgacggaagactcgccctctcgttgggcagctacagtggagggttctggttgtgattggtggtctctgggctttgttttcctttctcttggttagcgccgcccgtgagacccctgcttttgctacttctagcttgttgcagggtggcacactaattgcctggactcttgcttttgaaacgtggtgcttggggccgcagctctgattcctcatctctgcagccccctgcgggtgggagtagcgtccagttaaatctcagccactggaccctgcagtgcaccccgactacattcctgtgtctttccaacaaactgagccccaaagtgctaggacctggcttgttgacagtgactcgcccaccagactgtgatcatactctgtgactagcaaccagaagtacaactcgatgatgctggcagtacaatctgatgattcctctttagagcctcaggagcctctgcctaggtgtaccagcggccttgaaacccgctgtgtcagaaaaaaacgatagggggtatcacaatgaagcaaagttagagagtttctgctgcacttgacaaaggaaaggaatgcacctaggcacccagcagaagctctttatctgacttggaggtcttggaagctacttaatgtctaagtttgtttgaatgtagtatcttgctatttagttctggctaccctgaactttctgcctcccaagtgctgggattaaagacctgcgccaccatgcccagcttccccgaactttctaggtagaccaggctagctatggcaatgcttcagcttcgccccgcagaatgttgggatttcaggtatgtgctaccatgcagtgttatataactgagtggaaatattaaggaaagtgtgagccgggaggtggtggcgcacgcctttaatcccagcacttgggaggcagaggcaggtggatttctgagttcgaggccagcctggtctacaaagtgagctccaggacagtcagagctataaagagaaaccctgtcttgaaaaaaccaaaaacaaaagaaaagaaaaaaaaaaaggaaagtgtgtggttggggactttttttttttttaatgcactgtgcttaagcagtagatttcagtacttacttgccggtgaagatggtagagaaaacttgttgatcaaagaaatctttatgcatgtttggcaaggactttggatttgagtccattacccagttttgacaggtttgtgctgtttgtttcgcagaagggtttatagttcttttacaggtgaccttgtcaaatacgtcaacatctctgccattcctaccgagagagtgaggaggacctttttccttctcatggctactcgattttctacctagctctcctgtcacaagccaggcccgcttcttgttgctatacttgccaggggcctcagccaagcctttattctttataaggtttcagatctgagctatggtccctttttaagatttattttattttatatgtgtatttgagtattatgactattatgagtattattttatatgagtattatgactgcatgtatgtatgtgcccacagaagccagaaggtgttggatcccctggaactggagttagaaatggttgtgagccaccatgtgggtgcttggaattgaactcaggtcctttgcaagagaaagtgctctaaatcacggatacatccccagttatattctttttttaaaaaatggtatttatttaatgtatatgagtacactgtagctatcatcagacaccccagaagagggcataagatctcattacagatggttgtgagccaccatgtggttgctgggagttgaactcagtacctctggaagagcagtcagtgctcttaacctctgagccatgttttcagccccccacttcccccccccccagttatattcttgaaatgcctcaaaattagatccctttctccccccccccccccacctttcctttccccacttctccttctgagacagggtattactttgtagccctggctaacctggaactcactgtgtaggccagactgtcgtcaaacttacagagatccacctgccttcaaagtctgggcctcattgcataagtgcgtgtgacaccagcttcagctaaacttggtcattttaaaatccaggcttataagttattcggtcaaataatagatacagttcacttacatttcttgttgaaaagtatttggatttggtttatctcaccacgtgctttctgtttgcccaggtttttctgtccctttgtcctcgtttatgtacgaagctgccagcgggccatagaaacatgaccaccaatacggtccccttgcacccgtactggcccaggcacctgaagctggacaacttcgtgcctaatgacctcccgacttcgcatatcctggttggcctcttctccatctctgggggcctaattgtgatcacgtggctgttgtctagccgagcttccgtcgtcccacttggagctgggcggcgactggccttgtgctggtttgctgtgtgtaccttcattcaccttgtgatcgagggctggttctctctctacaatggcatccttttagaagaccaagccttcttatcccaactctgtgagtcctgagttcttgtattgtgggagggaattttctgggtagagattcactttgatagttacccactcaccaatgctttctcttttttttctaattttgttaacttttttttttttttaaaccctgagcagttgttttctgtgctgggattcttcatttttatcttttaaatttattaatttttaaatgatttattttatg

SEQ ID NO: 859 - DNA, 3024 bp, mus musculus; identical to SEQ ID NO: 858

SEQ ID NO: 860 - DNA, 12645 bp, mus musculus
cgccctgggagccactgctggtcccggccttgcggcctgcgggggaggctgccaggaggaggtggcgacagtggcagcggtgcgcgtccccggcccccaggaccacggcttcctttctgccaggtaggtctccagtagtgtgcgcgcggttcccacgttcccatccttaagctggcctgcggggcgcggatctataccccttgtcctgggacctagtccgcatcacctataggactccctccctgctatgttccctgccggcacttccactttcctgcagtccctcgaccagggcaaggctttgttgccggctttttgctgagtagggtgagatgaagctcgcggaagatacatccatacaaggagagatgcacacggcccctaagtgtcacagactccccctttctgcactccacattgagtgactaccttggaaacgaaggagcccacttcttccgccccatttgatatataggtctagaatgcatatcatttttatcatcattgaacaagactgttaacaacattctagatacacaaggtccttcattccctgcgggtcacagggcatccagaacacccgctgatatcacagttggtggctcagcccgatgtacctgatattcatatcctcccccaaagccttccaatagcaccctggggggttggcagccccaagctgaagtcctgagtgctcaaatcccaaccttgattgtggacagcaccacggacatctcactccctctgtgtcctccctttggcagctccatctgtccatccatctgtgtgggtccacaatggccaccttcagccgccaggaatttttccagcagctactgcagggctgtctcctgcctactgtccaacagggccttgaccagatctggctgcttcttaccatctgcttcgcctgccgcctcctttggaggctgggtaagtgcctaccaaactgtgttccaccacaacagattttatcttatctgtgacattcatggatatcaaactacaccttaccccaccacatcttaccatgcaacgtcctgcaatgccaaagcaggtccctacaggtccagccccatcatatcccattaagctaagccccaattccaccacaacacatcctttacatacagccacctcaagccacaccatggcaagccacatcctgttaaaccaagacatgaccttcagcattcctgcactctgagacggtgggatccggaactgtctgtgttccaaggtgttccaatcagatcctggaatgctgctgttacaagtatcctatcccaaagcgtcctagttactaggtatgaagagtctgccaagttgacattttcacatgctggacttccaaaaatgtgacattatgaatgtctataatcaggacattgtgaaatttctggattctttgattctataatgttcctgcagttatagcaaagtcaatatccaaatgggaaagttctgaaatccccaggattcctctaggatacaggcatttgtgaaaatcaaacgttctctaatcaactctttcctcttcatcttaagtgggtgctttctttcccccccccccagctttattattttgggacatgtcaaagctactgaaaagctgaaacaatattaatatacatttacatataaaagccagtcaccctggtttcacagctagccacaatagactgctctgtcttcctgcctgtctatcccgtcctcctctttctgaatcatttcaataacctgatggcatcaggacccctcacctcaagtccttccgcatatggtccttgagaacaatcccaccccatacagaaccctagccgcatccatcatccccacccctgtgacattttaatatggatgcagtcctgtccaacatcaattgataaattttcctttcagggtccctgaaatgtccttggtagatgttgctttttaaacccaggccttgccacacgtgccagctctccagtaccagctttgggtccccttagaccccagcatgttctaggcttttgcccaagtccttcttctcttgccagcctaccaacctcccgcttcttgttttcccaccctgcctctgtctctccctctccctctccccctaagggttaccgtcttacctgaagcatgcaagcaccgtggcaggtggcttcttcagcctctaccacttcttccagctgcacatggtttgggtcgtgctgctgagcctcctgtgctacctcgtgctgttcctctgccgacactcctcccaccgaggcgtcttcctctccgtcaccatcctcatctacctgctcatggggtatgggtgtgcatcctcaccctccccttgttggcagaaggcaggcgggggggggtccccaaggccttgatgaagtggtccaagataggatggcatgagattctaagaaagtgaaggagtcagggaccagagaggatgacgagtgttccagaaggagacctgaaacacgtgtccttccgtgaggctgtacaggataggttgaacatgggctttccctggaggagggggtcctggggattttttttttcttaatgtgttatatgggttaggaaggcagaaccccttcaatacctccgtgcccccggtagtgtccaaagccctaggaggcataggcccaagaccatcaccttttttcctcagtgagatgcacatggtggacaccgtgacatggcacaagatgcgaggtgggtagctctctgccctcccacctgccctcctcacctcctgagagccctcctggaccttccccttcataaaccaaccaccatacagtgcaggcttccctttcccctgacatctttgtctctgtctctttctacctatcactgtgtctcccttctcctctcatctcacacttggtgcgccctatctttcatggtgacatgctttcttatccatacacttgaccatgggccccacacataggggcccagatgatcgtggccatgaaggcggtgtctctgggcttcgacctggaccggggcgaggtgggtgcagtgccctcacctgtggagttcatgggctacctctactttgtgggcaccatcgtctttgggccctggatatccttccacagctacctacaggctgtccaaggccgcccactggtgagcttctgggtggccaggtgggcagggactgtgggagccgccatggggcagtgctcatggatccttgatcccacagagccgccgatggctgaagaaggtggcccggagcctggcgctggccctgctgtgccttgtactgtccacttgtgtgggcccctacctcttcccctacttcatccccctcgacggtgaccgactccttcgcaagtgagcacagccttcaaggccccccgtgtagcagtgagggggttgggtagaaggctgggtcttcccaattctgagcctgtctcttaatgcttctgtctgtcttctgttactacagcaagaaacgcaaagccaggtaaatgagggcaggtgctgagggcaagtgggctgaccagggctgggccttgggccaattgcttccagacatctgaatctggctgaccatctaccccattaccgcacagagaccaagtgtgtctgtctgtggatgtctgtttgaccaagatttggctctgtgactccatgtgtgactgacactccaacactattgtgtctggatgtccttctgttgtaccactagaaacaagttctatgactgaaatgggaagcggcaagtgtgtattagttggtgactctaaactgtctgtgactccagataatttgacttgtttgcctgtggccactgactcccctgagtgtggaactgagaatactgactggctgggctgtgcatcatcagtggtgggcttgtgtggctgtcactggctagggtaaaccttggtgggtgattctggcttatctgtaactctggtttgcctgtacagcatgcagtgtgcccgcttatgattgactctgccagtttgtctgccttctcagaccgcttgctgctacccgaggaaaggattgtgacaagctgtgagcctgtgtctgtgtttgtccaggactgtatctagctgtttgttagcggtttgattgtgtgactttcttcctgtacttactggctcctggttctgtctgatactgagcaagactccaaaaagtaaccgggcagtagtggcacacatctttaatcccagtgttcgggaggcaaaagcagacggatctcttagttcaaggccagactgcctgatctataaaaggagttctgggacagctagggctacacaaagaaaccctatctcaaaaaaagaaaaaagggggaaaagaaaacaacaaaagagagaggtgagaggggagagacagactccaaaaattggaatcacttgaccagtgtccctgagttaaacagccgggcacaaaactcaggcctaatcctatgtacaagatgctctctgcttttgacactgtctgggaaattgacagtgtgtgtgtgcactgtgagtgtttaactgtctctgtatctcacaacgattttattttattgtcttagaaggtgacaaaatctggttagagagctgagaggctgagaaccttttgtctggctgtgaggccattttagcgtgtagggccatgtcatatgccagctcgcccattcatttgggccacatgaaacctatcacctgacagtgtgtgtgtgtgaccatcatagtctgcctcttttgctaccatgtttctgtcttatctatgaagaactcaggccaacttccaggccctctctgactctcttttctctcttctctgctgcattcctgaccccttggggccctaggggcaccatggtaaggtgagtctgtaaggccggggtgccatgaaacatggggggtatcgtgtcggggcccaaatgtaatgcctctcttcctggcccttcacaggtggctacgagcctacgagagtgctgtctccttccacttcagcaactattttgtgggctttctgtctgaggccacagccacattggccggggctggcttcacggaggagaaggaccacctggaatggtggggagggctttggggccccttctcccacagggtgctgcctggaggaactgtagggcggtgggtggtgctcctgggaagggaccagtcaagacaaaaagaaaaactatagcagccggatagcttgagattccaaccgtaatggaatgtctgttttttgcccacagggacctgacagtctctagaccgttgaatgtggagctgccccggtccatggtggaagttgtcacaagctggaacctgcccatgtcttattggttaaataattgtgagtcacccagtcaccactccagaatagttggtgacccagggcctttcatgcatttgtacagcaaacatttactgagcaactactgtgtgatgggcactcaagctgcaccaggggctgttagtgttatttcagtttatagagtgtttgcctagcattcatgaagcccaagatttggcccccagcaccacgtacaaactgggtgtgtacctgcctgtagtcccagctctatagaggtagaggctagacagtcagaaatccaaggtcaggctggagagatggctcagtggttaagagcgctaactgctcttccagaggtgctgagttcaaatcccagcaaccacacagtggctcacaaacatctgtaatgggatgtaatcagatgccctcttctggtgtgtctgaagacagcgactgtgtactcatgtaaataaataaatctaaaaaaaaaatgttaaaaaaaaagaaatccaaggtcatcctcagctgtatagagctgttttaagtcagccttggatccgtaaggtcctgtctcaaaaataagatatgttagggacaacaacaaaaccacacaacatttgctaacctgctagaactgtcaatttggagagtggataatcaataagaaagattatgcagtaagtcaggtagtggtcaatgccacagtaaatcgtaatgatgttgaaacgagaaagagggaataaggagtggtctgggaattatccataatttatccagggaacgtttcactgaggaaagtgaaggaacaaggagtgtgggggaaggaatggaacagatggcgagaacagcaggtgcagaggtcctgaggtgggagttcacctggtgtatatgagagacggcaagacaatcattgggggcatggggacatggctccatggtgggccattgtaaggctcagagttgcatccccagaactggaagacttaaggtctttgggcagacccagggaggggtagtagtaggacatgagttcagagagatcctcaagaggctctgggacctaagaagtctttggctttttctttgagagacagtcactctgggtgaggctgggatccaaggggagtcatttggttttggtttttgttgttgttgttgttgttttttgtttttccagacagggtttctctgtgtagctctggctgtcctggaactcactctgtagaccaggctggcctcaaacacagaaatccgcctgcctctgcctcccaagtgctgggattaaaggcatgtgccaccatcacccggcagaggggagtcatttggatattggatcgtaactgaacccctttggctcgacggagggaagtggagggaagatggatggggtgaaggcagtgaggcccacccactgtagctgactgaggattagcagtagtggtggcaacagcccatggtgagaagtgggcttctgaaggaagagctgattcgatttgccaagagtgtgactgtgtgggaagggagaactttgtcctgaggacctggaagcctgcagggttggctctgactgaccttgggaagtccgactaaagcagactgggagttcattttcaggcttgtgacagttgagggcatcctaaagatgttatcctgagggtcccctacagattatggttatcatcctacctgtgattctctggaaaagttggtgggagttccagaaatcttgacctgtgtctctcccacctgtagatgttttcaaaaatgcccttcgcctggggaccttctctgctgtgctggtcacctatgcagccagtgccctcctgcatgtaagcaagacagaccatgaacaaggggaagtgggtggggggattcagagcctcctcttcactctccttgtccccttgtccgggtctctagggcttcagtttccacctggctgctgtgctgctgtccctggcattcatcacttatgtggaacatggtaagtgcacacagagcctggcacagtacaggtggaaggttcatgggaggctggggctaacctttccatactgtccagtcctcagaaagcgcctggctcagatcctcagtgcctgcatcttgtcaaagcgttgtctgccagactgttcacatcggcatcgcttggtgagggttcatcacgggtaaccttgtacctaacactgcccttcaaaaatgtcacttctgtctccatcttgtatctgtctccgggtacccagcctcctcttctggtgcctgagccatccctaaagcctcccctctattcactggcatctgtttctctaacaggcatttattgagcacctgctgtatactcacctggcattcgtttcccccactgaacatttattgagcacctgctggttctaggtgctggagacaaagtggtgaactaaagcaggccaaagtcctggccctgtgggacaaagattttaattgggtagacaggaaagtcagtcaaggctaagaatagcttgtgaggttgcgagtggcactaagcataaggggacgcggatgggacatatggtggtggtggtttcccttttcactggaaggccaggaaagcctccctgggtgaggcaacttttaagttcttctaagtgaagaagggaagggagggaaacttctcaggaaaagggggtacccagtgtaaaaagccccaccccaacgtgggcctctgagcaacagtgtggcttgagcagagagtgagggggaagggaaagatgggccctctaggtcagggcggggtttgttttggttttgttgttgttttcattctgtttgccataaaaaaaaatgcagacaacctcacatttgtctcccacccggcaaagatgctcatcaccataaccccacattcttgctcctctgcctgaacgctcgcatctcccccaacctggacgccctcgtggttaccaacaccctcgtccttggatacctctgagctcccataagagactccttgaaccatctctttcctatcttggggtaccctgggcatcctgggacccacagtgccttgtgttccccctgggcttccctacacaggtggtggtgggggacagtgaccaagtccagctgccaaatatatccatctgtccaccacagggcctgggggtacgagccttaaacttgctctttggggccctggctatcttccacctgtcctacctgggctccctgtttgatgtcgatgtggacgacaccacagaggagcaggtgaggtggggccctgggctgggaggtaaaccagggatggcagttactgtttgggggaaccttgaaggccaaggcagtgagaacaagccaggaccatgtgtcttagcttgtacaaatgccttccttcatcttcgcactgtctctcaaattcagtcatgctgctggctctttcctttgactaaactgcaatatttacttacttaccctctaaaatgcattctcctgcaatagaatacaaaatccaggcttttctctttttttaactactaggaactgtgaatccaggccctccttcatgttagatacacttgctatacctcctagccccaggttttacttttgtttgtagctttgcttgagacagggtctcagatattctaggctggcctcaaactcagtatttccccaaggtgatcctcctgtctgtacttcctaatgggttgggattacaggcatgcaccaccacacccagttttgtggtctgctagagaccaaaccaagagatgcaaggcatgtaagcactctactgtgttacacaccccagccttgtgtatgggtgtggatgtgggtgggtgggtgggtgtgcacacgtgagagggataggaaagagaggagaggagaggagaggacaggacaggacaggacaggacaggagagactgacttgtgtagctcagactggtctcaaggttattatggagccaaagatgaccttgaatttctaatcatcctgccgccacctcccttgaggtacattatagacctgtgcctctaggtccagtatgctgtgctgggggcagagtccagggcttcctgtgtacagagtagtcaatgtaccagttgagctacgtcgatagccctggatcctgctttaaaatgttatgttccttgtagtggtagtgcacacatccaggtgccagctacatgggatgctgaggcagggatggcctgtgagtccaggagtgttgccacctgtgcaacataactgagaccctactttgaaaaaaaattctcaatttgaaaattagttcatatggcttttgaaaaatctaaaatttgccctttttgggggggtgtcttactttttctctttcttttttttttttcttttgagataggatgtcataggagtctcaaactcagtatcttctgtcttagcctctctagtagttcaattttttaattttgttgttattttcgagacagggtttctcagtgtagccctggctaccctggaactcactatatagaccaggctagcctcaaagtacttttatttttatttgtttatttatttatttatttatttatttatttattatatgtaagtacactgtagttgtcttcagacacaccagaagagggcatcagatctcatgatcggatggttgtgagccagcatatggttgctggaatttgaactcaggacctttagaagagcagtcagtgctcttaactgctgagccatctatctctccagcccctaaaatttttttaaaaagatttatatatatgggtatcccgtctgcatgtatatacaccagaggaaaacatcatatcgcatggaactacagctacagatggctgctagccaccacgtaggtgatgctggaaattgaactcgcccattatactggacttctggaagagcagccaacgtacttaactgctgagccatctctccccaattttaaaattcttttttttaagatttattgattgattgattatatgtgtgtatactgtagctgtcttcagacactccagaagagggcattggatttttgttatagatggttgtgaaccaccatgtagttgctgggatttgaactcaggacctttggaagagcagttgatgctcttaaccgctgagccatctcaccatccccaatttttaaattcttaattgaaaataaaatttcatgttactttcctaattacaaatatttttttagaagttttccttgggctggagagatagctcagtggttaagagcacagactgctcttccaaaggtcctgagttcaaatcccagcaaccacatggtggctcacaaccatctgtaatgagatctgatgccctcttctggtgtgtctgaagtcagctacagtgtacttacatataataaataaataaatcttaaaaaaaaagtttttccttcagattgagtgtagagaatctgaatttgcagctaggcactcaggaggcagaggcaggccctgtctctgagctcaaggccagcctggttcatggagttctataggctggcctgagttccaggacagccagggttacacagagaaaccctgtctcctaaaaaaagtaagtaggtaaagctctgggtgtttttttttgttttgttttgttttgttttgttgttattatcatttcagtccaggctgacttgaaacttgtttgtcaaatctcagtctccctagtgtgaagattacttgtgtctctgggcagtggtggcacacgcctttaatcccaggacacaggaggcagaggcaggcggatctctgagttcaaggccagcctggtctacagatgaagttactggacagccaaggccacaccgagaaacgctgtcttgagaaaaagaaagattacgagagtcagccgtcaagcccactttggtttctttttagagaaaacgttgctctttgtttcagcctcccaaatcgacattataggcgcacaccaccatgtcaggctttaccacttcttaaaacattttagttctggctgtggtagtacatgattttactcccagcactcaggaggcagaggcaggtggatttctgtgagtttgaggccagcctggtctacatagtaagcttcaggccaaccagggctacacacacacacacacacacacacacacacacacacacacacacacaaaccctgccttgaaaaaaaagactttaaggctgggagtatagctcagtggtagagcctttgtctgcctgccatgcttggaatgtgatctttagcacccctaaaacaaaccaaaaaagtaagtattgtagagactcactgcaaaatgtgcacacattcaattttattctattaacccacttcctcaaagcatatcaaaaacatacactctatattttaatttctttccccttgagacagggtttctctgtgtagccctggctgtcctagaactcactctgtagaccaagctggcctcgaactcagaaatcggcctgcctcccaagtgctaagtgctgggactaaaggtgtgcatcaccacgtctggcttcccccaattttttaagtacacagtcttccttttttttttttttcattgcaagaatttgtcagggtttactttgtcctgtattggtagacactcagatttctagtggtctcatatacaaacgacctcagggatcagcatgacccaccacatccaacatatttttaaaataactctttttggtgtgctggaaatcaaaacctggggcctccccatgtagaccctcccatcaagctgtatactcagccccttaaaatgatctttaaagaagaagaaaccaaactgtatctggtcacccttgataagcacctagacccttcttttactcaggaatatgaaataccaaagatccctgggcaagagatgggttttccggagactcactgtccttgttgaatttcaaaatcatgacttgtttctctcccacagggctacggcatggcatacactgtccacaagtggtcagagctcagctgggccagtcactgggtcacttttggatgctggatcttctaccgtctcataggctgaggcatatgaccatcataatccccttcaatacccctccttagggtgccaactctgatgggggatgagaaaagaccctttctctactccttttcccttatccattcttgacccccaacacccctccacacaacataggaacacacacaactttctatgcctgtcaatcctcaccccgccaccaggcaggaagggggtggtccttattgggccaaggaacgatggatacttgggaaagcagacaggagcagatccagggcctctgcgcctgccgtctcccttttttatatgcagtttgttattgtcgaataaaagtagaacttaca

SEQ ID NO: 861 - DNA, 12645 bp, mus musculus; identical to SEQ ID NO: 860

SEQ ID NO: 862 - DNA, 1587 bp, mus musculus
tgccctcggcacggcgcgcagtcaagggggttcggccggggaagccgtgcccgcccggaccccccgtgggagcctgcggacggaccgagggccgggcggaggagcccggagcggccgcgggggctcggtgagtggtggcggggaggcccggcacctgcccgaggctaggacttcggaggtgccctggggtcgtcctagtgaccccgcgaccacgacgttgggcgtgggcgagactgcgggtgtcggcggggctcgtcccggcctctggctctcagccggcccgggtaagtacctggctgcgggaggtttgcgcagggcctgtcgtggcggctgcgcccgccaggacgccccgaacgccccgaggccgaggggagagggagtggctgcgggttgggggtggaggggcttgatcgctatcagccctcgcgggagaggcgaggatgcctttcctcctgggctcctggacatcctgcagaacgcacctctatggacaggtttgaagtccgggttaaggcgttcgagggattaggactcgcagaactaaggctgattcttttaaaggtgttgggacctgtgcgcaaggttagtagtggtagaaatgattgtcgtggaagtggtttgcaaataattgttggcaggtgttgaggaaagctaagatactgtcgtcttttaaagatgacactgaacagccgccctctgaggtccaacaacagattagagttggtcctagttggaggtttatagtttactaccgcgtatctgcttataaagtggattaagtaggataggaggagggaagatgtaggcaaggtgaaggagaaagtaagctgcacagtaaagaaccaaaagttcagattcaagacacgttgaagtataaaaaactgcctgttctgaagcataacatttagaatttggttgttgctggggaaattgcctgttagtggtgcaaggcagggctctttggttgtgggcttcagtaacctttgtcaatttttatcatttataatgtatttaggagtttgtaaacggaaaggaaggagcagtgtaaaagaacaacttgatgaacccggcttgctctgtactttgttagtgggtgggggtcgggggcttactttttgctttatgagtgatttataggactataaaagaacacacttagaaaggacgcatggttgagaagtttttggatttttttaaatggagatttaactataatattcaattacaaagtacactatcttctatggtaacttttctcaatgaacactggaagtcagcaagcacgtcttcaattctacatatacgtaatttgtaatcagtgggttatgtaatttttacaaacgtacagtccccctcccctttctcctagaacttgtttaatcaagacaaagttggctttagggaaggtagataataaatatatgattcctgacgttacatctgacaaggcataatgaatgtccagtcgccctgacttttcttctgttatgtgacatattctttaattgcaggcaaccctgtgcagtttgtgttggagcaaagtgagctgagtatctgcagtcactggacttggtaggcagtatgcat

SEQ ID NO: 863 - DNA, 6515 bp, mus musculus
gagagtgcgggtgccgagagccggacagagccattcccgatcctcttgagtcgcgaagaaggaaacagcgaagggattggggttcggccctgaggcaaggtgaggttcgcccccagacggggcatctgcccccctggcgcggcgtccttccgccattcttttctcccagtcccttcaccctggattcggaagccccctgctctgcctgctcccggattcagaccctgctcccgacccttttctaatttgaaactccgtccgtccccctgaatcttttctccagttccctccccgaatcctatttcccgaccttgatcccgttagatggttcctctgaattcagaaccttaattcaacttttcggacgcccgtgtctccccgctcgccgccctccctccccgcccccgtaaactaccgcatccacagctcctctctgactccaaaacggcagcgctgaagcttttccctggccgcgtctgagattggagatggtctagcgggacgaccggttacttttcccgctccgcttaggcctggttctccccccggactcggcacctcacccgcccccagaatcaaagcacacacgcacacagaattcggtcctatgtcttttccttctgtagtgtaatgcccagctcctctctcccacacccccccccttaggctctgctcttgccagggagacgagagctatggctcagaaaccggacggcggtgcaggcctccgcggcttccaggtgaggaccccgctcccaattcccccatttttcccctgctgacagtttacgcccacccccggccccttaggtcgcgcgaatggcaggatctgattttgcccttcttccggcctagacaccgcgggctctcagatttctagcgtttatcgaatgggggggaggggcggcccttttcagccatcggtccctgcttagagaaaggggagaccctgttagtcagggcattctgcccagagaatgcgggttgggtaaggaaccattttttttccataaccctgacgcgtgtagagcagtctgtcgccccatcccccaacctctcgcctccaccctccctttctccacgccgcgagactccccctccaccctctcggcttatcctccttgattcctccctcctcgggtcttgagctccccacctcaagcctaaccagtccgtctctaaacccatttggggctcagagcttgcaccacattccgcaccagcccctgctgccacagactgtccctcaccttgccctgccccctctacccttaattaaattttgttcgcgccccgcctccctttgacccgcctctgcccccacgtctgagtactgtgacgcctgtctacagctcccctgctgcgttgcgccgcgccccccccctcctctggtctgccatgtaaggctcagagattgaaatgttgcccctcctgtgtttgcaggctgaggcctctgttgaagacagcgccttgcttgtgcagaccttgatggaagccatccagatctccgaggctccgcccaccagccaggccacagcagctgccagtgggccaaatgctagtccccagagttcacagcccccaactgccaatgagaaggctgatactgaggtttcagcagctgctgccaggcctaagacaggctttaaggcccagaatgccaccacaaaggggccaaatgattactctcaggcacgtaatgccaaggagatgcccaagaatcagtctaaggcggcctttaagtcacagaatggcacccctaaaggtccacatgctgcctctgacttttcccaggcagcacccacaggcaaatcagctaaaaagtctgaaatggcctttaagggtcagaatagcactaaggctggccccggtaccacctacaatttccctcagtctcccagtgccaatgagatgaccaacaaccagcctaagacagctaaggcttggaatgacactactaaggtccctggagctgatgcccagacccagaatgtaaatcaggccaaaatggctgacgtagggaccagcgcaggtatctctgaagctgatggtgcagcagcccagacatcagcagatggctcccagactcagaacgtggagtcccggactataattcggggcaagaggacccgcaaggtgagatcccagctagcttccctttgctttgggctctctcctttcttccaatttccttggctccaaacacaataaagggcatggatttatctgtattttggcacagttgtagggggtgctaaggtaactattattcctgagcccaggttgtccacaggctgatgatgagttgatacaaggacacaggcaatatgtgtgtaggccatcttacattttgacattaaacaccatgtcttaagctaggcaggctcacacagaatcaattagatcttgaagatgtacctcactctctagagagaacagagtcaggaagaaacgagttcagggtgaaaccaagcactgtccgtagtcacacaggaaaaggagaaatctaggtcccactttctgtttgtttgtttgttttttcctttgtctggtttggagatgaaacgcctgtctgaaagacaaagagaatcaaagtgaccagtggctagtgaggtgtaggtgaagattcctaggtacttcctaagatagcaactgggaggacccaggattaatagtgaccctgaaattttcttctctctaattatacaggttaataacttgaatgtggaagagaacaacagtggggatcaaaggcgtgcctcactggcctcagggaactggaggtctgctccggttccagtgaccactcagcagaacccacctggagcaccccctaatgtggtgtggcagacaccactggcttggcagaacccatcaggctggcaaaaccagacagccaggcagaccccaccagcagcacgtcagagtcccccagctaggcagacaccatcagcttggcagaacccagttgcatggcagaatccagtgatctggcctaacccagtgatctggcagaatccagtgatctggccaaaccccattgtctggcctggcccaattgtctggccaaacccaatggcctggcagagtacacctggatggcagagcccacccagctggcaggctccacctagttggcagagccctcaagattggcagggccctccagattggcaggtaccacctgactggtcaatgcctcctgactggtcctttccctccgactggccttttccacctgactggatccccgccgactggccaattccacctgactggcagaacttacgaccctcacctaatctgagatcctcctccaactctcgtgcctcacagaaccagggtcctccacagccccgagatgtggcccttcttcaggaaagagtaagtgctgtgcctctccacttagtttactgcagtccttccatttataaccggcggccacgttttctacaaacatcattttaattacttctccccaggcaaataagttggtcaagtacctgatgcttaaagactacacgaaggtgcccatcaagcgctcaggtaggtcgttctgtccttgatgtccttgataggggcatcttttgcttattctgtcccctccctcccatagctgctgattgtacttgagaagaacctgactgggctaccctcagcagggctggcacaggggctggcactggacggtccagctcactccaggtgcttcccttctctcctacagaaatgctgagggatatcatccgagaatacactgatgtctatccagaaatcattgagcgcgcatgctttgtcctggagaaggtaaagagtcagacctgagaaacaagaatgatggcaaggacagggcttacagggctgtgactgcctgcctattggtaggttatcctaactgccgtcattgatcggttttcttctgtagaaatttggaatccagctgaaggaaatcgacaaagaagagcatctgtatattctcatcagtacccctgagtccctggctggcatactgggaacgtaagatgggaaaggagatggagtatggtctttctaagtgatgcttttttcccctaagagtctcagtattcagtcacataggaggtcatgggcagagtgggggcataatgatctctgctgaggaatactggagaagctaaattggtaagcttgtggggtttttcatgcagatggctgctgggtatgtatatatctatattctttttatactcctctaggaccaaagacacaccgaagcttggcctcctcttagtgattctgggcattatcttcatgaatggcaaccgtgccaccgagggtaagtgactgaccttggagctggggcttggctacagtctgatttccatgctcactttccatgccttgtctcctcttgcctcctatcacagccgtcctctgggaagcactgcgcaagatgggactacgtcctgggtatgattgggctctttcatctcaagtatcatttagcagcagggatgctaccagaattgcattaacctggtggtcttgggggagtctaaattatggtgtagagagataggaaaacaatctttaactctctcctttacttctcttcaggcaaattctctgattgtcgttttcctttttaccatcagggtgagacatcccctccttggtgacctgagaaaacttcttacttacgagtttgtaaagcagaagtaagtggttcttgtaattctgactgcttgatctgtgtcagaaaaggttctctaaacgtgacttgcagcgcacctgtgtcggttcccagaattactcagaagtgtttactgaagatactctcggaggtagactgtttctacagcatggttctaagaaaggcctgtccactcttcccatagtacacagtctcagattgtaaaatcctgaggcaacaactttagcatagtatgggttttttgttgtgtttgtttgtttgtttgtttgttttgcagactgcccataaacacactcttatttttctcagatacctggactatagacgagtgcccaacagcaaccctcctgagtatgagttcctctggggcctccgctcctaccatgagactagcaagatgaaagtgctgagattcattgcagaggtaatggaggaatcgaggatagattaacctgtgtaaaaaggctgggggtaatggtgtgtttttgcagtccagtgctggggaggtggaaatggtgcctcacaggggctcacgttcagcctgcttgttaagagaccctatctcaaataataaggtggatggtacctgaggaacaacacccaaggttggcttctatcctgcacatgtatgtgtacatacatagcaacacacaagaaaaactcagctcagcaatgtatagatatacactagtcattaacttatagacattctgctgcataatagatacccagggcttactcattacatctagctgaacttcatacactttaatgaatatgtccctatttcttgtcccacttaaacccctggcaaccaccgttctaatctactcctatgagtctagtttagattgtccacttatcaataaaattacattacttgtctctgtattgtcttgcttactataatgtccttcagcttcactcatatggtcacaaatagtaggattttcatttttaaaggctgaatagtattccattatatatagtacagtattttctttttgcatccctcttactgattatggtcttgtttttatttctcattgtaggttcagaagagagaccctcgtgactggactgcacagttcatggaagctgcagatgaagccttggatgctctggatgctgctgcagctgaggcagaggcccgggctgaagcgagaaaccgcatgggaattggagatgaggctgtgtctggtccctggagctgggatgacattgagtttgagctgctgacctgggatgaggaaggagattttggagatccttggtccaggatcccctttaccttctgggccagataccaccagaatgcccgctccaggtttccccaggcctttactggccccatcattggccccagtggtactgccaccgccaacttcgccgccaacttcggtgccattggcttcttctgggttgagtaaattgtcaggtaagtaagtcactttgaattaagcaggtagggtcagtgggggaattgtattcacattcctaagctagtagtaacaaaatccatggtggagaaaagggaaatacagagacgtactcttgggtgtttatgttcgttattgatacagctaattgaattattttctccttttcttacattcacagatactgctcatcatttgcaatagttttccctgagtgaggctgaagcctcaggttccttcaaaacacgctatctagagagccacatcctgttgactgagagtggcatgcaaaatacatttatttgctattctgtcttacttttttttttccttgtgtgttgtcaagttttggtatcagaaataaatgttgaaattgcaaagtg

SEQ ID NO: 864 - DNA, 6728 bp, mus musculus
aaacgccctgggtctggagtggaggcggggcctccccagaggccagtgcgcagctgaggacctggacagaaggcttgctccgcccccaggactcagaaagccaccatggaggggtaccaacggccctgcgatgaggtaccgcccctctggcgccaggaaaagcccctcagctctctctgactggctgtggggacactgcggggtggtctcttagttctgggagagttaagatgcagcttctctttagcctgggtctgctccgtgcggcctggatccttcttgcccttaggcttctcgctctccccgcccctcccccgcccctgagatccttagggtgggcagatcgtcgctctggccttagtgagcaaaagcgcttgggggcagtcgtcagggtctgcaagggccgagaggttgtagggaaggccagaatttgggttacataggcaggcaggcgtgggcgagccccgcccgtttgcgatcagggcctgggaaacccgtcttctctctgcttcctccacccctttgggcctccttgtgctggtgctgcaaggtggctctagtcccgggaattcttcccaggaaaggctagaggaagtgctttatggattaagagcccttgctcactgattcatgtttccctaagcctcaccagaactccatgatgtcggttagtttcctgttacagaaggtaaccgacttttcatggcgacaaagtgataggccccaagtgaaaagaatgacaggtgttccatttgaacccaggtctctggcttcatacttaagcccttatttcaaggaatttgaggatgagggctgttgaattgttgcacagcctgtaagagtttgcaaggacagcgtagacagagatgttctgcacctcctagcaaaggtgcaatgggatctattttgcactacttcctaaatacatgtaatttcaaaagaaattggagtgaagacatagtcctagtgtgcttggctagcacaggagacgccctgagcccagaagagacagagatgcgtccatagtattaggcgactttccaaactgtggtgaaatgtgtatcttttatttcttaggccaatttttggatgggattttgaagtaaaaatgatattttatcacaggcccaaactatgagaccttttttcataatgcctccaacaatttagattttcgttcctttttttttttttaggagaatggtgggaaattgtatagaataattaatagaattaaaatatggaaatctatacttaaagcataactcaggagttgacttgtttcaagtagtttgaagttccctagtggtttttaaagcacagaagtgctgtgctgctttcccagtgcactcagcatacctccctggaagtcatttggtgatacctaaagcatcgtgccttgtatttcaggcttatcacataacctagttctgcactagaggacacgtagatgctactgaaaatccttcttaacctaagattctaacaagctgctccaaaaagtatataccaatttatataattagaataacataaatttctaatgacagagtattgctgtaatcttataattgggaaagcaatggtttgactcacatcagttcaaaataaacttgaaaatgacagttgagcatactcttcttatggcccactttagctgaaatgatttcctgtatactgatagcacacaacagacatcagtaatagctgctgaataccaatttcttaagctttattatacaacgattatctagaataatcaatacactcactattgtaaaagcacttttcaaaatggtatttgcccaggttctgcccaattctaatggctccaaattcatagggaataggtgcaggatcctcaggagacccaatactcctagcactgtggtcttctgtcactatggttttcttaggccagatgagagtatcctgaatattgcctatgctcaaagcagttttattgtgtgttttcttcttaggttggcttcaatgctgatgaagcccataatatagtcaaagaggtgagttgatatttgctgttatcgcaaagcctgttgtgttgatggaaatatcttaaatccagttttgatttgtcaggccaatgctagagatgttaatgttaagacaccacgatgtaaaagatgtcttccttctttgtagtggtgtgtatgcagggcatgcactgaggcttagttggacctttttctgaaagtcacgctaaagctgtttcaagtctacagaaagaaagatcctgaagacccttattgattcgagtgttgtcaatatagactacactgtgggtgaggtactttaagagctctctaaagaatcatcattagctctgccaaatcctaggttaaagacaaaaccctgagctggctcaggagactggcttcaattgcaggtgtggctattgggacctgtgtcctaacaagccctgacgccctgacttgagttctgtctgggcaggattgactccaccttctgggcctcgagtgtgtgtgtgtgtgtgtgtgtgtgtgtgtgtgtgtttgccatcagtttccccagagacagcccctgacttgcctgactgcttgctctaaggtatagtgtcctcctgagctgagctgggctgaccctgtataagtaggatcatcagctcaacattgcagagggctaggcaacaggaaaaaacctgctgtattttaatagttgaagactttgtattagactatttagttatttaaaatatccagactatattacatagctgaatatttaattaaaataaaatgcaaatgtgttcagtgccttcacaatgtcagagaataaggaagagcaattagaagggagagatagcataatcttatttttcaaaatacaatctcaagagacattagtagttagtgattattagacatgaaagaaaagatgctggatctttgaaagaaccactttaatatattttccttacccaagttttgaaccatataaaaaggccgaagtatcacttgaaagagtaaaacactgcctttattgtcgataaaaactaggttgatgactgtatcatgttatactaaccccccctgctcagttcagaacttgcaatactggctttgcatgcacacaagggaaagtttgagtcagcggagaaacaggataatgtggttcttggtctgggtagggatggaaggaaaaatgaaaacccaaattcaagatgtgtgggaatgacgttttctcatgagaccaatgctgaccactcaccaaccagatagctcattccatctccctaggaaggagtaatggatgcaataagaggtcaggaatgttaaagatgtggggctggggaggggatttcatctgtgtacataggttgaaggaaatctactgagacctctgtcttaagaagaggtgggggaaagctagtggagatctagattttcacctatcacaggagttctagacgtgcctatagctcataaaacatagtggtaagcatgttatttggaaatatataagtaattacttcttaaactgttgtgtgtctgtctgtctctttctgtctgtctgtctctctctctctgtgtgtgttagaggttatgtggtattagaaactaccaaatgcatttttatctcttcccttgtttctttggtttttgggttttctttttgtgtttgtttgtttgtttgtttgtttgagatagagtgttgttatgtagccaggatagcctgcctcctagttgtaatactcctgcctcagacaatcaaccatcaggattacaggcacacagcactgcacctagcttactagatgcattttacagtaggcctctccctaactgaaatattgctgagactggggttagctctacaagccgtttaactgaagacagtttgatcccaactgaacttgagttctcgacatgaaagagggaacttcggagaaatctcaggcttcgtgcatattgctttggggaacacatctctggtctccttggtctttctttcctgaatcacttttctgtgccactaaaatacttccattgaaaatctggaaaggtttaaaggtgtaagtactattttaaaaccctccggaccattctagatacttccatagctccaacagtcgttcctgttttatttcatactcagtgtcattcatttaatttcagggcttggtttggtttgcttgtttgcttgttttgttgttgttgttattgttgttgttttgttttgttttgttttggcttgtttgatgtctttgtttttgttttcaaggcaaagtctctctgtgtagctctgagatttgctttgtaggccaggctggccttgacatcccagagtacccccagccactgcctttcagtgctgggattaaaggcttgtgccactgggtggtggtggcgcatgcctatagtcccagcacttgggaggcagaggcaggcatatttctgagttcgaggctagcctggtctacagagttgagttccaggacagccagggctatacagagaaaccctgtctcagaaagagaaagaaagaaagaaagaaagaaagaaagagagagagagagagagagagagagagagagagagagagagagagacagaaagaaagaaagaaagagagaaaaaaaggcttgtgccaccagcagcaacttcttttaatttcttgctctgaactctctctccctgtcaacttacttttgccgatgaacttttagagccaatcatgtactagtactagaagacatttatttaatttagtgatagaatttcccccatacccaaaatttccacaaagaaaaatgatgttttaaatgacataaactcaaaacgttcagtttagactatccagaaagtacatttaaatcagtattgcttgaacaacaaacgtctaagtcttactgtgtggccagatcctgcgcttcgtcctggggtaatccagaactgtttaaagctctgatttgtgtagtgtctttcagggttgatggtaattagttaggaacttcacttggctcggggcagtgaaggaatgaagaaaagacaaacatacatatagacacatggccagaaacgtgggatcaggtgccctgggcttaaaaatgagggagggggctggggtgatctacaaggttacccaattgtattgtgacactaagggttaattaagcaaagaaacatctgttggagactgggccttatccaggacatctgactcctacactttcggtccaaagttcagagtgataaagaggacaaaggaattagtttttgggtctgggaccatggattcaatttgaccctgccagcaagatggagaagttgtccctgagatggctggattcaaacaactgttctcttacaattacagacagagaagcagagttattttatacagctgagtaaggaggcagccttagctaatgtcagtaggagcagtatctgtaggcgagcagtgttcaggctgggagagaaagctatggtggccattttctgcacactgtcaatgtctgcatcttcccttaaccctgcattcattttttaccacttcctgtttaagatttgtccttcccatgttataaacattagagttctttgattaatgcctctgctagatttaccacagagccattggcaaatttatctttgtatgacctgtgatatttcatagaatgagataagactcatggaaatgcttagaaaactttttaagttagagacagtgcacaacaagcatttcgtagatgtgtgtttgagttaatgccttagcaggtactgtcttaaacgaatttctcttgcagtgtatgtctaatttggttcttctgggttaattgaactgttccctctcctagtgtgttgatggagttttgggtggtaacgattataatgagaataacatcaaccaatggactgcaagcatagtggaacagtctataacacatttggtcaaactggggaaagcttacaagtacattggtaagtgatgacacgctgtcgttcctccttagctcacgtacctttctccttctgattctctctggattttaagagtgtatctgaatgataggcactgtagttgaccactcatagtggaggatgcacttctgactcatcgcttcaacaaaatgcacaacaatgtgaaaaaggaagggctttccatctgaagcagtttgaaccgcttgccctttgtagcaacagttggctttgcctactgagacccttcagtgctgtgttcctctcggccatcagtgcctctgcataggcctgtgaagatccacacacccagtacaaagtaaaatagtccccaaattctgtctgaaatctgttaatggcacagagcacacaatttaatccagaatttttctgccatgcaattgctggtggtgatagttacagtccatgaaatggctgaatctcatgaagttaagttcaggacggtaggaagtattcaaaataggagacgattttagtctaccagagaaatcgttttgtgttacttttttcagccttgactccttcccccttttcagtaactgcccttctgtgtctttctttgtagtgacctgtgcagtggtccagaggagcccgtatggatttcacacagccagctcctgtttttgggatacaacatctgatggtgaggggcctcaaatgaatttatccagattcaaagttctagcaaagtcaggctggagttattaccgtagcactacttaaagtctgaaaagatggtatcaatag

SEQ ID NO: 865 - DNA, 343 bp, mus musculus
cttggaatgggctgcattggaatctctgcaatttctgtctcccgtcgcaactgttttctccctcaatttcagcccgtcgctccctcccgtgcgcttccacctcctccccaaagcccctttcccttagccacatttggtcctcctttgccaggctagggcggggatgctatttcggtgtaatcctagcctcactttgcatcaggcatgactagcgaaggctcctcggtgtgcttccaagtagcaccaagaagagctacttgagcccgcaccccgccggggcagcgccttgtgttcttgggttgagcggccccgatttaggttggaaatttccaggggttctctt

SEQ ID NO: 866 - DNA, 89468 bp, mus musculus
aagggaggcggcacccggggcgctgacccgctgctgtcgccggccttcagtctcagggccgccccggtctccttcagtcaagcggaggatgccggtgcgccacccggggaccacgggagactgagtggagacggggtctttgccggccgaagcctagaccgcgggaggctgagccgcggcctgaagtggactctgaggccgccggaaccaggtgacgcgcgggaaccattggccacacgagcaagggagcgtttagaaggtttccgtaggcctggcgtccgagcttcccgtgtgtgcagtgggggattagggacgtggcaccatgaggagccgcagtaactcgggagtccgcctggacggctatgctcggctggtgcatcagaccatcctgtgccatcaggtaagtgtaggtaagggtgaagtgtgagctccggacactgactctgggtgaaccctgaacgcatttgtctctggagagaccttaaaggatcccgaaggaaagttgcatgttgaacttggagtaaaatcaaagtgtggcatggagaatcacaatcccccaccctcgacccctctgcagtgattccagagtgatggtttctgagctcagacagaatgccaccccttcccccaactccccaccctcccaactatggcaggattccagggacagagtttcaagaaataacacttttttattgccctcaccccaggtttgggccatctacttccactccacttccccaaagatgtatgagaacatagagcatcctaagagaccttagactactgtgaaggtcaaggcactttgtacatacttttaaacagttttgcacagtggctcaggctggccttgaacttgggattttcctgccatagccttcacagtttggacaacagaccacaagccagtgggtttttttgtttgtttcctaagccgttgttgttttatttcttcctttgttgagaggattttaccttgtagcccatgctgacctcaaactccccatcctcgagcttcatctccccattgctggggtaacaggtatgcgccactgcacctggtttatatgtgctctttggagttgttggtttttgaaaccaagtctgtctttgtagcccacgatggcctgaaactcactatgtagctggcctcgaaggagcgtcagtctggagaattataggctataaggcactgcacctggctgtatatatttctagatttctttcctactcctttacttcagacttttcgttgctagttgaatttaacttttatatttatttttcttttaaaatgcacttagtggcatccttagtactacatttgataatacccctaataatgcctttattttaataatacctgtgttttggacttgtaagctttcagccagctctttccttattcttaagatagtgcatggaaatagaagaaactttctcatctcatataaatatgttctgcaatgctgattagcagcagtagcagcacactgactagtccatactactttattatatatatatatatagttgaaacttgctgagagaggagatccctcctatcaaaaagtgaggtaatagatgtattaacttgattgtcatttcacagtacattcatgtatgtatcaaatcgtcatgttgtatacagtaaatatgtacagcttttattgtcagttataactcagtaaagctgggggatagtatctacctgcaactggttaaaagagaagaaaggtcgaaaatttgagaatggggaagtaggagaaagactaaagtttctaagtaaaatattccctagattttgttccctttaacattctgaggttagttgcctgtcctctctctctcttaattgatcttgcagaatccagtgacaggcttgcttccagccagctatgatcaaaaagatgcctgggtccgagataatgtgtacagtatcctggctgtgtggggtttgggcctggcatatcgcaaaaatgctgaccgtgatgaggacaaggcaaaggcctatgaactggagcaggtaatcaaaacaaaactatacagagatgtggggctctgtgtgggtgtaatgggggagcaggaattgaaggaaaaatagcccttgtgccaccttgctcaaattgcattctataaggttttcctactattgtatctgcagtgggtttggtttggtctgatgtggtctgctctggtttggttattgtggtggaaacttgaaaactataattcagggaagagggctcagactatttattactttacttttgaaaatcctacttggatatatttcccaagattaataattctctaagtgtattttcaggttctaccattttattttcattgcaaggaatatttgggagcaaatgtgtattattttatttctctctctctctctctctctctctctctctctctctctctctctctctctctccctccctccctccctccctccccaaagtgtactattttatctcccccctctctcttttgaaaataattgtggtatctgtatgagtggacctgacagatcaacaggttttcttcattagacaaaaataatgacttcgttgatctttataactatgaccacaattttagagagcctgttgcctggggtcaaattgaggtcagagtcagcagatgactttaagccaacttttaaggcaccttcccctcaataaattagtatcctttctagaacttctgaacagaaaggaactacttcatcttaagtgtttaaaaaggcaatcatttggcatcatttgaattacacaagacctttaatgataaagtactatgctagttgtaagtatacgtagatcttttcccattagtgagaaggagccttaccacagcagctgtttctcctatcgtcttccttgaacttaagaaatctgagctccacttctgatttacaaatcaggttattgggatctggttatttttaaaagcagcaacatattcagaagttgttcttgggagtgggacaagtctcactgtattatcttcagcatcagtagccatttggaattccttcaagccattactgagagatacaaaagagtttttgctctagtgaagcaagtacagacttttatagaaataatgccataatagaaatttggaagacatagagtgtatttttttttaagaaaacctctctagtccgatatcctatcctgaatgttttgctgttttgatctcagttgtttgttccttgttttgatttgctatacattaatatcagaataacttcagttatgtgcctgatataatttgatcaaaaattttcagtattataagaataaatctgttgttccatcattcattggaattacttggaaagcttttcatcgatatcctaactggatagacctcactttaaaacagtttaagtaagaatttaaaaattatatccatgagcactggtctttttcaaattacctaggtgattctgataatgtgctgagataataaccgatgtaaaactagtaagtgaacatagattaagtccaatacatccacagattaaatttctacctgctgccaacttgccattactgtgtggatttcccccaaagcattgttagtcatttatataccctttcttccaactctcgtttttgcttctctttcataaaatcagaaaaccaataagaatagcagatggaaataagaaatgggtttaactaacttccttaatctatattgtaaatagaattatacacaaatatatatttacagattccctcctttcttgatcacatagataaaaaacaagtctcagggctggagagatggctcagtggttaagagcactgactgctcttccagaggtcctgagttcaaatcccagcaaccacatggtagctcacaaccatccgtaatgagatctgatgtcctcttctggttcatctgaagacagctacagtgtacttatttataataataaataaaagaatatttaggccagagcaagcagggccaactggagcaagtggggtcgaccggagtgagtggggttgactggaacgagcagaggtcctaaaaaaattcaattcccagcaatcacatgaaggctcatagccatctgttcagctacagtgtacacatatacataaaataaataaatctttaaaaaatgtcttatagctataaaaataaacactcaggcagatcaccatctctttggctgcccccacttctggttcttagtttcttctctttgtattgtctctcatctgtttctcatgggttttccattacctttttaggaatgatttccagctctcttcctttagctctgacctcagttgagatccaaatgccagtttttatgtctcttcttactagttttccctgtgtgtcctgtggttctttaaactctgtgtgcctgagagcccacctttccaagtaaaacacaatacaacactgtacgaaacagtagtaacttgccactgtgtttctcttaacagtgttcttaatttacagtcgccctcacagtattacttggaaaattttctcatagtatggtctgtggaacacaaagatgacttaagatcttctagactgtaaaacagaaagatttgtagagaattggggaagctgttccatgctgtgatgttctaaaacatactccctactcatgccaggtgtgcatgagatgtacacatatacatataatcaaaacactcatacagatggaatgaaaaaatgagtctttaaaaataaaatgagattttaactaagaagatgccatcaaggctagagggcatatactggcggagccttagagcccggggagtgagctaacttgcgccttttctctaggtggattctcaactattagatggttggctcatttttaggtaaaagtgccttagagtttttatattagtacttaaattcaagggatcataaagcatggcttttgatttaacttttagctgcagtctgttttgtgtgcctataaagtaaatgccatgcaagtagagcccaggatagggttactagttctcaaaggtcatgtactgaccgaagctgctgaataagtgttcttgtatctcggtatgtttataaccgtctggtttccatttatttttgcagagtgtagtgaagttaatgaggggactgctgcactgcatgatcagacaggtatggcactggtaacaacttctgataaaacataacatcttaatgatgcttataaccttttattcagattcacaaattgtagtctctaattttagaaggttcagaactctgggatgggcatggtacacagaccctgttacaactagaattatttcctttcagtctttttcctccccttatgaatgatttttctcaaaaagaatcattatcctatttgcagttatgcgcactagataaagcatgatacaggttttttttttttaatcttatctgaaacttttaggcccacatcccttctaaaactaatacattttcagatttttaaaaagataagcacactgcacgttatataatttctcatgtcttcagtagatagagaaaatactctaaggagctgaagtggtttgcaactccataagaagaacaacaataccaaccaaccagaccccctccccagatctccaagggactaaaccaccaaccaaatagggagccttggctccagctgcatatgtagtagaggatggccttgacatgcatcaatgggaggagaggcccttggtcctgtggaggctcaatgcactagtgtagggggatgccagggcagtgaggtgggagttggtgggtggttgggggagcaccttcatagaagcaaggggggatgaaatagggggtttctggaggggaaactgggaacatttgaaatgtaaataaataaaatatccaattaaaaaataaataaataaagctgtgtaccaccacacaaaaaaagaaaatactctgaaattaaaaaaaaaaaaaactctctctaggaaaacattccttacacactaaatgggataaggcctataaagaaccagatgttgatttgaatttagtgtttacacctaatttagtgtttgaagtttgaattttgagttttgatacaaaatttacgtggaaaaaatcattcaaagtattctcaattttaagattggggcaaaggaatcttgaacttcaaataattggtcttccctggccttgtgtgtagctaaacatccttttatatgtgaattgaaaatttgcagttccttactggtgaattacctgctagagctttgcctctttgtaggttgtctgtttcttgcttattgacttcttgtgtattatggatgttaatcatttgtacattgcaaatatgtttatagtctaccatttacattttgagtttatggcatttttccacacaaaagtattttactaagaaacctatattctgagatcttaaaacatattgaacctgagttaattagagcaaagtagaaaggaacagatctcaacttctaaacttcatgatttttaaatgaatatgaagttatttattgtatgtatctctttactagtctcacatatatcactttgtgtctttatactttatttatattttagatagttatgctttgtcctgttaaatagatatagtcacaaatttcatgaaccatatttaagattatcatacatcagagacataaataatcatatctacatatcaggaactaggttagaaactagttgcctgttatctaaggtctggatttctgctctgtgtgtgtgtgtgtgtgtgtgtgtgtgtgtgtgtgtgtgtgtgtgttagggattggacccagggccttatgcatcctcagattacagtaccgctgaggtatatccccagctcccaatgagcctcttctaattagttttctataataccagttttgtgactctatatggctctcattaactctttttatggcatcttcaaaatttatcctcttggggttagagagatggcttaatggttaagagcacatattgctcttgcagaagacctgagtttggttcctaatactcacttttgttgggtggcttacaactcttataacttcagctccaaagagtcgaatgccctcttctggcctctgggggtacccacacccacaaacaactatgcacaggtacattaataaaaataccctcatctgtcaatttatctgcacattcctactttaaattcaagaacaaatgtatagcactgcattttctcactaaactgttcttatacatttgagcgtccagtttctctacaatatgacaaagtaaccatttgaaaagcatagaaaagaggaaatgaacaagaaataggtgggtttttaaaaactatttcttattttttattaaaaatgctagatttccccagtgtagaaaaaaagcaggtaatagtatatttcccatattcacaatttcctgaaggcagagtatggtgatgtgtatgtcagagccctacagatagatgcatagcatataggttgatttatctgactggccattttatactgtttccttgtcaggtggataaagtagagtccttcaagtacagtcagagtactaaagatagcctccatgccaagtacaacaccaaaacttgtgccactgtggtgggtgatgaccagtggggacacctgcagttggatgctacttctgtgtacctgctcttcctagcacaaatgactgcctcaggtcagtacaagaagagaataactgcatgcttgtaagtttggatcatctctggttcatctactttctctgtagggattgactagaaaataaagtatctgtttagggtactcaatgaagcaaattgcaaataacaatagtttgtaagtttgctatagctagataactttttttgaggtataggcaatatcttattttattgagaagcaaatttgcagttctaattaatactcttttgaaatgggaacccagaaaagtgggctagatctttagctaggttttttattattatttattaattctcagatgccaggagatgggaaggaagggcaaaggtttgttttttttttaattttcatattctacaccagtatgcctttggtcactgtggctacagaaccacccagtttatatattctttattagtatgatctgaatctaaatgtgtatgtttcattattaagcagtattctatttaagtagttttgtgataatagttagatgcctgatatgtaaaagaaaattaaaaaaaatatagtagctcacatctctctgtatcctagcacttgggaggcagatataggccagccctagtttacatactaacttctaggtcattcaaaactacataaagtgatgctttatagatgtaaaattggaggtgaaaacaattctattatatggagttcctaaacttaataagaacatttccagatcattcagagtaagttaatgtatttacaatactatgttttctgtggtgttggggtttcaaagaagggaatcatgcatgccaaacaagcactctaccactaagctaaaatcttttttttaatttctttcttttttttttcctttttttaaaattaggtattttcctcatttacatttcccaatgctatccccaaagtcccccatacccacccccccactcctctacccacgaagctaaaatcttaaccctttacattttttttgagagaggatctcactaaattgtccaggccagagagttccttgatattaaaggaaacaaatctctctctctctctctctctctctctctctctctctctctctctctgcctctctgcaaataaatgtttggtaataaactccttaacttttttctttttacaccctagagtttgaataagctttctttgaaattatgagttgatcatccaattaatctccttttggaggagaaatttcttccacaacaaatttaattttgttttatttctttaagtagaatggtagttataatttcactttgaataatatttttatttcaactctgaaagctgtttaccatttttaatttttaaatttaaaaaaattggggtgggtggtattttgagacagggtttctctgtgtagctctggttgccttggaactcactctgtagaccaggctggcttcaaactcggagatctccctgcctctgcctcccgagtactggggattagaggcatgtggcaccactgcctggctcccttgggtattcgatggctagtgtttttaagctcccaagtattctgacctgatagagttgtaaagtaagtatgacgttgccaccttcacctagctttttattttctctctttaaagcaggcactgactaaatatccctgatggtttttaaatatgattccccaaaatggaagcaaagatagattaaaacatttcatgaggacttctatagcatgctaaatattttagaattatattctgcaaccagtagagatgtttgatgtggataatcaagggatggttcattctagtagcaggaagataggttgcatgagatagattagataaagaacaaaattaaggtagaagactagtaaagaagtcagtgaaatactttagcaataaataatacaaattttgtataatgcatttggattgaagttaaaaagcaacattgtggtgaaaagaatataataaaagatcttcatagagaactagcaatagcttgaatgttcttgaatacttagttattgcccgagcttttgttccaccggcaagaacacgctcagaacaaccggaatcttctgcggcaaaagctttattgcttacttcttcaggaggaagagagaaaatggcaaaaccccgtcccttttaaggagacttatcctccgcctaggacgtgtcgctccctgattggctgcagcccattggccgagttgtcgtcacagggaaggcagagcacatggagtgaaaaactacccctggcacatgcgcagattatttgtttactacttagaacacaggatgtcagcgccatcttgtaatggcgaatgtgagggcagctccccacacttagtgaagatagatttaggcagaaattgaatgaaatttatagaatagtagcatgaagagctccagcaaaacagccaaagatgctggaaatttaagaacaaaccaatactttgaaattgtccattggatattgttcaaaaggatttgcagtaagtagagaagcactcaaaaaacccctaattattaagaacatcaagggactgaggtatctggcctcagcttaacctcctatcccaactcaggataatagaagcactattccaggctgtatagacagaacacaggcttcctctctcctaagctctagtttagtggttctcaaccttcctttaacttctttttttttaagattcattcattcattcattcattatatataagtacactgtagctgtcttcagacacaccagaagagggcatcagatcttgttacagatgtttgtgagccaccatgtggttgctgggatttgaactcaggacctttggaagagcagtcagtgctcataaccactgagccatctctccagccctggttctcaaccttcctaatgcttgagatcctttaatacagttccttatgtgggagtgactcacaaccataaactagtttttatggctacttcattttgcgactgttattaatcataatgtaaacatctgtgtttttaaatggcctttgggagtcatgatccccatgttgagaatcaccatgttgagtttaaggttcctgaatgtccctcagaaaacaagctggcatcatttattacccttccaagctctgtattgcaagccctagtccaggcaagtacagctttaggatcccccatatccccagacacttaggaaataggatctcccttagatagagcagagtgagaccactatgtcatctacttcttgactgaggcaaacatcctacactggaatatgcaagctgggaagatcagaagctaccactctgtccagagcttagtgtctaaaacaggaatgccattccaaaagaaatggtctgcagcactggcatgaatattctcatggaaggtagcaacacactgtaaaaacaaagctccttaactcttctgaagaaaattgcctttacaaatgaagtgtgagaaaattagataattacttagtaattatgatgtagggctggagaggtggctactcttctagaggatctgggcttgattctcaacatctacgtgatggctcacaaccgtttgtaactctagttccagggggattccatgtcccttctggcctctgcaggcattgcacgtacatggtacacagatatcatacaggaaaaacacccacacacatcaaaggtggtcttagtaaaaacacatctaaataattaagatgaagttaattgttcagtaacagcaagaaactaagaaaaagattagctagaaatttttaaaaatccaaagaaagctaaggagtccttttaagtgtaagaacaagtatcaaagacttgactcaaagattgtaccagaaaggacctgagtctaattgtttaaaacgatagagaaatttatttttgaggattcgacaaaatcattaaacaatcagttgaaaccaggggttgggccttagcttcataccagcagagacagccatctactagatcttggaaagaattttttgtttgtttgctttttaggtgaaggatgtccttttttctttttctttttattgaatattttatttatttacatttcaaatgctatcccctttcctgattcccctcccctgaggaaccccctatcccatccaccctccacctgtttctatgagtgtgctcccccactcacatccttgccaacatgtgttgtcacttgatcttagccatttttttgatagaacatgattttaatattttcaactgttaatattcaacaaacagaataattgttttaagatatagtttgttgttatgtctcccttttcatttctgattttattaatttggatactgtctttgtgccctctggttagtctgaaaagggtttatctatcttgattttctcaaagaaccagctcctcctggttttgttgattctttgtgtagttctttttgtttccacttggttgatttcagccctaagtttgattatttcctgccgcctactactcttgggtgaatttgcttccttttgttttagagcttttaggtgtgctgtcagattgctagtgtatgctctctccagtttctttttggaggcactcagagctatgagttttcctcttaccactgctttcattgtgtcccatgagttttgttatgatgtatcttcattttcattaaattctaaaaagtctttaatttctttatttcttccttgaccaagttatcattgagtagaacattgttcagctttcacatgtatgtgtgctttccattgtttttgttggtatttaagaccagccgtagtctgagctgatctgatagggtgcatgggattatttcagttttcttgtatctgttgaggcctgttttgtgaccagttatatggtgaactttggagaaggtactgtgaggggctgagaagaaggtatattcttttgctttaggatgaaatgttctataaatatctgttagatacatttggcttataacttctgttagtttcactgtgtctctgtttagtttctgttcccatgatctgtccattggtgagtaggatgttgaagtctcccactcttattgagtggggtgcaatgtgtgctttgagctttagtaaagtttcttttatgaatgtgggtgcccttgcatttggaacatagatattcagaattgagagttcctcttggaggattttacctttgatgagtatgaagtgcccctccttgtcttttttgagaactttaggttgagagttgattttattcgatattagaatggctactccagcttgtttcttgggaccatttgcttggaaaattgttttccagcctttcactctaaagtagtgtctgtctttgcccctgaggtgggtttcctatatgcaccaaaatgttaggttctgtttacgtaaccagtcagttagtctctgcctttttattgggtaattgagtccattgattaagagatattaaggaaaagtaattgtttcttcctgttatttttgttgttagagttggaattctgttcatgtggctatcttctttaggtttgttgaaagattactttcttgctttttctcgagtttattttccctctttgtgttggtgttttccatctactatcctttgtagggatggatttgtggaaagataatgtgtagatttggttttgtcatggaatatcttggtttctccatttatggtaattgagattttgctcggtatagtagcctgggctggcattgttgttctcttagggtctgtgtgacatctgtccaggatcttctagctttcatagactgtggtgagaagtctggtgtaattctgataggcctgcctttatatgttacttgacttttgccctcactgcctttaatattctttatttactgcatttggtgttttgattattatgtgatgagaggaatttcttttctggtccagtctatttggagttctgtaggcttcttttatgttcatgggcatctgtttctttaggttagggaagttttcttctataattttgttgaagatattagctggccctttaagttgggaatcttcactcttttctatacctattatccttaggtttggtcttctcattgtgtcctggatttcctggatgtttttggttagaagtttttgcattttgcattctgcattttttgtctgttgtgtcaatgttttctatggtatcctctgcaccttagattctctcttccatctcttgtattctgttggtgatgtttgcatctatgactcctgatctctttcctaggttttctatctccagggttgtctccctttgtgatttccttattgtgtttgttttgagttttagatcctggatgattttgttcatttccttcacctgtttgattgtgttttcctgtaattctttaagggacttttgtgtttcctctttaagggcttttagctgtttacctgtgttctcctgtatttctttaagggagttatttatgacctccttaaagtcctctatcaccatcatgggagtagttttagatccgaatcttgtttttccagtgtggtggtgtatccaggacttgctgtggtgggagaattaggttctgatgatatcaggtaatcctggtctctgctgcttgtgttcgtacacttgcctcctgccatctgattatctctagtgctacctgccctccgtatatctgacaggagcctgttcttcctgtgatcctggttgtgtcagagctcctcagagttcagctgtctctgtgatcctgttattatgggattctgtgatcctgagatcctgggtgtgtcagagctcctgggactcaagctgcctctgagaccttgggatcctggtgtgagcaagctcctgggatcctgttatcctgtggtcttgggtgcgttagagcgcttgggaatggatcttcctctgggtgttgtgggaatggctctcatcctatgatcctgtgtagggctgtgggtgtgtcggaagaggggagttggagagagtgcctgcatcccgcccgagttctggtgttctgggcaggcagatgagcacatgctttctatgcagccccgggtgggcatctggctgtttgaagccactgaccccacaaggcaggggttggacaaggggcagcccccggtaccagattctcagcctccagcatcccaagctggatactgccgagaagctgagaacagaataggggccctggggtggcacttggccccagagatacggggagagagggcagggggaaagaggggtgctgggtggtttccacgcaggtgagagtccttcagagacagtctatagttttagagctttattatagaaaggcagggagaaagagaaaaggtagaaggagagagggagaggccagccatggccacgaggagagaagggggaagagagagagagagagagagagagagagagagagagagagagagagaaggctagagagtaagagaggtaaaagcttagagagtaagaaagcttagagagtgaggaggggccaagcagcccctcttatagtgggctttgttatcttgctgttgctaggtagctgtggaggagtctagccagaaggccattgggacattgtctacctgactaatagccacatgcctctcctgtgggggctataggggcggtaacttcgacaggagccaggggtccaggagacatgagggaacgcctaccatcccatgtaggtggaaattaccacacatagggtaccgctggggttcaatggagaccaggctgtctgtcctataatcctgggattgttagagtgtctggatgtagatcttcctctgggtgttgtgggactggctctgatcctgggtgtgttagagtgcctggggtggatcttcctctgggtgttgtgggatttgtggtggagtttgcacccaatgtctgacaggaaggagcacatgctactgaatgggcagaattcctagttgcctgggtcctgctggtctcagttatttccagtgttggggcagatgtgtctttctcacctctgatcctatgatcctgggagtgttagagcgcctgggagtagagcttcctccagtgttgtgggactggctgtggagtttgcacccaaggtctgctcagggcagtggcccagacagaaaagaggaaagaaattgttaacgagctccaataacatcatcttagagtgacagttcatgttcctaagactgtgtcttctgatggctaccagaggctgcatgttatgggggaatagattgtactgaattagttcagttaaacctctaaataaatagaaacagtctccagagaatagtctcggatcttgcattctcacaacatactaacatataatactacccagttttcaacctaaaaatttagatgcaaaggaacaagaaaatagaaatatatagtggtacacacctatatcctagcactcaggaggcagagaaaggaggattatgagtttgatgctacctgggatatatatcatggccctgtcaaagaaagtggggagaggaaaagagagaaaaggttgaaaagagtggaagagggagggtagaagggaggacaggcgtgggggcacacacctgtaatcccagtgcttgagaggtagacacaagaggattgggaatccaaagccggggttggttacatagtgagtttaaagccatctttggatacacgagactcttctcataaaacagaaacaatataaataaataacagcaaagggaagcaggagtgaatgttctcttggatatgatgccaaatgtataaacagctaaagaagaaaatcgtaattgcaatttaccaaaattaacatcaaggacccatctaagaaagtaaaaaagaatctgtgtatagtatgatgtctgcttgtaatccgagcacttgggaggtgagggtgggatccagagttgaagttcatcttcagctaatagcaaatttgatgctaacctatgagaccctatttatttatttatttatttatttatttatttatttatttatggaagcaatggtaattcaatctctgggtgcaacaactaaaacccaattgtgtaagcctttaatctgactcctccagtggcgaatcctgatggattcaccatgataccaggaaactctagcagctacatcttgcccttatgctattcctgttccaaaaagctgagaacccattaaaaaaaaacacccagcctttctcagtgtgtgtgtgtgtatgtatgatatatgtatgtatgtatgtatgtgtattgtgtgtagtgtgtatgtatgtaaaatcaacctatatagaaggaaatatttgcaatcatatataagctatttatattgagtagaaagaattctcacaactcattgtttagaaaatatcagaataactaagtcagatatgttggggtggtatatgcttttaaacctaatagaaggcaaaggtgtgaggatctcaaatttaaggtcatcctatgatgacactgtctcagagagagagagagagagagagagagagagagagagagagagagagagagagagagagggagggagggagagagagagagggagagagagagagagaaatagcctcctttaaaatggctagagtgggctagagagatgggctgctcttctagaggacgtgggttcaattcatggcacccacatgacaggtcagaactatctgtaactccagttccaggcaatatgatgtcttcttctggactaaacagacagagcatgcatgaagcacacagacatatatgtaggcaaaaacactcatacaccaaaaagctcaatttattttataaaaagtggctagaggatatgaactggattttcctctatggagtttgtagaaataaccattaagtacattacaaaatgctgtgcatcatcagtcactagaggaatactgacctgaataactgtaatgaccacttcagccacaacagaatggcaggaatcaagatgacagattaaaaggtgttgctgaagatattgagaagttggaacctttgttcactactctgggaaatgtaaaataagagcaaaggatatgtctcagcaggtataagtacttgctactaagtctgacaacctgaatgcaatacctggatccatatggtggagggagagaaccaactacccttagttgtcctgacttccttgtgtaccatggcatgcacacacataaataaatagataaataactaagtaaagaaatttaagttttaatgtaaaataatacaatcactttgaagagcagtctagcaatgcctcagaggcttaaatatagagttaccatatgatccagcagtttctctcctaagcgtgtgtgtatgcatatatgtgtatgtatgaatatgtatatatatgtatgtatgaaaaatatgtccacatacacaaaaagtatatatgaatatttatagcagcattatttacgatagctacaaagtagaaacaacaacaaggtctatcacctgatgattggataatttaaatatggtgcgttcacacaattaatattttttggcaataaaagaagtactaatgcatcccacaacacaaagggagcttcaaaatattgtgttcagtaaacaaacactgataacataatatacttctcagtttatatgaacgcccaatgagtaaagaattccttcttgtgatgatgaatatgtcccagaattgatgtaatagatatatactgtaatacaataacaaccattatattatatgaattacacgataagttatatgaaaggtctatctcagtttataaaaatacatgtgctggtcaggtcagtaaaggcaattgaagtgaagttgattgaagcagagttcactgagtcatttccattttggggcaggaggctgaagtgataaccaactaactgtctttttccctcaggactccatatcatccacagcctagacgaagtcaattttatacagaacctcgtgttttacattgaagctgcatataaaactgctgtaagtacttactttagaatgaacttaaacatagaatgtttttgtttccaaaacaccaaacaactcacttctccttataatgaacgaatcaaaaaggctcatgacaaaaccattttcagtttctttactaagaccttcattcccctgtttgccctgtcgtcaatgtgttacagagataaatgctgtggtttcagttccttcaaatcttattcttcatagtatgtgcttggcaatggaactaatttgtagtcattttattatattactattttcatttaatatattttattagagcatctctaggctaggctcatcctgaactcaatacatgaaggtgatcttaagcttctgattcttccgtctctacctcccgagtgtgttggagttataggcataagctaccatgatcagttttatgtggtgataggatttgagccctagcaagcactcaaccaactgagatctgtccccagcctctactagtcttattttaactgaaacctttaaaagaagcatgataactgagtaatgttatgggccatttggctgtacacaaataaaatttattcatgtttttgttgttgatctagtgtacaaaaagtttttccccttatgaactaccatatgaagtaggttcatattaaatgtcatcaataatattttctctgtataaaatgttgcattggacactacagaaatgcatttttcctttagtctaatatgaagggttttgttgctgttgttcattgacactttccttataatctcccaatcttcaaatcatccaaatgcccaggaacaaatacaagggataaacaaattgcagtgttcatgaaaggtcattttgttcaacaagaaaaaaaatgaactgtgagccatgcaaaaacgtgaataaatctaaaatgcataatggttagtagaagaaatttcatagaaaatgtacacaagcccgggcatggtggtgtgtaagcctttaatctcagcatttgggagaggcagagacaggtggatctctgtgaatttgaggctagcctagtctgaatagcaaggcccaagccagccagaactacatagtaagagcctctctttaaatgtgtgtgtgtacatgtgtgcatacatgcttgtatgtgtattatatatatatatgtgtatgtattatacacatacatacaagataattacactaacaaaattctagacatctgtaatgacagtaagcagatttgtgattgctttataacaggggcagaggaagaaatggattttggaagccaggaagagactttggaagtttttgaacctatcttttattgtgacaatagattcacatatataaatataattaattaatcacagtggtaccagctagtttgttcagtggttaaaggtgttctctgccaagactgatgttctgagcaagatctctctcttcctctctctgtctctctgtctgtctctgtctctgtctctgtttctctctctcacacacaactgtactaaacattttaaaagaggaatcatatagtttaactatattccggtttaactacaccattatacatcaataaagatataaaactactgttgtggaatggatgaatacaatcactctaagattggacaaatactacacttgtctctgattgtgcttttagtatgtgtccattgttactgactaacccccttgtatttaacatacctcttttcttttattttttgtggtgctaggattaaacaaaagtccttacacatgattggcagatactctgaaaccgaactctatctccactcagaattctttttcactttcaagtgtcatattattttaaaagatactactttaaaatgcatttatcacttttgataatgttcatttctccatgcatatgtatatgtaactttacccatttcttttttgatggacatacagtctgcttctgtaacttaacttttgtaaatagtgctatagtaaatgtgggtatgtacgtaatatgtgtgtggtatgctggctgattagattccattggctctatttctggaagtggtatagctggatcagatggcagatctatttttagtttttaaaggcactcccatactgattttcatagtgctggactaatttacatgcccaacagcagtgtgtaacattttcttacatttgttgttagttatttttctgatgatagatattctgaatggggtgagatgaaatctcaatgtaggttaggtttggtttggtttggcttggtttggtttggttttttgagacagggtttctctggatagccctggctgtcctagaatttgctctgcagaccaggatgacctagaacttaaagatccatctgcctctgactcccaagtactggggttataggcatactgcaccactgcctgcatgtggattcagaggtctgcttacttctttcccgtgagtgctgggattaaaagtgtgtgccattacacccgcctaaatccatagtcaaggttgagattgaagcatcttgtagtactaaacactccagaagtattcagggaggaacagggaatgtcaaaagtacactagaaaatgtcagaaccaagaggcacaggagcctaccagtggctagacctggaacaattaacaatgtaggcagcaaaataatgatagcattccataataaaccagcaaacatacacacaccaataaataaacaactgaaaaagaaaaaaaacaaggaataatggactgccttccttggagaaggattataattaatgaccatagaggtagcaaggaaaatagattaaaattatcatcaaaactatacttattgtaagcaattaaggcagaatgctgaattggtggatggttgtttaaggagaagcaaactatttacatgatcatcttgtttttctgagatagagtctcatctcaggtttgcaacaaggagcaaccccacctagtgatatatttatataatattgaacaatctctcaaagtatttactaattaaaaagagaaaagtaaaatggaaaatgccaatgcgaaccaaactgtttagctttcagtagtttttacttaggatcaaggtcacaaaggataagatttgagaaagcactattgattggaagtcactaaggagacatggcagggatgaaattgaatcttggaatatataaaaagcaccagtcaggcatggttgtgtacacttacaattccagctcttggaaagtatgggcatgaagtccatagttaactcagttgcttagttgagttgagtccttagctttagcagttgtcctgtggttatggtcaatgttaacattaggcaaaactaagtcataggtgttagggattcattgtactatttttgcaattttgtgtaattctgaagttttttttaaaaaaataaaaagtattaaaattaattttaaatattttatattgcctagggaatgtttatagctatggctaggagtaggttttggtgtgaaattccttagaatgtactctggattctgtcacttaccaagtatacaaccgtgggttagttacttactgtcattcttgtaatttagtttcatcatctgtaaaatgtaaagattaagggtagagagatggcttggttaagagcacttccagagaacccaggttcaattcccagcacccacacagcagctcacaactctttgtaactcctgttccaggcattctgacacctttttcagatatacatgcaggcatagcatcaatatacatagaataaaaataaaaagcatatttttaaaaagtaagcattaaggtagataatgcatgtattgtaaattttaagaaccaagagattaagataagaatgtaagtttcacataaaaataccaactgttgcttagcctctatgtgttagacttcatgggaatctcctttagggaaaacttgagaagtgtttctagatgatctgattaagtgttgaagagactcacaactttttagaggccccaatttaacttaggtcatcatctgctccttaatagcctatacagaggctattaagtgagtgagtatatgagagtgtatgtaaaaatttgctgctattaatatttttattaaaggattatacatctaatgaatgtttagtggttataatttgattgtaatgagttatatcttgattattttttgctaggactttgggatatgggaacgtggcgataagacaaaccaaggcatctcggaattgaatgcgagttcagttggaatggccaaggtacattttctttcttatttttaccaagtcttgtcaatggagtttagtttatctttgtgatagataaaatcttaatgtacatgttgacccatcaaattgttctttaaaccacaaacaaaatttagattcctccatgaaactatgaatatataatttgaaactttttataagtttcaaatttgaatcatatggcttttaaggcatgtctctgcttatatttcctattagaataacaaattttaaactgtactcaccatttttgccattgcataaactaagggaagctctttcccttccaacagtccagtcacccaagctcagtatcagatagccacctcacggtcctccatcctctgtactctcctcaatctcccatatcaccagcacctttccacttggccatatttctagaaagagtaagaatgtataaaataggatagcaggagaaagttcaaacattattatgttaaatgtacatggatcagccacttgtactaaacaggaaaatgcagatttttttaaaagaagtatacttcttatatcataatgatactgaaagtttaaaaccaagttaggagaagtaaaatatagagactaaaaagaaatgaaataacgattcaaggcaaaaaatattacatggaataaagtggacaagagggttatgatagaattttgacataacctataatgagacaatatggtctggaatgtagttccaattaatacagaacacaatatatttgaaatacaagacagatgtagttgcataaagaaataacttgctggacagtggtggcacacgcctttaatcccagcacttgggaggcagaggcaggcagatttctgagttcaaggccagcctggtctatagagtgagttccaggacagccagggctaaaccctgtctcgaaaaaaaaaaagaaagaaagaaagaaaagaaagaaaaggaagaaaaggaagaaaaggaagaaaaggaagaaaggaagaaaggaagaaagaaagaaagaaagaaagaaagaaagaaagaaagaaagaaaaaataatttaacagcaagactgtgatacatgtagaaaaccccaaacaaatcatagaaaagttctatacaagttttccactgctgagttctatctattgctccttccttttttattttgaaataattttaaactaaagaaaacaatttaagaatgttagggggaaaattccatacatcattcatgcaaggtttattgatatttgctttatctttccgtctactgtgttagacattcatacacatgcatgcttgtgcacaaacacacactttttcctgaactagttgaaaatacacaaactatggacatgatgaagtactactacaactcaacatttcattgtgcacttcctcaaagactgttgtaaccatggtatgattatcaaaaccaggaactaagtgattacacataccacaggacctattcagttttttaaaattatcccaataatgttaatataggcttttgtaatagaatctgatgatttttttttgcatttcctcagattctgttgttatgtctcccttttcatttctgattttttaaattaggatgctgtccctataccctctagtgagtctggctaagggtttatctatcttgttgattttctcaaagaaccagctcctcgtttggttaattctttgaatatttcttgtttccacttggttgatttcacccctgagtttgattatttcctgctgtctactcctcttggatgaatttgcttccttttgttctagagcttttaggtgtgttgtcaagctgctaatgtgtgctctctctagtttctttttggaggcactcagagctatgagttttcctcttagaaatgctttcattgtgtcccataagtttgggtacgttgtggcttcattttcattaaactctaaaaatctttaatttctttctttattttttccttgaccaaggtataattgagtatagtgttgttcagattccatgtgtatttgggctttctattatttatgttgttattgaaaatcagccttagtctgtggtgatctgataggatgcatgagataatttcaatatttttgtatctgtagaggcctgtttttttaatattcactttctcttattgtggtactggtaactgaattcaggatcttgtgcgtgctagacaggtactttaccacagagttataccctcagcccaacacacctaccattttaaaacaacaggatgctatgaagtacacaataacatcgctattttttttaagatttattttttattagatgttttcttcatttacatttcaaatgctatcccctttcctagtttgaccaattatacggtcaattttggagaaggtaccatgaggtgctaagaagaagcacttcttgttttggataaaatgttctatagagatctgtacaatctatttaggtcataacttctgttagtttcactgtgtctctgtttagtttctgtttccaggatctgtccattgctgaaagtggggtggtaaagtctctcactattgttgtgtgaggtgcaatgtgtgctttgagttttagcaaagtttctctaatgaatgcggatgcccttgcatttggagcatagatgaattgagagttcatcttggtagattttacctttgatgccacactttggttttccttcttgagtttcatgtggtttgtgtttcatgtggtttgtgaattgtatcttgggtattccgagcttctaggctaatatccacttatcagtgagtgtatatctttctaaatcttggaaggtaagagttcacctgaatagcggcctctttttgtcagttgagtccacaaatacactgaaatctcacatggctggttggctttatctcttgccactactatgccccgttcttcttccctgagtcacggggattctcttccattcctcttttcattctagcctgcacaactctaagtgtccaccccatgtccagccattggctgttagcatctttattgatggatcacaaaccaatttgggacaagaaccttcagtgtttggctggacacgcagattccagattgaatcaaagccttagaaccagtctccaacaggtatccctcattggattgaagaaatttctttctattgttgatttttaaaatttgtaaacatgtattgaattttatccagggttgacagcaagctgtaaaatccttgctttttttcttgtgacggttatctagtcttggagcatacctgttccatgtgtgtcctcatggtgaatcttcctggtccttctctgcttcctcctttctgcttctctccttttgtttgggaccaagataccttatattaagaagaatattgtcatatactgagagtgatgcattatattgatataatatgcataaaaagcaatctagcattgtatctcaataatcgttcacatactttaagccacagattatctactttaagaaagtaatgcttgggagaactggccatttctctcgccagccacaacactcaggagagggggcctgcaccttgcctgagcagcagagtagaactggccctggttgctggggctgcctgtgatctggcctgagggcatgagagcagcttgactggatagtgatacaaactccattttaattttccctgggcactgtgggaggcaaagtgcaaatcccaagctcctaggaataaggaatgttattttattttctatttcattaaatatattcaaaagcaacatcatgtaacatttataagatactaagaagaaaatatgtataatatatctcattcttgattttctttcttttttttttcagttctgggatttgaaccctgggccttgcatatactaagcatgtgttctgccactgaagtcctctcttccattgcttcttacaggcagccctggaagcactagatgaattagacttgtttggtgtgaaaggtgggccacaatcagttatccatgtcctggctgatgaagtccaacactgccaggtaaagaaagaatggaccatatcatagcaagtcttattcttgctcagagtcagacttagcatgagatttagcttaaagagagcaacccatcttgtgactattaccatgtgatcagaaatgtctttatcaagcattctatagtgagataaacctgatatagcatgagctataatatagattatggatatcttagttagggttttactgctgtgaacagacaccacgaccaaggcaactctgataaaggacaacatttaattggggctggcttacagttcagaggtttagtccattatcatggtggaaagcatggtagtgtccaggcaggcatcgtgcttgagaggtaggtgagagttctatatctggtaaaacttcattcttagttttgtttataattgctccctatattgaaagtttcttttctctggtatatgaagtttctccctttcttcaaaccctgattatgtcctatgatatcccagtgaatataaattaaacttctaattttgaaaatagtttttgtggataaagtatgtcatggaagaagcagggagagcttttgtggctaggaaggaggctagtgggactgctgcgggggcagggagaattctagagaggaaatatgtgcaaagtgcaatgagacgtggctgcaaatagaaagaagcctagtattccccatacttgatgaaaattaatttgaaaacatctcagaagcatagcgatccttctctagtctgcccaactgctgtattttgtcttagttttattattttaaaatttttataatttttgtgtatggaatttttccctgaatgtatacctgcaccatattcattcatggtgctcatgaggccataaagagatgttggcattatggatggttgttagctacccaatcctctagaagaatagacagtgctcttaaccactgattatgtttctagcatctctctccctctctctctctcttttttttaacctagatgctagcaaccaacagaactgtgtgcatcccacagatgttagagtctttatctatgaacagcagctctgcaatcaggatggggaaacactgaaacaggattaagaaaagagatgctataccaagcaaactacttgtttaagagtctggctatttaatagagtttggcttattctttccgatatcttttgtttccacatcaatcatttggaaccaaagtttcactttaaaaccaaggtatttagtaacaaaccctattttgctacttttctcttagtctatcctgaattcactactgcccagggcttcaacatccaaagaagttgatgccagtctgctctcagtggtctctttcccagcctttgctgtagaggacagccatttggtggagctcaccaaacaggagatcatcaccaagcttcaggtatggccatgtgtgactttcttctctttagggctgtgacttgaaagggagattctaggggccatgagtgtaaacttatgccaggaacctcccctcttcctaggttacactctcataagtattttttttgtttgtttgtttgtttttacaaattgtcaaaagcttctgcagtcgttacaattgtaagtggtatatccacttaggaaaacagttggtatattcttaggaatttaaacatatatgtaacatgtgatccaacaaacatcctatctatgtactgaggttatccagatcttgatttttaaataatagtcttgataaatggttgatttgaggatcaaactagggatgatacaaaggatcctgaagcatctgaaaattttagaaggtaaaaacttcaaaaggatttgggtgtggctaggcttggtgggacaagcctttaatcccagcatctgagaggcagcatctgttaattcaacagcagcctgcagagtgagttcctggacagccaggacaacacagagagtcagaccaaccccaaaagaagacacttaatgtcaaatttcttcttgctgtagaagtcaattaacacagagactcataactggacaatgtgtagagagtgagagcctttgtattgctcagccctaaataggatggttttgtcaaagccctaagcacatgacccaggaacctatgtggaagaggacatagaaagagtttaggagccagagatgatgagtgactcaaagaaaacagtgacatctagacatgataggactgatagacacatgagctcacagaaactgtgacagcacacacaagacctgcacaggttcaaaccagacaaaatcctagcatggagaagggaaactagacacaaaattcacatccttcatagttacagtttctattgctgtgacaaataccatgcacaaaaagcaagttggggagaaaaatgtttatttggcttacacttccaaagctgtgttcttcattgaagtaagccaggacatgaattcaagcagggcaggaatccggaggcaggagctgatgcagaggacatagaggagtactgcttgctggactgatttgcatggctttctcagcttgctttcttatagaacccaggaccactagctcagtgatggccccacccacatgggctggtccctctcttatagatcactaattgagaaaatgccttacagctggatctcatggaggcatttcctcaatggctccttcctttcttatgactctagcttgtgtcaagttgacacacaaaaccagccagcacactgttgttaaacaagaagctatttgcagctggtatctgctaggaaaggaacaatcaattttctccaatggcgtgacaggggatatcttcatcacactccaaggcaggtcccatacccagtgttggggtttgggaattgacacttaaactaaataaacattgatctcagttaagtaagaatagtttattgaacacacaccataaaactggactttcaggacctcagaaggactcaggggcctaattgtagtattagtctgctcttcagggtagactttttataggaaaaactaggttaaaagttcaaaaggcaaggaggggagcagttggcttcttagacaaaatatcatcagctaacctttaatctgattgctcctgagtaagggaagggtggtggtggatgggtggtgaacaagggaatcagagcattagtattgtaatcataactttttggcttatgagtaacattcttcagtgtcagccagaaaaaaaaccccacagtgatacataggtgtaggaagtgctgccggtggccagctctgacttaagatagtttagatatcgagttcatattgaccttcaatttgataggtcctatgtaaaactttgtggaatttcttaagattagcaaaccacatacagaacatacagaatagacagggtatgtgctcagcatgtccttgagccaagtcacttctgtgttactaacctgtaggcatgttaaagcaacaagatgaaatagctagcaggtatggagcaaatggctacagatattctggggggagggaggtcagaccataacaccaggacaacacaaaatggagttttgggggggtttagtacttattattttattgctttttaaaattttattttgatgttcttttttgtttatttttctttcttagagagacaacataaagttgggtgggtaatgaggaggtagagaggatctgggaggagttggtggacagcaaagaaaatgatcaaaatatactatattgaaaaaaatgcacctgaaaaactgcaagagccagaggaacagggagttagctctaagattctgttttctaggaatatcagaagctgcacttataaattcttaccaacatgtctgcttaaacatgacccaaacccggggaaagcctacaaggcctctaagtcacacaaagaactacaagaaactaaggaatgggaaaaacagaagatgtcttccctaaggaagagcaaaccagtaccaagtgctcagccctgaaaacactcatatacaccatagagactgagcaggttgaatttatagatttaagaatacatgtttgtgtgtgcttgtgtataatatgtatgtaagtaacaatgattaatgaaaaaagagaccatgaatttgaaagagatcaaggaggagtgtatggaagagtttggaacaggaaggggtatatttatattactatctaaagaaaagaaattattttaaaaataaagtaccaaaagatatttgtaaacattaattatcaaagtattaaaacacattattaaatcaaataaagagcagtctttacccaatttgggggaatgataaaatgaaatgaaaagatgtgtaactttacttttttcaaaccttacttttaatgatggttcctaaatgctttaacctcccttgtagcccaccatacaccagagggaatgggaaaaaaaggatacaggggaagtggaagggacctatcatgccccctgaaagacccagcaagcagctgaaagagtcagatgcagatatctgcacccaaccaatggacagaagcagctgacccctgttgttgaattagggaaggctgaaagaaactgaggagaagggcaatcctgtaggaggaccagcagtctcaattaatctggacccccgagatctctcaaacactagatcaccaaacagacagcatacaccagctgatatgaggcccccaaaacacatacagtagaggacttctgggtctctgttcattcagagatgatgcacctaaccctcaagagactggaggccccaggaagtttagatggcaggtggggtggagagtggggacatccacatagagacagggggtggggaggaggtatggggtgtggaacagtcagagggtagatgggtggcaataaaatgtgaagtgtaaaagataaattaatttaaaaaaaataagaaattaaaaaaaaagaaaggttctttgaagcaactccagtctgtgttgtctggaaatcagcagttcatttcacaggttagcgggcaacttgatctgcttgtaaacacttcatggctacaccagcagtccagttcactagagttgggttaacaaacaggaatcagcagtggtagcataacctagcagagatagccaggcctcagcctcagcacaagtcagcaggagggaccgggagggacagcaggagaagttctccttgtgcctctctcagaagagagatcagtgaagactcgaaacccagaagcattgtacagaaacactgctctataagcaagccaagctcagcctctattactctgtagagacccatttataccctccaaatagcacgtgccttcaatcagtgagtccacagaagtggcaagaaactgccccacaccaacagatgttttttggtgcatttctctctatggagttctgacagatgcagctcaactatgcagcagatggcagaccaatacatgcatgtctttaacaaagaattcttcatcacatgtcctttcatatacttgccttagcagaacatcctctctcctgtgtctgcttcagggaaatgtccttcaggagtctggcttagcctttcacaactgtgtcctctttagcaaagtgttccttcccgtgtttgcccatccaaccaactttccaaagaacccttctgtttccacttcatagattaattactgataagtatgagaagaaaagaaagtaagtagaagacagaaagaagtcattctggaatagagtggcccttctgacttacactgtgacttatacataacttagaattgctgcaaaaatgagacaaacttttaggaaagagaaaggaatttccaaacagctttagtagctttgccacaacaatcctctgccaaatcacagcccaaacaagaaattctatttccttttggtgctctctcctttaccagcaaatattgcattgtttatgtgaaaacaagcaggcacacccattcgatcagttataaacagtcaaatgtagaataaaattctttgtttttatcattaaatactaaacagaaaaaagggatagttaaagtcgaggagccacagaaaccaactggaaaggaaccctgatgcacagagtgaagacaattaaaaaaaaccacttataactcaagtcttgtaactcaaagaagaaatgaagttacctctgagtctatacagagaacaataaatatagttacaagagtgaaagttatagtgaagaaatctaggatctgccacattaaacaaatgattaggtttaatatcaccattaataggacaagtgccctgtcaaacatcaactagattcagctagacttgccaggaacccccaggaatcctcccattcctgtctctccagcattggaatgataagaactgccaccacacctggctttccacctgggtgctggagatctgaacttaggttcttacatttgcacagcaaacacattacccactgggacatctcttgagtcctgtagtgtggggctttaaattggatcctagaacagaataataaaggacagtggtgggaaacccagtgaaagctaaataggctttataatttaattaatattagtatattgtaactatacttttggctactttattgggttcttattcctattcctctttccatcccaatcccttccaaaccccaacactaggtaggtgagaaagaaggttagagggaaaggggctgtagatctctttagactacttcctgccggttaggagttcctaggggcaagtcaaatttcctttgtcaggatatccaactagcaatccagcaaaacagcaaaagaggcagaggcagatggagcagcaggagcagcagcctctgagggctctgccatttttaatactctcttaggagctgcattactatggagtagactgtgcagtaattagcttgttgcaggtttggcctgaggtggacagccatggaaaagatactgctggcaatgctgctttgaagaagaacctataacaacacatttcttgcttgaaagggtattgctggtgctgctgagctgtctttgaatactatgcatttgtgagatgttgatacataaagatgttcgagaatatttcttcttaattatagagtcacacagatgtacaagattcagggcctttttctctgtccccagggtcgttatggttgctgtcgttttctgcgagatggatataaaactcctaaagaggtatgtttcttttcaccacagggaaatagggtggaattgttcttactctttgtagctttattcagagataacagttacgtcattgatggaatttttgcagatcattaaaaaataataagtgatgtttgctgtatttgttgggctttgctgccaagttctaacattgatggtaaataaactaacagtaaaatgtcaaaaaaataaatataaaaaggaaaggcattcttttctttcagctggttagtgtaaacacaagttttaaacacaaacagtgtttacataatctccaacccccactccaatatttaatcaatacaaatggaaaggcatcttttcatcagtacatctttttaactacctgtcatagtccattttctgttatcagtgacaaagtaccaaaaactgagtatagctcagtgctttgagggtcgcaattctattggcacaaaatgaaggggtccacatctgatgattgccttcttactgacagagtcccaagtgtggttcaagtaccttatggcaaaagataggaatcactagtgcgcctcttctggtctctctcctgacaaaaccagggatttagtctccactctaatggcctcattgaatcctgaatgctgctttggggaagaacctataacacacttcttgcttgagtgaatattgctgctactgctgagctgtttttgagtactatgtctgtgttggtgagagattgatagatgtggatgtctgaggatttggttctgcttaattacagattagtttatcaatggacctcattatccccaaactagtagttagaagttgcttcatagagcacttgccaggggaggggagtatgagtatgtacttactgcctttcctgatgctgtctttgaaacaaataggctgctgtaaaactcctattataatacctctaaactaaggatatacgtctaatctctgagtgacaggacagcctttgtctattatatttttattcaggatcccaatcgcctatactatgaaccagctgagctgaagctatttgaaaacattgagtgcgaatggccattgttctggacatactttatccttgatgggatcttcagtggcaacgtagaacaggtaatgatctgggagaagagctcttagcaagctgctcttgtattgtcttttgactaatggctgtatgtttttactgactaagtgggagtcttcctatgagggaagagatggagttgtctcctagatacttatagctgatagtagtgaattaagagttgggagactcagattgttcttttcttcaatcctgaccattgagtaatccaagtatagtcattaagttcttcagtttcagtgtctctgtaggtgaggaaacattttatttttcattaaagattatcaagtaaggatgttaaaataggtacaccaatgtaactataagctgatgtcgtctggaaacttaactctttcttactgttttgtactaataagtgctggtttcttattttgtaatgcttactatttgtgctttaataagcactggcttcttactatttgtgttttaataagtgccggtttcttactctgtaacttactatttgtgctttcataagtgttggtttcttactctacctctgttgcttaaggacctctctctggccaggcaagaggcttcgattcatttaactcttcatgaaccaggaagaaaagaaagaaaatcttttacataggcaatatgcacagatacacatgcactcatacacacacaaattttggtcgggcccaaccacatgtcccatcagcttcataagtattcatacatacacacatacctacacatatatgtaaataaatatatataggcaaacagatatatgtacatttgaatggatggggcagagcccaccaagctaccaccttatttcttctctctggcctatttatatctttttagacaaaagttctttagaaaattacctcatagataaaatgttacaaaaaagaggagttacagaaggacattgaaagtcagtacaaaggagtgttttcaatctctatcgtttgtttgtttgtttgttttttggttttttgagacagggtttctctgtatagccctggctgtcctggaactcactctgtagaccaggctggcctcgaactcaaagatccacctgcctctgcctcccaagtgctgggattaaaggcatgcaccaccaccgccaggctttttttattttatttattttttatttttttaaatctctatcattataagttccaagcaacagtttcacatggtctcactttatcatagtatacacctgtggcttcatctttcaatctgacctagaatgaatgtttttctttggttacaaatttgtcccaagcccatttctctctttagtgtacttgtgaaagctcattgtattctttattatgtatcctttacttactattttatgaggagtgggtattttttattcttaattctaactttattatatctttttggcaaagcaattaaaataatctcttaaacctttcttcctaaaattattttaatcaaattagaaattctataaaagcattaattcgtctagaaagcattaattcatgaaactttatttttatgttgatatgcaggaaatctgctcaataggtggaattctaggaatccttaggctatgtaataatgacaggagaggcatatcagtagcaagaagcaatcctggaatgaagtctccaacgaccctgctcactcattcttaaagctcacccatcataggccatacagaaatgtgagccaccttcaggaaactcacctgctagccttaacctatcctcaatggatccggacaggagaaaaagaaggttggagaagaaagagaacatatatctctttagactacttcctgctgattagggatattaacttcattaggacaagtcaaatctttgtagtcaggatatctccaacttgttccggtctctctgctgtttttaattaggtattttcttcatttacatttccaatgctatcccaaaagtccccccataccttcccccccccactacccttccccctactcccacttcttgaccctggcgttcccctgtactgaggcatataaagtttgcaagaccaatgggcctctctttccaatgatggacgactaggccatcttctgatacatatgcagctagagatacaagctctgggggagtactgtttggttcatattgttgttccacctataaggttgcagacccctttagctccttgggtgctttctctagctcctccattgggggacctgtgttccatccaatagctgactgtgagcatccaattctgtatttgccaggcactggcatagcctcacaagaggcagctatatctgggtcctttcagcaaaatcttgctagtgtatacaatggtgtcagcgtttggaggctgattatggggtggatccctggatatggcagtctttacgtggtccatcctttcatctcagctccaaactttgtctttgtaactccttccatgggtgttttgttctcaattctaagaaggggcaaagtgtccacaatttggtcttcgttcttcttgagtttcatgtgttttgcagattgtatcttgtatcttgagtattccaagtttatgggctaatatccacttatcagtgagtacatatcatgtgagttcttttataattgggttacctcactcaggatgatgccctccaggtcgggtccaacagagtggttgtaaaagcttgcaatcccaccaacaatggaggagtgttcctctttctccacatccttgccagcatctgctgtcaccatttgcctaggaatttcataaattcattcattttaatagctgagtagtactccattgtgtaaatgtaccacatttctgtatccattcctctgttgaggggcatctgggttctttccagcttctggctattaaataaggctgctatgaacatagtggagcatgtggccttcttacaagttggaacatcttctggatatatgcccaggggaggtattgctggatcctctagtagtactatgtccaattttctgagaaactgccagactgatttccagagtggttgtaaaagcttgcaatcccaccaacaatggaggagtgttcctctttctccacatccttgccagcatctgctgtcacctgaattttttatcttagccattctgactggtgagaggtggaatctcggggttgctttgatttgcatttccctgatgattaaggatgttgaacattttttcaggtacttctcagccattcggtattcctcaggtgagaattctttgtttagctctgagctccatttttaatggggttatttgatttactggggtccagcttcttgagtgctttgtatatattggatattagtcccctatttgatttaggataggtaaagatcctttaccaatctgttggtggcctttttgtcttattgatagtgtcttttgccttacagaagctttgcaattttatgaggtcccatttgtcgattctcgatcttacatacagcacaagccattgctgttctattcaggaatttttcccctaagcccatatcttcgaggcttttccccactttctcctctataagtttcactgtctctggttttatgtggagttccttgatccacttagatttgaacttagtacaaggagataggaatggatcaattcgcatacttctacatgataactgccagtttggctgggtatagtagcctgggctggcatttgtgttgtcttagtgtctgtataacatctgtccaggatcttctggctttcatagtctctggtgaaaattctggtgtaattctgatagccctacctttatatgttacttgacccttttcccttactgcttttaatattcaatctttatttagtgtatttgttgttctgattattatgtgttgggaggaatttcttttctggtccagtctatttggagttctgtaggcttcttgtaagttcatgggcatctctttctttagttttcttctataattttgttgaagatatttattagccctttgttgaaatttttcattctcatctactcctattatccataggtttggtcttctcattgtatcctggatttcctggatgttttgagttaggatctttttgcattttgcattttctatgattgttgtgctgatgttctctatggaatcttctgcacctgagattctctcttttgtctcttgtattcttttgctgatgctcacatctatggttccagatctttcctagtttttctctctccagtgttgcctcactttgggttttctttattgtgtcttcttccctttttaggtctagtattgttttgttcatttccatcacctggttggatgtgttttcctgtttttctttacggacttctacctgtttggttgtgttttcctatttttctttaaggatttgtaactctttagcagtgttctcctgtatttctttaagtgagttattaaagttcttcttgatgtcctctatcatcatcatgagatatgcttttaaatccgggtctagcttttcgggtgtgttggggtgcccaggtctggctgaggtgggagtgctgcgttctgatgatggtgagtagtcttggtttctgttagtaagattcttacgtttgcctttcgccatctggtattcgctggagttagttgttatagttgtctctggttagatagagattgttcctctcatgattctgttagcctctatcagcagacctgggagactagctctatcctctgagtttcagtggtcagaggactctctgcaggcaagctctcctcttacagggaaggtgcacagatatctggcattcggacctccctcctggcagaagatgaaggccagaaacgggacctgtcccagaagctgtgttgctttggcctgtcacagaagctgttagcttctgtagtccacactctcacctgcacagactagtctcagagggatccgggaatcaagatggctcccccaggtgctctggcaaagccctcctaggcagggcggacacctctcctctggcagggaaggtgcctggatgtctagagcctgaaacggggtctgtctcagaagctgtcctctagggaccttggtgttgtccgccgactcagtgcccaaggtgaccaggtgctggcacctaccagaagggacttgtgaccctggtcaggttgggtttcctgctttcctaatgctgtctcaggtcccacgcgattggattggaacagaagttgtgttccactcactggtggtcctaagatcatgtggagagtcctctagggaaccttgggggtgtccacctactccgcgcccaaggtgacccggtgctggcgcctaccagaagggacttgtgaccctggtcaagccgggtttcctgctttcctaatgctgtctcaggtcccaggcgattggattggaacagaagttgtgttccattcaccggtggtcctaagattgcctggagagtcctctaggggaccttgggtgtctgccgactctgcgcccaaggtgacccagtgctggtgtcaactggaaggacttgtgaccctgcctgatctctctgtttacaaaactttgacaaactgcaacaacagcagtcaggagcagcagctgcctcagagtgtcccaggccatctcagaactctggcatttatatcctctgaagagtccccagaattccaaatgtaaactatctgcagctggcaaaaccatgtcactgctaatgcatgaggcaaatcataatcactcgtgaagcagccacttctcccacacctgggattaaaacaaaaacatattcatggaacataaataaccaggtttttgaagaaaccaaaactcccacttacatttcccccatttagtccaaaatggcttttttctaacatcaataaactatatgcaataagaacaattatgagaactatcaagtaagaattttgtttacaatgtccagtctatatgtatttggcagtcttgaagaaagcactgcactatctatcctatcctattgagtctaaagttttgaatctaaattactttcataaatttcttctatcaaactataaacatctttttaaaccttaaagcatttccttagattctaaacaacttaagcttttctgtgtttaatctttaataaggaagattgtaagactgttaactatatagtcttcaaccctgtcagcgacctgagtaagcaggaagttccaagcaagcagcttccaaaactgtagaggttcttcatgcccaacattttctttgaagaagattggggggtgcttccaggagcagatgtgttgctctgtgaaaaaaacccttttattattaaaaaatctttttattattaaaccaacttaaatgccatattctctagatctctgaagtgtttgcagaccacctatttatcccagtatatcttaatagccaaacattatttgcttctagctatttactctctgtttaactttgaaaacatatacaagactaaataaagcttatttctgtaattaactgaactagtacctaacaagacaacaaagtaagattatttataggtgactaactacttactaacttacatttctaattatcctaaacagtttgcaatagtagctgttataagactagaactttacattacatttttaagtgagttgtatatgtacaatacattaagcaagatttgaacaaaataagcttaaatttctaacaacaatacaataattcatatcaatgtaaaatacttgagagtagtagatttagtaatgtaccttttatcctgtcatactgtacttcttgctgctgagccttgagctggggccacaaagcaaaatattaatagcaaaatattatatagtatatccctcctggctgtaacaaaaggatggaccatctagagactgccatatccggggatccatctcataatcagcttccaaacactgacaccattgcatacactagcaagattttgctgaaaggacccagatagagctgtctcttgtgagactatgctggtgcctagcaaacacagaagtggatgctcagagtcagctattggatggatcacagggcccccaatggaggagctaaagggatctgcaaccctataggtggaacaacaatatgaactaaccagtaccccgaagctcttgactctagctacatatgtatcaaaagatggcctagtcggccatcactggaaagagaggcccattggacatacaaactttatctgcctcagtacaggggaacgacagggccaagaagtgggagtggggggggggcgtgtgggggacttttgggatagcattggaaatgtaaataaaataaatacccaattaaaaaaaaagtatatccctcctgtccctgcactcacttgttcagtgggaagcatctacaaactctgggaagcctcagctttcttactgaggacacattgctcccagaaagggctcattagtgtctgtggacaaagtactctgtttctcagagttaatacacaggctattttgatctctgagacttttagcggcttggttacagtttcttttcaaatgaccaaatttaccacagttgaagcactgggaagggtagtggtagtaatctcataaccccagactgccgctctggtgcagttggttagaaagataagcactggagaagccaggaaaagttaaacacacagctggagtctcctaagggagaagatatttggctgttctcccagaagtgctggggaaaaatgtagtttacagcctggtaatcctttggtacctgttgagccagtctcctcccatatcacccaggatattatgcttgtttatcccagactcctaaatccttgagcattacttcttggccataaaacttaccattgtgagagatgtcatttgtaatttataacaagctcagtaacttttgtgttgtattatgttcatttccattactctccttagacccttatcctgagcattgtttctgaagtcaagaagaagtcatcttacagataaagccctatgtatgccctttgtaaagaacttcagtgtgaacacgtcttaagcttttaaaccctgtattcacagggctgagttaattgttatttgattttttccaaaatagagctgtatttaaatatggctaaagtaaaatgaactgggtcagactcgagaagtcctgggccaggactggttaccaaaattgggctgatcctagtttcattcttactttaccctgatcatttttcactgcttgccttaaagcctctaggaacccctccacaatactcaaaccatgccccaatctattaaacacatttggacaaatttgtgactttgtcaatatcctatttataccatgaagcagcttggatgaagctattgtgttaaagaactatgtaatatgttttctgccataaattataggtgtgtgttgtgtgtgttcatttttgttttacttcttttgagcccaaggccttgtgtatgtatatactaggcccactgagctgtatcctgacccttcccttttatatagtttaatgtattattatgtttcagcaaatgctaagtaaataacataatcctaacataataaataacataacagcagccaaatctagagaggagagatgacaggggtaatgggaaggtatttataatcaaagtatagtgacatatacatatgaaatgtcataacaaattccattattttatatactaattaacaaaagtaattcataaaaatgtaggtttaaaatcctagtcaatggtctggagagatttctcagtggttataaacatttgctgctcttgcagatgaccaaagttcagatcccagcacccacatcagaaagctcagaaccagttccaggggatactaggccttcttctgacctcagcaggtgtgtgcacatgcacatgtgcatatacatgcaaacacaaacacacactcagatggatatacatgcataaataaaaataaaacttaaaaagaaatgaagtatgagccaagttaaggacttgtgagatagctccatgattaagaagagcacataatggttttccagaagacccaagtctaattctcagcaaactttgtcataaggttcacaacacttgtaggtggtacagtcacgcctccaagggtacatgttcatatactcacacaaaaacacatatgcatacatattatttttaaaaaaataatttttaccatggatagtggcacatatccttaatcctaatacatggaaggcagaagcagacagatctctgagtctaaggccagcctggtctacagcatgaattccagaacaggcagagctacatagtatgaccctgttttcaaaacaaaacaaaagcaaacaaaaagcatcatttacaagtatttttaattgaaatagaattgtaccacattccccacgtcctttccttcttcatacccctcccagcttctgtctttcaagcctcacccaacttctctcaagttgataccttctttaaaacaatacatgtttacagacaaaagtcagggggctggagagatggctgctcttccagaggacctgtgttcaatttccagcacccacatggcagctcacaactatctgtaactccagttccaggagatctgacatgccctacacagacatacatgcaagcaagacaccaatgcacataaaaaataaaatgtatcattaaaatttttaattcaaaaattcttagtaaattaagtgcttattagtaaactacaggtttggaacctctttaaacataatccttatgttgatggacttcaattgcaaatacctactacaatgaaatgcatattaaatgcattaaaatatgcacaatttccatgatacatttaatgagtacctaccttagttaggatgctactgctgtgaaaaaaccccatgcctaatgcagcttggggaggaaagggtttatttccatatcctgaattacagtgcatggagggaagccaaggcaggaactcaaacccattaggaacctggaggcaggcgctgatgcagaggccatagaggagtactgcttactggcttgctcctcatgccttgctcagcctgttttctcatagaaccagagtaagggatcttggaatcaggacagaacacacccagacaccaaatttttcgcacaaaggaacagtttgtgcaggagtggtttataaagagagaaaaggggaagccagtgttcggatgagttggtgtgccctgattggacatgttagccagtatagccaaataatagaatttgattgttggaccttgtcattttgactcttgaaccttggtgatcagtctcaggaatgagtcagtgactaaataagggaatgtacattgggagctagctttcggaaagtaatctaacagtttagcaagagagagggtaaggggaaggcgaggcctgccagtgtcatggttgcaatgcttgagcctgttaaaaagctatttacccaggaccactagcccagggatggcaccacttgcaatgggctgggctttcccccatcaatcgctgactaagaaagtgctttacaggcttgcctgcagcctaatcttatggaggcatttttattttccactgagggcccctcctctcagatgattctagtgtgtatcaagttgacacagtaccattctccctttcctttcctttttacttggttaaataagctctgttgtaattgtgctttttttttctttatccttctgctctgattcccatataaagtctctaaaattttggttttctacttttcttttctttttctgcaggttcaagaatatagagaggctcttgatgcagtcctcatcaagggcaaaaatggagtccctcttcttccagagctgtacagtgtccctcctgacagggtgagttggatagtgctggaccattgacgggaaaggaaccatgtttctatgatactgactcatctgagtcacggtgtttgtgactttgtatcttgggactttaatattctaaggttttggttttcacagtaggacaacagaaacaatttccttcagaaataaattgttaaaacagtctcaattatggtgctgttgtacaatgagatgtaaatgaaagcagatataaattctgagaatgatgtacagatcagtatgtggaaccagagtggtgttccgtgtcagcttgttatcttctgaagccagtaatcttaagatggctggtgtaaatcagacttagaaaaatcagacttcgccattgtgaaggagaattagacatggtagcaatacagccttacattctggtggggatttggagaacatttgctaacagcatccagtgtcacctgagaatttattacaaaaactttcatccacacctaccgtacctattcagtctgcattttcataagatttttgggtgatctgttcatatatcacatcttgaacactgtcctacttagcttttcaatccattgcctataaactataaatcaaactagacgccagtcttttatcgtctagtgtcttaagctttccagtattgcctctcatttgacctctttatctcgtcatttaggttgatgaagagtatcaaaatccccacactgtggatcgagtccctatgggaaaattgcctcacatgtggggtcagtctctatacattttaggaagcttgatggcagaggtaagggaagatttcaaagctatcccaccttttattggtttgtttaccatagtcactataataatcagatttgcaatgagctgaagtcaaaggatttcttcatccttttatactttgacttaattacagcctttcctctagcttgtctgcatgggctatggccattgcttgacaaaaagttcttgctccctgtctgttatgctgcccatagctccctacttgggcattgtacttggtgctgttcaggaatcaagttgtgcatctttccctttcaaaactcccctaggtgacttgcctggtgactaagcaattactggtgatagattaaatgccaaccttcctaagcatcataagattttattccctaattgaattaagtgatcattcggggcactttgacttgcttggtaataacaatgtggtctttctgttttgttagttaatgggtttttgttgttcttattgtgtttttgtttgtttgtttttgttttttactttttggaatggaacttccaatgtcaaactctgttaagacagctcttaatgaagcacaattttgtatccagtttctgggggttgcattttgagcctacacagaaggctatttcttctaaaaaagttttctagtcctttctgaaaactctattttcaacactgtaggttatgtttaagagccaaggtcttactatgtagcagtagtagctggtcttgaacttgccacatagaccaggctggccttgaacttgcagtgattcttctgtgtttgtttcctgagttctgggattacaagtgtgttctatcatgcctagcatggctgttttgatgtgagagacccaagttcttagagaatctagtttggaacttagctggcatttctgagtaagatattttcctgtttatatggccatttattttctacagctgtgtttttgttttgttttgttttgttttttccctgtggccatggctgtttgataatcttgaattgacatgactttggatttagcaataatgggcataatgcttcaaagtaatccgtgtccagtaactttcttgtctgacaataaatgaaatgggacaaaaaggaaggattcagtattatcaaggaaaaagatgagtgagctcattttatttaacaacatatggaaactaagtaaaaagatttccactaatcaaaatgtacagcgggcacatggacaaacaagcaaacagtgcttactatcaatttttaaaaatattttttattattacgtattttcctcaattacatttagaatgctatcccaaaagtcccccataccctcccccccactcccctacccacccattcccattttttggccctggtgtttccctgtactggggcatataaagtttgcatgtccaatgggcctctctttccagtgatggccaactaggccatcttttgatacatatgcagctagagtcaagagctccgggttactggttagttcataatgttgttgcacctacagggttgcagatctctttagctccttggatactttctctagctcctccattgggggccctgtgatccatccaatagctgactgtgagcatccacttctgtgtttgctaggccctggcctagtctcacaagagacagctatatcagggtcctttcagcaaaatcttgctagtgtatgcaatggtgtcagcgtttggaaactgattatgggatggatctctggatatggcagtctctagatggtccattcttttgtctcagctccaaactttgtctctgtaaccccttccgtgggtgattgtttctaattctaagaaggggcaaagtgtccacactttggtcttcattcttcttcagttacatgtgttttgcaaattgtatcttatatctcgggtatactaagtttctgggctaatatccacttatcagtgagtacatatcatttgaattcttttgtgattgtgttacctcactcaggatgatgccctccaggtccattcatttgcttaggaatttcataaattcattctttttaatagttgagtggtactccattgtgtaaatgtaccacatttttttgtatccattcctctgttgaggggcatctgggttctttccagcttctggctattataaataaggctgctatgaacatagtggagcatgcgtccttcttaccggttgggacatcttctggatatatgcccaggatttaacatattttgagaattccatgtatgtgtgctgcttttatattattttcacttcttgctccttttcacatacagagactgccaagtccatttagtggtacttatatgtgtatttaggattgaccacttgggactggataccctgtcagggggctcattcctggagaagactggttctccctgtctcagcagccattaattgcctatagatctttgtctagagtccctgagatttttctccattcatgttgccatgtctattggtggtgtcattgtggaggccttacttaggtgaccgtggtttttaaactttcatgcatgtatgcagcttccctgtcatatataggaagtacaatatattgcagcagaagtcctggtcccctagctctcaaaatccttccacttgctcttccattatgttccctgagccttaggtataggggtaatgtgcattttgtctataggggttgggtaccccaaagtcatttgttctctgcattttaaccacttgtggttttctgtaatggtctctgtctgctgcaaagaaaagcttctttgatgagtggtgagagctacatgtacctgtgcggataaggatgggtacttagaatccagttaggaattaatactggttcaggaaagtggcagtagtaggttctcctctaagttcgtgaccccaacagccaagggtaattggctaggtttccagtattagacatgggttccttcctattgagtagtccaattcgacaaccattggttgcctctatgagataagtacaaatattggacccttggggctatcttaccatactggtcgtaattgtggttcataggtttcaaaactggccaggactattgattgttttcctcccttggcagtttgtttagcacttttggtcgttagaaggctaattatgaggtaggaagctttctggtcagttccagcttaattccttccagtcctgtgtctaaggatatggtgtcttcagctattagatctcaccttaaagttctgtgaggcaaccaaggaaaatagcagtagcctacatttatactgtggagcctctatctctctctctgtctgtctctgtctgtatctgtctctgtctgtctgtctgtctgtctgtctgtctctctctctctctcattctctctctctctgcttaaagaaatataaaatgtttccctttggctcttccaaacatgtttagtattatttatccctttgccatccttctccctttccagttaaatctccaccccctatttttcccatttccctctttttaaaaaacattacattaggttgtttttccctcatttatctgttatgccatataaacatatccagaaaagatagtggaataaccagaaacttcctatttatttataatttataacctgcttttcttctaaaaaataaggatttgtggcacccactaaatataaaccagacaaaattaatttggagatgaattctgggttttcaagcatttttatacagagcaactgtttgtcttttgtcatttccccctaaaatactaactttactttttttttaactatttttaaattttattttattattatttttatttgcttactctatgtgtggatgctttttatactatgtaccatatgtgtatagtgcctgtggagggagaagaggcatcagcttacctaaaactggtattagacagttgtgagcttccaggtgggtgctgggaatggaactcaggtcttctggaatgccagtctacatacagggtgctatctgaggggatccaggaggctctggcccagccacagcagccagagggttacagctctctgacaggaagccagagtgtggtgggctgctgggcctcttctgtggccacagcttccctggagttggtgacagacagtggaatacagcagacatctaggggccaaggtcagggccaccaagcttgtggaagtggctgtggtcaggttcacacacctgtctggttgggctatgtcgaggtccagctttgggagggaaagcttttccctggagtgttatagcttgataaaagaggcactctcagatgatctttattccctgtagataggaacttataaacctttgggggtaggttgggatctagaggcagatgctttctagtggcttggtttgagatattaggaatgcctcatctgcttgtggaaggacttcaggtattgtcccttatgtgactgattgtgatggtcctctcaatggggtgtcatggttatgtatgccaggacaggaacccggtcaggaatatatttaaatgcctactaaacatgtactgttctcaatgatgagaattgcaggggtttctgaatatgctctgccttacttacatagtccactgccccacactggaagagcagccagtgttcttaactgcagggccatctctccagtgccccagctttatttttgaggcttattaattttgtttttatggatttccttcagggatttttagctcctggagaaattgatcccctgaatcgtaggttttctactgtgccaaagccagatgtggtggttcaaggtatgtattactcttagcaacagaaatattgtactaaaggtctgattaggcaaagagatttgggggctttgtgttgggcttcaagtctgtaacaaatttggtttagtttggtttcaaaattgctgttaataataaatcaatgaaagatgatctcagaggattgtaaaattctttttgacatacctcatttctgggaattattttctctaaaattccatgacattttattccactggttactgttacattcttttaaatcacattttctgagcttttgctgctagtatacctttcttttcataacctcctatgcattaacatcctgcctgcattaggctgttaaggcctgtttccctcatagtacatttgtttctaatcattacttactaggaagtatatctaaaagttttctgttaagaattaacttaaatgtgagagtatctacagtatgcaaacactgaactgagttctctaaatattaagaatccaagtagggctggagagatggcccagctgttaaaggctaggctcatcaccaaaaatataagaatccaagcctttggctgggtgtagtagtacatgtgtttaatcccagcagtgggaagccagaggcaggcagatcactgaattcaattttagcttcttttatatcaggagttcaaggctagggtttctattgctttcaagagacaccatgctatctactatttttatccttaatatttttaaatatccacgacgctagtaccctctaattagggctggcttacacttcagaggtttagtccattattgttatgatgggaagcatggcagcatgcaggcagacaggatgctagagaggtagctgagaattctacatccagatcagcagacaacaggaagacagagagactgggtctgacttaagcttctgaaacctccaagcctacctccagtgatacatttcttccaacaaggccacacatccaaatcctatcaaataatgccatgctttacaaacctatgggagccattttcacttaaactatcacagagatcctgtctgaaaaaattcctagtcagaatttcaatgaatgaactctgtgttaaacacaaaaaacacaaagctggtctctttcctatctatccttcttacttcccccaaagttgttgatatttttaccttccttgtttctttcaatatttccattatcctggtttttggttttagacatcttgatgtgaattttcattcaacatcactcttcaatatggtgtcaagttctactataaaaattctttaagatattcctagtcatttggatttttgattctgtatggaaaatcagcctattttctaaagctgcttatacttgattctctgtgtgataatataggtggtctttgcttcttgttgctactagcaatgagaaactattgttcttcatcccccataagaaggcatgttttcctctgaggtttaaacgttcttgctatgctgatcttctatttgttctaattcatatatttatgactttgaagctcaactcacagtcttctttctcctcccaaaattctgtcataaaactagatttcagcattggtgtaggtgatagctactatttttacccttaatatttttaaatattcatgacactagtaccctttttctgtatctctaggttacataccatgtcttggttacttttctattgctgtgacaaaacaccatgataatttggggcttgcagttccagaggttagagaccatggccaagatgacagggagcatggcaacaggcaagcatgatgctgaagcagtagctgagggcttacatccttatctgcagttaggagacagacagagagacagagagaggggagagagagagacagagacagagagggggagaggagagagagaatatgaactaactgggaacaatgtggacttttgctacctccactgacacgcttcctctgaggaggccacatctcttaatccttccctccagctgaggactaagcacttaaataaaggctataggggcccttgtcattcaaaactccacacaaaccatgggtcaaacttttggaccttataggtgtgtcattcttgtgttctgctaacaatggatcatggcttttccctccttcctatttgtttctgattcctcctagtctattcttttctacctcatgtttgatcatctgaatatcccattcaccattgcatcatattgtttctctatctaccagaactattatagttcaagcttaattgtataggctccactttctgatcctaaacctactaaaaagcatgatggggaaaaatacatgagaagcagagtggtggcagtgggtgtccatagtctccaactcagcttcccagtagattttgttcttattattagacagcattttcatatttttcagctatgccctttgttttcagcctattattcagactgctatttcatgccagatcattttcatattctgatgtcttttagtttaccaactctcccaccccaataatcttacccatacatacttgcttccttttctttctcctattcaagacgaattcccctattggtacttgatcctataatcttctttacaaataatctgttttgaaatattcagatttccccatttcagtttctttatctattgttatattaatctccatctggatttcagaggtggcttgttttcacattcatgtttctgcctctttataatccattaattctccagttcgttatagtgtggtttaatactcaaatactcttgcttagttttcagaggccttggcattgtcagtcttagatattttataatcagtatattagcagattttttagatcaacttgtcatatatctttctagaaacttaatttctacaatgttcatgatgatatatgtatttgtagatcttcttcaatctatttgaagtacttttctaccttattcttggctttctcttttatttcccttgagctgttggtattcctgagagttctgtccatagcctatcatttgtcttgttctgaataatgggtcacgttcccgaatctcatttcaaaccctttctcttttccctcacccccacatgatgaccccatgttctctgccatagaaaaaaataagacatgatacaagaacttcccccttgtcccaggcttatccttatcaatctattcctgagttttctcaaagtgatattccacatcctcttttcttgactttatattctcttcccatctcatctgtttctaatgacttctgacttgaatgtgtctatgcactgtagactcaactaaaacagatcagctggatcctcctaatataccagctaatcctgctatcccttctgtgtctgtatcattaaatactcccagcacagggaaatgaacacccaaagaacacctttcaattcctatttattcctctctgatttcctgtgtttatataacaagttctggctcctttacttcccaagtcactctaaaatccatcctgttttgacagtgtcagtagcgtgattgtaatgtaagctatcaacacgcacacccccccttacttcactgctttccttttgaactgatatttctgtctccagtctaggcccaatacagtcagggagtttcttattttgttttttaaaaatcactgttgcctacacaaagaaacgtccattcattctttaattattaacttgagtgtactctttttaagatgcaacatgggtatattattcctctgcaggaacttcctatttcagttcttttgacatggcttacaaagactctttgtagtttactctatttctctttactgctccttcacagtcattattcctactacaaagaacttggtttacaggctgagggtgtagcttagtggtacaagtgactggctgtttgtgaaggcctggctccattccccagcacaacaggaagcaaagcagtgaaagccaactttgtaactttgttcatgctgtgtctcttatctgaaacagattctcttttactcttaccatcacctctatcagattaacttctttctgccctccatcaggactcattttgtccattatgtaccccttgcatctgacatcaaactctcagtattttataaatataaacaaaaatttagttgcttgggttgaatgtactcccggaaactcaaagggctgtttaccttgattctcctttagtccattttactcctgtaaccaacttattgctccctgtagaacccttaagttttatagaatgcagcttgggaaacaatgcccaacaataatatacaaaaccttaaagtaacacctatccttccatgatgagctaataaccctgtctaccttttcactttcatttattttactgcttagtaaaatcatgccataacattgaagcttatatagtttgctgctgcctccccaacctttagactagaataactatcctcttgtgatttaatttttttaaaaaagcatatcagtaaggcccattggacacgcaaactttatatgccccagtacaggggaacgccagggccaaaaagggggagtgggtgggtaggggagtgggggtgggtgggtatgggggacttttggtatagcattggaaatgtaaatgaggtaaatacctaataaaaatggaaaaaaaaagtaaaaaaaaaaaagcatatcagcattttgcttgcatgtgtctttgtgtggcaagtgagtgtctggtgcctatggaggccagaagaaggcattggatcctctcttcattacggtttacattatgaccaaggcaactcataaacaacaacatttaactggggctgactaacagattcagaggttcagtccattatcatcaaagtgggagcatggcagtgcccaggcagacgtgggactgatggagctgagagttctatatcttcatcgaaagatagacaggagaagactagcttccaggcagctaggaggagtgtctcgaagcccacccacacaatgacacacttcttccaacaaggccacacctcttaatactctctgggccaagcatatttcaactaccacatttcctctggaactggatttaaagaattttgtgagccaccatgtaggtactggaaactgaacctgggtcctctggatgagaagctcctcttaactgatagtgagttgtctctccagcactccattcacctttccaatttactcatgatttcaagtgcagttagctaccagctctttcaggctactttattttacttgattttttaaaatttaataatatagttgttttatttgaatatacatctgagcaccaacatgtgtttctggtgccctcaaatggcattggatcccctggaaatggagttatagatggagttataagccatatgtacagaaagatattggtaactgaatctgggtcctctagaaaagcagccagtgctcttaactactgagccatctcttctgcccccaagtctacctttcttgaagccaaccttcctaactccagactaggtaaatgccacttctatgtggtctcatgatattctatacatatctccatttacctaggaggtcattttctattgaattcatatgcccctctaccataacactaagagattcttacaggagaaactactttattcatctctatatctctagtaccttaaccaccatccctgcaaacccacaactgtcaggcctgtatacagctgactcagaccttcctcctcagtttactctccttcttccattgtctagctataggacaactctggtgtttcagatgttctatactaccctcatactcctagcactgacattaagtgtacgtatattgaagagcctggacagtcagctttcaccagcactatcagaaaaagactcatgattaaaatttcccatttcaacatggaatctgataaatacccaaagagccatccagtaggcacatatagatacctaaccaaaaagctcagtctcatattctaatcatgttttttccttcctagttatgtaatttttaaaatctagaataatccctgattcattagaattcctcaataatactttcctctttccctctccaaagaaattatgcactttaaaatatttctaggggtctggagagatggctcagcaattaagagcacttgttcttgcagaagactcaggttcacttctcagaacccacatggtggcttataactgtatataaatccaattttaggggatctgatgcactcttcagacctccatgggcaccagacgtttatgtggtccatagacatgcttgtgatcaaaacactcatacacatcaaataaataaatctaaaagatatttttaaagtttctattgaactaaaaatcttctgttgacctcatcttctttctttcctatagtctccattctggctgaaacagaagaaatcaaggccattttgaaggacaaaggaattgatgtggagaccattgctgaagtgtaccccataagagtacagccagctcgtattctcagccatatttattctagtctaggtaaggagattgactagtgttatgtgatgctggctgattgctttccattccccatcctgactcccacttctttagcttgtaatgctttattacattggaatccaagtttctgaactaatgttttatgagcaggcttaataattttaggtgtgtgttttttttagatttatttattattatatgtaagtacactgtagctgtcttcagatacaccagaagagggagttagatcttgttacggatggttgtgagccaccatgtggttgctgggatttgaactctggaccttcggaagagcagtcgggtgctcttacccactgagccatctcaccagcccccatttaggtgtgttttatacatactttggtatgcaggacaagtttgattccagacaatattatatccttcttctaaatgtatagtcaactagcatgttttccactttctcggaaactatatttctgttatgaatacatgctaattttatatagagtagtaatcaaggaacttattttatgctttgttgtgtaatgaactaattattaaaaaattaatacccttttctaaatagttatatttattctttttattaaatttaatgatggaattttatattaaacaaattactgcactgttaactaacaaaaaaatatgggtgctggtagtctgtagctcagtgacagaccccttgtatatactgtgtatactgaccctgagttccaaccttattaccaaaaaataaagggatatgcaaatttctgaactacctttttttttctttttttttttttaattttttattaggtatttagctcatttacatttccaatgctataccaaaagtccgccatacccacccacccccactcccctacccacccactccccctttttggccctggcgttcccctgtactggggcatataaagtttgcgtgtccaatgggcctctctttccagtgatggccgactcggccatcttttgatacatatgcagctagagtcaagagctctggggtactggttagttcataatgttgttccacctatagggttgcagatccctttagctccttggctactttctctagctcctccattgggagccctgtgatccatccattagctgactgtgagcatccacttctgtgtttgctaggccccggcatagtctcacaagagacagctacatctgggtcctttcagcaaaatcttgctagtgtatacaatggtgtcagcgtttggatgctgattatggggtggatccctggatatggcagtctctacatggtccatcctttcatctcagctccaaactttgtctctgtaactccttccaagggtgttttgttcccacttctaaggaggggcatagtgtccacacttcagtcttcatttttcttgagtttcatgtgtttaggaaattgtatcttatatcttgggtatcctaggttttgggctaatatccacttatcagtgagtacatattgtttgagttcctttgtgaatgtgttacctcactcaggatgatgccctccaggtccatccatttggctaggaatttcataaattcattctttttaatagctgagtagtactccattgtgtagatgtaccacattttctgtatccgttcccctgttgaggggcatctgggttctttccagcttctggctattataaataaggctgctatgaacatagtggagcatgtgtccttcttaccagttggggcatcttctggatatatgcccaggagaggtattgctggatcctccggtagtactatgtccaattttctgaggaaccgccagactgatttccagagtggttgtacaagcctgcaatcccaccaacaatggaggagtgttcttctttctccacatccacgccagcatctgctgtcacctgaatttttgatcttagacattctgactggggtgaggtggaatctcagggttgttttgatttgcatttccctgatgattaaggatgttgaacattttttcaggtgcttctctgccattcggtattcctcaggtgagaattctttgttcagttctgagccccattttttaatggggttatttgattttctgaagtccaccttcttgagttctttatatatgttggatattagtcccctatctgatttaggataggtaaagatactttcccaatctgttggtggtctttttgtcttattgacagtgtcttttgccttgcagaaactttggagtttcattaggtcccatttgtcaattctcgatcttacagcacaagccattgctgttctgttcaggaatttttcccctgtgcccatatcttcaaggcttttccccactttctcctctataagtttcagtgtctctggttttaagtgaagttccttgatccacttagatttgaccttagtacaaggagataagtatggatcgattcgcattcttctacatgataacaaccagttgtgccagcaccaattgttgaaaatgctgtctttcttccactggatggttttagctcccttgtcgaagatcaagtgaccataggtgtgtgggttcatttctgggtcttcaattctattccattggtctacttgtctgtctctataccagtaccatgcagtttttatcacaattgctctgtagtaaagctttaggtcaggcatggtgattccaccagaggttcttttatccttgagaagagtttttgctatcctaggttttttgttattccagatgaatttgcaaattgctccttctaattcgttgaagaattgagttggaattttgatggggattgcattgaatctgtagattgcttttggcaagatagccatttttacaatgttgatcctgccaatccatgagcatgggagatctttccatcttctgagatcttctttaatttctttcttcagagatttgaagttcttatcatacagatctttcacttccttagttagagtcacgccgagatattttatattatttgtgactattgagaagggtgttgtttccctaatttctttctcagcctgtttattctttgtgtagagaaaggccattgacttgtttgagttaattttatatccagctacttcaccgaagctgtttatcaggtttaggagttctctggtggaatttttggggtcacttatatatacgatcatatcatctgcaaaaagtgatattttgacttcctcttttccaatttgtatccccttgatctccttttgttgtcgaattgctctggctaatacttcaagtactatgttgaaaaggtagggagaaagtgggcagccttgtctagtccctgattttagtgggattgcttccagcttctctccatttactttgatgttggctactggtttgctgtagattgcttttatcatgtttaggtatgggccttgaattcctgatctttccagaacttttatcatgaatgggtgttggatcttgtcaaatgctttttctgcatctaacgagatgtgaactacctttgcaagagactgaataaccatccttccctcaaaatatccgggttctgatctttagtacctatgaacattacattatatggcagaaataactttgcaaatgtggttaaattaaggaacttgagataagaacgattgaggtggacctcaaatacaatcatagggacaggacaggctacagaagcagctgtgatatatttggggtttattagaatgacttacagattgtggtccagtgactccaacaatgactacctataaaagtaaggtccatgcatccaggtagtgttttagttcacaaggctggatgtctcagctggtcttcagtgtacactgaaatcccaaaaaaagtaggctctaatgacagtgaaaaaagagaaagcaggcaaagagagcaagtttccttcttccatgtggatatctatccattgtacaactgcaaacacatcataaatttagaataagtggcaacgtcacttgagggccgtcctcttagtatctcaaacgtaagtatgctaacaattgatattctcttaattgatgttacatggcctgataaattgaggaaagacctgggtggtgatggtccatgcctttaatcccagcacttggaaggcaaaggcagcctggactacagagtgagttccaggatagccagtgctacacagagaaatactgtcaaaaacaaacaaccaaaaacacaaaataaagaagaaattgaagaaagaaaacacaaatgcattcttaacaaaatatgacagaaatactcatgtcaattataatcctcatttttgcaactggtcacatggccttagctggtatttaaattatcttctactatgcattctgtatatcctccactctcagcaagtccctgaggtcttgactctttttctggacgagtgaccaattccctcattcttgaagggtctgtgttctttgtcatcttgccagaattacgtgcttatagtttcccattggcaacatagaagatggtaggacctagagacaccctgaaggatctcctacattccagacataatctttcttagctctattttggagaagcgatccaatttccccctggtaatctggatcaatcacccatcctaagactggcattactttcttggcctgttggcttaaggtcaccaaaaacccaaagttgccagtacagggtctaagtttacagttcagttgaatatttgttatggttcctggcaggaatgctccctcaggctggaaccaaaacttctaggccagaagaattagaggtcacaggaacaggaagcaaaaattttcctactgggtcactagggggttaaagtaagtggaactaatcccttttctatcccttgattcctggacccatggatccttgctatggttgtaccatatactagatgctaattcaaagcatataccaccttttggagaatcctgtcccagcccttgaggctgctgccacttcattggcatgtaactttgtgttcaaaagactattccacctttcttcctttttcaaaatttttattagatattttctttatttacatttcaaatgttatccctttcctagtttactctctgaaaatcccctatcccctccccttgcttcccaacccactcactcccattcctggtcttggcattcccctagactggggcatagaaccttcacaggaccaagggcctctcctcccattgatgactgactagaccatcctctgctacatatacagctagagctacaagttccatcatgtgttttctttgataggtggtatagttccaaggacttctgggggtactggttagttcatattgatgttcctcctatggggcttcagaccccttcagctccctgggtatttctatagctccttcattggggatcttttgcttcatctaatggatggctgtgagcatccacttctgtatttgccaggcactggcagagcctcagaggagacagctatatcaggctcctgtcagcaggctcttgttggcatctgcttagtgtctgggtttggtggttgtttatgagatggatccccaagtggggcagtctctggatggtcgttcattcaggctctgctccaaactttatctctgtaactccttccatgggtgttttgttcccccttctaagaaggattctgagcttctgggctatcagtgagtgcatgttttgtgagttcttttgtggttgagttacctcactcaagatgatatcctccaaaatatcatgaatttcatgaattcattgtttttaatagctaagtagtactccattgtataaatgtaccacattttctgtatccattcctctgtatagggacatctgggttctttctagcttctgactattataaataaggctgctatgaacatagtggagcatgtggccttattacatgttggagcatctgctgggtatatgcccaggagtggtattgctggatcttctggtagtactatgtccagttttctgagaaactaccaaactgatttccagagtgattgtaccaccttgcagtcccaccagcaatggaggagtgctccgctttctccacatccttgccagcatctgctgtcacctgagtttttgatcttagccattctgactggtgtgaggtggaatctcagggttgttttgatttgcatttccctgatgattaaggatattgaacatttttaggtgcttctcagccattcaatattcctcagttgaggattctttgtttagctctgtaccccatttttaatagggttgtttagttatctagagtccaactccttgagttctttatatatatattggatattaaccccttattggatttaggattggtaaagatcttttcccaatctgttggttgtcttttggtcttattgacagtgtcctttgccttacagaagctttgcaattttatgaggtcccatttgttgattctcaatcttacagcacaagccattgctgttctgttcaggaatttttcccctgtgcccatatcttcaaggcttttccccactttctcctctataagtttcactgtctctggttttatgtggagttctttgatccagttagacttgagctttgtacaaggagataagaatggatcaattcttattcttctacatgataaccgccagtttagccagcaccatttgttgaagatgctgtcttttttccaatggatggttttagctcccttgtcaaagatcaagtgaccataggtgtgtgggttcatttctggctcttcacttctgttccactgatctgcctgtctgtcactgtaccagtaccatgcagtttttatcacaattgctctgtagtacagcttgagttcagggattgtgattctaccagaggttcttttattgttgagaagagtttttgctatcctaggatttttgttacttcagatgcatttgcaaattgccctttctaacttggtgaagaattgagttggaattttgatggagatttcattgaatctgtagattgctttcggcaagatagccattttgactatattaatcctgccaatctatgagcatgggagatctttccatcttctgagatcttctttgatttctttcttcagacacttgacgttcttatcatacagatctttcacttccttagagtcacaccaaggtattttatattatttgtgactattttgaatggtgttatttttctaatttctttctcagcctgtttattctttgtgtagagaaaggccactgacttgtttgagttaattttatatccagctacttcaccgaagctgtttatcaggtttaggagttctctggtgaaatttttggggtcactaatatatactatcatctgcaaatagtgatattttgacttcttcctttccaatttgtattcctttgatctccttttgttgtctaattgctctggcttggacttcaagtactatattgaataggtagggagagagtgggcagccttgtctagtccccgattttagtgggattgcttcaagtttctttccatttagtttgatgttgactactggtttgctgtattttgcttttgttatgtttaggtatgagccttaaattcctgatctttccaagacttttatcatgaatgggtgttggactttgtcgaatgctttctcagcatctaatgagatgattatgtggtttttgtctttgagtttgtttttatagtggattactttgatggatttcagtatattgaaccatccttgaatccctggaatgaaacctacttggtcaggatggatgattgttttgatgtgttcttgtattccgtttgcaagaattttattgagtatttttgcatcaatattcataagggaaatctacctgaagttctctttctttgttggatctttgtgtggtttaggtatcagagtaattgtggcatcatagaatgaattgggtagagtaccttctctttctattttgtggaatagtttgaggagagttggaattaggtcttctttgaaggtctgatagaactctgcactaaacccatctggtcctgggctatttttggttgggagactcttaatgactgcttctatttctttagggggctttttagatcattaatctgatcctgatttaactttggtacctggtatctgtctaggaagttgtccatttcatccaggttttccagttttgttgagtatagccttttgtagtaggatctgatgacgctttggatttcctcaggttctgttgttatgtctcccttttcatttctgattttgttaattgggatactgttcctgtgccctctagttagtctggctaagggtttatctatcttattgattttctcaaaacaaacaacaacaacaacaacaacaacaacaacaaaaaaaacagctcctggtttggttgattctttttttctttttcttttcgtttttcgatacagtgtttctctgtgtagccctggctgtcctggaactcactatgtagaccaggctggcctccaactcagaaatccacctgcctctgcctcccaagagctgggatcaaaagctacaggcaactaatggctgggaaatgagtgagaaccaggattctctggggacaaccccttgataggttttctgatcccatattgtcagccttgaacacatacatatagacaacattaaatggactcaataagatgtgcttttatgggccggtgagatggctcagccgttaagagcattgactgcttttccgatggtcctgagttcaaatcccagcaaccacatggtgcctcacaaccacctgtaatgagatccgacaccctcttctgttgtgtctgatgacagagacagtgtacttatgaataataataaataaatcttttaaaaagattgctttatatatgcatatgcatgtatatacacatatgtgtgcatgtataaaaataataataaagaggctatgagtttgaatgtgaggaacagaggagttcaaaggagtgaaaaatatgcaaatacagtatttgtgtgaaattctaaaaaaaaaaaaaaaaaccaaagttaaaaaaaaaaacagatcagtagggatactggactcacaatacatgcatatacatagaacaaaaagaagtctttttttcaagttaaacatagaactggtatatatttcaggaattctaagtatatgcacaaaagggaatggaatgagaacgatgaatagatattttctacattattcgccaatattgtttataatagccagaaaatgtgaacatctgcaatgttcatcaacaattgaatagaaaagcaaaggttgctggcaagatgactcagcagttaagagcactgactgctcttctgaaagtcctgagttcagaaatcccagcaaccacatggtggttcacaagcacccgtaatgagatctgacgccctcttctggcgtgtctgaagacagtgtacttatgtgtaataataaataaatctttaaaaaaaagaaaagaaaagaaaagaaaagaaaaggtggcatatacagggggtggaatatgtgacctgggagggaaactttaatatgtgctattataagtatgaactttgaagatactgtgctgattgaaataaaccaattagttataaaagaaaaggattctagtcaatatcagatattttgagtagtcaaattcatagatgcaaagtagaaatttgttgtcagagactgggaggagaaggaaccttagtgtttaatgggtgtggagtttcagtttggagacatgaaatagtctggagaggtgaatagcggtggcatttacacaatgatatattcaaaggaagttactaaactgtacacttaaaatattaaaatgataaattttatgttacacataaaataatactatcaaaggccctcatgatggtaaaagcacttgtcacttaagcctgataacttgagtttgatcctagaaactctaagtgagttcagtctcagacccaaaggattgagcaccaactcacaaaggttgccctgtggcctccatgtgtgtcatgtcatgagtgtgcatgcacacatacacaacatatacaataaataatcattaagatcttactaacaagaattcgtgaataaaactggttttgctattaatcctagagcaaatatgagagttattcagtggaacttggaatatggccaaggcattgagcattctctggtctgttcctttacaagttgaagcaactctgaaaatgtaatgtttgtgtgtgggggtgtgtggttaataggtaaaactcttcccttataatcatgaggacttggcgtctttgattccctgaatatatatgaaattgtcaggaatggtatgcatgcttacgatcccaacagtgaggtgcagctcactcactgttaagcaagtctagcctaattggtggattctccgtcagtgagagacccaagctggaaaggagatgaattacattgatgaggatgacacctgaagggttccacttgcctgcatatacttacacatgttcgtgagaaggttcatgtccgtgcagttaacaaatcaagtacttataaaaatatagtgtagccaaaatcatgtagtaggggttctctcagtagtgacaagaaagaatagtcaacatatcttggaggtaaacagttttagaacaatatgtgaagtatttttcccctctgatgaaggaaaaatttatgtcagtgaatgaacaattcccttattgtaccttaaacaatatttaatgtagttttctatttatatataatatatagttatatatgtatatagtttatttaacacagatatggattgcgaggtagattctgattttagaaagctaaactgtaaaaggaagacatctcaaactgaaggaaatgaggtggttgtgagtctatgcatatatgtacattgtattatctgtattaataaatactgctttaatttgtacactaagaatttcctgatcgtttctcaattctgtgtcaggatgcaacagtagaatgaaactcagtggacgaccctacaggctcatgggtgtgcttggaacatcaaaactttatgacattcgcaaaactatctttactttcactccacaggtgagtgggataagctgtaaaattcatagagatgaatggaaatgagagagagagggagggggaggggagagggagagggagagagaatgagaacacagatcacagaagcaaagcatttgctagaattggattagtcagagtcccacagggccttgcatatcttaaatggctcaataagtgtttgttgaattgaaccaaattgaacttgcagcatagaaaattgccaagtgactgttattaccaacagtagtcccgggtggtaaattgtgtttgggattttctaaatgttcaggtccttacacagtttttcttattttttggaagttaaatgaagactgtatttatcctttataagtgaaacacagtcgttttatttaagtgctaaattaagtttttcctgtggggaaggagccctttcatttgcatagaaaacttcagtgccctttaaagaaaaagatcaggactgttaagctgtaattatacatattggcggcctgacatttgttagctacataataatagatctaagttcaattgcacgtgggtatggtagtagaaatgattttctggtgccacatgcttgtaatcccagcacttaggagggtgaggcaagagacttgtgttcagagcctccaacctgagcaacatggttagcaaggtcattatgaactccacaggagtattctgtctcacccaagagctgaagctcgagctcagggctgagtattccctaagtatgtgctaggaccagggtttagctctagcaccacagtgaatattttctgaaaggaaaatttaagtaccttgtcatatctaaaacagtgcagctgagacaaacataaaaaatgatgaagtgactctagactcatatttctgatttttccatttgctaatgagatgtgtgtgctagttcatatactgtctctgagtctttttcttcatattaaaagaaaaacagcaagttgggaatagtggtgaatgcctgtaacccaggactcaggaattctcaagcagggggttatgagttcaaaccagcttaggctgcaaaatgagaaactagggagaaaaagaaaagggaaggaggagctgcctacactaggtggttataggattaaatgaaattacatatttgaacagatttctaggcactcacacacttcaaaattatcagaaactattgtgcctactattggccaacatgtactttagaaattattagccactaaatttgagagtactgggttttttttttctgtgatatgtatgccttataaataaatgaacattgaaaaatattatttgatatttgtgagagcaaaacttcctgaacgatggtttttttcttttctcagtttatagaccagcaacagttctacctggctctggacaaccagatgatagtagaaatgctcagaacagacctttcctacctctgtagccgctggaggatgacaggccagcccacgatcactttccctatctcgcacaccatgcttggtaagggctgaataaagcaggaaagtaagtcacatgtgtagttagttcttcagtgtcccactgtagagctacttcttacagtagtactcaccagttttctaaactctgcacagagtgggtgataggcaggtatggtttctgctctatttaagcttatgtttcaggaagtgaagacagtaagtatgaaacaaatggatacctaagaatatatagctttgagagaataaatagctttccagaatgatttttgaggcacttttccaaaaaaactgtattctacaattcttcttaaagacagtactagtacacctacatctattttatcccagtggatcatcaagatttctagggaagttcccaagttctctcgggaagcttgtcttagggaaacaggaaggtctagcatggggaaagtgcaaaggctttcggtttgtactaggggcaaggagaggtgcttcctcacaaggaaagactctagtgttctgagctcctgcaggattaaaagacagaggctgtttctttctttctgtgtctctgctgttgcttccaaaggactgcatgtactgccaaagtgcataaaattctgtttcattaaaaagaaccatttatcatgaatcatttaaaatccagacagactgggaagaattttggtcgcatctgaaaagggcttaaaaattagaagagaaaaagagctgagaaagtagggtagtctttgttctttttgtctttttcccttacttgagatgattaacaagtgtctgtttaataatgaatatattctcacaattgtcttcaaatagtacacagtctaatttagaaggcaaagttaatggatgatgatgatgatgatgatgatgatgatgatgataataataataataataataataatagaagacaaattcaagacagtagattaggaagtactgaagcactgaaggttaccacagtgccaaagaaaaaattcagctgatgtgagacttaagtttttggaattgcttttatttttttctttttaacaagattttaatatatgtgagggtacatatatgtccacagagatcaaaagagggcattgataataagccaactgaagccaaattaaagtataaaggcaggtttattgggggcagctgatctcacagggggaggtcagggaagtttgccccacagacaggaaaacagaaaaggggatggggtgcagagagagaaagtgcactagcactacaaaggaaaaatgcagatagaggccaaagtgtctgaagtatataatgaagacctgagcctctggcttggaaacttcagggtagaaggcaaagtatgtcagccaggccttgaacagggattctgggagaacatgaaggccaggtctgctttagtatgttaaatatgcacctccgcgccccttctcctgagtctgaaacccagcaggtatcagatcccctggttttgttaagcacctgatgtggtggtgggtggtggtggtggtttcgagacagggtttctctgtgtaaccctggctgtcctggaactcactctgtagaccaggctggcctcgaactcggaaattcgcctgcctctgcctcccaagtgctgggatcaaaggcgtgcgccaccaccactattaaattgttaatcttcacataggaggaggaaagaagaatgagatctcaactgggtttggggctgccttgagtgaggcctggagagaggaatgagcctgtgtgtgaggctggtgacaaggccaacttgaacatattagagtactatgatgaacaaaactggcaaagtaaggtaggctcaggttatgaagacatacttcgaaaatcagcagagagatttaaaacaagttatattagaagttacataagaggttgaagctttccaaagtttttgagtaaggagtgatgtggggagaccctgccaacttgttcagatgctcctctgagctctgcataaaaatggaggatttcctttaccagctggccttgccctgtctggggaacctgaccctccccccactgtctccctgcagaacgttgggtgtagccttgttgagattacatgtttaagcttcctttctcccaataagaacctgtccaacaactacctgaaattcttggaatgcctctccaggcaaacaaggcattcttcagtatgcaaactctagctaatgaaacttactcaccctgaaaaccctgcccccttcaaaagaaccaaaaaacctgatataccacttgatttagtccaaataaagttaggctttctctttgaagataattgtcctcatggctggtggccaacaacctctggggagaagggaggaccacagaatgacatgaaacaagttgtatttagtagattttagttgttgacaatagttctgttgtcacagtacactaacatcaagaaaacaagtgaccatgtgaggtgaggagataatattctgcattggtggtattgaaaattgaagaaagatgatacaaagccattttgctttgttctgtttgatgtttcctttcttttcttttgctctttaattcttttgacgcagaattctactctatggccctggctggctacaatctcactaagatgatttgaactcatagcagtcttcctgctgtagcctcccaaatgctaagatcacagccatttgccactatatcaagctattttattccatgtgtttattcttgttttgcttgatttacatatggatgtttgtaaatatttatatatttatttatttgttgtatgtgcacatacacaggcatgtagtggctcttgtgtggaagtcagagaacagtttgcagaaattgggcctctccctctatcatgtgggttccttggatcaaactcaggttatcagtgttggcagcaagtgcttttacccgttatgccatctcactttctcagtttgatttctgagactaggtcttatatagtataagctgtcatcaaacatgatatatagcaaaggttggctttgaactcctgatcttcctatatctacctctcaagtactgaaattacagatgtgcaccactatgcctggcttttattggtttttgttattttgttttgtgttttgaagcaaagtctcacaatatactcaggctattgtggagctcattatataaatcagcctggccttgaactcatggtcctcctgcctctgcatcctgagtgctgtcagaaagaacaaattggaaaaggcaaatcacaagattatcatcagtttcataaaaaggaggtaattagtacccttctaaaggattttaagtgtatatatacacattcacacatacatttgcacacaccaaggctcattgtgagtgataccatctatgagatacttatcataatgataatcccaatgatgcaaggcgaacagacactgacccatatcatcatggtcagattaatgaaagcaagcaattaattaaagcaagctctttttattcatgtgaataggctgcctccccctaaagtgtggtttaagaggtcagccttggacatgggcaaggtatggcttttatcagggataggaggtttccaaatgggggttttgacagactaataggcggggttacaggaacagcataacaaagtagtcataacagccttttgaaacaaaggtaaggttgcacgatggtcataacaactttttgaaacaaaaacatgattgcaatgtcctggaacaggcagtacaaacccatttgtagttaaggttataggtgggtgggcatagtccagtccttgagaaacaaagatttgattataaacaggaagtaacctagtttacctttaatataagataactttcaagcctaagatggaggtgggctggttcatcaatagtatgtgtcataaacatttggtaaatagtgctgggtacttgtgataaacaagataattcctttgaagaacgtaatctttaccacttgtccattctacagcgatgttgattctcacattaatagttgaagcacagagtacctgtacgatgttagtttgaaataattgaaatatttccccttagttctaagataaaatgacaaataattgttttttttttaaatctttccttttaaagatgaagatggaaccagcttgaattcaagtatcttggcagcactccgaaaaatgcaggatggctattttggtggggccaggtaattgacatatatatataccctgaaccaggagagatggagcacaagaaactgtcagtaatgcttagccctacttataatatgagaaagttaaatttagatccaaatagatgctgaaacaacacatacaaatataagaattcactgcagtctttcccaagacatcattcctgaaagcacttgaggtgggttagtcattatgaacgatatgctctcagttttagtgctgttcaccaagtgtcttcagatccttttggtgggtcaaaaatggggtcttacatctggcccagggcttgggccactggatgaggtggattcagggagtttgactgcggcacccccacaaaactgcaggtcaggtgtcgggctatgtgaagccacaggacccctttccagatatggggaaggcacagtctgaggtccccgtggacctgccggagtggagtagggagttgggctcagactctcaggtaacacagatgctgctgggtaccacaaaagagccggttcgggggtccctgggctgcaagaaggccagggacttcaggttctgggtctttgacaccacagacactgctggatgtctcagaagagctgagaacagagcgggggagggggcacaggcagactctggcccagagcctgaagggaaaaggggcagggaggagagctttggctgggttccttagggaggaaagtccttggcttgctcattggtggcttgggttgtgactggagtgcagggaggcctcccagtgggaggttagatacatggcttgttaggggaagacctgctccattgctcctgcatggtggatcccaatgaaaagaggcagtccatagttttaaggcatttattgtagaaaatcagagagggggagagagtagagaagcagaggtgagccatggccacatggagagaggggcaaagggaaggcagagacagggagagcaagggagcaagagtaagagcaagagaataagaggataagagagggaggagggggcaaacagctccttttatagtgggcctggcctacctggctgttgccaggtaactgtggggaggagcatacctggctgttgccaggtaactgtgggggtggagtccagacagaataccaggagcttggggcattgcctacatgactgatggccacacatgcctctctgcctggtgggggcaggagggtctttgggaggctgtagccggaacaggagccagggtcccaggaggtgtggctgaacacctgcagtcccttagcatcaccagggttcaaggtctgtgtttgaccaggaccaggctgtctgtgcacagctcactgccctataccttttctcaaaagtctttgagcaaatggtgctggcttccattgattcttgcatgcaagacttattactaagtcttgcgcgcgcccaactggccaggaagaacgacgctgcaacaggatccttctgcacacgtttattcagtcctgtttcttcttgtttatatctcccttgtttatatctcccttgtttatacctcccccgaaccctgggcctctcactcttttatactctcagttcccatccacgcacagcaggccacgccacttcaccaggcacgcagcttcagctaatcagggcagcaggggcatatctccatcaaaatggattcgccggtatcctggtacacctgcgcagctctcaagatgtttgtggcttatatgaggaagtcaggtgcaagtcatacgacttagctgcagtccctagcgcctttgggactgccgccacacccgttccccacatctccgttataaaatagtcttctagaaatttgtctgcatatatacatatatataaaccaaggttcatttgacagtgtttctatcactttgtgtacatctagaattagaattcttatataaaaaaacttattttgtggcttatgattaatatatattctttggattcttattttattcaacatgtcatggcccattcttttttttttttttttatattttttttccattttttattaggtatttaactcatttacatttccaatgctataccaaaagtcccccatatccacccacccccactcccctgcccacccactccccctttttggccctggtattcccctgtactggggcatataaagtttgcaagtccaatgggcctctctttccagtgatggccgactaggccatcttttgatatatatgcagctagagtcaagagctccggggtactggttagctcataatgttgttccacctatagggttgcagatccctttagctccttggctactttctctagctcctccgttgggagccctatgatccatccattagctgactgtgagcatccacttctgtgtttgctgggccccggaatagtctcacaagagacagctacatctgcgtcctttcaataaaatcttgctagtgtatgcaatggtgtcagcgtttggatgctgattatggggtggatccctggctatggcagtctctccatggtccatcctttcatctcagctccaaactccgtctctgtaactccttccatgggtgttttgttcccaaatctaaggaggggcatagtgtccacacttcagtcttcattctccttgagtttcatgtgtttagcaaattatatcttatatcttgggtatcctaggtttggggctaatatccacttatcagtgaatacatattgtgtgagttcctttgtgaatgtgttacctcactcaggatgatgccctccaggtccatccatttggctaggaatttcataaattcattctttttaatagctgagtagtactccattgtgtagatgtaccacattttctgtatccattcctctgttgaggggcatctaggttctttccagcttctggctattataaataaggctgctatgaacatagtggagcatgtgtccttcttacctgttggggcatcttctggatatatgcccaggagaggtattgctggatcctccggtagtactatgtccagttttctgaggaaccgccagactgatttccagagtggttgtacaagcctgcactcccaccaacaatggaggagtgttcctctttctccacatcctcgccagcatctgctgtcacctgaatttttgatcttagccattctgactggtgtgaggtggaatctcagggttgttttgatttgcatttccctgatgattaaggatgttgaacattttttcaagtgcttctctgccattcggtattcctcaggtgagaattctttgttcagttctgagccccattttttaatggggttatttgattttctgaagtccaccttcttgagttctttatatatgttggatattagtcccctatctgatttaggataggtaaagatcctttcccaatctgttggtggtctttttgtcttattgacggtgtcttttgccttgcagaaactttggagtttcattaggtcccatttgtcgattctcgatcttacagcacaagccattgctgttctgttcaggaatttttcccctgtgcccatatcttcaaggcttttccccactttctcctctataagtttcagtgtctctggttttatgtgaagttccttgatccacttagatttgaccttagtacaaggagataagtatggatcgattcgcattcttctacacgataacaaccagttgtgccagcaccaattgttgaaaatgctgtctttcttccactggatggttttagctcccttgtcgaagatcaagtgaccataggtgtgtgggttcatttctggatcttcaattctattccattggtctacttgtctgtctctataccagtaccatgcagtttttatcacaattgttctgtagtaaagctttaggtctggcatggtgattccgccagaagttcttttatccttgagaagactttttgctatcctaggttttttgttattccagacaaatttgcaaattgctccttccaattcgttgaagaattgagttggaattttgatggggattgcattgaatctgtagattgcttttggcaagatagccatttttacaatgttgatcctgccaatccatgagcatgggagatctttccatcttctgagatcttctttaatttctttcttcagagatttgaagtttttatcatacagatctttcacctccttagttagagtcacgccaagatattttatattatttgtgactattgagaagggtgttgtttccctaatttctttctcagcctgtttattctttgtatagagaaaggccattgacttgtttgagtttattttatatccagctacttcaccgaagctgtttatcaggtttaggagttctctggtagaatttttagggtcacttatatatactatcatatcatctgcaaaaagtgatattttgacttcctcttttccaatttgtatccccttgatctccttttgttgtcgaattgctctggctaatacttcaagtactatgttgaaaaggtagggagaaagtgggcagccttgtctagtccctgattttagtgggattgcttccagcttctctccatttactttgatgttggctactggtttgctgtagattgcttttatcatgtttaggtatgggccttgaattcctgatctttccaaaacttttatcatgaatgggtgttggatcttgtcaaatgctttttctgcatctaacgagatgatcatgtggtttttgtctttgagtttgtttatataatggattacattgatggattttcgtatattaaaccatccctgcatccctggaataaaacctacttggtcaggatggatgattgctttaatgtgttcttggattcggttagcgagaattttattgaggatttttgcatcgatattcataagagaaattggtctgaagttctctatctttgttggatctttctgtggtttaggtatcagagtaatagtggcttcataaaatgagttgggtagagtaccttctacttctattttgtgaaatagtttgtgcagaattggaattagatcttctttgaaggtctgatagaactctgcactaaacccatctggtcctgggctttttttggttgggagactattaataactgcttctatttctttaggtgatatgggactgtttagatggtcaacttgatcctgattcaactttggtacctggtatctgtccagaaatttgtccatttcgtccaggttttccagttttgttgagtatagccttttgtagaaggatctgatggtgttttggatttcttcaggatctgttgttatgtctcccttttcatttctgattttgttaattaggattttgtccctgtgccctttagtgagtctagctaagggtttatctatcttgttgattttctcaaagaaccaactcctcgtttggttgattctttgaatagttcttcttgtttccacttggttgatttcacccctgagtttgattatttcctgccgtctactcctcttgggtgaatttgcttcctttttttctagggcttttagatgtgttgtcgagctgctagtatgtgctgtctcccgtttcttcttggaggcactcagcgctatgagtttccctcttagaaatgctttcattgtgtcccataggtttgggtacgttgtggcttcattttcattaaactctaaaaagtctttaatttctttctttattccttccttgaccaaggtatcattgagaagagtgttattcagtttccacgtgaatgttggctttccattatttatgttgttattgaagatcagtcttaggccatggtggtctgataggatacatgggacaatttcaatatttttgtatctattgaggcctgttttgtgaccaattatatggtcaattttggagaaggtcccgtgaggtgctgagaagaaggtatatccttttgttttaggataaaatgttctgtagatatctgtcaggtccatttgtttcataacttctgttagtttcactgtgtccctgtttagtttctgtttccacgatctgtcctttgaagaaagtggtgtgttgaagtctcccactattattgtgtgaggtgcaatgtatgctttgagctttactaaagtgtctctaatgaatgtggctgcccttgcatttggtgcgtagatattcagaattgagagttcctcttggaggattttacctttgatgagtatgaagtgtccctccttgtcttttttgataaatttgggttggaagtcgattttatccgatattaaaatggctactccagctcgtttcttcagtccatttgcttggaaaattgttttccagcctttcactctgaggtagtgtctgtctttttccctgagatgggtttcctgtaagcagcagaatgttgggtcctgtttgtgtagccagtctgttagtctatgtctttttattggggaattgagcccattgatattaagagatattaaggaaaagtaattgttgctcccttttatttttgttgttagagttggcattctgttcttgtggctgtcttctttttggtttgttgaatgattactttcttggttgttctagggcgtgatttccgtccttgtattgcttcttttctgttattatcctttgaagggctggattcgtggaaagatattgtgtgaacttggttttgtcgtggaatactttggtttctccatctatggtaattgagagtttggccgggtatagtagcctgggctggcatttgtgttctcttagtgtctgtataacatctgtccaggctcttctggctttcatagtctctggtgaaaagtctggtgtaattctgataggccttcctttatatgttacttgacctttctcccttactgcttttaatattctatctttatttagtgcatttgttgttctgattattatgtgtcgggaggaatttcttttctggtccagtctatttggagttctgtatgcttcttgtatgatcatgggcatctctttttttatgtttgggaagttttcttctattattttgttgaagatattagctggccctttaagttgaaaatcttcattctcatcaattcctattatccgtaggtttggtcttctcattgtgtcctggattacctggatgttttgagttaggatccttttgcattttgtattttctttgactgttgtgtcgatgttctctatggaatcttctgcacctgagattctctcttccatttcttgtattctgttgctgatgctcgcatctatggttccagatctctttcctagggtttctatctccagcgttgcctcgctttgggttttctttattgtgtctacttccccttttagttctagtatggttttgttcatttccatcacctgtttggctgtgttttcctgcttttctttaagagcctgtaactctttagcagtgctctcctgtaaatctttaagtgacttatgaaagtccttcttgatgtcctctatcatcatcatgagaaatgtttttaaatctgggtctagattttcggttgtgttggggtgcccaggactaggtggggtgggagtgctgcgttctgatgatggtgagtggtcttgatttctgttagtaggattcttacgtttgcctttcgccatctggtaatctctgaagctagctgttttagttgtcactgttaagagcttgttcttcaggtgactctgttagcctctatgagcagacctggagggtagcactctccttagtttcagtgggcagagtattctctgcaggcaagctctcttcttgcaaggcaggtacccagatatctggtgttcgaaccagactcctggcagaagttgtgttccactcactagaggtcttaggatcacgtgtggaatcctgtgtgggcccttgcgggtgtcaggcgactcagctggcaaggtagccggggctcgagtggagtggaaggggtttgtgccccagatcaagcccgggtagcctgcttccctatgtaccgcagtctcaagttccacgcgattggattggggcaggcactgtgatccactcaccagaggtcttagggtcccgtggggagtcctgtgtggacccttgcgggtgttgggcaagactctgctggcaaggtagcccggggctcgagtcccgagtcgagcggaagggacttgtgccccagatcaggcccgggtagcctgcttccctatgtaccgcagtctcaagttccgcgcaattggattggggcaggcactgtgatccactcaccagaggtcttagggtcccgtggggagtcccgtgtggacccttgcgggtgttgggcaagactctgctggcaaggtagcccggggctcgagtcccgagtcgagcggaagggacttgtgccccagatcaggcccgggtagcctgcttccctatgtaccgcagtctcgagttccgcgcgattggattggggcaggcactgtgatccactcaccagaggtcttagggtcccgtggggagtcctgtgtggacccttgcgggtgttgggcaagactctgctggcaaggtagcccggggctcgagtcccgagtcgagcggaagggacttgtcatggcccattcttgtcattatttcttttatttttcaaattatccaaggtctggccattggtagcccctttaagctggcttccttagaaaattaataccactaggcagatctctgagttcaaagccagtctggtctatcaagtaagttccaggagagccagggctacacagagaaaccctgtctcaaaaacagacaaaaaagaaaattagtagtactaacttcatttggagttttggaattggcttattaagtagaaactgatatggctcaacttaatttattacaatgtatataattttcagatactgtcttttatgtccaaaatggtcctttgatagtattttaaaaactttttgagatttctttttatttttcttctatgtgtatgggagttttgcctgcaagtatgtctgtgcattgtgtgtgtgtgcctggtacctacagaggccagcaaacggtatcagatcccttcaaattggagttagagacagttctaagccattatatggttactgggaattaaacccaggtcctttggaagagcagtcagtgctcttaaccacttagcagtctctccagcccgatagtatttttaaaatgatgttatagatttgtgtgatttatcctcattccccatctatgtctctaatagctaatacaggtttttagcagacattcaacatagtgtacagcaatggaagaacatagaaataatctgttggaggactgtaaactttaatttgtggcctttcttttaaaatctccccaacatgcttaaaatatgcttagcattcctttatttacaagtgtggcttatttgttcctctgtttaatttttggagttgagcaaagggttttgttcatgctaggcatgtactttaccaattgagctatactgctaaaattgtgttactttaaaaaagatattctctaagtttctttttttctctgtaccctgtaattgtaaggatccaaacaggtaaattgtcagagtttttgacaacatcttgctgcacacacttaagcttcatggaccctggacctgagggtaagctgtacagtgaagattatgatgaagactatgaagatgatttggactctggcaactggatggacagctatgattcaacaagtaatggtaaggaggctttaaacagcgctgcatggccagacagtaatacaaatgactgtttagcttcattgttaaaattcaggcttccagccatctcatgtgaatcatcctcactcctctttaatacatctagatttctactgttgtttggcttcatttttcttccctctacttctctttggtttctggtctaataactctgtggtgactgattatggagtgtggggttagaatatgccttactaagattggggggggggttctttctttgtagtagctgatgatttgatatgaaagaaacaatggtgagtaaagtttattaaatcagttgtgcagttgaaaatatcatacatacacgtatacaaacatacatgcatttgtatatattacttttggtattaagaataagtaaatatggccgggtgtggtggcacatgcctttaatcccagcactcgggaggcagaggcaggaggatttctgagtttgaggccagcctggtctacagagtgagttccaggacagccagggccgcacagagaaactctgtcttgaaaaaataaaaaataaaaaaataaaataaagaataagtaaatatgaaatttgattagagttattttaaagtttctcataattcaaggtattatattttatgtatcattagaggcatatattggtagttgtgaggtctgtatagtttgaaaaaatctagtcagaatgcctgttgctttatgtgacacactagacaaataatgtgtatttaataagtgctaaagatatgaacatagtgccatgagaaagcactctgatagcatgtatttaaaatgactgagaaacactgactggggtgtcaaagtactgacctatgcaagtcaagaattacattgtttgaatccccataagagaatggtcaataagagaatgattcttctaactatctaaattttggtggacctgtttttgttgtctgggtatttgactgttagcatctatcttaagatactaacaaacataatctcatatataataaaagccaacacattagaagtactaagtactacttttttttatttgcactcaacatttactatatatccctctttgtttgcttagtgtttctttttttttttaataaaccattttttaacttaaatggaactgatatctctttactcaagtatttggattatattgaagattaagatacctgtcactgggatgccattgaatatgagttctagttgtgcagctctgctagtttccactagtcacattggatcactgagggacttctggagaggtcactggagattgcccagaacctgatgatgcatgactttggtactgatcccagcaccatgtttctctaactataacattacagatgcttataagctatgacatttccattatctgaattcagagatgattctaggtgggtccagcctttggacagggtggcatgatgtcattatctacaaagttcatgctcaagaattataccatagagttacagaaaaaaaccctcatattttgagtaagttcataattttatatcaggccttattcatagctttccttggcttcatgaagccatggggctggagatccttgtaagatggatacctgtaagagagtgagtccaagagaatacagaggatatatactttctataacaattctcagtgccttggacactgcctgttctatagtaacaacacatatttggtgaataaataagtaaataaatattgactaaaaggcagtttgtggtcgatagtcctatttcaccaatagcatataaagacgctttttggctagtgattagaactattgtttgtacattctgtttacaactaactcagtatttggtggaagatttttgccctttcctggccttcaccaaaatgtcttctacttgtgggacttgaaggggcctgtcctgctccttctccactgttgtcccccttctgccaccactgttgtcacacagaaataatgaaatacttgctctgcttgttctgaaacaaactcatactgcttttagctttcagtaacttttcctgtgtcccagaacagtggaagagcaggtggttcccggaaaatggccataacctctaactctcaatctgtgaggttgtataatgatcggaagctcgttttcctccatgagctaagaacagagtgcttctgacagtgttttaggtacaagagccagtcgttctgactgctgggctagattttgaaataactaaaatgttccttttttgtctcttcccctttcccaactaaccttgcagctcgctgtggtgatgaagttgcccgttatttagaccgccttttggcacacactgttccccatcctaaactagctcctacctcacggaagggagggctagatcggttccgagctgctgtgcaaacaacttgcgacttaatgtccttggtggccaaggccaaggagctgcatatacagagtgagtaatgccattagtccctagtgtcagacacaaggtggcatgaagcccaagttgggggcaggacattgattacatcataagcaggaagttgggattattcactgctttgttcctggcctcttgggcagcacctagaattttgtaggcactcaaatgcttatgaagtcaaggaattagatagagtcatgatatggatattgtcacataatctggtgtaaccaggaaaacagcacgacacagaacaaaagagtatattcaattttaatataggagtaagatgtggaagaatctggaataattacttctttggcagtaattttatttaaagagaaagcatcattagactactacaaaacaggagggacagacacagagactttctttaagctataactggttctccttttatgcccactataattgtgcacccagttgttctaggcatgctgtctcagatagaaaactcattcttctcagtattgccacagtcctctccataaccagtaccctcctttagtagtgttttcagaggaggacaccttctgaatatttgaatagtagccatggttcctaaacttgttcagtatttctatggttgctacatgtggagggagagaagggctccttggccacacctacatgactttaatgttacattatataaggatgagaatgattgagatgcatgttcttgctacctaaatcttcattgaccgttactaaccagatactaaaagtgagcacaagggtattgtttaacattgagaatagggaaaagcttagtgtacccattggttatgttccgtatagaaagggtttatgcaaggacatgaactttaagttcattaagttgcatttatcatttgtgaattagaaaaccagaatttaatttccagaagtgttatttacttgtttggctagttatagctctgagtagtctctgtataaaatggtgaaaatgacatgcagctctctccttggaggttatggtaagtattttaactatgtaagtaaaacatctttggaacatctcaaagttcatcagccactacttgtttttgattccctagatagatttcatccagtcccaacctctacaagtcaaatattagcctaggaaagcccagaaaaagtaaaatgtaacagagttctttgtctatgtgttttattatatgaaaatatcattgatagcatctttttgatagtgatcatattactaaacataacatcccatgtctagttgatggtacaattaaagaaaatcctttcaaaatcatagaaatagtcactgattattttaaaaattatttaatatcttacatttctttttttgaagtcagtgaaggaagttcgcatcatttctcttctgtaaagaaatagcccgtgtgttaccttcttgctgctgtcagcgatggatgggttttaggactttcctacagatcttaacttttcccgtaaatgtcaacttcttgcagatgttcacatgtatcttcctacaaagttatttcagccttctcgtccttcactcaacttacttgactcccctgagtctccacaagatagccaggtaactgtgcacatatttctgtaagctttttgtaaaactctgtcatttttattggacataatacaactagccagtatgatttctggtgttaaacaaaacagtatcaaatgaaatgcatgccttttaaaggttactctttaagtaggcaaggttttcttcttggactttgagaaaactacttagctctatcatagggcttgttggttttgttggtttggccttgcttttcatcaacagttttggggagaaaaattgaggcagagtcataggtaacccagactggccttaaaagttactatgtagatgaggatgtcctggaattcctgatcctattgccttggtctcccaaatgctagggttacagttgtgtactagcacatctggggagcatttagaaaattcttatagaaaaggtttccaggtggaaagataactcattctagggcatcatctacttaagcactgttaacctagtttcttttcatcattgcttattccaaaggttccttccgttcatgtagaagtgcatcttcctagggaccagtctggggaagtggacttccagtcattggtttcacagttgaaggagacctcaagcttacaggagcaagctgatatactctacatgctgtattcaatgaagtaagtgatggatattattgatatactttaaggtacatattgtgaggacatataacatgttagtaagctttctatactataacaaatacctgggataatcagttt
